United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 26

SEQ ID NO: 109982 - protein, 410 aa, Triticum aestivum
  Clone ID: PAT_TA_4400.pep
MATGGGGGGEGGSAAAEGGDGGAGAGPGRRLFVAVHVGAGFHAPANERAYRRAIRRACLAAAAVLREGSGTSLDAVAAAIRVLEDDPITNAGRGSSLTESGQVECDASIMDGTTGSYGAVGAVQGVKNPIQVALHLAKEQMSGPSLLGRIPPMFLVGEGACQWAKCKGIDIIEATSEDNNWLVTENAKAQWVKYSALLASAKELVNRSTASASESSSIQLDPSGAQADNLNNAKKIKKEFSRSIMQDDQDCVMDTVGAVCVDEYGNVASGASSGGIALKVDGRVGLAAMYGSGCWASSKGPFGTPFVIGCCATGAGEHLIRGFASRECCISASLSQSGPASSCTKVLRSVVQSSSEMSHDTGAGLLLVQSDLTKRGESPLLEAVERRMTISCPCCSPLFFPGKLFCYVEG

SEQ ID NO: 109983 - protein, 199 aa, Triticum aestivum
  unsure (1)..(199): unsure at all Xaa locations
  Clone ID: PAT_TA_4401.pep
MFGFGHHHMDQAPAVTVPNQIFKIYCRASEDYCLAVRDCEVVLAPGNPKDETQHWLKDMRFSTTDKDEEGMPALALVNKATGLDVKHSIGQYHPVKLVPNNPAYXDASELWTESKDLGKGFRXIRMVNNNRMNVNDLNGDKDHGGVHDGTTDELWEWMQEDNPCWKIWTWTDANAARRVRRHSGEQTPTPWVGDPPMHA

SEQ ID NO: 109984 - protein, 147 aa, Triticum aestivum
  Clone ID: PAT_TA_4402.pep
NLQNLEILNMSSNNLHGLVPKEIFRIPTLREIYLSLNNFNGQLPNDIGNAKQLRNLELSSNSLSGDIPSTLGECASLEDIKLDWNVFSGSIPTSLSKISSLKVLSVSHNNITGSIPVSLGNLQYLEQLDLSFNHLEGEVPKEGIFKN

SEQ ID NO: 109985 - protein, 152 aa, Triticum aestivum
  unsure (1)..(152): unsure at all Xaa locations
  Clone ID: PAT_TA_4403.pep
MSKPGGSAGGATAGPTAAAAAAAAQKQRALLQKADADVSSLVDNFSALINIARVNDPPVRNSQEAFQMDMRASRMVHSADSLLKLVSELKRTAIFSGLASLSENVDRRIEVLSQQSEETERMLXRIGQEAATSLKELEAHYYFIVVRTPLYD

SEQ ID NO: 109986 - protein, 167 aa, Triticum aestivum
  unsure (1)..(167): unsure at all Xaa locations
  Clone ID: PAT_TA_4404.pep
KERAVGMGTPSQGSAAVAAARVDLCALDLMPVFAKEMIAGGVAGAFSKTAIAPLERLKILLQTRTNEFRSLGVLKSLNKLRKHDGVLGFYKGNGASVLRIVPYAALHYMAYERYRCWILGNCPTLGTGPVVDLLAGLASGGTAVLCTXSLDLARTKLAFPVNNPDQP

SEQ ID NO: 109987 - protein, 211 aa, Triticum aestivum
  Clone ID: PAT_TA_4405.pep
GIPDFRFGPRESASRLSPGPVFRPQEERRENRSAETTLRCRSCRALPTPDPSRADPVFDRRRRAPLPDTMAPSDLPSRVTALFPTRSATGTTGDEHMPAPFLILPGSLGCRCRRHSSAQLSTRKSLLPATQPAPSSSPAKLRRVRWPDNRILLLGLYHRVVAIFPHHGPPFPGFFTALPTGQQGHPTACSLYMNRESLIKGVGNPYIEMPL

SEQ ID NO: 109988 - protein, 120 aa, Triticum aestivum
  Clone ID: PAT_TA_4406.pep
GRAAGSRAPTWPPRPWPPRRRRSTGSSPAPSARPPPSPPCRTPSPPPAPPSPPPPSTPTPTTTTPPSRPRPRPAAAKSKGAVLVRSAALLSWLATWLQACKMDGYAGAGAGRWALTPVAR

SEQ ID NO: 109989 - protein, 140 aa, Triticum aestivum
  Clone ID: PAT_TA_4407.pep
MAADAREGALAGQGAGARARRGRRGVRRAAAPGRGGARPGGGGGPGGARGAGVRRPGAAGAARGPAGGSRGVELEVVVVPAFARAQANDHAEGHIDRRGHWWAEGGDVRLRWKKVVQPALDVEEAVVAQRIVMVGYQPEA

SEQ ID NO: 109990 - protein, 162 aa, Triticum aestivum
  unsure (1)..(162): unsure at all Xaa locations
  Clone ID: PAT_TA_4408.pep
MASNSSAAAVAALFGIREGHQQDQMKPLLAQHQRQHVAAPPSALQTAGPDQAAAAAPPVKKKRTMPDPDAEVNALTPKTLMATNRLVCQVCNKGFQRQQNLEQHRXGHNLPRKLNPKDPDQVQPAESNLSPEPTXVHHETGQAQGRTYRPLQSHFCRKPRLL

SEQ ID NO: 109991 - protein, 399 aa, Triticum aestivum
  Clone ID: PAT_TA_4409.pep
LLFGALREHFDRFTASLISDRFWNKKVQINSSVFGAYEVINITYPGLGPAPPAMSSLTSGPPGNEEYPITADVHHQKKKLDSWIIVVVAGSSLVLIMGCIALIILIVKWKKFMRFHEAGNPVITPSVKRRHGGRSQSASLVSSASASMLSTVATCAASVKTFSLAQLEKATDGFSSRRVLGQGGFGRVYHGTMDDGNEIAVKMLTREDRSGDREFIAEVEMLSRLHHRNLVKLIGICTERAKRCLVYELIRNGSVESHLHGADKDKGMLNWDVRMKIALGAARGLAYLHEDSNPHVIHRDFKGSNILLEDDFTPKVTDFGLAREATNGINPISTRVMGTFGYVAPEYAMTGHLLVKSDVYSYGVGLLEAFIRKEAPRHFPTPWILENLVTLGFVPFLGK

SEQ ID NO: 109992 - protein, 161 aa, Triticum aestivum
  Clone ID: PAT_TA_4410.pep
MDDFFDEDGEQLMDPDARSPSPERGAQPYDGLEDDLDDDGADWNRDRSPTPVHGGGGDDGSSSRPRKRLLKKGGGKGDGGGGMPADDLEDWGEDAAAGLADDDVGGDPDADRKRKGSSSLRDLARGGGKDKHEKKRRKEDVGMVREKRGSSSGGKGSGGGR

SEQ ID NO: 109993 - protein, 327 aa, Triticum aestivum
  Clone ID: PAT_TA_4411.pep
MAAAPSPAPPRILLAGDAHGRLHQLFKRVKSVNQSTGPFHALLCVGQFFPPEAAEGDSPPGDVAAARGGRAAVPIPTYFTGDYGPTAPRLLSKAAADARGFNPGGIEICPNLFWLRGSALFNLHGLSVAYLSGRKGLGGPGCYSQDDVDALRALAEEPGIVDLFLTNEWPAGVVDGADTSKVPPQVLDPQGYDPVVAELVAEIKPRYHIAGTKGIFYAREPYVNDSSPHVTRFIGLANVGNKEKQKFIHAISPTPASTMSSADIHARPPNATLSPYAAPAKSVHVEDTSKRPAESTDLQYWPYEVKPARPGQTDGSLLGSKIHPQGP

SEQ ID NO: 109994 - protein, 182 aa, Triticum aestivum
  Clone ID: PAT_TA_4412.pep
MYLHSTAMAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRNWTMWKLPMFGCTDATQVINEVEEVKKEYPDAYVRIIGFDNMRQVQCVSFIAFKPPGCEEFGKA

SEQ ID NO: 109995 - protein, 229 aa, Triticum aestivum
  unsure (1)..(229): unsure at all Xaa locations
  Clone ID: PAT_TA_4413.pep
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGYEAGISKDGQTREHALLAFTLGVKQMICCCNKMDATTPKYSKARYDEIVKEVSSYLKSVGYNPDKVPFXPISGFEGDHMNEKFFNLDCYQGPNXLLKPLDPINEPQK

SEQ ID NO: 109996 - protein, 117 aa, Triticum aestivum
  Clone ID: PAT_TA_4414.pep
KKDEGSEHVDYGARGVGGGAVRGGGAAAAAGRVPLRRHVAHALSRAPLHGASPSRRSGFRRSPSLGAGTPSWEQGGTTTGGARRPGIPCARKGPCPMAPGSNSPWFNAEAGCTCLVH

SEQ ID NO: 109997 - protein, 134 aa, Triticum aestivum
  Clone ID: PAT_TA_4415.pep
MPLALGTQASEEVQRTLLEEIDRLLPTQKCLVSTRFLFSLLKAAIFLKADPSCLSSLEKRIGMQLDQATLDDLLMPNFSHSMETLYNVDCMQRILEHFVAMDQITGGGGASPGSVADSQLIGSPSLTPIASVSS

SEQ ID NO: 109998 - protein, 348 aa, Triticum aestivum
  unsure (1)..(348): unsure at all Xaa locations
  Clone ID: PAT_TA_4416.pep
PAAATQAAAAPGVCAXARLVVPGAQAINLIGKQXGASIKAIQEGTGATIRVISXDDRDRPFYVTDDERIVEIQGETEKVLKALQAVSNHLRKFLVDHSVLPLFEKTNAPVSQDRSAETWNDMPHHSIVSTQVNQQPEVRDEYVLPMKRDHLYLEREPLVEHNIHRSGVSLYGRDPALSALRPSGMHGAGPLLTQITQTMQIPLTYAEDIIGVKGANIAYIRANVGAVVTIQESLGSPDDITGEIKGTSSQVQSAQQLIQDSLATHREPVRSSYPGGLDPLYRSSYPYGSSAYPSSSLPSYSNMDGSGYSSSGLGGYGSTYRYLRWLLFAIKLAATLSPLLGHRCVCQQ

SEQ ID NO: 109999 - protein, 242 aa, Triticum aestivum
  unsure (1)..(242): unsure at all Xaa locations
  Clone ID: PAT_TA_4417.pep
MSGHGKQQQLLRHPALAAGHGSGSGMGRRRYLAFLAIAAALVASYHLLHAPTPSSRYHALFLTLGSNASAAAHLRALTLRPHVAGTPANALAAEYVRATLSSLSFPTRVTPYSVLLSYPLHRSLSLSAPGRATKSFSLTQDTYPNDPYAEAAAEVVPTYFAYSGSGSVTAEVVYANYGDRKDYAYLASRGVDVAXKVVLARXRDIHCEDMVRNARDAGARGTIXYTDAKTFGGPRPSETQMV

SEQ ID NO: 110000 - protein, 172 aa, Triticum aestivum
  Clone ID: PAT_TA_4418.pep
FPTTIAMPVEPEAELRRYKDSLGKYFEKRGRAAVYFEWVSQQSRHANLQAVPVPLSKAANVKKIFHLAAQRLGFEFSVVNPDGDANQGRELLRSQYDGKSGLFYVELPDGTLLLHIIDSGEKFPAQFGREVLAGLLSMADRADWRNCKLSKEEEVKMVDDFKQGFHEFDPAE

SEQ ID NO: 110001 - protein, 166 aa, Triticum aestivum
  Clone ID: PAT_TA_4419.pep
MAETEYRCFVGGLAWATDDNNLQQAFSQYGEILDAKIINDRETGRSRGFGFVTFGSEESMRQAIEEMNGKELDGRNITVNEAQSRRSGGGGGGGGYGGQRGGGGGYGGGGGGYGGQGGGGYGQGGGGGYGQRGGGYSSQRGGGGYGGGGGGYGCQRGGDSGGQCRN

SEQ ID NO: 110002 - protein, 152 aa, Triticum aestivum
  unsure (1)..(152): unsure at all Xaa locations
  Clone ID: PAT_TA_4420.pep
MAPKAEKKPAAKKPAEEEPAAEKAPVPAGKKPKAEKRLPAGKTAAGKEGGDKKGKKKAKKSVETYKIYIFKVLKQVHPDIGISSKAMSIMNSFINDIFEKLAGEAAKLARYNKKPTITSREIQTXXRLVLPGELAKHAVSEGTKAVTKFTSS

SEQ ID NO: 110003 - protein, 265 aa, Triticum aestivum
  Clone ID: PAT_TA_4421.pep
RTRGRTRGFEASIPCSAPAADKGYPVKESIIPSNGKKRLELPVQKNILTNYFCLASLEAKRKFRAPKVTPKQKMLNESSLPSRQTEHSGTPDSIEDTSLPMNNIQFSQYSSEHFSSEPPRDDSIDASQRSTGRAFPWDDSHSVSPHCSSRDIGNGPLSRDQRIEDAEVEVSYCNTSPMPISPCLERTSPGIADPSLVSHNTEPLRPVPHYAESYVAPTVRSSYFKKDKRVFTNQAENQFDDDDDNAETGTSTLSGVQPGNPGGVV

SEQ ID NO: 110004 - protein, 154 aa, Triticum aestivum
  Clone ID: PAT_TA_4422.pep
LDVALNAKIGAEVSHREEREKLLGALNETNCALSDSKSKLCENEITLHQQKQEVDHLEELRVDMETKLKGYVDENDVLKRDLDVATIAKMKAEEIHTEEKEKLLFALNEANFAVSEMKEELDQLKINIHQQKQAVECLEKIKVDMQTGLKGYCG

SEQ ID NO: 110005 - protein, 269 aa, Triticum aestivum
  unsure (1)..(269): unsure at all Xaa locations
  Clone ID: PAT_TA_4423.pep
MMSSSPPAGAADGDMETLPLAAASDYASVASTFDPLLSSSSPASPPAPAASPLSRASSSFVDPPSYADVAASSPRSASASSSSSPRSARAATSEYSYIAVSDPETEAEAAATSLVPGSAPTYISYLVTSARRGDHRRHSVRRRFRDFVTLADRLAESFRGHFVPPRPDKNTVESQVMQRDEFVAQRRAALERYLWRLAEHPAIGTSDELRVFLQAEGKMPLPSSTDVASRMLDGAARLPRQLLGEEAGGPAAXTLVNPPRGGRDLLGGI

SEQ ID NO: 110006 - protein, 166 aa, Triticum aestivum
  Clone ID: PAT_TA_4424.pep
MAETEYRCFVGGLAWATDDHNLQQAFSQYGEILDAKIINDRETGRSRGFGFVTFGSEESMRQAIEEMNGKELDGRNITVNEAQSRRSGGGGGGGGYGGQRGGSGGYGGGGGGYGGQGGGGYGQGGGGYGGQRGGRGYSGGGGGYRGGGGGYGGQRGGGDSGGQWRN

SEQ ID NO: 110007 - protein, 181 aa, Triticum aestivum
  Clone ID: PAT_TA_4425.pep
MPSIQEPLHFKPQEPKVVVAENENDKMVDVQDKEVTMEGLCSVAAYDQWTPLSVPGQRPKPRYKHGAAVVQEKMYVFGGNHNGRYLGDIQVLDFKSLSWSKLEAKIQSESAEPASVAPCAGHSLIPSGNKILSLAGHTREHTESLSVKEFDPQTSTWSILRTYGKSPSSRGGQSVTRVGDT

SEQ ID NO: 110008 - protein, 349 aa, Triticum aestivum
  unsure (1)..(349): unsure at all Xaa locations
  Clone ID: PAT_TA_4426.pep
VCQLVSYKAYFGRGGCCGRDRLRAFSCQIDAEALVSLEHLCNGVVNELAEPVERTPVILVLDTEVQMLPWENLPVLRNQEMYRMPSMRSIFLALTRSTNHHKDASAMAPPFPVIDPFDAFYLLNPSGDLISTQEEFYQLFRNYEWKGNAGDAPTAEELVLALRNHDLFLYFGHGSGSQYVSGKEIEKLDNCAAALLMGCSSGTLHCKGGYAPQGAPLSYLFAGSPSVIANLWDVSDKDIDRFSKALLNSWLQEKFKAAKNCPKCCRPLTQEFESTTIAAKDNGRPRRKGTRQGXSSSRQEEIDGSSNCLNCRPRRIATHISEARRACRLPLIIGASPVCYGVPTIIRKK

SEQ ID NO: 110009 - protein, 217 aa, Triticum aestivum
  unsure (1)..(217): unsure at all Xaa locations
  Clone ID: PAT_TA_4427.pep
MSTEALLAAQGGGGGDGVASRRLSIDDALAEHAGEFGRWQLRHFVLVSAAWALEALHTMVIIFADREPAMRCPAGEGRCGDRCAGAAAGWEWAQGSASSTVAEWGLVCGERYKVGLVQAVFFAGCMIGAGVFGHLSDXFLGRKGSLPVXVSLTHFFGSVNRCWPPATGVYGWSSGFFTGFSTGXIGLCAFDLRTEAHGALSAVEPAGLVSFLIFSWA

SEQ ID NO: 110010 - protein, 69 aa, Triticum aestivum
  Clone ID: PAT_TA_4428.pep
IKIADRYTNVYTSANNTQKPELGLNRLRGFSRPSKNLFCKAPIAPCLSSFFCVGKLFFSNRLYSFHISS

SEQ ID NO: 110011 - protein, 46 aa, Triticum aestivum
  Clone ID: PAT_TA_4429.pep
PIFIQCFKQSITKFCVNMVQIMNTIKKSQTWHIAIKHGSHQVYNQK

SEQ ID NO: 110012 - protein, 161 aa, Triticum aestivum
  unsure (1)..(161): unsure at all Xaa locations
  Clone ID: PAT_TA_4430.pep
MSDTDEHHFESKADFGASKTYPQQAGAIRMGGHIVIKARPCKAVEVYTSKTGKHGHAKCHFVAIDIFNGKKLEDIVPSSHNCDVPHVDRXDYQLIDITDDGYVSLLTESANTKDDLKLPTDDALLGQSKIGFADGKDLILSGMAAMGEEQICAEKEIADGT

SEQ ID NO: 110013 - protein, 182 aa, Triticum aestivum
  unsure (1)..(182): unsure at all Xaa locations
  Clone ID: PAT_TA_4431.pep
MAGRKAADRKKAVTRSVKVGLQFPVGRIARYLKKGRYAQRVGSGAPEYLVAVLEYLAAEVLELAGNAAKDNTKTRIIPRHLLLAVRNDQELVRLLARVTXIAHGGVIPHIKSVLLPKKSPAVAXERSPMSPKKKTPTTSPKKKVAGKEYSGTIDYLSRHPLWPIGTVSEEALLTSFTILTSH

SEQ ID NO: 110014 - protein, 189 aa, Triticum aestivum
  unsure (1)..(189): unsure at all Xaa locations
  Clone ID: PAT_TA_4432.pep
SPGXESPXXGNKPAXIXGDXKGSNVXLXGNMNAKLXCXXGFAHSGVXPXRRAXASSXGRAIMGSPGYVDPQLLRTGVAXKKXDVYXFGVLLLELXVTGREXVSARPECRLTAVVCPXVSEGNVAXVVDRSFTGKYSADEATVVVELAMRCVSDTPGLRPSMADVVHVLQEKTTALISAVGSRLDRRIMF

SEQ ID NO: 110015 - protein, 259 aa, Triticum aestivum
  unsure (1)..(259): unsure at all Xaa locations
  Clone ID: PAT_TA_4433.pep
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNXPDKVPLSPSLGFXGDNMIQXSFNLDWYKGPTLLEALDPNNEPKRPSGKAPAVFPFRTCTRMGGLGTWPMGAGLK

SEQ ID NO: 110016 - protein, 228 aa, Triticum aestivum
  Clone ID: PAT_TA_4434.pep
MNLSWCSLLLLVVFAAELALAAVVDDAVQFDPKDIKMTIKSRNGEIIDCVDIYKQPSLNNPLLKDLKHQIMRDIASAVAGQQDGNTRATTVEQEWHKGTRQCPMGSIPILRTNPSVNYLTGSLFPSPLRAANISTWSGAANAAGPRYEFAVAIAANGPYSGAYVQLPVWKPARVHGSEYTATYLLLAGTKDTEFDPTPGVLPADVPNQKAAGLFCYSKKDTNPRVNII

SEQ ID NO: 110017 - protein, 103 aa, Triticum aestivum
  Clone ID: PAT_TA_4435.pep
MSGRGKGGKGLGKGGTKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 110018 - protein, 143 aa, Triticum aestivum
  unsure (1)..(143): unsure at all Xaa locations
  Clone ID: PAT_TA_4436.pep
FHISPSLYHNRDIRFFTYWTKDLKSKACYNSQCTGYVPASGAKLVPGQAIXPPSVYGIQDHYMRISINQDPNSGDWVVYHHDLKKPSFFGTFSKGALPWNKTVSNQLPGLGITLKKANGPSNGERAIFLVFNEKNNVLISTPF

SEQ ID NO: 110019 - protein, 208 aa, Triticum aestivum
  unsure (1)..(208): unsure at all Xaa locations
  Clone ID: PAT_TA_4437.pep
CWDSSPTVSASSVTDSSGIEKPLXTHSGTSPWILDTGASFRMTYDSSTLTSVRPVESPVRVLTADGTPLPVARRGTLSTSSFHVPSVARVPXLTMQLISGGQIVDSSCRVILDFDSCSVQDRRTGALLGAGPRRSDGLWELDWLRLPSAATSASLATPVVASTSSFQQWHHRLGHLCGSRLSSLVHRGVLGSVSGNASLDCMGCRLGK

SEQ ID NO: 110020 - protein, 200 aa, Triticum aestivum
  Clone ID: PAT_TA_4438.pep
RVAPCNWSSRLLVLPPAPASPPSPASAVISPSESGTAFPLFPNKKPAKSSKKKEAPAAPAMTAAEAAAAEGRRCLHCETDKTPQWRTGPLGPKTLCNACGVRYKSGRLVPEYRPAASPTLGPSAPPPARRAPPPPPGPAPAPPPRPPPPLPAPLAVPPAVRAAPGAARPPRRRRLLVPPPPHRDRLPPATPLAVSAGHLV

SEQ ID NO: 110021 - protein, 246 aa, Triticum aestivum
  unsure (1)..(246): unsure at all Xaa locations
  Clone ID: PAT_TA_4439.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKFKLCKVRSVQFGQKGIPYLNTYDGRTIRYPDPLIKANDTIKLDLETNKIVDFIKFDVXGNVVMVTGGRNTGRVGVIKNRGEHKGNFXKTFHVEDAQGPQFGHRFGQWFSPLAGGTKPXWVSLPQGQ

SEQ ID NO: 110022 - protein, 124 aa, Triticum aestivum
  Clone ID: PAT_TA_4440.pep
FGLHVTAAPFHLFFDDLTVASGNMKEFYQARKSGRVVTVSVAGKQVPLYGAGANLHSKPNNGRLGPAVVPVRLAFVLRARAHILGLLLRSKFYRRGVCRLDVREAHLGKPVPGVAARCEYHDGR

SEQ ID NO: 110023 - protein, 203 aa, Triticum aestivum
  Clone ID: PAT_TA_4441.pep
MANGDQDMATDELMETEGLKVLAVDDDPIYLHSLTQMLRRCGYEVTAKPSPADAVREVEKNPNRTDFIMTVVQTRGRGMDGLGLLKRLGKRYPVVLMFSGEESMETRIRGNQGGACYLLEKPLHDTQIYFLWQHVVRWRLNAAAAATANANPHHSQGVHLDDTQRKRRQGMNDSNKGQGGFSRAAWHWGPPRRKKLEWDCRNA

SEQ ID NO: 110024 - protein, 228 aa, Triticum aestivum
  unsure (1)..(228): unsure at all Xaa locations
  Clone ID: PAT_TA_4442.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDAPTPSTXKGRYEENGKEVSSYLKKVGFNPGQGPFGPHSGFGGDNMIGRVHQPWPGTRALPFLRLLDQIIEPK

SEQ ID NO: 110025 - protein, 141 aa, Triticum aestivum
  Clone ID: PAT_TA_4443.pep
MRAASAPRYSVGAGAGPRVRGRVGGDVDPEALTEEDSLVGGGDSNSVDCLHGSYSSSLSLHGVRVDDEHSALENSSRPPSHINILTPQDVVPIEVARSRFLDIIIDHFIGQNVIEVGEPSLYDSILASNRINKRKQQEVQY

SEQ ID NO: 110026 - protein, 138 aa, Triticum aestivum
  Clone ID: PAT_TA_4444.pep
MPCLTAVRLRRASAEAPPASPSSASSPRAPPFYAHAVLHQQRRHPHRTSFLSPQPRPQVCQAAALPLPCSSGEEDAPLLARFDPYHDPEWLGVRDLYGQGVLRQVPLRHKRLPDDPQGLGKYQAVFGTKGNPLPLPRS

SEQ ID NO: 110027 - protein, 811 aa, Triticum aestivum
  Clone ID: PAT_TA_4445.pep
QRSKAVTEAFVRLRKDGLIYRDYRLVNWGCTLLTAISDIEVDHLELKEETMLKVPGYSSPVQFGVLISFAYPLEEGLGEIIVATTRIETMLGDTAIAVHPEDKRYKHLHGKHAIHPFNGRKLKIICDAVLVDPTFGTGAVKITPAHDPNDFEVGKRHNLEFINIFTDDGKINSNGGAQFEGMARFAARVAVIDALKEKGLYKDTKKNEMNLGICSRSNDVVEPMIKPQWFVNCHTMAKAGLDAVRSKKIEIIPQQYEQDWYRWLENIRDWCVSRQLWWGHRVPAWYVTLEDEQLNDLGSNNDRWIVARNECDAMLEAQKKYPGKKFQLNQDPDVLDTWFSSGLFPLTVLGWPDDTADLRAFYPTSVLETGLDILFFWVARMVMMGMQLGGDVPFQKVYLHPMIRDAHGRKMSKSLGNVVDPLPVINGTTLEDLLKRLGERKLDPNELSVAREGKKKDFPDGIAECGTDALRFALISYTSQSDKINLDIKRVVGYRQWCNKLWNAIRFAMGKLGDHYAPPATIVVSSMPPVCKWILSVLNKAIGKTVTSLEAYKFADATSAIYSWWQYQLCDVFIEAVKPYFFNDSQEFDSARAACRDALWVCLDNGLRLLHPFMPYVTEELWQRLPQPKDSCRKNSIMISEYPSVVKEWADDKLESEFGIILDTVNKLRSLKPPTDTNERRPAFALCRGEDIAATVQCYQSLVVSLSSVSSLKILAESDETPPDCSTAVVNKDLSVYLQLQGALNAEVELEKLRKKRDEIQKLQHALSQKMEASGYREKAPPSVQEEDMRKLTAFFEQLRVIGEAEKKLDA

SEQ ID NO: 110028 - protein, 260 aa, Triticum aestivum
  unsure (1)..(260): unsure at all Xaa locations
  Clone ID: PAT_TA_4446.pep
LSLLRRAIALCFFYHALQTRGVRFFPTIQEENDSPAKDFVHGPAKQILKSLKSNSTEVITSGQGSSLWDDPYINPDRYGDSHPHFYTRWTRDNYDATGCYNMDCPGYTRVDGAVIAPGDAIHPVSNVPDGPRQCITLRVLKDKXKWRLVGVLWLQXSPTGVGYFPRSLFSYLAEKADGMQFGAFVQAKKALPTPPMGSGALPNGGRXRAASFTDIRFIDQDGNSSPIKEDLAMFVTDRKCHAITHIVMLHAINGALRWMR

SEQ ID NO: 110029 - protein, 272 aa, Triticum aestivum
  unsure (1)..(272): unsure at all Xaa locations
  Clone ID: PAT_TA_4447.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKXGYNPDRXPXVPISGFEGDNMIERXTNLDWYKGPTLLEALEQNNEPQKPSNNPLRFPLQDVSKMGGFGTWPVGRVENWVSNLGNGGTFCPTG

SEQ ID NO: 110030 - protein, 223 aa, Triticum aestivum
  unsure (1)..(223): unsure at all Xaa locations
  Clone ID: PAT_TA_4448.pep
HGADIIRFTQRNILRIYPKGTRINSSNYDPMKAWTHGAQMVAFNMQGHDKSLRLMQGFFRANGGCGYVKKPDFLLKTGPNGEVFDPKASLPVKKTLKVKVYMGDGWRMDFSKTHFDAFSPPDFYARVGIAGVRADCVMKKTRTIEDQWVPVWDEEFTFPLTVPELALLRVEVQEYDMSEKHDFGGQTCLPVMELKXGIRAVPLHDRKGNRYKSVKLLIRFELI

SEQ ID NO: 110031 - protein, 175 aa, Triticum aestivum
  unsure (1)..(175): unsure at all Xaa locations
  Clone ID: PAT_TA_4449.pep
MAAAKPGSSSDIDTAELDRVLHAVGFQIETVSPALLAGRLPVTERCCQPFKVLHGGVSALVSEALASMGAHMASGYRRVAGVHLSINHFRSAALGDVVLARAVPVHLGRSTQVWEVKLWKMDPSAEMKKGPQIAEAKVTLLCNLPVPDNXHHAGDALKKYAADGAAPAPTTTTKL

SEQ ID NO: 110032 - protein, 265 aa, Triticum aestivum
  unsure (1)..(265): unsure at all Xaa locations
  Clone ID: PAT_TA_4450.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRXRGGMQIFVKTLTGKTITLEXESSDTIDNVKAXKIXDKEGNPPGPAAPNFVAKXLEDCRTLATTTSRGIQLQLVLGLWGGMENFWKTLTGRPYLWRVEVRTIDKVKGQIQAREGFPR

SEQ ID NO: 110033 - protein, 189 aa, Triticum aestivum
  Clone ID: PAT_TA_4451.pep
RASQTPLPVDLSSPRVPAAPSKPAPLPKPKPWQRRSNRGGRLARPPSSRSPLSGRPPGGAPSVTTKAKLGQLMCVHRPRSAGAVAFLSVAVASISAAGPRLGRRGLLLLAAARLHGLLPRGQSACCSGSRLPPTGAGGVRERKVIHLLSPGCRPDHLLPEGPGPPAGAGGAPEPKIRGAGGEQGRAAAG

SEQ ID NO: 110034 - protein, 159 aa, Triticum aestivum
  unsure (1)..(159): unsure at all Xaa locations
  Clone ID: PAT_TA_4452.pep
MAVGKNKRISKGRKGSKKKAVDPFTKKQWYDIKAPLLFTSRNVGKTLVSRTQGTKIASEGLKHRVFEVSLADLQNDEDQAYRKIRLRAEDVQRMNVLTNFWXMDFTTDKLXSLXVRKWQTLIEAHVDVKTTDNYMLRMSAIXFTKRXPEQVNRTCMPNQ

SEQ ID NO: 110035 - protein, 97 aa, Triticum aestivum
  unsure (1)..(97): unsure at all Xaa locations
  Clone ID: PAT_TA_4453.pep
MATSSGDQSSPRAASDLAVLPSYPEMIVEAIASLREPNGSSQAAIARRIEAARGAGVDLPPXHPALVAAHLSRMSAAAELVAVAGGKYALPPPPVFY

SEQ ID NO: 110036 - protein, 163 aa, Triticum aestivum
  Clone ID: PAT_TA_4454.pep
MAVGKNKRISKGRKGSKKKAVDPFTKKQWYDIKAPLLFTSRNVGKTLVSRTQGTKIASEGLKHRVFEVSLADLQNDEDQAYRKIRLRAEDVQGMNVLTNFWGMDFTTDKLRSLVRKWQTLIEAHVDVKTLTLHAPHVTMGSPTPKPVKRTAMPSSQTDDPRRW

SEQ ID NO: 110037 - protein, 103 aa, Triticum aestivum
  Clone ID: PAT_TA_4455.pep
ACQLFYVPAILRDGWAIQVFDPSVGPKGCSQDQQARHELIASCLHNALFGCLHAGWPTRKDNWSTISPVLWIPQLPGRKLVISSCTSLGTTMERVYRSPRTTL

SEQ ID NO: 110038 - protein, 185 aa, Triticum aestivum
  unsure (1)..(185): unsure at all Xaa locations
  Clone ID: PAT_TA_4456.pep
MAAPAPAAGSSLHSKTLLKSEQLYQYILESTVFPREPDCLRELRVATAAHPMARMAASPDQVQLFGLLIEMLGARNAVEVGVFTGYSLLATALALPXDGKVVAIDLXRESYDQIGAPGGGRRPGMAHKGRLPRSGSRWPVLGPRVAARGIRGLGPCAVVPAAEANFHHYHERLLRLVRXGGLIAY

SEQ ID NO: 110039 - protein, 121 aa, Triticum aestivum
  Clone ID: PAT_TA_4457.pep
SPTGAPSASACLPLPRPSMATCAATRTAPGAAWSRPGRRPWARPGPDARRYPYGVRPLQDAVPDAPRRSAATAPATMVRKAAPGSKEEELAAARRSSVSPSCSALILNLPAPEADQEQGEE

SEQ ID NO: 110040 - protein, 58 aa, Triticum aestivum
  Clone ID: PAT_TA_4458.pep
ATKIDLVAYFQPTDKNNMYLIEQSTGRQNQMHLFRYWYLFIRQYILHIFIVPYSTASP

SEQ ID NO: 110041 - protein, 200 aa, Triticum aestivum
  unsure (1)..(200): unsure at all Xaa locations
  Clone ID: PAT_TA_4459.pep
MEVVFDGGGGAGGANDWRSQIREEIRDSRVSVLSEALMQALSPDEPETLTDLLNVAVRLEKMIFDISLDDHFEEISSDYQMLEPSTATLLRGIFSDPQSQSIQVQSNLHRVLSGGNTKATAPIGNEEKPCCDDNDRISVLHESILHCIMSFMPAQDVVRTSLLFPKIAPXWTSAPCPDIDIGHFDMDRVKVQQVCQKVCV

SEQ ID NO: 110042 - protein, 98 aa, Triticum aestivum
  Clone ID: PAT_TA_4460.pep
SIPQPVVTFFFEKSTRGHIDINKSLDLDGKKKKKKKKKKKKKKKKKKKKKKKKKKKKKKKRTKRKEKKKKKKEPPEKKKKKAPGGRARQKKGGPPGRR

SEQ ID NO: 110043 - protein, 167 aa, Triticum aestivum
  Clone ID: PAT_TA_4461.pep
SGAGLGPGSAARRTAIGRSLVASPGTGPLLTVTRAATTPWLPVLGSVSSACAAAKDSTAASAVAGAAVVAFVCTFSVGFGPMAWVYSSEILPLRLRGQGAGLGTAMNRVMSGIVTMTFISLYGAITMAGAFYLYAAVAAASFVFIYTCLPETRGRNLEDMEQLFRTK

SEQ ID NO: 110044 - protein, 74 aa, Triticum aestivum
  Clone ID: PAT_TA_4462.pep
PSTTLAIMYENVITLSRVEKLFLSQQTQQHFALRMTRRVSPGPASRAATCFALFLGDERYSRTDFSIDVLACRR

SEQ ID NO: 110045 - protein, 300 aa, Triticum aestivum
  unsure (1)..(300): unsure at all Xaa locations
  Clone ID: PAT_TA_4463.pep
QSGQRQQDQQSGQGQQPGQRQPGYYSTSPQQLGQGQPRYYPTSPQQPGQEQQPRQLQQPEQGQQGQQPEQGQQGQQQRQGEQGQQPGQGQQGQQPGQGQPGYYPTSPQQSGQGQPGYYPTSPQQSGQLQQPAQGQQPGQEQQGQQPGQGQQPGQGQXPGYYPTSPQQSGQEQQLEQWQQSGQGQPGHYPTSPLQXPGQGQPGYYPTSXQQIGQGQQPXQFAQPTQGQQXAATKDXGQQGQQPXKKGNKGQXQPXTRGSXPGQGQPXSYPTXFEQVXEKGHXXRXNGXHPXQGQPRVFPKF

SEQ ID NO: 110046 - protein, 458 aa, Triticum aestivum
  unsure (1)..(458): unsure at all Xaa locations
  Clone ID: PAT_TA_4464.pep
RHRDVLLFLYIQSYKRLVPRPHKDSPAVADVWPSTSAFDGYLSALSPIQLVRSNSRRFIPSQADEEIHQLSYLRPPTRPILTLLADSVEGEGDDSLVLTMETFEHLGFLVHFSEGTSLSQAATFFANSDPDMPAAPVSAAQVHDWILQNIVSSLEFYTEKSTAKEGSQQIASDLDVTMADANTSHPRNSTPTVANPAFHRNSTFVEGFSKTSVVKHASDVKGNSVKVLNCHDSVIYILAPVKYATVYGCSDTTVVLGAVGKVIKVEHCERVHIIAAAKRICIANCRECIFYLGVNHQPLIVGDNHKLHIAPFNTYYPRLGEHLTQVGVDPSTNKWDQPFVLGVVDPHDSLSHPAGVSDVQAESATCVDPDLFTNFLIPNWFEDEVQEPTKCNPFPLPEIYXASQSKKQAVLEDTKKTIRELXLTENRKKELASALHSQFKDWLYATGNIRQLYCLQGD

SEQ ID NO: 110047 - protein, 129 aa, Triticum aestivum
  Clone ID: PAT_TA_4465.pep
PLSRAAETSALTTMALVTILFLHAILQINPGQLLQIFHSTIMGLRLLILSYCLLFNVSAKVSAMEAFLCAKDIGSTSRLWRQFFVFGPSPADDLEGSGIKNRRGKPPRLCEWPVVECCIASIKSRSVCV

SEQ ID NO: 110048 - protein, 126 aa, Triticum aestivum
  unsure (1)..(126): unsure at all Xaa locations
  Clone ID: PAT_TA_4466.pep
AQCIQREAATGDTSVRXSQIQNESTELGVAIQHLEAMLFELGRTMMTLRMGPSPVCIFLLCHYHTSDSQGQRFAFRSEYAVCRLKPSICDTVETKDFSAERQPVERAFLIDLNVPDRRCRSFPHNV

SEQ ID NO: 110049 - protein, 248 aa, Triticum aestivum
  Clone ID: PAT_TA_4467.pep
MRVLPLALAAAIFSGVTAILIYISGLSSYGGAGLSEADLAALAALQGGFSKCVDANGLGLQAFGGEDYCRVVIQYPSDTVSKWTDPKTGESEGLAFEFNLCEAVASWEQVRNSTTILTKEYIDALPNGWEEYAWRRINKGILLNKCKNRTLCMEKLSLVLPDSSPSVPPPSGSCAGLGYSRDLLYSKSGGESDSCVPLFNSSAGLAGFLSCDYPHPPRAAALLPILSLKLGHLSTSPSRSFLIALSPA

SEQ ID NO: 110050 - protein, 176 aa, Triticum aestivum
  Clone ID: PAT_TA_4468.pep
TQVEPRHQPPLLLRQANFQGQPATRSMQSCPPLPKQKALGQGSTTSSPSSQAKKAQPGHPHPSHQALTRLPRKQPTTPPPTLGQRRQPRRGTPLSTAVAACSRAHRRGSELKAHGSEQRRAQIRPQRPPRGEHRHTEQDTGAAPAQPRATDDAPSRHLRARGDAAAACPPPSGQIQ

SEQ ID NO: 110051 - protein, 293 aa, Triticum aestivum
  unsure (1)..(293): unsure at all Xaa locations
  Clone ID: PAT_TA_4469.pep
AHIFTHCWLHCHLALVAVFYPYNRGALFSALVVIYALTSGIAGYIATXSFYCQLEGTNWVRNLLLTGCLFCGPLFLTFCFLNTVAIAYSATAALPFGTICVIVLIWTLVTFPLLVLGGIAGKNSKSEFQAPCRTTKYPREIPPLPWYRTTVPQMAMAGFLPFSAIYIELYYIFASVWGHRIYTIYSILFIVFIILLIVTAFITVALTYFQLAAEDHEWWWRSFLCGGSTGFFVYGYCLYYYYARSDMSGFMQTSFFFGYMACICYAFFLMLGMVGFRAALFFVRHIYKSIKCE

SEQ ID NO: 110052 - protein, 134 aa, Triticum aestivum
  Clone ID: PAT_TA_4470.pep
AIPSRRPRRERDSIFFHQQLGLGDLEMVASANKTPSFRARPATGATNSSPAAAFSPLRPVAHCANPPRRPRSRRAGDRPARLIPLRQLASLSPTYGAPGQSSSPHRIGTGSRSEVALGAPRAPTSAPPYTTCDF

SEQ ID NO: 110053 - protein, 142 aa, Triticum aestivum
  Clone ID: PAT_TA_4471.pep
MKTFLILALLAIVATTATTAVRVPVPQLQPQNPSQQQPQEQVPLVQQQQFLGQQQPFPPQQPYPQPQPFPSQQPYLQLQPFPQPQLPYSQPQPFRPQQPYPQPQPQYSQPQQPISQQQQQQQQQQQPQPQEPTILSQILQQH

SEQ ID NO: 110054 - protein, 141 aa, Triticum aestivum
  Clone ID: PAT_TA_4472.pep
MADGGEMDEEAMMRAFFPTSFGKAPTRPSAASHSSTLRKPQNPSSNPSTSAAAEEDDVGGAVVGPPRPPKELAPIQEDDEEGGGLIGPPRPPQRPSAHAAVEDEDGSMVGPPRPPPSKEGDEDDEDEGDDHDEDDDDDDMD

SEQ ID NO: 110055 - protein, 115 aa, Triticum aestivum
  unsure (1)..(115): unsure at all Xaa locations
  Clone ID: PAT_TA_4473.pep
RRKDKTGQNGQRRENEQDQRNQGQQRQRNRTERATPRRPPATSGNTGSRTRRGGTRKPPPRRPAPPRPAAPXAPPXPPTPTPPSLITAVPSPANEPTGGATARVMPVWPRALLAA

SEQ ID NO: 110056 - protein, 122 aa, Triticum aestivum
  Clone ID: PAT_TA_4474.pep
PWPTKGGLQWMLVGLTSAYFGERAASKIGPSCCSSGVLRLTPDPCEVAHEVQRELIEVLASAAADSDDDTEHRPTGRGYPGSYVHGVHITLRQQELPDFTGCVVELVVAGHERQAESDIAGG

SEQ ID NO: 110057 - protein, 109 aa, Triticum aestivum
  Clone ID: PAT_TA_4475.pep
CHRCRTLSTDINPAATDDPPSPKSPSPAKLTGEVPPEKTIEDVTITGTGYTKPGNPTLLAKHSAKEEPSAADKGNLQLDLQNYADFSAGELHASYLSRLHTTAIWKLAW

SEQ ID NO: 110058 - protein, 137 aa, Triticum aestivum
  Clone ID: PAT_TA_4476.pep
LFAPVIRRHCHLDEYHPNHMTLHANQVRSNLFTSLNLFWPRPRQARERCRGSGDDATRLEEPLDGGHPSRSRRLTPSRRRRHLHCQHLNYPRPSSTITVPITGNSKPRSLTRKRTRRRRLSCSRRGPTSRTGAAPPL

SEQ ID NO: 110059 - protein, 292 aa, Triticum aestivum
  unsure (1)..(292): unsure at all Xaa locations
  Clone ID: PAT_TA_4477.pep
MKTLLILTILAMAITIGTANIQVDPSGQVQWLQQQLVPQLQQPLSQQPQQTFPQPQQTFPHQPQQQVPQPQQPQQPFLQPQQPFPQQPQQPFPQTQQPQQPFPQQPQQPFPQTQQPQQPFPQQPQQPFPQTQQPQQPFPQLQQPQQPFPQPQQQLPQPQQPQQSFPQQQRPFIQPSLQQQXLNPCKNILLQQCKPASLXHSFWAIIWATKRMARGAGTMVATTRTTILKXVQGGTLPSGGAFLFLPXRGQHHHPHGVXAFLAPFYXHRXGKGVFVQGXXIXQXQKXXLNGGW

SEQ ID NO: 110060 - protein, 146 aa, Triticum aestivum
  Clone ID: PAT_TA_4478.pep
RVVWEQHLYQLEGKFLATENFYHTLKFFGLRSKSFLSDLMLAGDQFCHGDWSSNIKREHCSFNEGELLLFCFSSAYIVALLHDTLKVPMDHKNVLHPEAEKISPQDNIGHGERPAHDNKGQPMSLAPGRWELFLRWSSSDRICKYS

SEQ ID NO: 110061 - protein, 344 aa, Triticum aestivum
  Clone ID: PAT_TA_4479.pep
RLRWWNVSVPLWEKKFCTDACSIPWGKLCEAKKLMSLYTNIVDWDDSAAFEAFKDAKDRFCAAYHGQPCYIPLPDPDMYIAARGPDEYIDPELVADLERSRRRAPRRDSTAPNGWDSFIFADKPVPATGWGDGETTNTIGQQCSVNWDNHVEQLVEANCKQSSVNWDSYVSQPAETFVQQSSGNWDAYVEQQGQTSGWGAPIIPCTSNWGMNGDPWNHDYGWGSSAIQTDSWGDQKDSYYVPDSQAQGSSDGHWRRRNSQSGRRNSRNRDRGGPISSKAMKSKYQADEHGGANNGWRHCRVRDNMQYSYEQPGYAAHQSLSNVRKDDEDHLGRFGGAILRVGNV

SEQ ID NO: 110062 - protein, 195 aa, Triticum aestivum
  Clone ID: PAT_TA_4480.pep
NKLIEELQTVTKRMVARKYARERDVLVKNLLLAIDKISHFESDIPFVDKQNKDAALQAKDWLLNKQREQKSVSIYEDAVLKCTALDNWIKRLELDQTTEGSLLQDSSTSSSGYEELPEGSSVEEQTNKFPPRSVPTGETLLEIFRVETNLALIKTILVYDYKGAALVYKSKQGDKSRFRKKVFQLAVKTYQENPF

SEQ ID NO: 110063 - protein, 183 aa, Triticum aestivum
  unsure (1)..(183): unsure at all Xaa locations
  Clone ID: PAT_TA_4481.pep
PALPLRPSPPPPAPPPPAPPRPPPPRPPRLPPPARPPPAAPPPRPPPPPPASPPRPTPXPPPADAASPPPPPLVPRSSFLFPRPLGPPCVAPPPPAPPLGCRSALRPRVASKLAALQFAPRGFGGLRPPAPLPPFGCIGGGRPHCYVAAGAATACGKQKQAAAAVRGAWAGGVCVSQQRQPWL

SEQ ID NO: 110064 - protein, 206 aa, Triticum aestivum
  unsure (1)..(206): unsure at all Xaa locations
  Clone ID: PAT_TA_4482.pep
MKTFLILALLAIVATTATTAARVPMPQLQPQNPSQQQPQEQVPLVQQQQFLGQQQPFPPQQPYPQPQPFPSQQPYLQLQPFPQPQLSYSQPQPFRPQQLYPQPQPQYSQPQQPISQQQQQQQQQQQQQQQQQQQQQQQQEQQILQQILQQQLIPCMDVVLQQHNIAHGRSQVLQXSTYPLLQXLCCQHXLWQIPEQSQCQANPHVC

SEQ ID NO: 110065 - protein, 217 aa, Triticum aestivum
  unsure (1)..(217): unsure at all Xaa locations
  Clone ID: PAT_TA_4483.pep
MKTFLILALVATTATTAVRVPVPQLQPQNPSQQQPQEQVPLVQQQQFPGQQQQFPPQQPYPQPQPFPSQQPYLQLQPFPQPQPFLPQLPYPQPQSFPPQQPYPQQRPKYLQPQQPISQQQAQQQQQQQQQQQQQQQQQILQQILQQQLIPCRDVILQQHNIAHASSQVLQQSTYQLLQQWCXQQLLQIPEQSRCQAIHNGCHAIIMHQQEQQPQLQQ

SEQ ID NO: 110066 - protein, 119 aa, Triticum aestivum
  Clone ID: PAT_TA_4484.pep
PTAQLPPRPPGSLSSASRQWPTTFASSFSRPPPTPTPPPRYPRPTSASSSTTSATAPTACTPPPSPSPPPTASRSPPRSSEPPAPRPRQRPSSPPSSRRSPRSHPPRTCPTSGPSLIAS

SEQ ID NO: 110067 - protein, 210 aa, Triticum aestivum
  Clone ID: PAT_TA_4485.pep
MDPRARYPPGTGNGRGGNPNYYGRGPPLSQNNHHHHQQTSAAHQQQYVQRQPQPQPQQHHQNNHQQQHHQNNHQQQHHQNHHHHQQQQQQQWLRRNQITAAGTSGPKVVAPPPAAVGNDPSSQDWKAQLKLPPADTRFRTEDVTATKGNEFEDYFLKRELLMGIYEKGFENPSPIQEESIPIALTGSDILARAKNGTGKTAAFCIPALEK

SEQ ID NO: 110068 - protein, 167 aa, Triticum aestivum
  Clone ID: PAT_TA_4486.pep
PTRPPTRAKHFKGRTNEKSKDVTTLDWNGEGTLLATGSYDGQARIWSRDGELKQTLFKHKGPIFSLKWNRKGDFLLSGSVDKTAIVWDTKTWECKQQFEFHSAPTLDVDWRNNNSFATCSTDNMIYVCKIGDPRPVKTFSGHQSEVNAIKWDPTGSLLASCSDDWTA

SEQ ID NO: 110069 - protein, 172 aa, Triticum aestivum
  Clone ID: PAT_TA_4487.pep
VQRERKVQREREREQGHSHGNNTRLRCRFRIRCSGPCKLPRLRCRFRIRCSGPCTLPRLRCRFRCSGASMGPGLQCTGTPSEWRPCGPTSAGSTRCSAESVSWPSNTTGTGTRKERTAQVAATEEPPLATRRARPTACRRRGMARGSQSQSQQQKNRRTSPSNLASRVGGAR

SEQ ID NO: 110070 - protein, 95 aa, Triticum aestivum
  Clone ID: PAT_TA_4488.pep
LDKQVDEIIKRTIKHRNLELIGAIAKVLYCFFGSFSYCPFVLVVVLSFCYCLYRGAFQCNFCRLITSCISVSFEWFAVIIQDPPIIRASWNILWV

SEQ ID NO: 110071 - protein, 168 aa, Triticum aestivum
  Clone ID: PAT_TA_4489.pep
MAPQPTPSPRTGPPTTPQASAAATPFRTPVSKHRLHFPPATPRHGGAGAATEHPVEVIGRVRNLIASAAGASVLEVPGGAGGTTVPVRGDAGGISCRDFSLDGVSVSEEEDLEGFYPRFGRSGIPGVRVGAQCTVMAYGPTGAREDSNHGSVGQGSPGIVYRAPGEIL

SEQ ID NO: 110072 - protein, 129 aa, Triticum aestivum
  Clone ID: PAT_TA_4490.pep
MTNAKVAGVLSLLVLVAISSCPRHARAGHAVDHCLIDKKKVMRDCWHNIEKNFGDPFPSHGSICCDTIRDSKDIHCVCDRFTADELTVISLSKFATVTHKCGNGLHAHTHYAGYRVPIITLPPPPPEGA

SEQ ID NO: 110073 - protein, 119 aa, Triticum aestivum
  Clone ID: PAT_TA_4491.pep
EQVKVSTIVRFTWHFCICGGKRGKEKVEKWALMQEPACTTWWSIGRGTCMEVVKNRETHAGRSVVVKMIMASQITGPHLCSSNPLSNHTALRLQQPTPSSSVVTVEPTRRNCPAAYRVR

SEQ ID NO: 110074 - protein, 291 aa, Triticum aestivum
  Clone ID: PAT_TA_4492.pep
MQPFDLRSKGSRKPVSWENGKPLPCRSHAGSSLLLVPARPSILWWFAPSRHVHSHYGSSTNPNPPPKSMASQISTIGGEYKVRTITGDEFDVIYTRSSATVKGCLSRFRRMFEDSDDEWVAGLDVEYTTVLGREKDLKDEERKKPAVIQVCVHDLCLVYHICHADVECQDFKDFLESNLVKFVTVDFGNDKEVLGRIGLVVGNTFDLQKNWLVSSRQPSMLTLAGAMVHPSYGKLEKPPYTFHRYAWQQNVLDIDHIHYAAMDPPTCFSIYKGWTINTSPVCDTCIEVLTT

SEQ ID NO: 110075 - protein, 146 aa, Triticum aestivum
  Clone ID: PAT_TA_4493.pep
MDRRAPPPPSSLSGASSPRCRFDAAWRALGTRGAAAAAALGQALGALLAFVFAVVGSLVGIFIGAFMGMSTESGMLRGAGVGAVSGAVFSIEAAESCIEIWRSSESGKDSFLFVLDIISSLFSGRIVWEKGSPRLQRAGPSADEFK

SEQ ID NO: 110076 - protein, 103 aa, Triticum aestivum
  unsure (1)..(103): unsure at all Xaa locations
  Clone ID: PAT_TA_4494.pep
SMVMMILLHMVTCLSYKGVSRLLKGPIHQTYYSPISVKVSNEHVKVPVLCMKPYYLDAWCLKSSLCSPQRQSNNRLLXQRPIPHTPGGAPNLSALLARLMPRA

SEQ ID NO: 110077 - protein, 179 aa, Triticum aestivum
  Clone ID: PAT_TA_4495.pep
MKSTRLLYPEASAYYVNLAGISFGRTRLGGNLAEVFRRRKLADGSWHSGCVLDAGMFWGGTFMIRPAYDILERALAEHGRRLGVPRVPRHNFGLCFRATRAILLHWPTVTLHFESEQDLVLTPNKLFVLQDQDMCLTVTPNPQITVIGPATQVGTRFVYDLAAGRVYFAPENCNADTGV

SEQ ID NO: 110078 - protein, 98 aa, Triticum aestivum
  Clone ID: PAT_TA_4496.pep
VQAQSLVKGMGAARLAADAAAGAGPPVVPLFGAQPAVAPVADLAADDLCGTELSNRVGAVWPSAIEAWGVTRPVHRRAALQRHTPSDDQAPLQRPPRC

SEQ ID NO: 110079 - protein, 272 aa, Triticum aestivum
  unsure (1)..(272): unsure at all Xaa locations
  Clone ID: PAT_TA_4497.pep
AGLQLLDVKQAGGDVDGLMGLSITLDEWMRLDSGVVDEEEQFSDRTSKILAAHHAKPTDLLGEGQTADKKSRRSGRRWGLLGNNFTVALMVQLRDPLRNYEPVGTPMLSLIQVERVFIPPKPKIYSTVSEKGNSAHDEEEPNPEQXLXKASVDAEKIEEDSVPQFKVTEVHVAGFKSEPERTKPWGNQTQQQSGSRWLLGAGMGKGSKHPLMKSKATAKATKDAAVQQGDTLWSISSRVHGAGTRWGELTGSKRDPYILLPKDKRFRGGLYQ

SEQ ID NO: 110080 - protein, 199 aa, Triticum aestivum
  Clone ID: PAT_TA_4498.pep
KRAKVIVLGPTDAPRFKKPQHTSCLNKRQSPPGEGKRGKWKGRNQDRHTPLSAAGGPELGGASHPSSLPPHRPAPVSPPLGGRRSSTRGTTTHLSPGKEKSQGPPLTTKEAPQGAHLRFPPSSSRCSHWIPAPATGQPQLRRSTIRRGHGRGRNLQPAPPAPDLSSKSPSLETKARPPPGRPPRGSRSAAAPQLPATPP

SEQ ID NO: 110081 - protein, 152 aa, Triticum aestivum
  unsure (1)..(152): unsure at all Xaa locations
  Clone ID: PAT_TA_4499.pep
RREVLCPPLSVXVLLLLRAYVEQPPFLTCEHHAPVLCGYPRHKNHWACNVKLGEVAQQYSDPSNLALAAPSFSFSPSIGNAVKQEPRCQPLAPQVHPVLPFSPSSTLTPLLAYSSWCRCLCEEEKQEKMHASGKEMEEGQIEEGKREGGGSG

SEQ ID NO: 110082 - protein, 217 aa, Triticum aestivum
  unsure (1)..(217): unsure at all Xaa locations
  Clone ID: PAT_TA_4500.pep
PIHPFPFPQKKKNPSFPRFSATASARLPTRDGRTCRRPARGEPPPPQGIHPSLPSPAPSSPPPPRRPDDSPPRTAAPPECLKGGGTGARRGPHRRAPGPHPAARPLLPPRRRRACGRACRPRAGATSGDPPXGPARRGPRRGRPRSGPSACRGPPGRPWAPAPXPRRRPEVARPLLGAAETPARSPDPFARRGGAAGLPFTRGSFLLSLGKLALGLK

SEQ ID NO: 110083 - protein, 138 aa, Triticum aestivum
  unsure (1)..(138): unsure at all Xaa locations
  Clone ID: PAT_TA_4501.pep
LLFLLSSSPSPPAPPPPMPTPPSPPGCAGRPRTPXVHAGPQRQPXPAPRPPRTPPAAASRSRSRRTLLTPALSTSATSTSEAKAGAGEPRQRRWPDPVEATTTTPNTPTEPVPTGWAGASALVPGPQALGDSYVGEFA

SEQ ID NO: 110084 - protein, 143 aa, Triticum aestivum
  unsure (1)..(143): unsure at all Xaa locations
  Clone ID: PAT_TA_4502.pep
MSWLARSIATSLNIPEDSGADDDPDAVPAAGSPPSARAPPPPHSAAADGVKEDLTELSKTLNRQFWGVANFLAPPPGKGSPSPSPSPSSAGGQSADAGTPPEIAGIRRDFSQISARFRSGISRISSHKGXSGFSTITSIFLPL

SEQ ID NO: 110085 - protein, 110 aa, Triticum aestivum
  Clone ID: PAT_TA_4503.pep
AMITSAMAMITSVMAMFVRVMEIREATDCKVEEEVVQTNRWVQPAFSSIILHRTLTRINASPAVWKLYGRGNQHKKKKQRSTETRCTFSFPALKMLTTPQYICIANAPQQ

SEQ ID NO: 110086 - protein, 181 aa, Triticum aestivum
  unsure (1)..(181): unsure at all Xaa locations
  Clone ID: PAT_TA_4504.pep
MAPKAEKKPAAKKPVEEEPTTEKAEKAPAAKKPKAEKRLPAGKTASKEGGEKRGRKKGKKSVETYKIYIFKVLKQVHPDIGISSKAMSIMSSFINDIFEKLACEAXXLARYXKKPTIXFRESQSFXLLVLPXEARQHAVFXGTKAATKFTSSRIRCLICTKKGSACWEIVESWPMLLWLRD

SEQ ID NO: 110087 - protein, 64 aa, Triticum aestivum
  Clone ID: PAT_TA_4505.pep
IPCSKLTLTKGNKSWSSTAVAAALELVDPPGCRNSARERTSLEFFFFFFYHNNIIIVIILKGKY

SEQ ID NO: 110088 - protein, 230 aa, Triticum aestivum
  unsure (1)..(230): unsure at all Xaa locations
  Clone ID: PAT_TA_4506.pep
VIGQLAKPVSFSIASTSFLASCFIASATTXXFFMADRMKNWPYLKSERLPLMGSKTGLIDVCDNPSYSYILIFWPAQQRCRRKINRGRQLIFHRCTAPPTPPNPLFITEAGSPPKGRLLQEREEGPDYNFSTDRLRIKINPFGLRLPHKPKSISFLSGLQKEIDSSSASGSLEIISPKTPPGIIAQAAEGGYDTKSDCGQQGWWWQAAEKGGGVAAGDGGGRGGRVRRTG

SEQ ID NO: 110089 - protein, 261 aa, Triticum aestivum
  unsure (1)..(261): unsure at all Xaa locations
  Clone ID: PAT_TA_4507.pep
MKTFLILALLAIVATTATTAVRVSVPQLQPQNPSQQQPQEQVPLVQQQQFLGQQQPFPPQQPYPQLQPFPSQQPYLQLQPFPQPQLPYSQPQPFRPQQPYPQPQPQYSQPQQPISQQQQQQQQQQQQQQQQQQQQQILQQIXQQQLIPCMDVVLQQHNIVHGRSQVLQQSTYQLLRELCCQHLWQIPEQSQCPAIHNVXHAIILHQTXKQQQHPSSQVFFQQPLEQISIGQGSFRPXLENPQAQGXSVQLNNLPQVEGNKN

SEQ ID NO: 110090 - protein, 348 aa, Triticum aestivum
  unsure (1)..(348): unsure at all Xaa locations
  Clone ID: PAT_TA_4508.pep
MDLLQSSYAPGDASSPEDESLSXSPDPSPLRLPSKSAAPAVDETALALSAAAASTSRPLXDPSLHLIPFPTRPDQLWAPVLGPQHPHAPISSASGHRNHKLGHVEDAALLPFLFDEQYNTFHRFGYASDPSGLHIIGDAQPQAPDLDTVYNLPPSEHKRRRIQSREENHEPLPPEAQNPASDEWVVHNKQSPWAGNREGPPVELTDEQRQYADAHAAKKAEKEARGEGKEKTEVVVKSTFHGGEEKDYQGRSWITPPKDAKATTERCYIPKRCVHEWVGHTKGVSAIRFSPKYGHLLLSASMDCKIKIWDVLESKTCMRTYMGHSKAVRDISFSNDGSKFLSAGYDRN

SEQ ID NO: 110091 - protein, 354 aa, Triticum aestivum
  unsure (1)..(354): unsure at all Xaa locations
  Clone ID: PAT_TA_4509.pep
PAPPPAPDPYSHHRRLPPPPQPPRARFPSPAPPPFAGPARGGRGRCSRFQRGTMAASGPEHAYSNILTGLPRPEGGQYGKFYSLPALNDPRIDKLPYSIRILLESAIRNCDGFQVTKNDVEKIIDWENTSPKLAEIPFKPARVLLQDCAGVPAXVDLAAMRDALAKLGSDANKINPLVPDGILRIDHSVQVGCSKGRPMHLQSNMELEFTRNRERFGFLKWGSTAFQNMLVVPPGSGIVHQVNLEYLGXRVVFNTDGIMYPDSVVGXTDSHTTMIDGSRVLLAGGLVVWDAAGCGAGGSRAASSCLGQPMTMVLPGVVGFKLTGKLRNGXVTAPDLVLLGPLPSGGWGVVAAFG

SEQ ID NO: 110092 - protein, 311 aa, Triticum aestivum
  unsure (1)..(311): unsure at all Xaa locations
  Clone ID: PAT_TA_4510.pep
GQCQPRYYPTSSQRPXQLQQLAQGQQGQQPXRGQQGQQSGQGQQLGQGQQGQQPGQKQQSGQGQQGYYPISPQQLGQGQQSGQGQLGYYPTSPQQSGQGQSGYYPTSAQQPGQLQQSTQEQQLGQEQQDQQSGQGRQGQQSGQRQQDQQSGQGQQPGQRQPGYYSTSPQQLGQGQPRYYPTSPQQPGQEQQPRQLQQPEQGQQGQQPEQGQQGQQQRQGEQGQQPGQGQQGQHPGQGQPGYYPTSPQQSRQGQPGYYPTSPQQSGQWQPPTQGQQPRQEQPGQHPGQGXQPGQGXPGYYPNFPSNQEKNTT

SEQ ID NO: 110093 - protein, 108 aa, Triticum aestivum
  Clone ID: PAT_TA_4511.pep
PPPPQFRAVLPAPDPIGTEVVQSLRRQGATAIFMDYPSRYGGCPSLPLPKIHASLSSFVRELAGDRPPAQHLAHALRRDGVWESAGGAAQYLLDARSAVVSSEDINLP

SEQ ID NO: 110094 - protein, 553 aa, Triticum aestivum
  unsure (1)..(553): unsure at all Xaa locations
  Clone ID: PAT_TA_4512.pep
LGFPCCILSWSNPYRNPLFRAREPLSHFIPQICTVRRVPLGMQQSKEELLYQQVNYGNIEGIRNLRAQGAGVEWIDKEGKTPLMVASMRPDLLNVAKALIELGANVNAYRPGSHAGTALHHAAKKGLDPTVHLLLSHGANPFITNDDCNTALDLAREKGHVNVVRAIEGRISLFSGWMRENYGPGFLEAFAPGFMTRKIWAVILPREARNPTRPVKLELAIYPELQAAKPRVVVKLWKSQLEEPKYNLADPSMTIFDKVTKSRYKLLPAYEGDKQQLRSFYSACCGMAQVASMVPARPVNAPSPNPIPNPSLAPSAESTPSEEDLELAMAINASIQSAIAEGVPNVQPMTSTNSSLNGWGSPDSPAPSKTSGQAQVDAPSSSKYNGWDVPGRGAAQSSSKPNKSQNNNPSIVIPPEAGAAPTPTALPVPTPTALPTLPTPTGPPHAEGTFYDGPIEHPPIDYTPVEVTMPRTDGGGTALNTAKPVAGEGXAGSRGNTPSGTCALCIXAPAGGPWSTGGHMAGCMSCVEDPESKKWGCPICRAKINQIIRLYAV

SEQ ID NO: 110095 - protein, 119 aa, Triticum aestivum
  Clone ID: PAT_TA_4513.pep
MKTEIEEEGTRGSWTEEDKSLCASVLGLDAFTYLTKGGGAISENLVAASALVGLQNKLQDLVEADGKSLRWNYAIFWQLSHTKSGELVLGWGDGSCREPHDNGGNSTPRALIHDASSLS

SEQ ID NO: 110096 - protein, 255 aa, Triticum aestivum
  Clone ID: PAT_TA_4514.pep
MFPPGLIHHRTDGPGPGEVPRSGGAPSLVLTADPKPRLRWTADLHERFVDAVAQLGGPEKATPKTILRTMGVKGLTLFHLKSHLQKYRMGKQTGKETPEQSKDGSYLLDAQGGMSLSPRVSTQDAKESQEVKEALRAQMEMQRSLHEQVEVQKHVDIRMDAYTTYINTLLEKACKIVSEQFASSGFSVSDQSLPELSSGGVMCGTATDALSSSVFHQLSVSSINMHSPGGKPSPSGMEGQLLLQRSPEFKRKSSC

SEQ ID NO: 110097 - protein, 208 aa, Triticum aestivum
  unsure (1)..(208): unsure at all Xaa locations
  Clone ID: PAT_TA_4515.pep
MKTLLILTILAMAITIGTANIQVDPSGQVQWLQQQLVPQLQQPLSQQPQQTFPQPQQTFPHQPQQQVPQPQQPQQPFLQPQQPFPQQPQQPFPQTQQPQQPFPQQPQQPFPQTQQPQQPFPQQPQQPFPQTQQPQQPFPQLQQPQQPFSQPXQQLAEAQQPEQSFPQQQRAFIQPSLHKQLTHARYSGARCKPCVIXVSLGNIWHKAM

SEQ ID NO: 110098 - protein, 156 aa, Triticum aestivum
  Clone ID: PAT_TA_4516.pep
NTKWQTPPPCSTHSSPPPGRRAAASTEPRPRGSPRPPAPPAAPAGRPRSVRPMASSTTAARARRRAAGAEEGIRGLYHESSRPGENNRGQHMPHGFYQFGEGAFMFDHRLAQIRMIEGGPSLWPLSRTIRQTNPKQLVEVECENWWKLQKPGLTNI

SEQ ID NO: 110099 - protein, 249 aa, Triticum aestivum
  unsure (1)..(249): unsure at all Xaa locations
  Clone ID: PAT_TA_4517.pep
MKTLLIVTILAMATTIATANMQVDPGYQVQWPQQQPFPQPQQPFCQQPQQTIPQPHQTFHHQPQQTYPHQPQQQFPQTQQPQQPFPQPQQTFPQQPQLPFPQQPQQPFPQPQQPQQQFPQSQQPQQPFPQPQQQFLQPQQPQQSFPQQQQPLIQLSLQQQMNPCKNFLLQQCNPVSLVSSLISMILPRNDCQVMQQQCCQQLAQIPQQLQCATIHKGRASIIMQQEQRQGVQIRGPLVXLVQGQGIIQP

SEQ ID NO: 110100 - protein, 197 aa, Triticum aestivum
  unsure (1)..(197): unsure at all Xaa locations
  Clone ID: PAT_TA_4518.pep
PHLSPPPLPLCSARALPPSSPPTVSSKXSQLPLRPPAPTKWLASPWSPPSSRSWPSPRPRSAPGRPPRWPRCRRPRRGPPPVATPPNAXPPSPMASPPAPPAPPPDPPTGPPSXPPRSPEHPRARPPARPAAPRPPLPPFTPPPPPPPPRPRPPPPPPRPRXPAAGRPRPPPAGLPLCFPLFCCLRDAFLVAALRGA

SEQ ID NO: 110101 - protein, 178 aa, Triticum aestivum
  Clone ID: PAT_TA_4519.pep
MQFFGGSSLTSVAPESSPAPAAPPGTGTGSNAQVIYVFNRNGVCLLYREWHRPLRTLARNQDQKLMFGLLFSLRSFTAKIDPTSTEHANLGAPLLPGQGCSFHSFKTNTYKLNYMESPSGIKLILLTHPRTGDQRDALKHIYSLYVEYVVKNPLYAPGSPIKCDLFNKHLDQYVKTLI

SEQ ID NO: 110102 - protein, 173 aa, Triticum aestivum
  unsure (1)..(173): unsure at all Xaa locations
  Clone ID: PAT_TA_4520.pep
METPPPPPRWPPGFRFSPTDEELVLFFLKRRVAAGRPSPYIADVDVYKSHPSHLPERSALRTGDKQWFFCSRLDRKYPNGSRASRTTADGYWKATGKDRSICNAGRAVGNKKTLVYHHGRAPRGERTDWVMHEYTXLXDALPPPARCXESYALYKLFEKSGDGPKNXEQYXAP

SEQ ID NO: 110103 - protein, 180 aa, Triticum aestivum
  unsure (1)..(180): unsure at all Xaa locations
  Clone ID: PAT_TA_4521.pep
MANTTRSIAIVLIVLAALSFGFPAIDADATFLVKTCKKTTNALLCLAVLNVDPKSAYATTEHDLASIAPQIAINTADHNVEVIHNLAMDVQGTPEGGALNICLGAYVDAANDLEIDARPGFDGGNYVGARNLVLGAKGAGGRCEDAFKGDQXKSPVTNIDQQMTERCGVAGELIGLLIHK

SEQ ID NO: 110104 - protein, 128 aa, Triticum aestivum
  Clone ID: PAT_TA_4522.pep
RPPPRNLPSLLPFLSDRARGCEGGVAALERERERDMAGLKLKLMVPPAFLCLLLLVMPPLLLPPGCAATRLDPTQGPSEGNNKTCTELSKRSPILYCEHHACVDNCRIEGFPEGGFCNWLRCLCKRPC

SEQ ID NO: 110105 - protein, 117 aa, Triticum aestivum
  Clone ID: PAT_TA_4523.pep
MRTSLLLLAALGVISVITTPAVALKSKWQPIKNITNPHVQDLGTWAVVKYRMVSNSRLHFKQVVSGEVQRMTEGMNYRLDVQVSRMDHKDAMYKAGVLEEDKPLSTIRKLVSFAKAK

SEQ ID NO: 110106 - protein, 116 aa, Triticum aestivum
  Clone ID: PAT_TA_4524.pep
WAVKWQIMSKLVAFWFQMAEDAAEFIIQNLAVHHCFIAVPACIALYLILASCPEILAQNQKNTEEVLQPCMWCTLELIVSNVRGYVPKMSTSSSIMMSPYKTSIHYKCSLVSEKKK

SEQ ID NO: 110107 - protein, 173 aa, Triticum aestivum
  Clone ID: PAT_TA_4525.pep
APTRLMRQERAEDLTAGEGSYIRTSALPHRATVRQMALHARLLRRGCVPGFLRICRKAPFPGLAGRRRRRQVCGSTPPSSGRAARRPPPRWKLPASSSLSQMEICRPRAATAQEGAIPPPLRRVGVRRAGASRARERHRSEKEGKREIIYINLLSSIGNPKYFMSKAPMVQLA

SEQ ID NO: 110108 - protein, 268 aa, Triticum aestivum
  unsure (1)..(268): unsure at all Xaa locations
  Clone ID: PAT_TA_4526.pep
MSPSTKKERAAEARASSSKPIVAGAPQVQRRRVSGGGWTSRRISFYASRVYFLLIILQIPLFRVPCRAGTCTTPIQITSSQLVSNEIFPPSVVKAMLYPGAIVRNLTTSMRMTFPRWSDLFDIYNLTXEAKNASAVIDLQRLEMLAGSYFCVAGALVGIINPGRMILFGTFLXIWGGTHDAXFGKLKISDLTEPVYIYPTILIALYCSFMTVTYNLXKKAISSLYNSITSQLQTTAKSKLRSALSSLMVGLVRWSASPAAVRRPPLVC

SEQ ID NO: 110109 - protein, 158 aa, Triticum aestivum
  unsure (1)..(158): unsure at all Xaa locations
  Clone ID: PAT_TA_4527.pep
RNQITGSIPQDIGNLVNLQTLFLDENKISXGSIPKTFGNLQNIQRLNMNDNKLTGSLPQGFGDLKNIVGLNLADNSLSGPLPMNICTGGSLRAFVMSLNMFNVSVPWSLKTCTSLTGLYLDGNQLTGDISHHFGVYPQLRHIWLTSNRLSGSIAPKWP

SEQ ID NO: 110110 - protein, 111 aa, Triticum aestivum
  Clone ID: PAT_TA_4528.pep
MASRQDQASYHAGEAKARAEEKTGYVVGAAQDKAREAKDTASDAAGRAMGRGGDAKEATKEKAYEAKDAASDATGRAMDNGRGAAEATKEKGCEANDNAAGTAQQTGSYIA

SEQ ID NO: 110111 - protein, 185 aa, Triticum aestivum
  Clone ID: PAT_TA_4529.pep
MQQAMPMPPAAAAPGMPPSAGLSTEQIQKYLDENKQLILAILENQNLGKLAECAQYQAQLQKNLLYLAAIADTQPQTTVSRPQMAPPSASPGAGHYMSQVPMFPPRTPLTPQQMQEQQLQQQQAQMLPFAGQMVARPGAVNGMPHAPQVEPAYAAGGASSEPSGTESHRSTGADNDGGSGLADQS

SEQ ID NO: 110112 - protein, 94 aa, Triticum aestivum
  Clone ID: PAT_TA_4530.pep
MGPAGGGGGPGRGRVRRWRWAPGGGSGFSGGVLNETRRGLGSFQLCAPCTCCGGPRGVCVLSPCCYAINCNIPNRPFGFCSFTPRSCDCLHCNV

SEQ ID NO: 110113 - protein, 170 aa, Triticum aestivum
  Clone ID: PAT_TA_4531.pep
RAHRSATAVRREAPRGSVDVGPHGHERPEYLTQGAEAVGAVAAPRPVVRHPIECAAEQLRLRQLLRPWPPLEEHEPAAARVALPRHGPRAEFSTSTSPKLPVAAAVRDLPDYALTSHIPSLPPSRTAAGSVAVVVFTLVQPSPSWLEHTLDNFRLAFIISFADHLALLFL

SEQ ID NO: 110114 - protein, 120 aa, Triticum aestivum
  Clone ID: PAT_TA_4532.pep
PQLNQHIKTGDSEVDGSEVERRGFAGHPMCKFCRSPFYGETELDTHLTREHYSCHICQRQHGGQDDYFRNYDDLEMHFRRDHFFCEDRECLEKKFIVFQSEAKLKRHNAWEHKKRMPHAQ

SEQ ID NO: 110115 - protein, 532 aa, Triticum aestivum
  unsure (1)..(532): unsure at all Xaa locations
  Clone ID: PAT_TA_4533.pep
WRRRRGTGREEEDEMLLDDGDIEESPRDSFRDSDDDDAEAEEGRGEDGDGVGSFESHQWPQSYRETTDTYTIAASPIFGYLGPSTSKYSIDGGRSGLASDLRLPFISDKLESVKSLRRHLLGSVRDEKLSFQYTGEIYVGQGCSVTQTVFNGINVLAGVGLLSAPFTIHEAGWAGLAVLSVFAIICCYTGVLLKHCFESNGGIAPYPDVPVAAGGGIGRWFVSIIGGTVSEAYCVEFIILEGDNMTSIFPDVNINLFGIHVDSKHFFGVLTALVVLPTVWLRDLRVLSYLSAGGVIATLVVFISVALVGTTEGVGFHQTGEAVKWSGMPFAIGIYGFCYSGHSVFPNIYQSMSDRTKFPKALFICFVXCTAIYGSFAIIGYLMFGDKTLSQITLNLPKESFASKVALWTTVINPFTKXALLLNPLARSLEELRPEGFLNETIVSIILRTSLVASTVVIAFLLPFFGLVMALIGSLLSILVAVIMPXALCFLKIAQNKATRPQVIASVAIIVVGVISAALGTYSSVASIIGYY

SEQ ID NO: 110116 - protein, 191 aa, Triticum aestivum
  Clone ID: PAT_TA_4534.pep
MREEVRSSSAAPADPPLRSDSPPATPVASSAGASSPPAQTNVATIDWLGSEQLSKVGSSSHVASHAAQPSLSTNAVGAAMDFSQPSCRPWERGDLLHRLATFKPSTWASKPKAASSLACAQRGWVNIGVDKIECDSCGAHLIFTALTSWSPAEVANAGEAFAEQLDASHQNDCPWRGNSCADSLVQLHFTP

SEQ ID NO: 110117 - protein, 95 aa, Triticum aestivum
  Clone ID: PAT_TA_4535.pep
MAAMPGPARLALAVLALASVLPAYRSDDLNTDAQALEALRKAVGRSALPSWNGSAQTCQWQGVACENGRVVELRLPGAGLMGALPSGVLGNLTAL

SEQ ID NO: 110118 - protein, 115 aa, Triticum aestivum
  Clone ID: PAT_TA_4536.pep
WCRSTDRLNPKNKQGNNHWNMFYGRCEKGIASKTDKEIIGITYDRKLPNPGVTGAKFHTFTLLRGVPRRRQRRLEPHRFPKRRALLATKPRTPVPTYVDRSYGSITDTFPNKIRP

SEQ ID NO: 110119 - protein, 90 aa, Triticum aestivum
  unsure (1)..(90): unsure at all Xaa locations
  Clone ID: PAT_TA_4537.pep
MPPXEEKXXGQPPRXPVLEAAAGRGGRXGAGPPPPRLPSAAAPPPLSTRWRGGGSRVAGGSGRQNLRWWRLRRAVFERARAVGLSCGVRA

SEQ ID NO: 110120 - protein, 176 aa, Triticum aestivum
  Clone ID: PAT_TA_4538.pep
LPSQASPPVPHARQSVLENFLNFLLLLLVLFLSIGGGGGTPRVNDPIQAEEQPQVAVPPQVELAPLPEVELPPQPELPQLELLPAPAVQLLPQPKPAKAEVGPAPVAQMPPKPPKPRGYLRSKPALPKVELPPKPETPAGPVFHSPEPHTPTVDSPPVPETTTVTPIHLLHPVATP

SEQ ID NO: 110121 - protein, 201 aa, Triticum aestivum
  unsure (1)..(201): unsure at all Xaa locations
  Clone ID: PAT_TA_4539.pep
RRTGLLNTPEEIAHASNEVPEVHVDPHMAPTYESAEEWNDETTVDLTINGNGPDLLFPGREAAESNAVQYLSQKCPDASRHSSLNLPTEGVTHIPGAGSITNLQAANGSNIPRPRIDLNNTAGDAASVPSSGVVSSDTEPRKSMALQGPSGNVKXRLPFTLSKWTLIPKWHEIWSXXDEEIIXATGMXQQTEVHQLAXLHR

SEQ ID NO: 110122 - protein, 245 aa, Triticum aestivum
  Clone ID: PAT_TA_4540.pep
VRPRVRGRVGAKALVAVSTGSASIPVPKLKNVRRLRTEHYVYEIPDSHSLVQQLGLDQRETGDPSPYLLTIWMQDDINEMIKAPKPCSDSPMEDRFCNNEKCQYCVLERENQSRYVRATILVPCRTATKGSFPLNGTYFQVNEVFADHKSSYDPIYVAREQLWKLERRMVYFGTSVPSIFKGLTTEEIQQCFWKGFVCVRGFERETGAPRPLCQHLHVAASKVPRSRNAAAAAGRNSDSAKASAP

SEQ ID NO: 110123 - protein, 291 aa, Triticum aestivum
  unsure (1)..(291): unsure at all Xaa locations
  Clone ID: PAT_TA_4541.pep
MKQTVVLYPGAGVGHVRPMTELANVFLKHGYDVTMVLVEEPLKLSDSGTTVIERTAASNPSISFHVLPSIHAPDFAAXAKHPFLLMLELLHYYNEQFEAFLCAVDRKSLHSVVLDMFCIDATDVCMNLGVPPMPASHLIKELLEHPEDEMFKAMMNIWKRNTETMGVLLNTFESLESRAVQSLRGPLCVPERILPPIYCVGPLVGKGAKDEEKVERKECLEWLDMQPDRSVVFFWLGSKGTLSTEQLKEIAIGFERSGQRFLWSVRMPAGSDNPEKYLEGFPEPELDALLP

SEQ ID NO: 110124 - protein, 165 aa, Triticum aestivum
  Clone ID: PAT_TA_4542.pep
MTAHNTSLAMYGFSWIVLLVMVLLFKLFTATPRKSTASPIVFRCLHGRLAIGIIAAIACLIGFTDFTIADLFASALAFLATGWCILCLAITWKRVVKTLGLWDSVREISRMYDAGMGAVIFAPIVFFSWFPFVSTFQSRILFNQAFSRGLEISLILAGNKANHES

SEQ ID NO: 110125 - protein, 151 aa, Triticum aestivum
  Clone ID: PAT_TA_4543.pep
GFVVSLPSNPPSTPHRQSIMLHQENSEVYVRHHSEQLACGNLRGTDDGRSNFLPGKYHIATEWNTTACLVNTASAVKEVTVDHHKRPASSGFTDMLDCKRMKQEEQTVSEKDNAADADINVPEYGSYKTWERISDSPAYGSEESEDEGVDP

SEQ ID NO: 110126 - protein, 141 aa, Triticum aestivum
  Clone ID: PAT_TA_4544.pep
IRKYLAAFHLLDDFPAAVIVDDFTGFFSERSCQLRYGNTRARDLALVRILALCQNAISHANAKLGTIGSCNLLLSDVHQGDNPRSLFIYKRWIGSIYTIQGDGLGSYLLKNISTPQSGTKEARAAKYSIALQYLVLEEIKE

SEQ ID NO: 110127 - protein, 135 aa, Triticum aestivum
  Clone ID: PAT_TA_4545.pep
MHTAGTLRDTHGRRTCWSGTLDYRDLRYSSCKITKAGIGGPLLDFNGRFIGMNFYDKKIGTPFIFRDCIIRVLANFVEKRSFDEVGSDRPIRWPVPIPCWRHPDDELKDSLPPGHGEKSGMFGFSYVDGVRVDNH

SEQ ID NO: 110128 - protein, 355 aa, Triticum aestivum
  Clone ID: PAT_TA_4546.pep
MESPDGSSLPDFLELQRTRVLCKADAPTHTEGFQYSGAFAAMGVDTSVSVEKFCKNFKIEINRLTDEDMEFDMIGVDASIANAFRRILIAEVPTMAIEKVFMVDNTSVIADEVLSHRLGLIPLDADPRLFDYISDDVPNERNTIVYKLHVSCEKGSQRLSPKSGQLEWLPEGSQLTMASPAQSGDNQRTYTSFGQSQQNTSERPLGVKYNDIPIARLGPGQAIELEAHAVKGVGKVHAKWSPVATAWYRMLPEVVLLKEIKNGDAEELVKKCPVNVFDIEDLGKGEKRAVVAKPRACTLCRECVRLADDQVELRRVRDHFIFTIESTGSLPPEVLFTEAVNILEEKCERVISELS

SEQ ID NO: 110129 - protein, 232 aa, Triticum aestivum
  Clone ID: PAT_TA_4547.pep
TRLSPPLPSPVISPLPQTPLCSSHWIGKKRDWAVTLHLHRSPRDLTSVRPAPIRARRADRPPTHRPAPPGRGRRGGAHPPPAGGDWRAQLQPEARGRIVDKILETLKNRLPVSVSVAPEALNELQKIAAWFEQKVYTEATSQYDYLRKISLKLLSMETQRQQAAGNAQLIPNQNNPAPGLHPQGSNEAQTSAVPLMSQQQARQPNASTSVTAGAAVATSSVCESFECAANTA

SEQ ID NO: 110130 - protein, 113 aa, Triticum aestivum
  Clone ID: PAT_TA_4548.pep
IAVSRSWYCTFTLRLLALLCSTVSTSATASSSSSSSSSLLVGDVEGSPAEAESTAEARSSSASRSAAKSSLPLDDDGDGDGDSAARLIDDDAETGANNSRMDQSAAETRPRAS

SEQ ID NO: 110131 - protein, 145 aa, Triticum aestivum
  Clone ID: PAT_TA_4549.pep
TTLLLVPIVAILLTATAATLAKAPAPTANKPTAYEMLGRYGFPPGILPEGVHDYELRPNGSFEVHFSDECKFRVDGQYDVHYSTRVAGNIKNDTISGLEGIKVKVFIAWASIKEVGRDGDELRLLAGIISKSFPVGDFSSSPKCN

SEQ ID NO: 110132 - protein, 202 aa, Triticum aestivum
  Clone ID: PAT_TA_4550.pep
MAKETEYYDALGVSPAASDDEIRKAYYIKARQVHPDKNPDDPQASDKFQALGEAYQVLSDPLQRKAYDGYGKTSISRDNILDGALVFTLLFGSELFEDYIGHLAMATMASSEMASGDNGSAEKLQDRLKGVQREREEKLARFLNKFLSQYVSGDMEGFAHRAESEAKRLSSTSYALDIRRTIGYVYSRQAAKELGKKAMYLG

SEQ ID NO: 110133 - protein, 108 aa, Triticum aestivum
  Clone ID: PAT_TA_4551.pep
THLSSGPPAHLSSPPPAHLSSTAPASGAEPGAPASCWGSGGGGGRGRSSSGVPSSSCWVSGGGGGRGRSSSGAAAGEAGVSCWVIADGGGVPGGGPGRAASKSSPGAG

SEQ ID NO: 110134 - protein, 205 aa, Triticum aestivum
  unsure (1)..(205): unsure at all Xaa locations
  Clone ID: PAT_TA_4552.pep
TTASAAAAPTQPIWRSTRRIRRWGGLSRPYIPSRWPSCAEQLPSIWPAPMATVALPPSPAVFHLPGGPAGAWVFRLAARAVIPRIRVHRPSPLLDPSPSSSRCHIQGGGVCSTSXPPTRHCGFLPDARPTSGSVARSLVQSAARKHPLRPRRALAEPSTPACRPSPMPCCNAARCVPRPRTCVSLALDAAQYSCGCSLGARRRRR

SEQ ID NO: 110135 - protein, 349 aa, Triticum aestivum
  unsure (1)..(349): unsure at all Xaa locations
  Clone ID: PAT_TA_4553.pep
MENGSSKGDVPEDANAHCPGTQSDEAGKADSCAGCPNQQICATAPKGPDPDLVAIAERMATVKHKILVLSGKGGVGKSTFSAQLSFALAEMDHQVGLLDIDICGPSIPKMLGLEGQDIHQSNLGWSPIYVESNLGVMSIGFMLPNPDDAVIWRGPRKNRLIKQFLKDVDWGEIDYLXVVDAPPGTSDEHISIVQYXQATEVDGAIIVTTPQQVSLIDVRKEINFCKKVGVPVLGVVENMSGLRQAFTDLKFVKPGPAGETDATEWAMNYIKEKAPELLSVVACSEVFDSSKGGAEKMCHEMGVPFLGKVPMDPQLCKAAEEGRSCFADQRCSASAPALKSIIDKLIKTK

SEQ ID NO: 110136 - protein, 389 aa, Triticum aestivum
  unsure (1)..(389): unsure at all Xaa locations
  Clone ID: PAT_TA_4554.pep
GSKLCVLVKQFPCRVHGDATSSRQAARAGLERKRWGTAAAKATSRNGASNGGAAADANAQWPGTQSEGAGKADSCAGCPKQQICATAPKGPDPDLVAIAERRAAVKHRILVXSGKRRVVMSTFSAQPSVGLAEMDHQVGLLDIDICGPSIPKMLGLEGQDIHQSNLGWSPIYVESNLGVMSIGFMLPNPDDAVIWRGPRKNGLIKQFLKDVDWGEIDYLVVDAPPGTSDEHISIVQYLQATEVDGAIIVTTPQQVSLIDVRKEINFXCKKVGVPVLGVVENMSGLRQAFTDLKFVKPGLAGEIDATEWAMNYIKEKAPELLSVVASGEVFDSSKGGAENMCHEMGVPFLGEVPMDRQLCKAPQXGGWRQSDAAQRASAPALESLFSKLC

SEQ ID NO: 110137 - protein, 169 aa, Triticum aestivum
  Clone ID: PAT_TA_4555.pep
IPPPPPPPPPPPPPISPSVYNVMALRSLIRKMPAVGLRSTPMPPRMGPVHALSTAAGSRIMSDGAPGINGRAKIYSEDEIAERREAIKRLHAEIEKDRAVSERYLAEHRNVMEMLEQQSAAGEAAYNAAMRDISEARVSCMKTLKNVATACDVVAVACPMLIVLMMITT

SEQ ID NO: 110138 - protein, 280 aa, Triticum aestivum
  Clone ID: PAT_TA_4556.pep
MAASGEGASLPSPAGGEDSRRRRVSYFYEPTIGDYYYGQGHPMKPHRIRMAHSLVIHYGLHRLLELSRPFPASEADISRFHSDEYVSFLASATGNPTILDPRAVKRFNVGEDCPVFDGLFPFCQASAGGSIGAAVKLNRGDADITVNWAGGLHHAKKGEASGFCYVNDIVLAILELLKFHRRVLYVDIDVHHGDGVEEAFFTTNRVMTVSFHKYGDFFPGTGHITDVGAGEGKHYAVNVPLSDGIDDDTFRDLFQCIIKRVMEVYQPEVVVLQCGADSLA

SEQ ID NO: 110139 - protein, 155 aa, Triticum aestivum
  Clone ID: PAT_TA_4557.pep
MVVWRDSYLDLILVPLGLLLPALYHAWLWRAVRRRPLSTAFGVYSAARRLWAAGMMRDNDDKKGVLVVQSIRNVIMGSTLMATTSVLFCTGIAAVLSSTYSVKKPLSDAVFGAHGEYMMALNFLLPPLRFPLPFLCHTLTICFLNQASFLINTCL

SEQ ID NO: 110140 - protein, 187 aa, Triticum aestivum
  Clone ID: PAT_TA_4558.pep
LIATSGGLNQQRIGITDAVVVAWILNATLVVPELDHHSFWKDDSEFSDIFDTDWFISYLSKDVTVVKRIPYEVMISMDKLPWTMRTPRKSMPEFYIDEVLPILMRRRALQLTKFDYRLANDLDEELQKLRCRVNFHALRFKKPIQTLGKKLVRRLRVMSSRYVAIHLRFEPDMLAFSGCYYGGGEKE

SEQ ID NO: 110141 - protein, 112 aa, Triticum aestivum
  Clone ID: PAT_TA_4559.pep
MKTFLILALLAIVATTATTAVRVPVPQLQPQNPSQQQPQEQVPLVQQQQFPGQQQQFPPQQPYPQPQPFPSQQPYLQLQPFPQPQPFPPQLPYPQPQSFPPQQPYPQQQPQY

SEQ ID NO: 110142 - protein, 136 aa, Triticum aestivum
  unsure (1)..(136): unsure at all Xaa locations
  Clone ID: PAT_TA_4560.pep
MKVGXAETPVNSCLNLMLRVEIARRTPKNTLMLPFRSMSLSSASRLLRLRCLCLDLRAEIASCRVEISLSWPSTTPPLGRSELRFSSGSIIFTCPPMASFSMQRNQELLLLPSFLPQRSSICFILREETRVSALSL

SEQ ID NO: 110143 - protein, 196 aa, Triticum aestivum
  unsure (1)..(196): unsure at all Xaa locations
  Clone ID: PAT_TA_4561.pep
NCHKPLERHINDTPHTPQRGGPRQDALRRHRCHCSPTGIITHPKLRASNSDFVEDERQADPHSRGRAEHKKTHAEGNTAPILMKSSEEELCNVGAAXRPLNKPPAACHRCHRAPPPQLRLHRNKTTRGNPTDTXEEEPTIATVATPPTLLASAIVATEASTPKSTPATGPPCQRPAPKTKPSRGETTPRRRQRLIT

SEQ ID NO: 110144 - protein, 248 aa, Triticum aestivum
  Clone ID: PAT_TA_4562.pep
PKCSLSPDSRIQNSGSEESTDDETVDAKDNGFHDAENDVDQELDERILSGNLSESSARTGADLYDYQVDPGDSDAERFVTDKALEAKSDLKDAPHSHLNQNGTINVQRLPNGNDPTNLASSHESPLSMGEILSSLDAGVPLSGPGAEHSADRQSIKSNETQLHVKRSNIWGRSNARKSQQSEFADSSGEEELAIQRLEIAKNDLQIRIAKEASLERRKQALHERRSVLEQDVSRLQEQLQAERDLRAA

SEQ ID NO: 110145 - protein, 74 aa, Triticum aestivum
  Clone ID: PAT_TA_4563.pep
MMMGTDVCSSRMLSLPRYESGDEELTVLPRHTKVVVTGNNRTKSVLVGLQGVVKKAVGLGSWHWLVLKNGVEGE

SEQ ID NO: 110146 - protein, 83 aa, Triticum aestivum
  Clone ID: PAT_TA_4564.pep
LICSQHKSGCLCEPKFLCLPRKLIDHGCIHRYKDINSKDETTFREIHHVQNTNSERNRSTWLIMGLQQACQCSSMSCLEKIYT

SEQ ID NO: 110147 - protein, 187 aa, Triticum aestivum
  unsure (1)..(187): unsure at all Xaa locations
  Clone ID: PAT_TA_4565.pep
MANCDTYYVIPQMHTYKAVGLGGWHWLVLKNGVEVKLQRNALSVLEAPTGNEDDDEIDGGNNSFCGSFHMGDKDMNYSSIEYQKPTKPRVRHTRPWSSCTTTSSSRANNLHSTSKLRARVNLTKLGTPTLWRYWKHFNLVSMNPTPSXEQLFHGVQQHFQSQQLDELQVILGFIQTAKRLKTLYKNS

SEQ ID NO: 110148 - protein, 181 aa, Triticum aestivum
  unsure (1)..(181): unsure at all Xaa locations
  Clone ID: PAT_TA_4566.pep
MADPPSVAAIASPQPDQLGGSASAPQNSNPNSLLXSPQIPPSPTVSDLSVISSPQLDPAAAAAGGGSADFPPRPQQLQAPSPTQAVAGAGGYGQIQRSGSASRLAAASQLPQYSAATARMYGGQMSFSGGGAQLGQQQQLPPRAPARAQARPGGRLGQGCPAAAALARPLPPWIAHRGLPV

SEQ ID NO: 110149 - protein, 88 aa, Triticum aestivum
  Clone ID: PAT_TA_4567.pep
MSSRRSSRGSISDEEVNELMSKLQSLLPNSRRRGSSQASTTKLLKETCSYIKSLHREVDDLSDRLSDLMSTMDHNSAEAEIIRGILRS

SEQ ID NO: 110150 - protein, 67 aa, Triticum aestivum
  Clone ID: PAT_TA_4568.pep
PMEGGSSHHGSVLGFLFLVQFSRSSPFLILSCPVLGAVKFISLLNSLKCSIPKFLGGFCEIIVSKVH

SEQ ID NO: 110151 - protein, 235 aa, Triticum aestivum
  unsure (1)..(235): unsure at all Xaa locations
  Clone ID: PAT_TA_4569.pep
LSPFYKTTVKRLKKYDLPLVSHVNHNFSVHAIXXGEDIMSVFEHAVKVLSRREDLTDPSENGASIWQVDSDQMEHVFSTLVDHLQIQEAYNIFILNPKPIEKSTQYGYRKGFSESEINLLRENKTLQARILQSKRDPKLYLDIEKGVNKRPLYENHPLSSFSWTTTDNVDMGDWSKQCKEALSGFELLKAGKSKEDIIYDKAVQILHGAKDELHDVLESALMSSDLKGLHAECLT

SEQ ID NO: 110152 - protein, 325 aa, Triticum aestivum
  Clone ID: PAT_TA_4570.pep
MRRRRRRWPPSPIGRWRRRRGPTSSPLGRGRAPPFCPTGCGGTPPAARGAVTTYTRPGRLTMCSLSPHRFLCWVDYFSGVLLSDFSSTRGSPPPHFVPRPGDAPSPGPLRVSTHFPGRFRSVSISQGKMRFVHIDNDFHETIHDDDDSPWHQLPRITSPGQRHEGPQKITIWTLNSDKFSWEQHAMINLDGLWAQRCYKALDIQQRLPEFPVVSVDDPDVLCCLLREKEFGGKGWMSVIDMKLAKLQACTQYINRRSYCAECKDAGCAECVDDKNDFPNMPLLPTVFSSKHLERPTGVALDNDKVATRLSSKSARFVPKRRKCAA

SEQ ID NO: 110153 - protein, 155 aa, Triticum aestivum
  unsure (1)..(155): unsure at all Xaa locations
  Clone ID: PAT_TA_4571.pep
MIDCPRLLLAAASSAPGPSSAACRRFTTGCPTFSFSCRSRLPSXLCNLHPLGRGASRASWMSRRPSNGPCXDFYALRKDVELAVKRVNEVRQDAGLEQLLEEIASLENKSGDSTLWDDPSKAQELLVALTELKEKVKLLNDFKSQVEEADTIVQL

SEQ ID NO: 110154 - protein, 109 aa, Triticum aestivum
  unsure (1)..(109): unsure at all Xaa locations
  Clone ID: PAT_TA_4572.pep
QEYNVVAMVVLLGPKLKHIQDQMQDEVKNMMSVQLRPPTSGGGRYAARXHRPYNPQSPPLVASCSPFGRTGTGMVARIVAVSTESVYTFLRHHLAALEPFLGVAPYSSS

SEQ ID NO: 110155 - protein, 148 aa, Triticum aestivum
  Clone ID: PAT_TA_4573.pep
VVNLVMSFLVVILLYVSVCRCGGVHLRAPLGAPRGLVGCRRFSCLEGIGSTRISRVTAAHSTGTCSSLSLSWKYISSEKVPGGGRGPGLRTPCASSLLLKSLVAGMMLDQATRALDGSCSGAGLAVCSVQSCSSALACVHFMFFPYFS

SEQ ID NO: 110156 - protein, 115 aa, Triticum aestivum
  Clone ID: PAT_TA_4574.pep
TGWWRSSSSCHQRLASTPLWTGRPEPLASRPATETRIRTDRRRWPSTGSPSGMSGSSDAAVVDVDAVAPSAPRRPAAAAPHPWPGPCVRPWPPSRAPGPCRRGVLAAHRHSPAPR

SEQ ID NO: 110157 - protein, 124 aa, Triticum aestivum
  Clone ID: PAT_TA_4575.pep
MGGKCPHRKVKKRRLNCKQVRRGKFLVKADDAVYDELVKLADQGKDSEGKALPVDEDLPGMGQFYCLHCDRYFADETVKEDHYRSKRHKKRVKQLSGPAPHTQIDADLAGGMGMPDNGLKLMSS

SEQ ID NO: 110158 - protein, 164 aa, Triticum aestivum
  Clone ID: PAT_TA_4576.pep
ARLHPTPPRPPPPPPPPGAMALRSPSSTSRRNLGPRYSPPADSLPPTSQAGSGNGARAGVAMKVKEAEHMLANLEEEGVEIDGNIASIINDEIARIKAEAEREKIINVLTRNGRMVLLTIASAAAGLALAAAAVGRALGAQLAMIWGQPERSACRAPLLWLRKT

SEQ ID NO: 110159 - protein, 72 aa, Triticum aestivum
  Clone ID: PAT_TA_4577.pep
LWRPDIISVWSSGDGDQTSLSNFIPCVFSHEFRTSNTEAHKLAKHALILGTGRHVWLGHLGDLIFVHVNVTV

SEQ ID NO: 110160 - protein, 102 aa, Triticum aestivum
  Clone ID: PAT_TA_4578.pep
DCCYTAKQELLQHPSKSTPLASASCPTESLQGVSTPCSLGEDDVPQISGMARTFDVSGLARTFDVAGLARVFDVPLEGEGFCASSRALFSDSVLTDLSTHSN

SEQ ID NO: 110161 - protein, 53 aa, Triticum aestivum
  Clone ID: PAT_TA_4579.pep
LWQKKWEDTAVKQKEKKSHKLRSSEYLHLVMLLPSFSKETLISTRGNVRARLQ

SEQ ID NO: 110162 - protein, 433 aa, Triticum aestivum
  unsure (1)..(433): unsure at all Xaa locations
  Clone ID: PAT_TA_4580.pep
MGVPAEDMRDFHHERCLRKSDTEVEKDEHSKYKIPAAWAEEXQEKGKDIQGITWARGXLKLKRDKLQTDQXEKYKIYENIPNSGEAAAKECKPTVKGGMYYEFRQNTRSVKSTILHFQLXRNLVWATSKHDVYLMSHYSVLHWSALSGVDTELMNVQGHVAPREKHPGSLLEGFSQTQVSTLAVKDNLLVAGGFQGELICKHLDREGISFCCRTTYDDNAITNAVEIFNTASGAVHFMASNNDSGVRDYDMERFQLCKHFQFDWPVNHTSLSPDGKLVVIVGDDPNGLLIDANSGKTLHSMKGHHDFSFASAWSPDGRTFATGNQDKTCRIWDARNLSKAVHVLKGNLGAIRSIRFTSDGQFLSMAEPADFVHIFDVKSDYNRRQELDFFGEISGMSFSPDTDALFVGVWDRTYGSLLQFGRLYNNWYHDPLL

SEQ ID NO: 110163 - protein, 159 aa, Triticum aestivum
  Clone ID: PAT_TA_4581.pep
FAAAPAAGVFASARPSVALRRRGSSRGASSSSSRAGAGRVRLVRPLPPPRAVGGDGGGDLPALDKWDMMELEFGRFLGEDPKLTLAKILLKKSDPDASSLDVEKLVASKKDTLDVILKEFMEANKQDKTATAGEAISAPMKDKQPLGVSRPALSKPKLD

SEQ ID NO: 110164 - protein, 437 aa, Triticum aestivum
  unsure (1)..(437): unsure at all Xaa locations
  Clone ID: PAT_TA_4582.pep
VERLIPRSLQXFPDSSFLGNPXICGPPLDNCSFPTPTPSPELPSTPSSPSPVHHDRKLSIGFIIAVAVGGFAVLMLIVVVLCVCLSKRKGKKEAGVDYKGTGVRSDKPKQEFSSGVQTAEKNKLVFLDGCTYNFDLEDLLRASAEVLGKGSYGTAYKAILEDGTXVVVKRLKDVVAGKREFEQQMELVGRLGKHSNLVPLRAYYYSKDEKLVVYDYIATGSFSGMLHGIRGVAEKTPLDWNTRVKIILGTAYGIAHIHSEGGAKLTHGNIKSTNVLVGQDQNAYVSDYGLSSLMNAPVSASRVVVGYRAPETIENRKSTQKSDVYCFGVLLMEMLTGKAPLQSQGNDDVVDLPRWVHSVVREEWTAEVFDIELMKHQNIEEELVQMLQVAMACTSAPPERRPAMEEVIRMIEGLRHSASESRASSDERFRESNPPSV

SEQ ID NO: 110165 - protein, 203 aa, Triticum aestivum
  Clone ID: PAT_TA_4583.pep
MFLVRRRLLSTAAAVAAARGPPPVRVALTDSAGRGVFATRPIASGEVLHSAHPLVTHPSRSLFHEVCYRCLKRKAGKSDDLKGGCYFCSDACREHAEGFHGIEKKADWSLLDDHCSSRGLKYPYMVKRLACMVISGDVGADCLDILQPAQLHQGTLIEMDEEFELLKSTFRKAGFQEELTTFLTKQWYINVLARIRVNAFRIE

SEQ ID NO: 110166 - protein, 101 aa, Triticum aestivum
  Clone ID: PAT_TA_4584.pep
CNGGMSLKVLLGSLCLLVMRTGLFVNMWLVAAFSSSSCPYKIIISFRGSSQFIYLLFGRLRPLPRSIYFCMSSWRFAQNKIMRRDDLRKRNLKKKKKKKKK

SEQ ID NO: 110167 - protein, 167 aa, Triticum aestivum
  unsure (1)..(167): unsure at all Xaa locations
  Clone ID: PAT_TA_4585.pep
PPPPXXLRVRCDAXXTRRIWASLPSRSSRRALTFPVLPCAPRPLLGPAASGRPGRRRHAERRRPNWIHTLLHCLLSSHQSSARIGLAGSRRRQILAWPPAERSSTLAPLTVDGGRNDGAVHVAAPMWCEQSNRLAERLQGCSTPCLEQHAWVVAETSEELQQKAVIQ

SEQ ID NO: 110168 - protein, 179 aa, Triticum aestivum
  unsure (1)..(179): unsure at all Xaa locations
  Clone ID: PAT_TA_4586.pep
YGDSHTHFFTSWTRDTYHTGCYDMDCPGFQLVKGSKIAPGGTIQPVSHVHGVRQKITIKVFREKSTGNWWIHYGFNKAPTPVGYYPAKLFDKLSKKATQISIGSVVGGESVYPIXPMGSGFLPSDKAALITDISLIGEDGRMTPFTVNTDRLQSKSSCYSISPIQGAKCSYGGPGGCSR

SEQ ID NO: 110169 - protein, 146 aa, Triticum aestivum
  Clone ID: PAT_TA_4587.pep
DRHVALFECEWYDLESNKPVRIDDDFVSVNTGSKWYQNDSFVLASQVSQVVCVRDTKMRGDWLVVQKAPHRHLFDPEVWNQVNEDDASDDIAFQEEEATNVSIDETFEGNISCRHDVAPEIVTDPKELASLKESHVSQDNSEEEPE

SEQ ID NO: 110170 - protein, 280 aa, Triticum aestivum
  Clone ID: PAT_TA_4588.pep
MAAENYWRYADARQQQAMVAAAAAAAGMAPAATVAQAATAAGGMQQHQHQHQQAAMAQQQQQQQAAAPSLKRARPDYGDGPGGQEMAGYYPRENAGYHSLRDNEAIGASYDRYLRNGMPSVAANEPSRAVVGAMGGAAMVGGGMSGYPVDDRRMMGVVGMDSRAMGYGARPEPPLPPDASNTLYIEGLPANCTRREVSHIFRPFVGFREVRLVNKESRHPGGDPHVLCFVDFDSPAQATISLEALQGYKFDEHDRESAHLRLQFSRFPGPRSAGGPRGRR

SEQ ID NO: 110171 - protein, 176 aa, Triticum aestivum
  Clone ID: PAT_TA_4589.pep
RRPLVRHPHLHVVLGYPTRTQTAPRPHVARRLTCLRGRTMGRGELLEGTPTRGSSRPWVAAAAAAAGMAPAATFARTATAAGSMQHPTAPSTRKQPGRDVATACQQTAIVMQANRCPALLMGSVQRDFSTETQDQLVEILMSCDSLSLISLPDNESNWAPCKVIIWTDTHREASHI

SEQ ID NO: 110172 - protein, 186 aa, Triticum aestivum
  Clone ID: PAT_TA_4590.pep
MGLSSSLAPVASALLFLCCFTARNAAAASGDGGGGLRLNFYSESCPRAEQIVKEQVRRLYEEHGNTAVSWLRALFHDCTVKSCDASLLLETDAATGLVSEQASPRSFGMRNFKYVGAIKSALERECPGTVSCADLLALAARDGAAMLGGPTAIPMRTGRRDATESQYGEVERYVPNHTHGVGGAVP

SEQ ID NO: 110173 - protein, 290 aa, Triticum aestivum
  unsure (1)..(290): unsure at all Xaa locations
  Clone ID: PAT_TA_4591.pep
MRGRGRREYGETGETALSWLWDHCPVCTGKSWVASVRLDTXRGHRPRIQRPPPSVGLASANVRWGAIKSGPGTRGSRGTFSCADVLALAARDGAAMLGGPAAIPMRTGRRDATESRYGEVERYVPNHNDTVSAVLSRFAAMGLDAEAVVALLGAHSVGRVHCNNLVARLYPAVDGGIEPAYGAYLRGRCPTADAREDTRDVAYARNDRATPMVLDNMYHKNLLKGRGLLLVDQRLASDPRTXAPFVRRMAADNGYFGETFAAALVRMSENGPLTGGQGEVRKDCRFVNAK

SEQ ID NO: 110174 - protein, 205 aa, Triticum aestivum
  unsure (1)..(205): unsure at all Xaa locations
  Clone ID: PAT_TA_4592.pep
ARASLKPTLSQRSGFGAVRMAAAAARDLAALDAETLALLGGGPDMAPVAVCGEWETFKENVRPLKRGRNVGLLNQALKAHTDPAQRAALLAXRRRMIEATEEYQGEDPXQPWVECIKWVQESFPAGGEFSGLVVIYEQCVRAFWHDERYKDDLRYLKVWLEYAGNCSDAEVIFECRRDLXSGEGHAVFYIRYASLMESKNKLKXA

SEQ ID NO: 110175 - protein, 91 aa, Triticum aestivum
  Clone ID: PAT_TA_4593.pep
IQSSPYQHGNLQSFPPIMRTRCMFLLVLAVTLVVLSPDVAVKVTAGNCRPIIDKGDCNLDVCKSRCNEWNGHSVSHVATCVPDGCQCYVCF

SEQ ID NO: 110176 - protein, 89 aa, Triticum aestivum
  Clone ID: PAT_TA_4594.pep
VVTQKDSRFLCSDPFIAFAHVSSTEANAPWEPTRRMRREEKRSLAAMVCALAWLGLCCGWLRLVHWQTLRNFMPLCSPPSIQNYLSRNE

SEQ ID NO: 110177 - protein, 242 aa, Triticum aestivum
  Clone ID: PAT_TA_4595.pep
MDPSGAFARSSSNVSLASLVRSGSGGSGSSRGRGGAGGSRRMVRRVLRGVITFIFAIAGLFLGAVTGGLIGLATESGLFRGTGIGAITGALVSIEVVDSSIRLWRSRRSGIWSILYVLNVIYSLLTGRLVREKVDPAVQRVVRSQMNAVDSSQFREAPDLFEIEGTNGMPRASIEKLPEGTITEEYNRNAVGDLSGCSVCLQDFQIGEKVRSLPDCLHVFHVPCIDGWLIKHGSCPLCRRKL

SEQ ID NO: 110178 - protein, 142 aa, Triticum aestivum
  unsure (1)..(142): unsure at all Xaa locations
  Clone ID: PAT_TA_4596.pep
QXIRHEGSSVRRRIGGRRDLDAARQTSELIMPPTLFCAARWSQTMSPCLPLALLTIAVNPVMRPWLISQSYYTFPPPGSSCSGPSLHLEGLGAVVTLMNNTPIRDHSDLGEEIKRINNPWWFSSSSAQVQSATMMTSSQGSY

SEQ ID NO: 110179 - protein, 219 aa, Triticum aestivum
  Clone ID: PAT_TA_4597.pep
ESMANSDNLLLENCMPSAQTFDSSSSTRNSAVTLAEVPGNSGMPYMPTSSPRVRPRVRSSPPEMQRPVLDTNSSTQLPNMSAVPSVPKAMTPGLSDISIPGFPDLHDLITEDAINIPVENFTMPGPECIFPLPDEGSDDSVPMDPIDTDETDDTQKLPGIIDSFWEQFLCASPLSIDNDEVDSGLLDTREAQEENGWTRTENLANLTEQMGLLSSNHRG

SEQ ID NO: 110180 - protein, 244 aa, Triticum aestivum
  Clone ID: PAT_TA_4598.pep
RPPVPSSPSHSDRDPPLGTALCYPAPVMRAQGPPLPPPCPRAACSPSGTSARREALQGGLVEGRAVCSVFVTMLMRVELPLRHIWPPRYQTLQPPFSLGWSRAHLTLVFSPPWIRLCAWMRKESLQEVLVETEVECGIDIHGVIYNCLYGFLGLHVSLPASLTQKGLQRCVVMALPLANIDAHRSDLWLWRRSFGWSTTVSGFSAGSNYVTSCWLAYIYFCIWHFWLADVVMLSTGTQYLRWCL

SEQ ID NO: 110181 - protein, 220 aa, Triticum aestivum
  Clone ID: PAT_TA_4599.pep
MARFQESGPDLLNSGSDTRMMAEARLPKARKPYMITKQREKWTEEEHKLFLEAMQLHGRAWRRIQEHIGTKTAVQIRSHAQKFFSKVTRDSSGDSGGSSSGDGPPIQIPPPRPKRKSVHPYPCNLRSAQPGKHAHAALLRVDKPQLSMCEQGNGSPTSVVTTSQIGLGSESFDSDTSTIDVEERCPTPSTGTAEVAVQAPPTNDAKKSKGSSSTSEEVGL

SEQ ID NO: 110182 - protein, 176 aa, Triticum aestivum
  Clone ID: PAT_TA_4600.pep
ITLLTVYQAWKAKQFSGPWCFENFLQITSLRRAQDVRKQLLEIMDRYRLDVVSAGNDLTKVRRAIAAGFFFNSAKKDPQGGYRTLADHQQVYIHPSSALFHQQPEWVIYNEIVMTTKEYMREVTAINPAWLVELAPRFYRSMDSTKMSKRKRQERIEPLYDRYNEPNSWRLSKRRG

SEQ ID NO: 110183 - protein, 125 aa, Triticum aestivum
  Clone ID: PAT_TA_4601.pep
ARITSFAHFGLKVLPKLLALSPASLGKFRKVSPAMGTETVLRKLPELLQDVLRKVSPPMETETVVRNLPELPQDVLMDIFSLLGDTRPHACGLCPLLLGAPRLPASAASLSCTNGLKRLASSYTS

SEQ ID NO: 110184 - protein, 257 aa, Triticum aestivum
  unsure (1)..(257): unsure at all Xaa locations
  Clone ID: PAT_TA_4602.pep
MALSLRAAASLAAPPAHLRPRRRATSMVRATVSPPPALDSRRRPQNVSGEFFVDHRCIDCATCRWMAPEVFNRVDDQSAVAAQPTSGEIRTKALQALLSCPTGSIHTDKPTKDILQVQNTFPLPIDDDLPGVYLCGYHSENSYGATSYLIVHPEGNIMIDSPRYTPKLANQLEKLGGARYMFLTHIDDVADHRKWAERLKCERIIHSGDVEDITADVEWKLTGNGPWNIGTDFELXHTPXHTEGSVCLXYKPLKALF

SEQ ID NO: 110185 - protein, 315 aa, Triticum aestivum
  unsure (1)..(315): unsure at all Xaa locations
  Clone ID: PAT_TA_4603.pep
MALSLRAAASLASPPSGPRPGRRAASVVRATASPAALGNRNRRREQNVSGEFFVDHRCIDCATCRWMAPEVFKRVDGMSAVAAQPSSEEERTKALQALLSCPTASIHTDKPAKDILQVQNTFPLPIDDDLPGVYLCGYHSESSYGATSYLIVHPEGNIMVDSPRYTPKLVDKIEKLGGARYMFLTHIDDVADHRKWAERLKCERIIHSGDVVDITADVEWKLTGSGPWNIGNDFELIHTPGHTEGSVCLLYKPLKALFTGDHVAKSEDSDELNLFRMYSKQSVXLQLDSMRKLLXILDFEWYLPGHGYRIRYEDV

SEQ ID NO: 110186 - protein, 288 aa, Triticum aestivum
  unsure (1)..(288): unsure at all Xaa locations
  Clone ID: PAT_TA_4604.pep
AAFISNCGARNFRLQALEMLESLDVKIDSYGSCHRNRDGKVDKVETLKRYKFSLAFENSGEEDYVTEKFFQSLVTGAIPVVVGAPNIQEFSPGEGAILHIKELDDVISVAKTMKHIASNPDAFNQSLRWKYDGPSDSFKALIDMAAVHSSCRLCIHIATKXHEKEERTPKFMNRSCSCSSKRGTVYHLFVRERGRFKTESIYLRSDQLTLGALESAVHGKFRSLKHVPVWKDERPSSIRGGDELKVYKIYPIGLTERQALYKFQFSDDAEVARYIKGHPCAKLEVIFV

SEQ ID NO: 110187 - protein, 108 aa, Triticum aestivum
  Clone ID: PAT_TA_4605.pep
GPPASSSATGVVAAVVCATVNPTPGWKSCEDGPKIDELAKWALAEMKQGLQLSSVLRCEEQGLGAQGIIYRILLNALDRTGGTGHYTTDVYDEAATKVRKLLYFGTAP

SEQ ID NO: 110188 - protein, 867 aa, Triticum aestivum
  unsure (1)..(867): unsure at all Xaa locations
  Clone ID: PAT_TA_4606.pep
HASXXTWSSRGPTADGDLGVSIXAPGGAVAPVPTWTLQSRMLMNGTSMSSPSACGGVALLVSAMKAEGIPVSPYTVRKAIENTASSISDAPEEKLTTGHGLLQVDRAYEYARQAKKLPLVSYRISISQVGKSIPKLRGIYLRGSNSCQQTSEWTVQLNPKFHDDASNLEQLVPFEECLQLHSTDSSVINIPEYILLTNNGRSFNIVLQSCLISVXGLHYXEVYGMDCRAPWRGPIFRVPITIIKPIALSGEPPVLSLSKLYFKSGHIERRFINVPIGASWAEVTMRTSAFDTPRRFFLDTVQMCPLKRPIKWESVVTFSSPSIKNFSFPVEGGLTLELSIAQFWSSGNASHEPTCVDFEIVFHGIFIDQKVIALDGSESPMRIVARSLLASERLVPVATLNKIKIPYRPVDSNFCPLPTSRDRLPSGKQIIALTLTYKFKLEDGAEVKPHLPLLNNRIYDNKFESQFYRISDSNKCVYSSGDVYPSYVKLPKGEYTLQLYIRHENVQILEKLKQLVLFIERKLEKKDCIQLSFYSEPDGPMTGNAAFKSSVLVPGEPEAFYVGPPSREKLPKGAPPGSVLVGSITYGIVSSFNKKDEQHAPASYSILCIIPPSKVDDTKEKGVSVETEKSISERLNDEVRDTKIKFLSGLKQDNEDNKSAWTELVASLKSEYPKYTPLLAKILECVHQESTSDDKISHHKEVIVAADEVVDSIDKEQLAKLLVLKPDPEDEESQKTKKKMEETRDQLADALYQKGLALAEIESLKPDESTEASAKDVFEENYKELIKWVDAKSTKYGTLTVLRERRCGRCGTALKVLXDMIQEDXEQPKKKLYDLKIQLIEEIGWAHVSAYEKQWMHVRFPPSLPPF

SEQ ID NO: 110189 - protein, 181 aa, Triticum aestivum
  unsure (1)..(181): unsure at all Xaa locations
  Clone ID: PAT_TA_4607.pep
YAGAAAFLLPYAASLGLRTATLHFSPCKSKPLLLLTCXGTDPSLPSILXFNSHLDSVPAEPEHWIHPPYAAHRDPATGRVYARGAQDDKCLPVQYLEAIRGLQAAGFAPARTVHVSLVPDEEIGGEDGHEKFVQSEEFRALNVGFMLDEGQASLTDVYRVFYADRLVWKLIVKATGAPGHW

SEQ ID NO: 110190 - protein, 172 aa, Triticum aestivum
  Clone ID: PAT_TA_4608.pep
MNNTLPVTAPTAHAPMPSPAPKLGGANIASRWRELQGSDSWVGLLDPLDYDLRQSIISYGELASAAHDVFNLEKRSPHAGFCLYSRDHLLAASTVTHPEYYKVTKFLYATCGGSTASRLATSVPTVTNALFVQPLGKAEGSPSSDGFGRGAAATNEGVTALGRRDIVVVWRG

SEQ ID NO: 110191 - protein, 548 aa, Triticum aestivum
  unsure (1)..(548): unsure at all Xaa locations
  Clone ID: PAT_TA_4609.pep
FLLLSWRWPCVLLSQRGHLPAHHVLRMLSATVVRLAPLFVEMFPVPRPLPALLPVGVWAVAPSRPSAGRLAGIPSRPAPLRRAGLPPRATRGPPPGMPPSSVKQQHRRPLHFDDDTTPTEPQKPKVPALEKHLVGQLSKEEQNALEAKFKEASDADKKVQELEKEILDSREKTDYYRTKMQELILYKSRCDNRFNEVSESMSADKREAKKLEIYNSIVKLQKGDGDDEKLQERANQIQSELEELVKSLNEQCKRYGLRAKPTTLVELPFGWQPGIQETAAVWDEEWDRFAEDGFSIIKELTVEVEPPAVKESHPAVEDGKVSSNGVSTATTTEKEDNKSDKTAAAEQAVEPEATGSNGKAESAKNPPVSPHLIPCSAGDKANNRHSWGPSFDHGDDNDSLWDFGDKDGENXDSDLFFGPGGLPPIRTGGSTSASAFGKEQKPMFDSVPGTPMEKPFFDSVPGTPLQKSVFDYSVPSTPMQNSSFDYSVPSTPMQKSLFDSSVPSTPMQRSLFDSSVPSTPMQKSLFDSSVPSTPMGNSFYDSFPSTPM

SEQ ID NO: 110192 - protein, 325 aa, Triticum aestivum
  unsure (1)..(325): unsure at all Xaa locations
  Clone ID: PAT_TA_4610.pep
HASGALERHLPPSLLEADRDVKLHFMRDILARYWPHGERNKVHRHKEYRQKIVHLYKPLHQELYSMHPSAFFLPTXLEAVRTNTEESIASIMTEPIAGVFSFAMLQPNFCDMLLEEVENFEKWVHAMKFKIMRPNTMNKYGAVLDDFGLEAMLNQFMEEFIAPISKVFYPEVGGGTLDSHHAFVVEYGKDRDVELGFHVDDSEVTLNVCLGKQFSGGELYFRGIRCENHVNSETQHEEMYDYSHVPGRAVLHRGRHRHGARPTSSGLRMNLLLWCRSSVFREMKKYQMDFSSWCGECQREKRERQIQCVKATKLXFLRGAGGAMI

SEQ ID NO: 110193 - protein, 176 aa, Triticum aestivum
  Clone ID: PAT_TA_4611.pep
KTNMAVMILRYFNVIGSDPEGRLGEAPRPELREHGRISGACFDAASGIIPGLKVRGTDYPTADGTCVRDYIDVTDLVDAHVKALGKAEPNKVGIYNVGTGKGRSVKEFVEACKKATGATIKVDYLDRRPGDYAEVYSNPAKIRDELNWTAQHTDLRESLATAWKWQKAHPGGYGSA

SEQ ID NO: 110194 - protein, 136 aa, Triticum aestivum
  unsure (1)..(136): unsure at all Xaa locations
  Clone ID: PAT_TA_4612.pep
SRRVCHGSRRGPRSDEDEGQQGGMANGNGVAPPPSRMAGRPLGAAAYSDRRLRLNPNTEHKPQDYTDVRGEVXAPAVYRRPGAGTSPPSLLRRPDRPMCKLQLHCRTYSRRYWPHGRAETMVYRHKVYRQYESPPL

SEQ ID NO: 110195 - protein, 103 aa, Triticum aestivum
  Clone ID: PAT_TA_4613.pep
PTLTTSAPPSLTELCSLTETLQTTISLLRNLNVRTWDDAVFLSLAHRQHHGMETLCAGHQNRREKLTACVCVYHIRRSVLVYEEASAELCCRVRGINTIFNEH

SEQ ID NO: 110196 - protein, 71 aa, Triticum aestivum
  Clone ID: PAT_TA_4614.pep
VCGCSGKPLKENSMSCRCECPAMIRLLRTDDNGWYITEHRVEHNHSLSSILVHGHGHGHNQTTMGASGGVE

SEQ ID NO: 110197 - protein, 255 aa, Triticum aestivum
  unsure (1)..(255): unsure at all Xaa locations
  Clone ID: PAT_TA_4615.pep
GSAPRTVNPSPPASTVSSHGHQGTQPHSPLITPASGSTRGSEPDDDDLAGVNKRTHARFLVTHAEAGLIMGGGGSTIAAIEARSGARVRLSRHDQLLPGTDRRVVLVYGLLSQVMEAMELLLQRLLLYXVQGDQASDSEATLVLVVPQPCCGALIGKGGSVIKSFTEASETAIQVSPQNSSYGFNDRLVTITGPLDNRLRAVFLIIFELLEDIRYLFPCAAAMPNTPMRSPVNKDAQESVTISVADEHMGAVIGR

SEQ ID NO: 110198 - protein, 122 aa, Triticum aestivum
  Clone ID: PAT_TA_4616.pep
MNGWMDECGSKNRGMLAFLDRRICQSKERKREKKRNEKKKNVISVLSAVYAGKNLSGGKNVWTLQKCCLVQKNERRKKECPITSTKEESKKMNQKLPGTLCRASSPAASPNTSMICFLLQER

SEQ ID NO: 110199 - protein, 141 aa, Triticum aestivum
  Clone ID: PAT_TA_4617.pep
TPVLGLCTVLLAPRSAHVLLFFGRLLACLPSGRGVRAPFRTPPARSRTSSSALGGSRAFRVLGGCARGGGRAGGRYPSAPGSVPPHCGMPDARSEALVSCLLLRTAGYLGAVHASTEVLALAARSLRVSPPRAVASTRPCP

SEQ ID NO: 110200 - protein, 238 aa, Triticum aestivum
  Clone ID: PAT_TA_4618.pep
MEARPRPSGVRRVTAKKRPRPDASSNSARKLQRREIAAFPERTFAASTTRERFRNIQLQEEFDTYDPKENSSLLPYLRKRSEIIEIVGARDIIFALSQLGVCAAFSRVTNQRICFLNGSPDEVIRSLFYNKNNDSLITVSVYGSENFSALRCRTTRIEYIRRGKPDAGFPLFETESLRWPGFVEFDDVNGKVLTYSAQDSTYKVFDLKNYTLLYTISDKDVQEIKINPGIMLLIYSRK

SEQ ID NO: 110201 - protein, 227 aa, Triticum aestivum
  unsure (1)..(227): unsure at all Xaa locations
  Clone ID: PAT_TA_4619.pep
MAASKLDRTPSIRERVEDTLHAHRNELVALLSKYVXKGKGILQPHRILDTLDEVQVSGGXAFAEGPFLDVLRSSQEAIVLPPFVAIAVRXPRPGVWEYVPRSTWHELNVEQLSVSEYLRFKEELVDGQHNDPFVLELDFEPFTALIPRPSRSSSIGNGVQFLNRHLSSILFRNRDCLEPLLDFLREHRHKGHVMMLNDRIQSVGRLQSVLTKAEEHLSKLPAETPYL

SEQ ID NO: 110202 - protein, 228 aa, Triticum aestivum
  unsure (1)..(228): unsure at all Xaa locations
  Clone ID: PAT_TA_4620.pep
MMAGVTNGNSHSDIQRKYQVVVAATREMGIGKDGALPWKLPSDLKFFKDLTMATADPSKKNAVIMGRKTWESIPTKFRPLPGRLNVILTRSGSSDYATVENVVTCGSLDSSLELLASAPYSSTIEKAFLIGGGQVLRESLNASACEAIHLTDIESTIECDTFIPPIDPLVFHPWYSSSPVVENNIXHSFATFVRVRKSAEEANDSNLSELTSNDAKKKKFEIQIFSFL

SEQ ID NO: 110203 - protein, 236 aa, Triticum aestivum
  unsure (1)..(236): unsure at all Xaa locations
  Clone ID: PAT_TA_4621.pep
MNVRASAMLPSLKILAVKVRFSHDKEVKXLHTLLRCFPRLETLHIMFIQSTSPDGVHCAEFWESQSSCDCLESHLKTLVLHGFQGLDCELLFLGYILKNGKVLKTLGMVCRGSDDVVSEGGRMTCSVGEGNAPSGGSSGSDDVVVEGGPVSGSAGEGNVSSGGSTGSHDVVMEGGPVPGSVSEGDAPSGGGTGSDVIYVCPASPSWSFQNAIDLSVEDPFCVLRRARAWRASRAEA

SEQ ID NO: 110204 - protein, 138 aa, Triticum aestivum
  Clone ID: PAT_TA_4622.pep
LAAAVACQVNTWVEKLTSGLIKEILPDGSVDSTTRLVLGNALYFKGAWTEEFDASKTKDGEFHLLDGSSVQASFMSSTNEQYLSSHDNLKVLKLPYRQGGDMRQFSMYILLPEANDGLWNLAGKVSSEPEFLEKHTPT

SEQ ID NO: 110205 - protein, 189 aa, Triticum aestivum
  Clone ID: PAT_TA_4623.pep
ELARAPAPRPWTRPIGDVSVASSVERVFESQPPLPGTWGQVTLRSMAISVVLGTVFGFVGLRIMMKAGIIQALNLPINALSFFFLKWLINLQRAAGFTTLPFSRQENVLILTTVTTCLNTAICGGFANYVVGMTSGVAKSLGENPDPRDIVDHIPTGRWMLFLFLIGMVGVTASVPLNQVIHHLHILAE

SEQ ID NO: 110206 - protein, 349 aa, Triticum aestivum
  unsure (1)..(349): unsure at all Xaa locations
  Clone ID: PAT_TA_4624.pep
ALVAGARRAAEAGEIVELRELLCAYSNAVVTRATTGAAGATAEKLKQLLGNSAAFMSGLQAEDVLPGAAAKVVRWATGLEKRLDAELELWDKFLSEAIAEHLEKKKCDGSAGDEDFLDVLLRLREEGAAGLELTDDRIKSIIKDIIAAGTDTSSLTLEWAMAELVGNPRAMAKLQDEVTRATEGKPTIEGDDLRRMEYLKAVLKEVLRLHPAAPLLVPHQSTTTAVVQGYEIPAETPLFVNAWAIGRDPXAWGATAEESRPERFLGRRRRXGVDLRGNDYQLLPFGAGRRLCPGIGFAMPVLEIALSSLVRHFDWELPARARLDMSEAPGLTTPPLASLRLAPKCRGQQ

SEQ ID NO: 110207 - protein, 225 aa, Triticum aestivum
  unsure (1)..(225): unsure at all Xaa locations
  Clone ID: PAT_TA_4625.pep
PRGGRVPPPPSRPHRRPPHPHPSSPRAPAHPRGRRPSSSAAHPTRRSSLAMSTMKGQTRMDRPRTRPHGLTEQKGQELSXAFHLFDNADSGTSDAXKXNLSMWTLRFEITDGXIKKMIAEVDKNGNXSIFYEEFEHRMGARXIGEGDTKEDRTNALDRNEKISNGNIPXLIIIRIAKHLGEKFPRREKNGVDEIDVNVHDAVQKSDGERYFGEFARVMKKTWFGY

SEQ ID NO: 110208 - protein, 257 aa, Triticum aestivum
  Clone ID: PAT_TA_4626.pep
MASRFLSVAALLVAAAACVLANTQSPINIKSSEAVDAELPALSFKHYRSSQSSYYLANTGHGCQITLKNWLYNPKVKGGPLPRTFVLEQVHFHWGASDGVGSEHYLNGNPSSMEVHLVHWNSKYASYSEASTKADGLAVIGFFIEGIDNYRNPDFQKLVNAIPKIVAEESEKVEVNADLLAWVVPYLEASGYYTYDGSLTTSPYSENVLWIVYENPIPIGKAQIAPFRAIENHESEQLTTNFRQLQNADGVEVRYVA

SEQ ID NO: 110209 - protein, 130 aa, Triticum aestivum
  Clone ID: PAT_TA_4627.pep
IYYTRIQPASQPTIGGASISSLTCPKQRSCRLHRPSSSSFSLSFFLPCFAPCRARWRRRGVFRCRRSRSGTTTTTTTSRRRRRRGTPCRSRRPAATCGSSTRRPRTSPRPRSSKRSGGGRRTATACPGSV

SEQ ID NO: 110210 - protein, 91 aa, Triticum aestivum
  Clone ID: PAT_TA_4628.pep
LLNPSRTYIQRFLRVCFFLQSIFFRAVESTLTLIRSAAAPESSQSSPGPFQYAVPGCATMEMPTVREHNTPDPAAHHQVQLLLNPVKGDLL

SEQ ID NO: 110211 - protein, 328 aa, Triticum aestivum
  Clone ID: PAT_TA_4629.pep
MEWTAPKSTPLSPPHLLWDWGDAAAPGSSGEAAGRRGKEKRARGEAAGGGGGGGGGGGVRCQVEGCGVELRDAKEYHRKHRVCEAHTKFPRVVVAGQERRFCQQCSRFHALSEFDQKKRSCRRRLSDHNARRRKPQPDAFSFAPARLPSSLVFDDRRQISFVWNKDPLSHARPFPCSPWDSPSDFKLPQVKEIREVSINGQVHFDKSHLPNAVPALSHDIAELLPMKGPDASVTASKLGGAPDLQHALSLLSASSCGLPDPVQQASCLVQFTGASQNSRGPSPHGGSPPSASCAEGQPMVPSPQFVRFTMDGASSGYESTFFGVNRMN

SEQ ID NO: 110212 - protein, 189 aa, Triticum aestivum
  Clone ID: PAT_TA_4630.pep
FGPAPSSHLQSSNSLDLDLSAFLPSVSFSLPLYSSIPTKPSTATATSKTPPHRPVVRAGTPGGLRRPVTEELYRGRRCQRTPNRAAANTSRASADGSYGASGVASRRSTVGCWPHMPPWRRPRPYGGDAPEGRPGAAAVDLTCVRVSAGRERLHSWACRAEGTRAGSQAWMGLHDGILDGRARGLQGNG

SEQ ID NO: 110213 - protein, 291 aa, Triticum aestivum
  unsure (1)..(291): unsure at all Xaa locations
  Clone ID: PAT_TA_4631.pep
MRHPWKHPTARHGAAELCFREVGDLLPRRFARRAAASEELVMRLQIHRKLNKHTGCVNTVGFNAAGDTLISGSDDQRVMLWDWDTGAVKMQFHSGHGDNVFQARFMPYTNDRTIVTCAADGEVRVAKIQDGRDVLTSLLGDHDGRAHKLALEPGSPYIFYSCGEDGHVQHFDLRTDTATELFICRKPVAKSGHSSHVRLNAITIDPRNPNLLAVAGNNSYARVYDIRKCKSGGSSDFAQPSDCYCPPHLIGNKNVGITGLAFSHQXELLVSYNDENIYLFPKNXXLGPDPK

SEQ ID NO: 110214 - protein, 191 aa, Triticum aestivum
  Clone ID: PAT_TA_4632.pep
MAAPVGEMVWVPVLEEGVFRFDASGEARSAAGPSLSFVEPRRRQEPREGGDRPAVVPACEVAGNVQKVVIKLPSGTSFYGTGEASGPLERTGKRVFTWNTDAWGFGPGTTSLYQSHPWVLAVLPDGKAFGVLADTTRRCEIDLRQEPTRPTSSRSAYPIINFGPYNSPAEVTMSLSHAIGISHLIINLFPY

SEQ ID NO: 110215 - protein, 127 aa, Triticum aestivum
  unsure (1)..(127): unsure at all Xaa locations
  Clone ID: PAT_TA_4633.pep
RPAILRHIRLSPATAGXLAAAAAAGRPLALAPWLARPMSSXHDAHLTRDEVVGRVLDVLKCHPKVDPSKVTPEAHFEKDLGLDSLDTVEVVMAIEEEFKLEIPDLEADKINSLPLAIEYVANHPMAG

SEQ ID NO: 110216 - protein, 227 aa, Triticum aestivum
  unsure (1)..(227): unsure at all Xaa locations
  Clone ID: PAT_TA_4634.pep
MIPSPARILIFLLPTPSLIPPPPVRRPHRAWAGTARCAPEAVAGGGFVVIEDDLSDLLQILPRDLRDNLQNEPRTDHLLEVFPHLGRRPEARFLGKFGGPALLVCQISQLELEEAQRAVGEFGGDNRAGIEGTLHRISAIRSRKGMVVGLTCRVGRAVNGHVDMVRDLLNYKESILFLGRPGVGKTTVMREIARVLADEFQKRVVYXNNVIVDTSNEIGGDGDIPHA

SEQ ID NO: 110217 - protein, 420 aa, Triticum aestivum
  Clone ID: PAT_TA_4635.pep
MADTAPADDRPEPCPVAADPSPPPPPTPEELVARGVAPVKPAFLRPAPVRDAPGEDGRASGAVPLEKKSKRQFRRDRKQEQESVLRLCVAVAKSGNVDACKFGASCRFTHDIDAYLAQKPADLEGTCPFTVLGQPCPYGLTCRFSGTHKDNHAPSESHEINTLSKDVQKLLSTPPYKFPRASEQIKHLGLKEVIKIKASALAEDRSADHDNPDVSCELNGDEKTESSCNAAVNVEHRPISSHKLDKLGGEPLDGDSVARAAKKSKIEVVEINKEGAGTHDTKPEPEDPNLVNGLEVPSNIPSSCRVDLVATPHLRERKIIDFREKLYLAPLTTVGNLPFRRLCKTLGADVTCGEMAMCTNLMQGQASEWALLRRHSSEDLFGVQICGAFPDTVSRTIELVDNECSFDFVDINMGCPIDLV

SEQ ID NO: 110218 - protein, 368 aa, Triticum aestivum
  Clone ID: PAT_TA_4636.pep
RPSRRPSPPRAHSCTNRTVNSGAPCTHCRVRPAGQIVSDPPPRREKSKAQRSRVVSERGSAGDLSPGASAWDARFSCASNRVAQLLLARPYSFSQLGMLAGILLQLFYGLLGSWTAYLISVLYVEYRSRKEREGVGFKNHVIQWFEVLDGLLGPYWKAAGLAFNCTFLLFGTVIQLIACASNIYYINDRLDKRTWTYIFGACCATTVFIPSFHNYRIWSFLGLGMTTYTAWYLAIAALINGQVEGVTHTGPNKLVLYFTGATNILYTFGGHAVTVEIMHAMWKPAKFKYIYLLATLYVFTLTLPSASAMYWAYGDELLAHANAFSLLPKTAWRDAAVILMLIHQFITFRFACTPLYFVWEKVIGMHDT

SEQ ID NO: 110219 - protein, 164 aa, Triticum aestivum
  Clone ID: PAT_TA_4637.pep
RAMAAAATEATILELDPSHERAGRVIDDIVRLEKRIFPKHESLARSFHDELKRRNTGLIYSTSGVGDDEEVAGYAMYTCATFLCASITKLAVKESCRRQGLGEALLQAAVDRCRRRRVQRVSLHVDPARTAAVALYRKAGLQVDATIEGYYSAQRNAYRMYMDL

SEQ ID NO: 110220 - protein, 224 aa, Triticum aestivum
  unsure (1)..(224): unsure at all Xaa locations
  Clone ID: PAT_TA_4638.pep
FETEEXSVRRYMGTITGISDLDAVRWPNSHWRSVKVGWDESTAGERQPRVSLWEIEPLTTFPMYPTPFPLRLKRPWPTGLPSLHGGKDDDLTSSLMWLRDSASPGFQSLNFGGAGMNPWMQPRLDASLLGLQPDIYQTMAAAAFQDPTKMSPTMLQFQQPQNMVGRATPLLQSQILQQMQPQFQQQSYLQNINGATIQGQAQSEFLQQQLQRCQSFNEQKPQLL

SEQ ID NO: 110221 - protein, 218 aa, Triticum aestivum
  Clone ID: PAT_TA_4639.pep
MRRLWRWYQQSLSSYPVRTQVVSSGILWALGDIGAQAVTHKSASSHHHHAKNPEDKDKEFKIDWKRVGITSSFGFAFVGPVGHYWYEYLDRMVRRRYLPGSFKFVASKVAADGLLFGPLDLGLFFSYVGLASGRSLEQVKDDVKRDIIPALVLGGAIWPAVQIANFRFIPVRYQLLYVNLFCLLDSCFLSWIEQQGDAAWKQWFTSFQKKIEDQKSNA

SEQ ID NO: 110222 - protein, 112 aa, Triticum aestivum
  Clone ID: PAT_TA_4640.pep
ATPATTTSSRPVVRLKSPHRRPPPLSSAPKQSTSSATLSSPPHRKRREQGDRPGQAPVMAATRSATAVATSLRLRSWLPWRSEQRAETGSNLDHVRRRLPAPRHRRHGASPF

SEQ ID NO: 110223 - protein, 225 aa, Triticum aestivum
  unsure (1)..(225): unsure at all Xaa locations
  Clone ID: PAT_TA_4641.pep
VRGRVGSKAATVHQENNDNDQRELHFVFFRKPTKFLPSDDGSTVGAMELEKTLLKDDGATGKQVAVGTGEFEELKCGIVLKSIGYKSXPIEGLSFDKYRGVVPNLRGRVLSSESETATVEPGLYVVGWLKRGPTGIVATNLHCAEETVDSILEDDRKGLFTDPSGPKRQGRRGLLEILEQKNARYVPFDGWEKIDTKEKADGELKNKPREKITRWNELLEAAREG

SEQ ID NO: 110224 - protein, 134 aa, Triticum aestivum
  Clone ID: PAT_TA_4642.pep
PSPPPLSPPPPPPPPPPVARCRPGHLRAAGAGRRGTAPAPRGRPGGAACRPRPHASPAPAPPPPPRAPRALAPASLPPPPPAGPRRLPAQPPRGSGRPRLLPPLLPGSRRSRRPGPPARPGRGSPHLPVLVPCG

SEQ ID NO: 110225 - protein, 190 aa, Triticum aestivum
  unsure (1)..(190): unsure at all Xaa locations
  Clone ID: PAT_TA_4643.pep
RLGPWLKPGDGAQGSALPGARCGRPSPPHMMAILRLSRANSLLLPKTSLEGYHAKVSEENKCASVEIFLKASGHLECTMQHVLPRMSXERGKVFLWDLSEGVLKATCMQXALGQAIDVQLGWQLDSPKATLAVKRSXGNXRRSXXWQXAQXSIXDIPLLRAAGXKKHKPLKLESMGQKPPFFFHTPLPFL

SEQ ID NO: 110226 - protein, 122 aa, Triticum aestivum
  Clone ID: PAT_TA_4644.pep
MLPKVKGNIAAKDRSSSKPPSGKLNKKDNRKRGRAEEDELDPMDPSSYSDAPRGGWVVGLKGVQPRAADTTASGPLFQQRPYPSPGAVLRKNAEAASGGKKRGGMSAISKRGDGSDGLGEAD

SEQ ID NO: 110227 - protein, 221 aa, Triticum aestivum
  Clone ID: PAT_TA_4645.pep
MSWRPPISPGRLLLVVQFVALCSIPGAFSSRLVTLDTIDIFTTHEWFSRPTVFFRCSGDNKTHLPDVKDANLIYTFKGEESWQPLTELPEKKCKRCGLYEQDMFRNDVFDEWELCSSDFKDGKYTHFKEGQFNATFLCPNCTVSVGDAAAHHSSSEVEAKKTSVAVIIIVSVLASVIVVLALFGAYKYWLKKKRERDQLRFLKLFEEGDDMDDELGLSNEL

SEQ ID NO: 110228 - protein, 123 aa, Triticum aestivum
  Clone ID: PAT_TA_4646.pep
MGETAMGGYGLDKPPRCSISFDTPCGALLRELEQIWTEIGEQEQDKDRMFQELEAECMRVYRRKVDSANADRSQLRQSVMAKEAELKALVASIGENTTQFKVNEKHASLKEQLAAVTPLLDDL

SEQ ID NO: 110229 - protein, 315 aa, Triticum aestivum
  Clone ID: PAT_TA_4647.pep
MLGARSKSGLADAKGDGKPEGKVGSKPSGKPEAKSNGKGTPPTPRGETPPTPKGDRPRKPAVPKANAAHGTPPSAPRTADKSPRSADRKSPKGATPTRPAPPTPPPPQKQGKAGKPCPEPQAAKPSQELQAQLDAVQEALKKAMGQLVEKEEEKGKVLEELECAKKVADEANAKLKEALDVQSRTVEIQKVRSMEPEQPSNDDSAHGVEDELRRKLKSMQSQQEADAAALHSTVEQLEKARYELADAIDAKNWALSQADDAMRACEVNTHKIELLNAEVERLKGLLDSEVESKSREAADKIGKLEAENSVLKLEL

SEQ ID NO: 110230 - protein, 509 aa, Triticum aestivum
  Clone ID: PAT_TA_4648.pep
MEGNTRGGGHSEALKNYNVGRTLGIGTFGKVRIAEHKHTGHKVAIKILNRRQMRTMEMEEKAKREIKILRLFIHPHIIRLYEVIYTPTDIFVVMEYCKYGELFDCIVEKGRLQEDEARRIFQQIISGVEYCHRNMVAHRDLKPENLLLDSKYNVKLADFGLSNVMHDGHFLKTSCGSPNYAAPEVISGKLYAGPEVDVWSCGVILYALLCGTLPFDDDNIPKLFKKIKGGIYILPSHLSALARDLIPRMLVVDPMKRITIREIREHPWFQNRLPRYLAVPPPDTAQQAKMIDEDTLKEIVNLGYDKDHVCESLCNRLQNEATVAYYLLLDNRFRATSGYLGADYLQSMGRSFNQFTSSESASPSTRQYLPASNDSQGSGLRPYYPVERKWALGLQSRAQPREIMIEVLKALQELNVCWKKNGHYNMKCRWCPGFPQVSDMLDANHSFVDDSTIMDNGDANGRLPAVIKFEIQLYKTKDDKYLLDMQRVTGPQLLFLDFCAAFLTNLRVL

SEQ ID NO: 110231 - protein, 96 aa, Triticum aestivum
  Clone ID: PAT_TA_4649.pep
TMASKALAALVVLVLLAGGKLGHAVLVSGRPPVSTLPHPSSSTTAGQATNMNAMDGASAATTHRQLRIGEGEEKSISVNSLPTVHMRVPVIIPKST

SEQ ID NO: 110232 - protein, 352 aa, Triticum aestivum
  Clone ID: PAT_TA_4650.pep
KVKYVASLVDPGEAVGVILAQSLGEPSTQMTLNTFHLAGRGDMNVTLGMPRIQEILMKASANIGTPYMKCPVHEGKKRKDAARLAEKLRGVTLADVVEGIEVCTVPFHNSNGHISSLYKLHLKLFSPDCYPPESELTVDECQASLRTVFVDAMEYAIEKHLNLLHKVSGIQETRVKDTENLPSEGPEESEGRPTDGDESDASDGDDENEDDLGADAEKRKRQENDEMEYEDDIESEDGMNSDPDEETKHELDNEDDPAESGVESEENDEGHLSDSSNKTAKLEGRLAATKLKKERNETVENLQEQKQAQITQKRSKKLKLTVHVESADLNFEVHYILHKEPHILLSQFLNMC

SEQ ID NO: 110233 - protein, 339 aa, Triticum aestivum
  unsure (1)..(339): unsure at all Xaa locations
  Clone ID: PAT_TA_4651.pep
SAHAYEENGCAVLSGQDAFVLWDTYGYPIDLTEVMAVDFGLSVDMEGFNASMEEARQKARNARYKAGGKSIVLDANATSQLRNRGLDSTNDSPKFQHKVHSSVVKAIYTGSEFVATACADENFGLCLESTSFYAEQGGQIYYTGSIEGPSGSFTVNNVQVFAGYVLHIGSFLEGPDSRHLSVGDEVKCKVDXTRRTLIAPNHTCTHMLNFALREVLGDTVDQKGSIVLPEKLRFDFSHGKPVQPEDLRKIEYIVNQQIKDELEVSAQEIKLADAKRINGLRAVFGEIYPDPVRSCIXLVAKWEXLLANPESKEWLSIXTELVGRTHISNLEMLRHLPSI

SEQ ID NO: 110234 - protein, 246 aa, Triticum aestivum
  Clone ID: PAT_TA_4652.pep
MSRGSGAGYDRHITIFSPEGRLYQVEYAFKAVKSAGVTSIGVRGKDSVCVVTQKKVPDKLLDDTSITHLFSITKYTGLLATGLTADARSLVSQARNEAAEFRKKWGYEMPVDVLAKWIADKAQIYTQHAYMRPLGVVAMVLGYDEEKNAQLFKCDPAGHFFGHKATSAGLKEQEAINFLEKKMKDSPQFSYDETVQIAISALQSVLQEDFKATEIEVGVVRKEDRVFRSLTTEEIDQHLTAISERD

SEQ ID NO: 110235 - protein, 123 aa, Triticum aestivum
  Clone ID: PAT_TA_4653.pep
PVLRLCGAATDFEIQVWATHADVKYDTTAVREAVVKAMDRFKGLPIMVFSTDEASNKAVIYAGVPADAPNGFKVLDWLTPSIAPLKGKGGGGKNGLAQGQGSDASRVKEAMELATQIASMKLS

SEQ ID NO: 110236 - protein, 312 aa, Triticum aestivum
  Clone ID: PAT_TA_4654.pep
LRKLRILVKKQIEDELEVSAQEIKLADAKRINGLRAVFGEIYPDPVRVVSIGRKVEDVLANPESKEWLSISTELCGGTHISNTRDAAAFALISEEGIAKGVRRITAVTAECASQAMKLASSIDTDINEASKLDGATLEKKIGSIKNTLDAAAIPAARKADLKGNISKLEDQLRKAKKKMGEENIQKAVKTAIDAAEAALSEGKTFCVTHADVGLDTTAVREAVVKAMNRFKGLPIMVFSTDEASNKAVIYAGVPPDAPNGFKVLDWLTPSIAPLKGKGGGGKNGLAQGQGSDASRVKEAMELATQIASMKLS

SEQ ID NO: 110237 - protein, 169 aa, Triticum aestivum
  unsure (1)..(169): unsure at all Xaa locations
  Clone ID: PAT_TA_4655.pep
MGAGNGLSNGAAAAAEAAPDGTTVFRATAYSPLRTTLALALWLGAIHFNVLLLLASLFLLPRRVAAMVLGTQALXFMLLPLNDKSRLGRKXAKIHKXSTSVGYFPVTPTMWRTTXACRPQKELYVFRXMNRNSXVCPIGLGALLDLVGFMPLPKTKVLASTAVFYTPFL

SEQ ID NO: 110238 - protein, 191 aa, Triticum aestivum
  Clone ID: PAT_TA_4656.pep
MAGEHQQSQGAAKALSKGSPSPSFRLRNGSLNAVRLRRVFDMFDRNGDGEITVDELAQALDALGLEADRASLAATVGAHVPPGASGLRFEDFEGLHRALGDALFGALADDAEEGGAGGQDEEEMREAFKVFDVDGDGFISASELQEVLKKLGMPEASSLANVREMICNVDRDSDGRVDFGEFKIMMQGINV

SEQ ID NO: 110239 - protein, 171 aa, Triticum aestivum
  Clone ID: PAT_TA_4657.pep
LVPPPARGTGGMGMSPGFLAKRSRESAAASFMGDPQSSNTSREQEHVGAAALLPDKIQEGRSSYCTTNGIEAQHGAASVHDVSGHSDENGHAFVGTKNGIHGEENGSNGTLDMHDSSCQMDENGHGVLDIKDVIFREQNVSNGTLDTHGMGSEDADHVVKSPAAPAHDGLR

SEQ ID NO: 110240 - protein, 127 aa, Triticum aestivum
  unsure (1)..(127): unsure at all Xaa locations
  Clone ID: PAT_TA_4658.pep
PVAPRVGEKGLVYCVGGALLQHGTAHPPVGPEVGEXDLVKCVCSTIGQKGVEHLLDSRPDMAFKEEISRVLNIGLISAPSLPVNRPAMRSVVTSVQGVRADARQTPDKDALPPPHGSVGSAYQGTCV

SEQ ID NO: 110241 - protein, 76 aa, Triticum aestivum
  Clone ID: PAT_TA_4659.pep
VNATFTFRKERVYHAPTVLMLLCILFILISQINKTEEASSTVQDHHPQKAVVNFLKDENTTKTIHEQWQAKAKVAS

SEQ ID NO: 110242 - protein, 116 aa, Triticum aestivum
  Clone ID: PAT_TA_4660.pep
HSRRCPHSSPLSRDSGSRRPFAFVRIASASSSPADVEISSSLPPPSVRILRFPSHPQLSGARAARMREQIEAAAFRPGMRRKARRGRFTCLGRSMDGMMAGTDACLSCSLHSCFFI

SEQ ID NO: 110243 - protein, 218 aa, Triticum aestivum
  unsure (1)..(218): unsure at all Xaa locations
  Clone ID: PAT_TA_4661.pep
MQSFFGRGSRNQRTFRPKKSAPAGNNGMKLKRHIDATLGSGNLREVVRLPVGEDLNEWLAVNTVDLFNPASGPLATLSEFCTPCXLAPTMSAGTKYGYRWADGVKIKRPIEVSAPKYVEYLMDWIEAQLDEESIFPQKLGAPCPPNFRDVIKTIFKRLFRVYAHICHSHFQMILKLQEEAHLNTCFKHFMLFTWESQFIHRVQVAPPRELIEPILVGH

SEQ ID NO: 110244 - protein, 219 aa, Triticum aestivum
  Clone ID: PAT_TA_4662.pep
MPLPLPRSMVLSPISFHLPAPMDPYVAGGTTRHSGRPDWVLLHNSARISGHRNSTTAGCHTMEGRPIEVSFWLVDPPGVSYFSVHCPGLSKDFQGEPYVHCAEAALVLFSVTFLPVPGRRSIQHFVYRAGPGAPSLDLIPDPDKIRRGDRYGLLPCGDDTDHYAVVFLDRNFIAYDKPWRFNAHVCLSPTWSCRCEGPLSRLSEDDQALLLKHGTCKPP

SEQ ID NO: 110245 - protein, 151 aa, Triticum aestivum
  Clone ID: PAT_TA_4663.pep
DYFRIQDGLYDTYETAGKHANGCICNLFLNAHHTAKAVGKLLGCSACSCAANPRDPQEPRSEDNTRQKVHCCAWPCAGRTASGNTPLVPNTDQADGEASGCIRKLASGALNTVRTVGKLFPCSSFPPVHDDVSGKSVLCGACISKAHSKNM

SEQ ID NO: 110246 - protein, 114 aa, Triticum aestivum
  unsure (1)..(114): unsure at all Xaa locations
  Clone ID: PAT_TA_4664.pep
KSTPFHPKQLHGIICQSPHTSAHRPNQILANCTESVRQSKTVPTLLVQTRKWQSSPLKLRCQARSXGVDLGRLDRVNAIIEEFPVSKKPCSHLSPQGRPPHTVVQLAIAVPMPV

SEQ ID NO: 110247 - protein, 147 aa, Triticum aestivum
  Clone ID: PAT_TA_4665.pep
PPDRAHAATQPCISLSHSLPPPRAPPSPPPPPPPPPPPPAPPPPPPPPARAAAGPPADGPPGRGPPASARLRAAPPPPRRPPPPPPSSRSMQPASTSAAPWTASSSSSSTSRFLYVAAATTLIAKPPRRIGSPPRAPESPISLRLWL

SEQ ID NO: 110248 - protein, 318 aa, Triticum aestivum
  unsure (1)..(318): unsure at all Xaa locations
  Clone ID: PAT_TA_4666.pep
WSPSPSRGCAPGTRCPCRARALADGVFCGVFDRRRRCGHAGGKLVRDYLPFMVLSHRNALLLADADADASSDDPVFSDASPSSSADSSGNSSPHPSHTLGVWREACTNAFKXMDNELKLQANMDCFFSGTTAVCAIKQGKDLIIANLGDSRPVRATMSRAGYLKASTCAPPTSGPACLQGAVRVKRCEGRVFALREEPGVMRVWLPGENLPGLPMARALGDSRLKHHGVISTPQVTGHRISDADLFIILATDGVWDVLSNEEVVSIVCATPRKQHASKAVVEAAVQRWKTKYPSSRVDDCSAVCLFLHDHSAAAATKL

SEQ ID NO: 110249 - protein, 173 aa, Triticum aestivum
  unsure (1)..(173): unsure at all Xaa locations
  Clone ID: PAT_TA_4667.pep
MASALSSLRYGDSLSVVAISGATAVLCEAISWLLIYRTATYGALRASIERHSRKLDSMKSVSSGTGGAAPSSQPASSRAKKMDRVESSLKDASRELSLAKLKSGAVVAAVLFVVFGXLLNSLFEGRAVAKLPFAPVPLVQRMSHRXLPRNDXTDCAMXXLYFLWLMSIRTNXQ

SEQ ID NO: 110250 - protein, 525 aa, Triticum aestivum
  unsure (1)..(525): unsure at all Xaa locations
  Clone ID: PAT_TA_4668.pep
KSIEEERAAATSLANKMVESLKFQAVLVRLYEGKEPIEFFPIFQNLVIFKGGASTGYKKFVSENGIQDDSYSENGVALFRVQGSGPDNMQAIQVDAVAPSLNSSYCYILHDGEYGVYXWIGNLSSSMDQELAERQLDVIKPNLQSRMLKEGSEYDQFWKILGIKSEYSSQKIARDPESDAHLFCCTFLKGVLKVREIFNFTQDDMMTEDIFILDCHSCVFIWVGQNVDTKIRAQALSIGEKFLELDIPMENLSRETPLYVINEGSEPQFFTRFFTWDSAKTAMHGXSFERRLSILKDGIKPRRDKPKRRTTTSSHTGRSSVPDKSQRRSTSFSPDRVRVRGRSPAFNALAATFENSNARNLSTPPPVARKSFPNVWPHAWGKATPXAASIAAMSASFERPRQTLIPKSIKASPEVKKPQSEASKPKPEEDAKESTPATKDGQTVTPTIQEDVKEDQPEDEEGLPTYPYDRLRTSSSNPVTDIDSTRRETYLSSAEFREKFGMTKEAFAKLPKWKQNRLKIALQLF

SEQ ID NO: 110251 - protein, 145 aa, Triticum aestivum
  unsure (1)..(145): unsure at all Xaa locations
  Clone ID: PAT_TA_4669.pep
ADAWAPRKERDTSPPRKVRKEGAQKETMRAGLMSAEEVKEDIRKIKEDEKLKFAAQDPSFTGKGAKVVFRDKEGKRINQEDIQKAKKDEKPKEKHIEWGKGLVQXRADQARVKELEDVKDQPFARTRDDPELDGMLKNRLRWGDP

SEQ ID NO: 110252 - protein, 165 aa, Triticum aestivum
  Clone ID: PAT_TA_4670.pep
MEMEGEPPQSHQLLLQGISLDLRLETATATAKRQQGQRGARRPASPPPAAPAAFDNAGREAFACNYCHRKFLSSQALGGHQNAHKLERTLAKRSRDVPSEITVATTTASSSTAARWLHAGGGELWGYSASAPAPDSARMAPLMSMGMGWAGTGSTAGGEGGNPVA

SEQ ID NO: 110253 - protein, 260 aa, Triticum aestivum
  Clone ID: PAT_TA_4671.pep
MLLPVRGLPAAPPRPLAHPHTAPAPPPSLLGPRRRRPSRRLSKVVSYYGLTTPPYKTDALEPYMSRRAVELHWGKHQQDYVDGLNRQLAISPLYGHTLEDLIKEAYNNGNPLPEYNDAAEVWNHHFFWESMQPEGGGSPEAGVLQQIEKDFGSFFNFREEFMRSALSLLGSGWVWLVLKRSERKLEVVHTRNAINPLAFGDIPIISLDLWEHAYYLDYKDDRRTYVSNFLDHLVSWHTVTLRMMRAEAFVNLGEPTIPVA

SEQ ID NO: 110254 - protein, 123 aa, Triticum aestivum
  Clone ID: PAT_TA_4672.pep
GLFRHRRRLGHVLPPPATMDWISALRESVSFEGFLSEPVQWYTMAHVCWHRRLPWRMSNSRTGQFFCRLQQDLPPPTAMLRALAVLDQSRVVRHSCPWLVRRKCNTYGRSRAHMEWKAYIVLT

SEQ ID NO: 110255 - protein, 242 aa, Triticum aestivum
  Clone ID: PAT_TA_4673.pep
GIISAIGISIVVGWGYILGVTFAVKDIPSLLSPDNEAGGYAIAQVFYQAFKSRYGSGVGGIVCLGIVAVAIYFCGMSSVTSNSRMAYAFSRDGAMPLSSVWHKVNEHEVPINAVWLSAFVSLCMALPSLGSLVAFQAMVSIATIGLYIAYALPIFFRVTLARKHFVPGPFNLGRYGVLVGWVAVLWVVTITVLFSLPVMYPVTRDTLNYTPVAVGGLFILVLTSWVVSARHWFKGPVTNLSG

SEQ ID NO: 110256 - protein, 183 aa, Triticum aestivum
  unsure (1)..(183): unsure at all Xaa locations
  Clone ID: PAT_TA_4674.pep
MVAGGWRKPPTRAGVGPRFGLAMGPAPGDSKRFSGVVPPAALVFLALVFVAGAIVTLHHKENLSILQVQPRELAANEDSFRSXAPGQRSARRRGRRDRDAVGGTGDATGGTNDDAAPDICEXQCRXSGQRXAAEGIXQDSXNFNSIXGRQPGRKGSRGRPRXLLAIPDQQKASQTSGNSICHT

SEQ ID NO: 110257 - protein, 228 aa, Triticum aestivum
  unsure (1)..(228): unsure at all Xaa locations
  Clone ID: PAT_TA_4675.pep
MSRGGGYGEMGQKIDYVFKVVLIGDSAVGKSQLLARFARNEFSLDSKATIGVEFQTKTLQIDNRTVKAQIWDTAGQERYRAVTSAYYRGAVGAMLVYDMTKRQSFDHMARXWLEELRSHADKNIVIMLIGNKSDLGTLRAVPTEDAKEFAERESLFFMETSALEAXTNVEKAFMTGLEEIYRTVSKKNLVANDEANSXGNSSLLKGTKVIIPGQEPAPPAKAACCMSS

SEQ ID NO: 110258 - protein, 212 aa, Triticum aestivum
  unsure (1)..(212): unsure at all Xaa locations
  Clone ID: PAT_TA_4676.pep
XITPSSKLTLTKGNKSWSSTAVAAALELVDPPGCRNSARDRRRPQRQIPRLAAAALSAASPPTTSQSRLAADHCPAPPRRRPLPAPAETPPPCGRSPKPPLPPPSPVAGSTLGQRPLLLHIVKALAHKIAGTMSFAGVSVVAGGGGRLPRPSAESDTIYSGSSAASRGSSYYHLLVVEGYSRIKDLPNGGTIMGRTFKAGGYRWVLRVHPNG

SEQ ID NO: 110259 - protein, 89 aa, Triticum aestivum
  Clone ID: PAT_TA_4677.pep
YSLALLLFFVFLTFLTTPPPLPSVLLRNLCSLVWDGIPSRTCFFSSCVSDFKQVSRDSLLCLFALIFFLHIVSKMCQVAASQCLCFTWL

SEQ ID NO: 110260 - protein, 52 aa, Triticum aestivum
  Clone ID: PAT_TA_4678.pep
MWQPSILLLCFILQGAVAADRSEVWGYVEIRHKAHLFWWYYKSPHRASSPIK

SEQ ID NO: 110261 - protein, 207 aa, Triticum aestivum
  Clone ID: PAT_TA_4679.pep
MAAAAASAGAAAITRRLASCNTGARERAVRHLLADFLPASAPHLSATDLLKLWKGLFFCFWHADKPLYQADLASRLAAAVSAAATPAVAADFLAAYLATIRREWSAIDVHRLDKFYLLNRRFLHHAFLFLGARSFAPDVTAQIVSVISEKAVLPEADNATGRGLGYHVADVFLDEILPVLPVSLQSMELLLAPFFTVLEKSADRVLV

SEQ ID NO: 110262 - protein, 285 aa, Triticum aestivum
  unsure (1)..(285): unsure at all Xaa locations
  Clone ID: PAT_TA_4680.pep
MSSTEMQMRFCRGSGETVDSFHASRYPSPSTEDPACLLPRRAPTPSYASTEDLGDLHDSLEEVDVVELDPHDQPARMVADPGQIAWHALDLKFPREESESDWSDWSEGDGRLIDGEEKDCPGNEVVDSDDDDDDDDDDNCNVQVVYEDKSPNTKIICPGKLYPESEAEEIELEWIESYCKQMGEYSELFDDILAREDHDDFTTLPPFPMKLLPPTTSLCFMDGGYCYHSLYKSHDTSTTASTXGYRTPQQMLHSFMRYNSGLSYPLVCMDTARHWTRIPLRLKYA

SEQ ID NO: 110263 - protein, 251 aa, Triticum aestivum
  Clone ID: PAT_TA_4681.pep
MVIAGEPEPEEVAVMFSDRLRAEEETVVFPGWVMLDRIGRTHCDGDLGAAREAVNGNKTAVQVEMDSGHSFYVSFTLAPPPQGASYLDLHWPLEGSAKSVPPYKQPAYPFVRAIDKDLVLFHISIPSLPHRNFVPPDLFVYNAAGHPPSVQQLPLYRRRSFLRVNFTTGILRRQNGSYIVSDLNVYPKKEGTGNNSMCAELCVFNASPPPSSFACHVAPQPQDQSNGQFPTLWSTDHVLAFDGRFLCWVDY

SEQ ID NO: 110264 - protein, 98 aa, Triticum aestivum
  Clone ID: PAT_TA_4682.pep
FKSDYIQASCTRSPLLPLPIGTASLSHGHKKKPPSSIAWFSAMRWSMLSASSVSSCIRGGAISPSTISAAKMLLRTRGRTRGLAADARRTPEPRPGTC

SEQ ID NO: 110265 - protein, 318 aa, Triticum aestivum
  Clone ID: PAT_TA_4683.pep
MKMKSSSNLEAFLHAATPLLPWRSATMERFQGAPSSVWQQPDGKSKDAVEYFALSDLWEHYAESSAYGLAVPVRDAGDRAVVTTQHFVPYLSAVQLYTATQPTTHTLGATSRSTGSETDSWSDDSVGDRFAGSGSSSWDAASDEDDSSSTYDGNGSTGVSAKQSGYLNFQYREWDSPYERVPLAHKVAELAQDYPCLLSLSSAELSPSSWMSVAWYPIYHIPAHVNLKGTSACFLTYHSISSVFQDNIHSGPEHGEGEIAALSPFGLATYRMQGDLWKRPGSSDYRRLSELHWAAASWLKQVGAHHPDFTFFTSSHRR

SEQ ID NO: 110266 - protein, 128 aa, Triticum aestivum
  Clone ID: PAT_TA_4684.pep
MAASGSGSGSGQIQPLKIPDAVVALAQAAAKANNSSNTGAGDATDKYLPGWPLFSPPKMQLTKCAKCPREFCSSVALRRHTRVHRRALKIDKDFPKNRDHLAAFWDKLTVDQAQAILSLEGVAIEETS

SEQ ID NO: 110267 - protein, 259 aa, Triticum aestivum
  unsure (1)..(259): unsure at all Xaa locations
  Clone ID: PAT_TA_4685.pep
MIEQFVNFVIRPPRSEYNPDQYLWEREFMLAGRRYKRLDLELTNPRGHTLKCSHYLPASVPENIALPCVIYCHGNSGCRADANEAAVVLLPSNITVFTLDFSGSGLSDGDHVSLGWHEKEDLKCAVSFLRTNKQVSRIGLWGRSMGAVTSLLYGAEDPSIAGMVLDSAFTNLYGLMLELVDVYKIPVPKFTDNMAVQYMRRTIQKRAKFDIMDLNVVKLAPKTFIPALFGHGLSDMFIQPHHCDRIXEAYGGDKSMVKF

SEQ ID NO: 110268 - protein, 183 aa, Triticum aestivum
  Clone ID: PAT_TA_4686.pep
GTCYTSTVMVSRTRSRRCSPGGAAGLPGDSPRRTFGSRCEPRPGKADVVRIRWTAALIGILMCRNSRILGHRGRPLSLEAGRCMAFAIQLLTGAVPVRCQSSHRWRSAGRLMPMTFLRAQPFRRMVSRCPTPCSGFSPRYPASPLIRKIRVVPQRPKLRATSSFRNLYMQAGREYVKQISKIL

SEQ ID NO: 110269 - protein, 177 aa, Triticum aestivum
  Clone ID: PAT_TA_4687.pep
PRVRATASDSTPPPYPLFPPGLIPGMVRKMQIGSGVPYSPLSPLDIPTTIPPSTVPESEILERVTRFFKEIGEENPSEGPMKQGEPGDYDDYERELPARKGGACIPPPASLHVNPETGMRADGSFDSKPGSSGRLGLGASADPSEASHQYGDVYSSYRKQRSSNYHSSISSRAVAPR

SEQ ID NO: 110270 - protein, 143 aa, Triticum aestivum
  unsure (1)..(143): unsure at all Xaa locations
  Clone ID: PAT_TA_4688.pep
RPGPGPRPLLPRRPPASPPPAPRPPPPVPPVRLAGPPRAPPPPSSVAPPPXPPSRPAVAPPPPPRRLACPPRGVVGRWGLRSGPGELAAPTHQYRSMIQSTVQGQLAALLVDEIKLSSGLDLGACNKHVMSRTNVVNHAQRKD

SEQ ID NO: 110271 - protein, 281 aa, Triticum aestivum
  unsure (1)..(281): unsure at all Xaa locations
  Clone ID: PAT_TA_4689.pep
RLIISTLDFLPKGVLCTDISDDELFRINAAVVQATDSILTRRNPAAHTIRLLSTRFYLRDDVPISIGRAVGHAMAAHLVDNAKFSVMTGKYEISDMAEDDLITSARNFMLFFDACPSAFGGLTTLDLENLRFGESDISNVLITCKRLKHLRLYNCDSGDCSTLQVEHAHLSELSIVQCMLERVELKWLPQLTTMVFEGWLQFQDPLXSLGHVPLLEVVSLTNLALSYHKMVLLSEFLSGTSIRDLKLAFNSEKLGLQPASPSPRLSSVVRHPRLRNLLHLP

SEQ ID NO: 110272 - protein, 605 aa, Triticum aestivum
  unsure (1)..(605): unsure at all Xaa locations
  Clone ID: PAT_TA_4690.pep
MCSALDSSDFATAMQLQILLTTSDWDECNFWLSSLKRMIKTRQSFRSVNLCVVPVAAASSCIHLFLIVKIVSVSNLEGWRAQRCYPASSVNSTGPSCSWKGSLTLLXSVATTHGWSVFRGTRASRLRSAGDMLTATLCYICAGNIDKAVEIWSRNLXSEDGGXTYVDLLQDLMEKTITLALATGQKRFSASLSKLVENYAELLASQGLLKTAMEYLKLMGADENSDELTILRDRIAFSTEENDATRSSVPESSANSSSYLPNQQSYTPDPSQNLYQVPQQYNNVQSYPEVYPQPPNSRANVPSNTYPEVYPQSHNAAYSGYAGYQPQHQTQMFVPQNTPVDTQPSPAPLPVPHQTVKTFTPANVPSLKNPEQYHQASTLGSQLYTPPANSSYAPGPPAQFQSGPPTTFHQPAPPAQYQTVPPIPSVPGTNPNQMFTPAVPTNSASRFIPSTNQGFVQRPGLSPAQPSSPTQAQPPAQPTVAPPAPPPTVQTADTSNVSAELRPVIATLTRLFDETSKALGGAPAKKREIEDNSKKIGALFAKLNTGDISPNVSSKLIQMCSALDSSDFATAMQLQILLTTSDWDECNFWLSSLKRMIKTRQSFRV

SEQ ID NO: 110273 - protein, 199 aa, Triticum aestivum
  Clone ID: PAT_TA_4691.pep
FLCIFSATSRTPAAATSWSTVGRTDVAVPSCPTPTDALTCPTPAAVPTWLAACPGAAPGTAPPRPTPASPSAPMSSSKSRILAPQLNCRRRRMYEGEREPDPPRPCVAPPAVTTASTRWPSAASAPPPAPPPAMAPVRCTPYWEFIWTGRHYSPDEQRLAWIGGLTPSELGLDPEGETLGVRRKIGEILGERTSGLGGG

SEQ ID NO: 110274 - protein, 168 aa, Triticum aestivum
  unsure (1)..(168): unsure at all Xaa locations
  Clone ID: PAT_TA_4692.pep
SCRSCPRAEFGTSSSPTTTTACTRGLLKDLGAELHACAARLRNQLFFPASTASSVLLPALALLVCGTALSRVVVFFLPLVVSTTICCAAMYLLVASGSVGREGXAKEVVLLWGDRVGGXGSWRCTAAPTGSAYGDRRXVXVXCFLHRKPPNRXXGGSGGWKETPASKK

SEQ ID NO: 110275 - protein, 80 aa, Triticum aestivum
  Clone ID: PAT_TA_4693.pep
LQQQQQEFAQQQMQQYLQQQANQQVFSDQNGELNHQDARKRQLEHGQQSEASQSDVSKLRSDEQSELSYPSTPQSQRSSH

SEQ ID NO: 110276 - protein, 143 aa, Triticum aestivum
  Clone ID: PAT_TA_4694.pep
QGGRLLLVTYVPSAPQQQGVEGRRLQGMGSPCPLVELLSSRPPALVETALRRRSRTVAPTQDPAGSSGGDRRRRLYGVTAAARSGGIFARRSTAVRSGRVFSRRSATVRSGRVFSRRSAAVRSSGVLAAAKGWRAAANEGSES

SEQ ID NO: 110277 - protein, 287 aa, Triticum aestivum
  unsure (1)..(287): unsure at all Xaa locations
  Clone ID: PAT_TA_4695.pep
MASTAGLQISHGHWFNTTLTSSQSHPCSRSSFPRPPPGDFLERSPPRCRRRCSHAVAAAIVVEKLGQRRSVGPSLPVPRRSRDRFLARRGRQQPAAAPSGGPVFPAQAADAATDRFAKTLTSLPKPGGGEYGKFYSIPALNDPKIDKLPYCIRILLESAVRNYDNFQVTESDVQNIIDWEKTSPKLAEIPFKPARLVLMDNTGGPAVVDLAAIRDVIAELESDXGEINPLVPVDVVIDHXVRVDVAKCADALKQNMDLEFSRNKERFSFFKWASSAFNNMLVLPPGS

SEQ ID NO: 110278 - protein, 166 aa, Triticum aestivum
  unsure (1)..(166): unsure at all Xaa locations
  Clone ID: PAT_TA_4696.pep
MDRSNLPPGNTTQGTPYASLNLHGNSLQMHAPSSGKHLFNQSQMPGSFTMPINRATEHDNPGSGFQFVEHGKKDHHQQQQQHNHLIKNSISDDEEHDMTEDATDAQSGKGKKGSAWHRMKWTGSMVKLLITAASYXGXDPGADLGGGRRNITVMQXXXKWKAISXX

SEQ ID NO: 110279 - protein, 145 aa, Triticum aestivum
  Clone ID: PAT_TA_4697.pep
APAVQRLLALSVGATAGPLHGWDDGDGGGAEDLDDDDDEEDTDDDDEDSEDDDVREETEEEFLARYAAAAGESIEVVEEGDIDEETQDIELGSLDEMDIQQVVLSLIQKHTALLQAQVLPDDLIERIAETFPEYEQLLHAHQLRC

SEQ ID NO: 110280 - protein, 481 aa, Triticum aestivum
  unsure (1)..(481): unsure at all Xaa locations
  Clone ID: PAT_TA_4698.pep
AAASGTKKKKQLGRPAPGPWRLPLVGNLHQIVTSKXPVVLRDLAEKHGPVMCLRLGQVDTIIISSPSAAQEVLREKDLNFASRPSLLVSEVMLYGNLDIGFAPSGAYWRXLRKLCRMELLSERKVRHFMPVRESETLALVRAVHEAGQGGKRPVNLALLLVSCSNAITEQTAFGPVAXGASSSEQLLAAINVGMTISSGFSFGDLFPGLGFMDTVTGLTRRLWQARRQMDAVLDKIIAKSEQKGDDLLSVMLRIRDGGDPEFPIETTTIKAIIVDMFSGGTDTTATAAEWVMSXLVRNPPAMAKVQAEVRRTFDGKTPQEHEGHIHELHYMRMVIKESMRLNPVLPLLVPRICRETCHVGGFEIVEGSRLMVNSWAIGRSPESWDDPDEFRPERFEDSMADDKGPRFDYLPFGGGRRMCPGSTFGLAVLELIMARLLYYFDWSLPTGGTELDMDMTVGITARRKNQLHVVALPYKEVPLQS

SEQ ID NO: 110281 - protein, 210 aa, Triticum aestivum
  Clone ID: PAT_TA_4699.pep
RHHGGQGRRGQPSPGRGARKGTGRHHHWDQPHEEGADRWRNGTKALTTKTCLTSGCFSLYSFLKLFLQACRSDGQWWSTSPMTTMSMQVLSLAHGTSAAPGVSSAAPPGTPAPPPSTSRMACRSDGQWWSTWPMTRMFMCVLSLPMDETPRREIRMSGSPAHFTAAQPSREREREAAAGHRRGRDGVEELQMWTRRRPAGGGVEADDGPA

SEQ ID NO: 110282 - protein, 261 aa, Triticum aestivum
  unsure (1)..(261): unsure at all Xaa locations
  Clone ID: PAT_TA_4700.pep
PTRPTNVVKELLLCGYKPDVEPYLSMILQTFRASKLLELKTKSRIFIPEGRAMMGCLDETRTLKYGEVFIQASNSANDSDKFVVTGKVVVAKNPCLHPGDIRILEAVYTPVLDHMVNCVVFPQQGPRPHPNECSGSDLDGDIYFVSWDPDLIPTRMVAPXMDYTPAPTXQLDHDVXIEEVHEYFANYIVNERSGXIANAHVVFADRESLKAESTQCIKLAELFSIAVDYPKTGVPAQIPPELHVKEYPDFMEKLDRGYLCI

SEQ ID NO: 110283 - protein, 190 aa, Triticum aestivum
  unsure (1)..(190): unsure at all Xaa locations
  Clone ID: PAT_TA_4701.pep
CHYAVEEILTVTVALPAVVGAVERMKESFGPKHYGVGYVYNNLGAAYMEMDRPQSAAQMFAXAKEVMDVSLGPHHSDTIETCQSLANAYNTMGSYALAMEFQKRVIDSWRNHGPSGADELREAXRLYEQIKIKALAFHVTWVLKQLRCLNLQEQEADPDPGENRTTVIRNFASCTLFLPLFWMPVCCSCS

SEQ ID NO: 110284 - protein, 211 aa, Triticum aestivum
  unsure (1)..(211): unsure at all Xaa locations
  Clone ID: PAT_TA_4702.pep
GTAPTTPGTGDCPPSPSTGAAPTTPGGEDAPPAPSSDTSPTTPGGGYYPPTPSSGTAPTTPGTGDSPPAPSSDTSPTTPDGGYYPPTPSTGTAPTTPGTGDCPPSPSAGTSPSTPGGGDYPPSPASGTAPTTPGGGNCPPSPSAGTSPTAPGGGYYPPSPASGTAPTTPGGGNCPPSPFGGTFSTSPGGSYYPPSPXTGTDPNTPGGGCYP

SEQ ID NO: 110285 - protein, 117 aa, Triticum aestivum
  unsure (1)..(117): unsure at all Xaa locations
  Clone ID: PAT_TA_4703.pep
HLNMSDVMDEGLWCERVFRDHQLSVMLPVGGTMAVYFFNSDGLIPRRYNARIIRTDEGRDLAWLRAQDVYEPVTCLRFFDPPYASGWNVVALALYHNWMGLLPLFFXKPRERYSWSK

SEQ ID NO: 110286 - protein, 88 aa, Triticum aestivum
  unsure (1)..(88): unsure at all Xaa locations
  Clone ID: PAT_TA_4704.pep
YLRELVTCIYGDRSAPLSLLLTLIKQIRLAYPEAXVSAEFLEYYIALENYNQRYKSEYLIREMFPADGLFLVSKDPIILFQAVKQHIL

SEQ ID NO: 110287 - protein, 362 aa, Triticum aestivum
  unsure (1)..(362): unsure at all Xaa locations
  Clone ID: PAT_TA_4705.pep
GRGRWWGSLPGEHHPHQHQHPHQHQHQHQHPHQHHPPGPMLYAAPPPHAVAPPPGSNXLGMGDLMRKKRGRPRKYAPDGSMALALAPLSSASGGXAAPPPPPAPADGFSISSPPSDPNAKRRGAPLAPGKKKQFEALXSWGISFTPHILSVKAGEDVASKIMSFSQQGPRTVCILSANGAISNVTLRQPATSGGLVTYEGRFEIISLSGSFLLAEDGDTRSRTGGLSVALAGSDGRVLGGCVAGQLTAATPVQVVVASFIAEGKKSKPAEPRKVEPMSAPPQMATYVPXAPVASPPSEGTSSASSDDSGSPINHGGMPYNHSGGQQHQQQHMPPAYASGGWSLSAHHQNNNRHDADMKMMSN

SEQ ID NO: 110288 - protein, 132 aa, Triticum aestivum
  unsure (1)..(132): unsure at all Xaa locations
  Clone ID: PAT_TA_4706.pep
MPDERPTSADRVTALEKALTGFADRDSDSVVTPSVGLSFDSINEAYEFYNLYSWESGFGVRYAKSRTNVKGTNTCSXFVFCCSGKPKEANSKSTRCQCQAMIRLLQTDDEGWYINEFRSSHSHPMRNPGAVS

SEQ ID NO: 110289 - protein, 268 aa, Triticum aestivum
  unsure (1)..(268): unsure at all Xaa locations
  Clone ID: PAT_TA_4707.pep
GQTLGTTEKFQLKCPDLFKHCTVKSISILHALTDGKWMRHFKSNLSQDAISQFTSMWNDLQLVQXIRSQEDTLTWRWTANGQWSSCSAYTATLTANIKPLFAKLAWSSDAPPKCQFFVWLAAQERCLTADNLAKRGWPHNPLCSLCLQEPESATHLLTTCSFAKEIWHLTFDMLHMHHSLMANNGESLXSWGATLQFRRMTKDKAKTWRSIIALVWWNIWKERNARVFTNSSCSARPLFEKIQVEAKDWIDAGRRRVLQLVEGPLEPD

SEQ ID NO: 110290 - protein, 199 aa, Triticum aestivum
  Clone ID: PAT_TA_4708.pep
EKNLEFDLVRIDTFKRQHKLPEFIRLRDPSGQVTFKHGDKTLVDPRAICRYLCTQFPNQGNRNLYGTGSLERASIEQWLQAEAQSFNPPSSALVFQLAFAPLLEIPQDHMVIAENERKLQQVLNVYDEILSKNEYLAGDEFTLADLSHLPDSQYLVSSERGMKLFTSRKNVARWFDQISSRKAWEQVVKMQMEHPGAFE

SEQ ID NO: 110291 - protein, 183 aa, Triticum aestivum
  Clone ID: PAT_TA_4709.pep
DAWGREKDCLPRVGQWNMMNKKMVNGARVRSWLCVNFARNVQESMATGFCREPDAWGQASGMDFALEPVLPVIYVRPDQVERGLKARFHDAMTALGPQRKEIELLIGILPDNNGSLYGDLKRVCEIDLGLISQCCLTKQVFKMNKQILANLSLKINVKVGGRNTVLADALTRRIPLVTDKPTI

SEQ ID NO: 110292 - protein, 134 aa, Triticum aestivum
  Clone ID: PAT_TA_4710.pep
ILVNSFDAVEPDAARVLSHPEPGRPPVYNIGPLILADTGEEPRAACLDWLDRQPPKSVIFVSFGSGGSLPTEEMHELALGLELSGQRFLWVVQSPSNYVLLVPITFIISRILTVDRDRTSQLALVAFAAIFDGN

SEQ ID NO: 110293 - protein, 272 aa, Triticum aestivum
  Clone ID: PAT_TA_4711.pep
ARCPLPPRAPPPPRPLPRRLMSSSSSSSSSGWHHSSRLPPPPPPPPPSFSDKDQLFRGLEAALGTTFSSEPLAPPPEPMILVISGPSGVGKDAVIKRLQEEREEIHFVVTATSRAIRPGEVDGKDYHFVTKEAFLTMIEREELLEYALVYGEYKGIPKQQIRDYMAKGHDIVLRVDIQGAATLREILGESAIFIFLVAESEEALVKRLIQRKTETTDMLLVRIATAREEVRRMKYFDYVVVNAEGKLEDAVKQVESIIDAEKAKVQKRNVKI

SEQ ID NO: 110294 - protein, 257 aa, Triticum aestivum
  Clone ID: PAT_TA_4712.pep
HEGRRRRLGETDEGGGLESKILAIKDFLEDPDQSEEELVSLLLHRAPGDGPRPARQGPALAPLGRRPPVHPSGDVRQLVKLLVRKWKEIVDGWVRLHNSGGDGGNSILTDGDSPEKTQGKSYQNARVSDFKYTPSPPQRHSGLSSERSRNNNGFESTLERHRASPAPTYHTKQNNGNNYSTTSSSAPARAMREQKDNHLDEKLDSARKRLQENYQEAQNAKKQRTMQVLDIHDIPKPKNKNTFIRKPGGGGLPGRHR

SEQ ID NO: 110295 - protein, 487 aa, Triticum aestivum
  Clone ID: PAT_TA_4713.pep
MTEVALFRGPTNLASPASRGSSSSSSSSTSLRYLADSDVLQRGTTGSAQSPAGSAERQAGGSEEEEEEEERWSFLALLLELLRKSLLRCRAEDGGQGQGGMEIGLPTDVQHVAHVTFDRFHGFLGLPVEFEPEVPRRAPSASASVFGVSTQSMQCSYDSRGNSVPTILLMMQRRLYEQGGLRAEGIFRINAENSQEEFVRDHLNSGTVPDGIDVHCLAGLIKAWFRELPSGVLDSIPPEQVMQCQSEEDCARVAKCLPPTEAALLDWAVNLMADVVQEEQINKMSDRNVAMVFAPNMTQMADPLTALMYAVQVMNFLKMLIQKTLKDREESNLEDASLPQKDPSDENGHQNPSLPVNPQPEETSGRPSFVSEEPIVYSPTHSAEDKPPVEGDSIASVVHTSDVRSSVEGSASCSQPALVASSAIADASCATAANLLPSRGSRGLNSRRTRKGKRQCGTPAAPPAEKSRGASIVSRINSKVERIEAWR

SEQ ID NO: 110296 - protein, 182 aa, Triticum aestivum
  Clone ID: PAT_TA_4714.pep
PEFCYISYIYILLQSAGSRVETCSYQLHHKQYGRKSLLRLSFSCRAQHGDGIRHNLKQNASAKAHLYCPKHVLHQARHLLFLLPHSLPGFIYLFANQLDLTQDLLLTCLVQIKSFALLSTLRGGAAEDPWTNAGRQRRQVAGSRRRHAVGRRNASGRRVCAAPWLAEREGAGPGTAAAAADG

SEQ ID NO: 110297 - protein, 241 aa, Triticum aestivum
  unsure (1)..(241): unsure at all Xaa locations
  Clone ID: PAT_TA_4715.pep
TRPLGHLSLTPPPPHPHRXSIPSQPAPPSPPRXPPNQPASSPSIHPFPQFLHPPTGARAFSPRPQALDPPSQPPSPLDPWPPPTRATSAPXFSPLSDPEERSSSRPHLARWSPATQASAADEHRGPPLPPXSPSPRXDPPPSLNSPPLLPPAPAGPRGRPPPCRPLPPPPRPVPARWPPAPPRPSTRPPLPPPCPRPPPAPRLPDMNCPDPXPSPVASSSSRPRQTTDPPNRTTPLPPLPT

SEQ ID NO: 110298 - protein, 205 aa, Triticum aestivum
  unsure (1)..(205): unsure at all Xaa locations
  Clone ID: PAT_TA_4716.pep
PAPPFPQPPQLPTPDSGDSASVPPPAAPPRSRLPRLRPPPPARCPPPPPPLAPPPPPRAXSPSPAASARPAPPPAPGGPPPSSPAPPPPPPPPLAPPXPPAAPPPPAPSPPGGRPRAGPRPGAPPARPPGPARPPAPRPPGRRPLRPRPARARARRTPALPLILGLGAGAPVQQKHALPLNNLHGVRSSSSSTRLFPTSSLLRGR

SEQ ID NO: 110299 - protein, 830 aa, Triticum aestivum
  Clone ID: PAT_TA_4717.pep
GVRARIRLGVLLLRVLGSSGPPSHVEGCCAVPCAAKDAHPRHKVCEMHAKAITAVVGNTVQRFCQQCSRFHLLQEFDEGKRSCRRRLAGHNKRRRKTRPENAVGGTPIEEKVSSYLLLSLLGICANFNSDNAEHLQGQELLSNLWRNLGNGRVGLDPKELCKLLEACQSMQNRSNAGTSEAANALVNTAAAEAAGPSNSKAPFANGGDCGQTSSAVLPVQSNATMVATTETPACKFRNFDLNDTCNDMEGFEDGSNCPSWIRQDSTQSPPQTSGNSDSTSAQSLSSSNGDAQCRTDKIVFKLFEKVPSELPPILRSQILGWLSSSPTDIESHIRPGCIILTVYLRLVESSWRELSENMSVYLDKLSSSSADNFWTSGLVFVMVRRQIAFMHNGQVMLDRPLAPNSHHYCKVLCVSPVAAPYSATVNFRVEGFNLFSSSSRLICSIEGRCIFEEDTAIMADDAEDEDIEYLNFCCSLPDTRGRGFIEVEDSGFSNGFFPFIVAEQYVCSEVCELESTFKSSSLEQPDKDNAMNQALEFLHELGWLLHRVNIISKHDKVEPPVPAFNLLRFRNLGIFAMEREWCAVTKMLLDLLFDGFVDAGLQSPKEVVLSENLVHSAVRGKSARMVRFLLTYKPNKNLKETAETYLFRPDARGPSAFTPLHIAAATSDAEDVLDALTDDPGLVGLNAWRNARDEIGFTPEDYARQRGNDAYINLVQKKIDRHLGKGHVVLGVPSSMCPGITDGLKAGDISLEICKAMPMTTTSAARCNICSRQAKMYPNSFARTFLYRPAMFTVMGVAVICVCVGILLHTLPKVYAAPNFRWELLERGAM

SEQ ID NO: 110300 - protein, 172 aa, Triticum aestivum
  Clone ID: PAT_TA_4718.pep
PKVQQNKVSTLTAVSLCSLLPKPAPVVAYCYPGCFVAINISPMFCFLACLLLQSILLLLSYLLLVVPSNYVYLLLSYLYSHVIKHLCTTVVVVWQTPEANHICDAVSVTWRFYMACLYWQLYTDDDVYLHCLILFILILTEKHHMFLFCLRHNKHVFFIVELNYRLLCSSNR

SEQ ID NO: 110301 - protein, 158 aa, Triticum aestivum
  Clone ID: PAT_TA_4719.pep
PRVRAVIPILGEASSRYQINESDLRIERFRSGGPGGQHANTTESAVRIVHIPTGTTATCQNERSQHMNRASAMAVLQSRLDQLEITRQAQMNAEHTQSLSEISWGNQIRSYVLQPYRMVKDLRTNYEVSDPDSVLEGDLDDFILSFLSLSLDKVDESV

SEQ ID NO: 110302 - protein, 205 aa, Triticum aestivum
  Clone ID: PAT_TA_4720.pep
ASGRTTSASVRGPRFAGAGRRGALLLALLLAAAAALLPVAEPSCPRDNSVVKDINKMHQSNYGIGGFSHITVAGALAHGMKEVEVWLQTISAGQRTPIHRHSCEEVFVVLKGRGTLLLGSTSLPYPGTPQEIPVFQNSTFTVPVNDPHQVWNSDEHEDLQVLVIISRPPVKIFLYEDWSMPHTAAKLKFPFVWDEDCLDAPKDEL

SEQ ID NO: 110303 - protein, 159 aa, Triticum aestivum
  Clone ID: PAT_TA_4721.pep
ISKEADPLLRGRFPKRGLYQALAIAAMCLQEKSRNRPLIREVAAALSYLSSQTYDGNDAAVRRYLDGPSASKVSDDQVNQDDALASQHGAQTSMHDRMNDFVPEGKEHCRSGSNRGGRGRVVPNGVDRDRALADANVWAEAWRRHEKASKVRVTDEILG

SEQ ID NO: 110304 - protein, 142 aa, Triticum aestivum
  unsure (1)..(142): unsure at all Xaa locations
  Clone ID: PAT_TA_4722.pep
MRMKTLACCRRRPXXFSVDMDQEPEKVTTYNGLESCIFNSSSYDEDSGVSATTGADGCVTADSLEDEASSCSSSRDVDGSSFSSQCLPLSEHEEHSRGEFDTLDAIHLLPLKGKNPITYTLSAADIEIMKEKFAKPLLGDDV

SEQ ID NO: 110305 - protein, 71 aa, Triticum aestivum
  Clone ID: PAT_TA_4723.pep
AVGVVGGVIALGLLALLLVCFVRYKREKKMEVMERNAEVGETLRMAQVGRSQAPVALGTRTKPVIESEYVA

SEQ ID NO: 110306 - protein, 232 aa, Triticum aestivum
  unsure (1)..(232): unsure at all Xaa locations
  Clone ID: PAT_TA_4724.pep
SLKLLRLRTAGQCHFLPPLLLLHLVPALLLLPPSRPALAAAATVVTHLPGFDGPLPFNLETGYVGVEEEAGAELFYYFXXSERSPGTDPLLLWLTGGPRCSVIMGLAFEIGPLKFVLAPYSGGLPELVSNPYSWTKMANILLLDSPVGSGFSFARDPKGYYVGDYSSSSQVQTFLNKWFTDHPQYLSNPFYIGGDSYAGKVIPLIAQGIFRRIDMRQQPVINLKTYGYYLAY

SEQ ID NO: 110307 - protein, 140 aa, Triticum aestivum
  Clone ID: PAT_TA_4725.pep
KKKKENTVRARQLRSRVPRRARYTTRAVEGVGDQRVQPRQGSPRPAANATQHTQRTRAATVPLSPGRPAAAARWSPHFPLSVRSLSQSFPFAFPSRHRFLRQPSPATPPLRRGVPYPRPPPAPLRCAHPTHGPRDRTPAP

SEQ ID NO: 110308 - protein, 292 aa, Triticum aestivum
  unsure (1)..(292): unsure at all Xaa locations
  Clone ID: PAT_TA_4726.pep
MDAPSVALYNQLKAAQPFFLLAGPNVIESEEHVMKMAKHIKAITTKLGVPLVFKSSFDKANRTSSKSFRGPGLEQGLKILEKVKAAYDLPVVTDVHESNKCETIGRVADIIQIPAFLCRQTDLLVAAAMAGKISNIKKGKFCVSAVRTNSREKVRLAGNQNVMVCERGTMFGYNDLIVDPRNFEWLREANCPVVADVTHALQQPAGKKLDGGGVASGGLRELIPCIARTAVAVGVDGIFMEVHDDPLNSPCDGPTQWPLCNLEELLEELIAIARXVTKGKKPLKIDLTPFKE

SEQ ID NO: 110309 - protein, 186 aa, Triticum aestivum
  unsure (1)..(186): unsure at all Xaa locations
  Clone ID: PAT_TA_4727.pep
THRSPAVLERERLLAPSSKKQARAGAPLPQLEPERVERAPPRTLVHEGGSSQGPFFPAANPVGRAKPPAGDLQQHPAGCTNSSTTMAPPMDLRTAAVTPASFGTFTDTRRRDPACACQHHNNGAAQISELPSACPRHSSESSPTPAVAILHVRVSEEHLPPWPSTGSSSSPFSFLSSTXAXGXSSV

SEQ ID NO: 110310 - protein, 67 aa, Triticum aestivum
  Clone ID: PAT_TA_4728.pep
KFTLLVQEKKMPTVVTYNTTSHVYSFPLYRKNCFFNAWVAYHTTLCSASSTEQIVMKKLHTKFRQLP

SEQ ID NO: 110311 - protein, 225 aa, Triticum aestivum
  Clone ID: PAT_TA_4729.pep
SSDSPTSPIITLPLLRPSGRPQGKLRIRVALRERSPPPPEPQYPPPSSSPYYFPAPPPPTYSAPPQYGSDQYYRPSGYYSAPPAPPPSQYEYTTGPSAPVEYGRQYEQRGRTEGVTGQYDPRRTEGVTGQYDPRRTEGVTGQYEPKGRTEGVTGQYEQRGRTEGGTPSERYGLGTGLAVGAVAGGVGALAIDEGVKYKEEKAAERVGEKVTPAARDDYSEYRREY

SEQ ID NO: 110312 - protein, 316 aa, Triticum aestivum
  unsure (1)..(316): unsure at all Xaa locations
  Clone ID: PAT_TA_4730.pep
LAPPPPPPSPLHPHQLQQHPLPPHQHPHPQYQAPPPSMPPPPGAPPNAMDLEVTVVSGKHLKNVNWRRGDLRAYAVAYRDPSRRTATRPDGTGGCKPAWIDRMTLQRPPLLPPHDPSILXRLDVFHSIPSKSPKPRGCYSRAPLRRLLFPDGLKYKEGKGGTRGWARXRGSCRPGTPPGEVPSQIDLIGSSKCVRVRXLPLLISVALPRYGSXRFYRPGGLYSAPPPPPPSHFYEPKGRTEGVTGQYEQRGRTEGGTPSERYGLGAGLAVGAVAGGVGALAIDEGVKYKEEKAAERVGEKVAPAARDDYSEYRREY

SEQ ID NO: 110313 - protein, 160 aa, Triticum aestivum
  unsure (1)..(160): unsure at all Xaa locations
  Clone ID: PAT_TA_4731.pep
DLQGRRQHHGPRVTEEQVQRDLAMNKIDSNHPRHLQPVGEPVGQPVTVTSDAYEPVRDAHAVCILTEWEEFRSIDCRRMYNVMQKLAFVFAXRNIVDPXKLRDIGFIVYAIGKPLDQCPVAEGHASHHPRRCTLIAERRRGFFLLINNNTWLNFKRFLML

SEQ ID NO: 110314 - protein, 81 aa, Triticum aestivum
  Clone ID: PAT_TA_4732.pep
SKLRRTERYLNNRYDRSKERGFTLQVLRLRLVETQVNPEPVNPHLPILIGCLLFPSSLVTILPPHISPRHERIAGLRASYA

SEQ ID NO: 110315 - protein, 51 aa, Triticum aestivum
  Clone ID: PAT_TA_4733.pep
PLFRRSRLRVLKRSRQQKATSREQAAKDLQELEKWREELEALLIAERSELV

SEQ ID NO: 110316 - protein, 270 aa, Triticum aestivum
  Clone ID: PAT_TA_4734.pep
WLSLCFIAGTTLLAIWFLELSRRNPNKKLPPGPWTLPIVGSLLHVVGAFPHRTIAELSRRHGPLMHLRLGEVATMVVSSAEVAALVLKTNDLTFADRPRTVTQDIFGSGGKDIAFAPYGAAWRQMRKVCVMEILGSKQARRMERVRTEEIGNLLRSIVSASAGGGAGATVNVSEKVAMLSNDVVSRAVFGGKVAQRDKYIRELGEAMELVTGFCLVDIFPSSRLVRWLSSVERRMRRSYGRMQSIIADILDERKAARAAGDGSCSTDDED

SEQ ID NO: 110317 - protein, 199 aa, Triticum aestivum
  Clone ID: PAT_TA_4735.pep
GRPTPPAAPPADLPSASTTGSTCRLINAPLHLGLRASTASPCCRLTHTPPSPCSAPSPGRPLHPTGRPATPPFSRLCIARRAPVPPRERPGWVICFDLDAPLAMGGDSAGCDSSHLPMAQREEAHEGGDSGGMGPSALLPRGSAAQVHVPDIDNTDSHRESPHLNRNTLQLRGLKGSDLARYPTAAPHYREGKVLWRRP

SEQ ID NO: 110318 - protein, 221 aa, Triticum aestivum
  Clone ID: PAT_TA_4736.pep
ATSTASSSTVANPCYDHKPDILNSDIASHWQNLQYGRFCQDARPMGPVLYPFAVPPGYMQGHVPWDGPGRPPSPNVNWTQMVGAGQRAFPMMPLQPASERVTAVPPHYGEHAPRYRGGTGTYLPNPKVPFRDRERPSSSRYFRGGYNSDKGDNSDKEGSWANSRQRNTGRNYGRSQSERYGMRSDRQTTHEGQFDRQRRSYRNDSHRHEAGAQYLGQGQSH

SEQ ID NO: 110319 - protein, 150 aa, Triticum aestivum
  Clone ID: PAT_TA_4737.pep
MATGHAFRRLARRMLSNVPESTVYGGPRPQEAAAARRVTVTTLRGKHRRGEPITVVTAYDYPSAVHVDSAGIDVCLVGDSAAMVVHGHDTTLPISLDVMLEHCRAVARGASRPLLVGDLSFGCYESSSTQAVDSAVRVLKECGMACNQTG

SEQ ID NO: 110320 - protein, 117 aa, Triticum aestivum
  Clone ID: PAT_TA_4738.pep
EPDDGEKPPKSSLPLTVTITKSDGPSLDFTCTAYPDEILIDTLSVKQPSENLGEDYIAYEGPDFNDLDENLQRAFHKYLELRGITPMTTNFLHEYMINKDSREYLFWLNKLKDFVKQ

SEQ ID NO: 110321 - protein, 143 aa, Triticum aestivum
  unsure (1)..(143): unsure at all Xaa locations
  Clone ID: PAT_TA_4739.pep
AKQSEGYVRPNFLPRITLANIWEPASREACDNNIWEIIKASFGILFAKSTXPAFEELIILYSDDSAQSNEKESSEMQMLPPQLKIYEKIPIPDLPVVFPHKKLSFRILDTVRLDIATVIGLLAYVVNYKFESLASSPAAFLLD

SEQ ID NO: 110322 - protein, 212 aa, Triticum aestivum
  Clone ID: PAT_TA_4740.pep
NAISSEQTCSTSPRGYVHWFWAAPWRIGAAVDLAGGRRQWEKEDDNRGEPNLDLDDDQSECTRTLSSCIGRCRTVDERQLAPAAPAVVLPHSSFPGCLPRPPELFFPRPALLLRLPPRLPSHSALVTPRQRRLRVAAFLPASPSGTDPGLSSSSSCHPMVIGAVDAVAPNAHHAELAGHSRWIRCRVGTVEADVADSGMGHGGGGPGTEQRR

SEQ ID NO: 110323 - protein, 296 aa, Triticum aestivum
  unsure (1)..(296): unsure at all Xaa locations
  Clone ID: PAT_TA_4741.pep
MATESPFRADVLRGKAALVTGGGSGICFEIAAQLARHGAHVAIMGRRREVLDKAVAALRSEGLRAVGFQGDVRNQEDAARVLASTVEHFGKLDILVNGAAGNFLASPEDLTPKGFRTVLEIDTVGTYTMCYEALKYLKKGGPGRGPSTGGLIINISATLHYTASWYQIHVSAAKAGVDSITRTLALEWGTDYEIRVNGIAPGPIGGTPGLRKLAPDEMGKGKREMMPLFKLGETRDIAMAALYLASDAGKYVNGTTMVVDGGLWLSHPRHIPKEEVKELSKVIEKKXRASGVGVPS

SEQ ID NO: 110324 - protein, 299 aa, Triticum aestivum
  Clone ID: PAT_TA_4742.pep
MATESPFRADVLRGKAALVTGGGSGICFEIAAQLARHGAHVAIMGRRREVLDKAVAALRSEGLRAVGFQGDVRNQEDAARVLASTVEHFGKLDILVNGAAGNFLASPEDLTPKGFRTVLEIDTVGTYTMCYEALKYLKKGGPGRGPSTGGLIINISATLHYTASWYQIHVSAAKAGVDSITRTLALEWGTDYEVRVNGIARGQMRCTSDLIGGPSRTKEACAWGPFSKLRGPRDIAMPALYLASDAGKYVNGTTMVVDGGLWLSHPRHIPKEEVKELSKVIEKEGLRASRCRCTVHARL

SEQ ID NO: 110325 - protein, 106 aa, Triticum aestivum
  Clone ID: PAT_TA_4743.pep
RSLRRRSHHGRRPLQGRESCYKARDAFYACVEKHADKKPTEIATMGLLFPADCKKSRAQYVSSCRPSWVRHFDRQHCAKKRVQRLLDGDDDGRGPMSLPQPYTFKQ

SEQ ID NO: 110326 - protein, 137 aa, Triticum aestivum
  unsure (1)..(137): unsure at all Xaa locations
  Clone ID: PAT_TA_4744.pep
GPPPPPPITAAPEPPWPTCSPRAAPPRTSPVPPRRPRSRSPPTPPPXAPPPGPPLEGPLQVRPRPAPHRRPPLPAAALRPAARRPVAGREAARRRRRRPGSHVAAPALHVQAISGADDGPVLCTNQIRPRWYWFIVL

SEQ ID NO: 110327 - protein, 107 aa, Triticum aestivum
  Clone ID: PAT_TA_4745.pep
LENHASKTAKVLLVAANDNEAQKLSSSLKLEILTVNDGSQGSTFTVCSSMGLINVLVKGCESLATSGVEEFEIVLVADLPASFDDYVEILTRIAPSHGCRGGACYRL

SEQ ID NO: 110328 - protein, 94 aa, Triticum aestivum
  unsure (1)..(94): unsure at all Xaa locations
  Clone ID: PAT_TA_4746.pep
MGNSIYKFLGGVCSDLSDAACQPHGAXHASVAGLGRDILEFPAXTKQVPEGLGRHVVSSAAAHANWYKKLQVXWQERRRRPRTKPDECRPPRGA

SEQ ID NO: 110329 - protein, 178 aa, Triticum aestivum
  unsure (1)..(178): unsure at all Xaa locations
  Clone ID: PAT_TA_4747.pep
TADGGKTLCYNLNCGGFVQTSRAIALGASIVNGASGVDDPVPYLLVSIEKSAAGPWHVLVNDTDLGYYPRAIFPWWMFPESVANLMGGTVLNTWPGGKHTDPVVGNGRRPPRDSKPAIVKGYVAVDLDXTPSPTTLEVIVHTAPNCYDVKFFDQSNGSVGASVAFGGSGGPDCAPRPA

SEQ ID NO: 110330 - protein, 177 aa, Triticum aestivum
  Clone ID: PAT_TA_4748.pep
LSESRVELCPPAYEEGILEAPTGFEGTANLEYNRLIREGRETGNAPGENIKRSATRLRSIAHLLGCRTVEAGMPTQSRSTSSEEEAAAEMALRGFMDDAPQPSQPIERRHFNLKPRKTFNRYTPEAWNKKQKRTVVESENEFEDEEEPAPKKVLRRLKRVGVEPGTKKVVRQARGKK

SEQ ID NO: 110331 - protein, 123 aa, Triticum aestivum
  Clone ID: PAT_TA_4749.pep
PSQKRCFPPHPTSPHVALKDDADAVPSKPPSHMEPPVGMPPHLGTTRSHEERLPGPLTPGPPPARPPPVCRRDPPRGALAGPSAPGHGAPPRPLGPPMIPPPPTSACSPRPPLPQSPHIPGVV

SEQ ID NO: 110332 - protein, 312 aa, Triticum aestivum
  Clone ID: PAT_TA_4750.pep
EEEWVYVFKRDRDQKLSWHAFDPVHQLWRSLPPVPPEYSEAVGFGCAVLSGCYLYLFGGKNPVRGSMRHVVYYNTRTNKWHRAPDMLRKRHLFGSCVINNCLYVAGGECEGTQRTLRSAEVYNPNRTRWSCITEMNTGMVPFTGVVYDGKWFLKGLDSHRQVVSEVYLPTSNTWSTTGNALVAGLRNPTISFNGRLYSADCRDACKLRVYDGDIGLWTRFMDSRRHLGSSRAFEAVALVSLNGKICVIRNNMGMTLVDVCDPTKVIEMESARVWETFARKGHQHRSLMANLWSAIAGRNLKAHIIHCQVLQA

SEQ ID NO: 110333 - protein, 185 aa, Triticum aestivum
  Clone ID: PAT_TA_4751.pep
DPTGSKPLPYPLVSCQALPIPFTKTQEILFIRRSGASVLISRKLKQAVVEPHALSSMDWCRFSSLESRNVSCPIFCSGLSGVSSEIPRVSKGSHPSQPPSLEAYIMVFGSRSSPSRSSSLVHIPELCHQPYKGLISLLLMMLCVILVIDELAPFLVQRLSDEVVLVLFSVGGHHLHHRRSAMGPV

SEQ ID NO: 110334 - protein, 122 aa, Triticum aestivum
  Clone ID: PAT_TA_4752.pep
IRHQEGGQVEVLSCCGMAILNSDTRTIVYTMAVALLVVMMMSSSLPSCHGTDEEEGWECRQLLHCTAPGCLSYCKVLKHGVGHAYSIMSKCRHNRTECCCRDYNHEPPPPRDLVLVQNNAGA

SEQ ID NO: 110335 - protein, 173 aa, Triticum aestivum
  unsure (1)..(173): unsure at all Xaa locations
  Clone ID: PAT_TA_4753.pep
MGPTGRSRAVLLLLLAAAAAAAPEHESLLRLPSSARSLAPKTPRSAGADLIRALNLHPRDASPRRPGGVGVGVGGSDALPAGSLVERPIRLASLVAGDDGGGGTSVXNLGHHAGYYRLPTTHDAKXSFYFFFESQAGTKXEXDPVGIWADGRAXAXTTKLASFTKNGPLXITG

SEQ ID NO: 110336 - protein, 348 aa, Triticum aestivum
  unsure (1)..(348): unsure at all Xaa locations
  Clone ID: PAT_TA_4754.pep
AQSYESTPFCSGLWSNQPPPSSPAARSDRRLPPSTPPEDSASIGLVMASAAYLDNIDAEVIDPPKIGMLDVTELVGDLIEHSPKPNVIVSSNVRELLECPVCLVAMYPPIHQCSNGHTICSGCKPRVHNRCPTCRSELGNIRCLXLYEKVAASLEVPCKFQNFGCVGIYPYYCKLKHESQCQYRPYTCPYAGSECTVTGDIPYLVNHLKDDHKGDMHSVSTIFHXDVKSNPHEVENATWMLTVFSCFGQYFCLHFEAFQLGMAPVYIAFLRFMGDDAEAKNYTYSLEVGGINRKMTWQGIPRSIRDSHRKVRDSYDGLIIQRNMALCFSGGDRKELKLRVTGRIWKEQ

SEQ ID NO: 110337 - protein, 157 aa, Triticum aestivum
  Clone ID: PAT_TA_4755.pep
MAASSPASSGKAASDSSAPPPAPSPVVSNGNGTPQKPPPVAGFDMPKPNLRGLNKPKCIQCGNVARSRCPFQCCKSCCYKAQNPCHIHVLKQNNTLPEKTPPAPIPLSDQPSTNSPLTGSSSRLSSLQKLPHHFLNSIRTESPLPRRTLQALPSGGL

SEQ ID NO: 110338 - protein, 327 aa, Triticum aestivum
  unsure (1)..(327): unsure at all Xaa locations
  Clone ID: PAT_TA_4756.pep
MPKPNLPPLSTPPCLPSGAVARSRGPCPGSSTGPGAAPSPCHIHVLKQNNTLPEKTPPAPIPLSDQPSTNSPLTGSSSRLSSLQKLPLHFLNSIRTRKSLAKKDIASINKWRFMKLKEHMQGDIDIEKEACERYTQNIGLLEXETFYLKEDSSGEHETEATSSEEMMEIMVSEAKVRLKSDGANAAGFKERIATVLDQKLKKLQERNSAYEDDNSSDQSLDDHTKPVKLNIKQQTVRNAKTNELLGKLTKAQSEDDLKPCLNIMAQLFGKEIASSSMGTSNKSSDQESTPAVAPSYSFPKLTTRLEVDENMMSKISELSSLSQVVQL

SEQ ID NO: 110339 - protein, 142 aa, Triticum aestivum
  Clone ID: PAT_TA_4757.pep
RVGILLLWAAVLWLPWHLPDRCPWRASARCLSHSWYSLPTLLFLACCCPVCSPLGLASDAPPAGGLRCFAPLLLFPGCCPGDGHHFCVVSPCPGSTACSRSRSPPSASSSPHMTLLTAAPKWPFPLLRPFDTWVFQVVPPMR

SEQ ID NO: 110340 - protein, 175 aa, Triticum aestivum
  unsure (1)..(175): unsure at all Xaa locations
  Clone ID: PAT_TA_4758.pep
VWNYYECCCNDWHGWQLVYYPTSPQQPGQLQQPAQGQQGYYPTSPQQSGQGQQGYYPTSPQQSGQGQQGYYPTSPQQSGQGQQPGQGQQPRQGQQGYYPISPQQSGQGQQPGQGQQGYYPTSPQQSGQGQQPGHEQQPGQWLQPGQGXQGYYPTSSQQSGQGHQSGQGQQGYYPT

SEQ ID NO: 110341 - protein, 522 aa, Triticum aestivum
  Clone ID: PAT_TA_4759.pep
NLHDTFSAFGAILSCKVAMDDIGQSKGFGFVQYEKEESAQSAMKSLNGMLINDKPVYVGPFLRKQERDNSFDKAKFNNVFVKNLSESTTKDDLVKVFSEYGTITSAVVMIGMDGKSRCFGFVNFESPDDAARAVEELNGKKINDKEWYVGRAQKKSEREMDLKRRFEQSMKDAADKYQGQNLYLKNLDDGITDDQLRELFSNFGKITSCKIMRDQNGVSKGSGFVSFSTREEASQALTEMNGKMISGKPLYVAFAQRKEDRKAMLQAQFSQMRPVPMTPSMTPRLPMYPPMPTLGQQLFYGQAPPAMIPPQPGYGFQQQLVPGMRPGGGAHMPNYFVPVVQPGQQGLRPGIRRNGPGSAQGQQTPQPFQQQMVPRGRVYRYPPGPRHMPEVQQMPGVGVGGMVQPYDMGSFPVRDAGVSPAPPIGTLTSALANATPEQQRTILGESLYPLVEKLEHQQAAKVTGMLLEMDQTEVLHLLESPEALKSKVAEAMDVLRNVAQQQNPNAPTSQLAGLTLSDGIIS

SEQ ID NO: 110342 - protein, 233 aa, Triticum aestivum
  Clone ID: PAT_TA_4760.pep
FRSKWVSLSNNALIINSRITCSLSNSTGARIWPRNCSCHAIAHLTLHRCILTLFPAAKAYYALGLGMSGDPYSNSLEFSRDALHSSTEGTAVARWHTQLQAGNRRRPASQLPPEKQSREESSRDITGDTHEGWLICLEVHDDVRRNTVWLRLGDRGCWPARSVGVGAEALGEGRGGPHRTPEGARCSGGAGGGVRSRGADRWERRAPAQVRRTGPERIAGGGGPQGRRAAARA

SEQ ID NO: 110343 - protein, 131 aa, Triticum aestivum
  Clone ID: PAT_TA_4761.pep
SLPPADPTQRTTAPPNPTQHLGRSRTPTTAPSPSGFSPTTTPAPSWIISSSKLSSVTSTSPVTCGSRGVAKKRVKCRDGAIRRGSLCSAHMPQQRHLRPRTAAVCPAGRPILNGREDDHAVQKKVSLLLFL

SEQ ID NO: 110344 - protein, 222 aa, Triticum aestivum
  Clone ID: PAT_TA_4762.pep
ENRKVKLKLRVDASPSCWAGRQPPPQPHPPQHAAAHQATGHGDGGGGDDVVQPVSIDIVAPFMDASSMTSRGGGGRPAARCPPFSTAGMDWKETRTAHVSSGGRARAGRATRWRVRWGSERGWSAIDRAARARPPPQGKGDAWHGAGAERLQVRRTARLPPHRRGGGRHPPARHRTAHHHHPQRRRRRYQDSHTPLQPLITYASHPPSQFLQPHGSTTRSHC

SEQ ID NO: 110345 - protein, 120 aa, Triticum aestivum
  Clone ID: PAT_TA_4763.pep
NKLKIASESMKLVALGLVLLGCLQSLAAPDFQVIALYEMRMMLTDSRGVLKDWNNNQVSPCYFDNVRCDQDGKRYWNVCERLQLKCVLHQPSLAALSTLRRLFFDASRATSRRCSTPTSG

SEQ ID NO: 110346 - protein, 153 aa, Triticum aestivum
  Clone ID: PAT_TA_4764.pep
PSPPPPDLTLAATAAAAAAVAAFVVPLRCSRPAHPPLRLHIPSFLVPSLSSRRSSEPHLVLLAPTRSLTTSPSAPSSHRHHRRSSTPRSRRLLSVERRILNNERPGEWWLHGHGVLCIGLTNSPGRSPILAFCSDLVYMKAHGSPNFNSDAEQ

SEQ ID NO: 110347 - protein, 315 aa, Triticum aestivum
  unsure (1)..(315): unsure at all Xaa locations
  Clone ID: PAT_TA_4765.pep
VDFCHGRGVYHRDLKPENLLLDEAGNLKVADFGLSALAGHARPDGLLHTACGTPAYVAPEVLGGNGYDGAKADIWSCGVILYVLLVGALPFQDENLMSMYRKMQRGGFLCPSWVSKDARKLIGRLLDPNPSSRITIASLVESPWFKKTSPIPSPLLEPVPPAAARGNGEDKDEPPEALNAFHLISLSAGFDLSPLFDQEPSTGRGARGGVMRFATREPASGVIFAAXRAWRPGGAMRVTKSGARGVRLEGAERGRKGRLGVAAEFFSVAPSVLVVDVKKDGGDTMEYRSFCSDELRPALKDIVWAAAAAAAAFPR

SEQ ID NO: 110348 - protein, 193 aa, Triticum aestivum
  unsure (1)..(193): unsure at all Xaa locations
  Clone ID: PAT_TA_4766.pep
MVASEIAAVFFLFNALLRGSLVHSQGLQRGFYDSSCPDAEDIVRSTVEKYYNNDATIAPGLLRLHFHDCFVQGCDASVLISGASSERSAPQNFGLRGFEVIDDAKSQLESTCPWXXVSCADILALAARDSVDLTGGPSWPVPLGRRDGRISSAADAKALPSPADPVSVQRQKFADQGLSDHDLVTLVGAHTIG

SEQ ID NO: 110349 - protein, 338 aa, Triticum aestivum
  Clone ID: PAT_TA_4767.pep
RSLARAQTDRSVRPADRRLREVEGGGMVVRRSPARRRGVRVGPTKLEGLPAAWSAPAVAAVKVKWPGAGGALSQMLTGRRGGRGVTAVEPVGGDGAVRWDAAADANRVRVDVEPGASPRGGAGAGGAGRPERGVFFSVLYGFQEQGRGKDLVRLDEIGTAMISLEECCWEMQLQQQQKVGAPLQQLVVVPIRVRKDGWASDAMLYVNVELVDLSTPAGGAPSASPTGSPSPNPTPVPTMREIHRGSTYHEVLDLKQLLDLAEKQGRVAVYRNKRNSDTSSVSSGGMSSSSSTVSLSSASTSTSGGASPEPGSTSKRRFLPWRRRSRESLSQEMPVAKC

SEQ ID NO: 110350 - protein, 121 aa, Triticum aestivum
  unsure (1)..(121): unsure at all Xaa locations
  Clone ID: PAT_TA_4768.pep
RGPPRPPPARPAPPACARPSSSSSPRPPPPRHCPAPPPPPPPPRPPPAPPPPPPPXPPRPPPPAPPPAPPSCPPSSASAATLRSACGCALLRVLARCPLPRSVTFCRHVAEWMSVGHSPGL

SEQ ID NO: 110351 - protein, 145 aa, Triticum aestivum
  unsure (1)..(145): unsure at all Xaa locations
  Clone ID: PAT_TA_4769.pep
XDCSPKXVLVPXWSTXQTIXXFSQAHPFFNHQTQQQQRISSYGIFNDWAAKRASPGDPATSQAAATYVDGIASQHRQDAWSSDQWQRRPTATLTMVALVSTCQGNGRRQQQTTIDEVHGVGTSMEAAESGRSTHGEEAHGPDEGP

SEQ ID NO: 110352 - protein, 123 aa, Triticum aestivum
  unsure (1)..(123): unsure at all Xaa locations
  Clone ID: PAT_TA_4770.pep
MDDCFHTSQLLNSSLLWVYPKGLLGXFIRVILIKALLYSLGSGESPFLDIVAYAGMXFAGTSLAMLVLIFWSYSYYFVLPWFCIXLQGASRTYERHPSRNHYFLLFLAAAQFPMLFWLGNIKG

SEQ ID NO: 110353 - protein, 176 aa, Triticum aestivum
  unsure (1)..(176): unsure at all Xaa locations
  Clone ID: PAT_TA_4771.pep
MLMASAALSSTATPPPPSPADATLPPPSPFFAPPYGPLPSHPPACTSTCAASATASQLGHAMGGATLEEALEEVHGLQDRLGVPPAASAPPRPRRRAAAGAPPDRTGRAVAVGDLPGRARSATVKVVRPLTKLXALNDAKDLGGRLPKRGTHAVGKDERGDPKDQHGAVGAKVPVA

SEQ ID NO: 110354 - protein, 333 aa, Triticum aestivum
  unsure (1)..(333): unsure at all Xaa locations
  Clone ID: PAT_TA_4772.pep
TARLIRKPPAPVVDAVVPLPEEVAATAASVVDVERAVAAPVNRRRAPNGVAEQEPRSGGIRGEVKPRIIDVPNGVVGEHVAAGWPRWLTEVATEAVRGWQPRKAESCEKLDKIGQGTYISVYKARDLENGKIVALKKVRFANMDPESVRFMAREIHILRRLDNPNVIKLEGLVTSRMSSSLYLVFEYMEHDLAGLAATPGIKFTEAQVKCYMHQLLSGLGHCHSRGVLHRDIKGANLLLDNNGALKIADFGLATFFNPNQKQNLTSRVVTLWYRPPELLLGATNYGATVDLWXSAGCILXAEFLSGKPIMPGRTEVEQLHKFLLVVTTKDSGI

SEQ ID NO: 110355 - protein, 199 aa, Triticum aestivum
  Clone ID: PAT_TA_4773.pep
VPLLLPQNMATDSETKAARTLTRDEGFNFRAAHWGELHRRLHEAPPAAVTVHWGHQFLSFEVSDTDGDGGKRGGVVATARVLRTGETVEVAGDLLVAADGCTSSIRRRFLPDLKLRYSGYCAWRGVFDFTGKESSDIITGIRRAYPELGSCLYFDLAEKTHAVLYELPGNRLNWLWYINGPEPELTGSSVTMKVSDATL

SEQ ID NO: 110356 - protein, 426 aa, Triticum aestivum
  Clone ID: PAT_TA_4774.pep
PPRAQASCGATQFPGGTARSLPCSYCRWTADSSIGRRLPGSPRPSRPYARQEIRCDTLPAVLHPADLPAGVPDLMRFGWACPPRRRATGRHPPGGRLSFASEPMAFNTGPTAGGQLCATFGNVTAVIIALFALREGKITVVKCSLLGSILSNLLLVLGTSLFFGGLANLGVEQPYDRKQADVSTGLLILGVLCQSMPLMLRYAVSAGEHAVNSDDSGLVLSRACSVLMILAYGAYLYFQLKTHRQLFEPQEVEDDGDDLVSEDEAVLGFTSAMVWLAVMTVITALLSEYVVSTIEAASESWELSVSFISIILIPIVGNAAEHAGAIIFAFKNKLDITLGVSLGSATQISMFVVPLSVLVAWVMGVPMDLDFNLLETGSLFLAILVTSFTLQDGSSHYLKGLLLLLCYAVIGVCFFVLRRRSADGSN

SEQ ID NO: 110357 - protein, 416 aa, Triticum aestivum
  unsure (1)..(416): unsure at all Xaa locations
  Clone ID: PAT_TA_4775.pep
NWECNSVLRVKSVYVSSAILATKSPFFYKLFSNGMKEFVLTHATLRTTAXEESALMELLRFIYSGKLTTNQPTLLLDILMMSDKFEVVSCMRHCSQLLRSLPMTTESALLYLDLPSSISMAAAVQPLTDAAKEFLANKYKDLTKFQDEVMNIPLAGIEAILCSNDLQVASEDAVYDFVIKWARAQYSRTEERREILGTRLLPLVRFSHMTCRKLRKVLACSDLDNEQATKSVTDALLYKADAPHRQRALATDVLTSRKYTERAYKYRPLKVVEFDRPYPQCIAYLDLKREECGRLFPSGRIYSQAFHLAGQGFFFSAHCNMDQQRGTLQHGLMQSAFHCFGLFLGMQENGSSSVTVDYDFGARXKYKGCYTFTGGKAFGYRNLIAISWPAFMFGDSLAVVYGGLQASFFIPWKYHI

SEQ ID NO: 110358 - protein, 165 aa, Triticum aestivum
  Clone ID: PAT_TA_4776.pep
YGDHDDMVTVIDPKRSYSVKAPTRHPIYENFRVETFKALLTAANTDEQLSALGELMYQCHYSYNACGLGSDGTDRLVNLVQEMQHRKTPENGGPNLYGAKITGGGSGGSVCVIGKNCLQSAEEIAEIQQRYKAATGYQPIVFDGSSPGAGKFGYLKIRRRLIITK

SEQ ID NO: 110359 - protein, 283 aa, Triticum aestivum
  Clone ID: PAT_TA_4777.pep
LPHRRGGVAAAAASSSPSGRVSQLASTLNHQGWIHDRNKKAMELVAKGWSALQEVDRVIDFADRNDKRLIPLLRGAKENFELALEIDNMNTHARCWLAKMHFKYHVPGACKAIGAALLVEAANMGDPEAQYELGCRLRVENDHVQSDQQAFHYIEKAVDQLHPGALYLLGAVYITGDCVKRDIASAMWCFHRASEKGHAGAAIAYGSLLLKGAEVPEVITRFNSGKSPSTGKVRKRTIQQDPVKLAKEQFQIAAESGSDLGLRWLKRLGDYEKQPEELKQIQQ

SEQ ID NO: 110360 - protein, 250 aa, Triticum aestivum
  Clone ID: PAT_TA_4778.pep
MAGGVLYSGLKPSLIGTMFFLRFHYGFLSHVCRHIHRQERKVIESKRELLLKEISRANPMDAHILKDRLAKLDSEKPRPYGTLQAIREVYRESGISGFWKGLVPTLIMVCNPSIQFMIYETLSKRLKSKRSGKRFPKKNITAMEVFLIGAMAKLGATLVTYPLLVVKSRLQAKQEIGRNAASRYTGTLDAILKMIRYEGLHGFYKGMGTKIVQSVLAASVLFMVKEELVKFVVLLVARSRTLLLTRSNKR

SEQ ID NO: 110361 - protein, 122 aa, Triticum aestivum
  Clone ID: PAT_TA_4779.pep
EFGTRFPPPLEAASGLPAKPHPFHLTLIGRSFPWMLYTQFSSPCITHHHLRRSTPSVHTPAPPDHLQIPDCSSTPGLLASSEVLRIFLLLVDPVSRELEILLQRPADHIATDHGLWLKTTSL

SEQ ID NO: 110362 - protein, 88 aa, Triticum aestivum
  Clone ID: PAT_TA_4780.pep
MVFTDRMHLNQYAQQDHYSLVSSVYTSIHILFIHTPWIIAYIFMWSNRRLFNSYRLMVMSCSLLLDKPGAVGQTQITPATRTQQALLE

SEQ ID NO: 110363 - protein, 132 aa, Triticum aestivum
  Clone ID: PAT_TA_4781.pep
LLFLLEISSETSKSIFLAKHDGATGSGTHHAHPYNLVSICPPVQHQGRFLLFDQPFAVSKMQRGMQGAQGLHIQASGNMDLYMEHPKRNQSCSEPVQRASVSPCISFNSYWHSCMICVQWLIHEFKLPGANI

SEQ ID NO: 110364 - protein, 205 aa, Triticum aestivum
  unsure (1)..(205): unsure at all Xaa locations
  Clone ID: PAT_TA_4782.pep
MGCVGRCWDKCKWPLACFPALAAVIIIVVMVXAYSFAIQPSITVEDASLARFALATTPTTSLGYNLSXLRLVVRNRNWATTMKNTEPLGGGXNFDGQQFDRVQVADKGDKHGPRKTRVYPLVTGQESGYGALGHPGVAAYKEQNKTGEFELEVAVTGEVRYTLQLKKNKLSGTCKLKLKIDSPATAAVVFEKVKCKLEKEKKDQG

SEQ ID NO: 110365 - protein, 140 aa, Triticum aestivum
  Clone ID: PAT_TA_4783.pep
PRVPLRPPPGGPRRKHKLATTNTHSPDPDLLSSSSAHQGRTRHTVGRADSCERVVHRSSRDGSRGERRRARCRRGAGRGEEGGGVGGRGRRRQEGRPGRGVPAHGRRACRHLPRALIDRSVDGRRIGEFMFVSLHLCINL

SEQ ID NO: 110366 - protein, 113 aa, Triticum aestivum
  Clone ID: PAT_TA_4784.pep
AGTPRPGRPSCRRRPRPPTPPPSSPRPAPRRQRARQRSPREPSPDDRRTIRSENRLDGGVLPFPVSGRRRRRLLLEQDLDPGCGCWSWPIRKKIWIRAVGVGRGQLSLPCPYA

SEQ ID NO: 110367 - protein, 80 aa, Triticum aestivum
  Clone ID: PAT_TA_4785.pep
NCEELLTKSHHNNQYQILLNQNRSVTSVNLSMLRKPYTNNHNEEKKYITAWQRLESVEKFEYILWHDFRCNETNLTILQM

SEQ ID NO: 110368 - protein, 216 aa, Triticum aestivum
  Clone ID: PAT_TA_4786.pep
RPTRPLQPYPVASYAPPHQPAPVASYAQHQQPAQQVASYAPPLQPQVASSYAPPPPQPQVASYAPPQQLPQVTAYSTSQMPQSYIEPQQIHYVNAQQFGLHGVSQSANLMPAHMSQYVPSTLGTNSMATTGAQIGALRPVSAGTERVLENLHFSRPMQTPVDPNCRVLQPLSELPPLPHTTLQASDAQRYGVQTVLTSTASSPVMTSSRAFPVVVS

SEQ ID NO: 110369 - protein, 181 aa, Triticum aestivum
  Clone ID: PAT_TA_4787.pep
RKEMKYFVCCALGFIQIVKFITPTLLPVTQQTERKNPERDKHPAPCGTAAPRPQRTPCGPGLSSPAGGVLLRSFPGKMHNPHAGGTSMSFPLKKRNEILFHYALGFIQIVKFITPTLLPVLKIKELKNNERIKRNTSSSIYKPRQIWSKPCPVQTIHKDTPCAGGLPHESSGRARRRRAGG

SEQ ID NO: 110370 - protein, 381 aa, Triticum aestivum
  unsure (1)..(381): unsure at all Xaa locations
  Clone ID: PAT_TA_4788.pep
THASGGANLEGATPFGAGTGRRGAYLGGASAFFLVPGPLPLLGGLTAAFSHVPRPSPLLREQMAEVGDRPRPGLSQRDGVTMVVDPTHHAVHQRHGDTMVIDLTDKQGDEGNLSNAFAAEMQNFPDIRYVHFDFHHICRGGNFDNLQVLYDEIEEAIQKQGYFLMNSKGEILLDQSGVVRSNCIDCLDRTNVTQSFLARKSLDSQLQRMGALSSAESISQSDSINDKFKKCXVWVEHGDELSLEYAGSYALKGDLVRYGRQTLPGLIKDGMSALSRYYLNNFHDGVRQDALDLISGYYTVSKSSSSPFQIIGFESAPYLPVASAIIVGGITVTTFTLSQVGRSAQHLISSIIFAGLTAGVVALVKANGKQLCSRPRLCGLI

SEQ ID NO: 110371 - protein, 145 aa, Triticum aestivum
  Clone ID: PAT_TA_4789.pep
DLYITVWDHACSMEMDEEKRKKELYSEDKGVEWDSATADFQHRSLVTLVICGFESEDYFVNYVRRVMAAAVNLEDVFLYSRLLCANCKDEKQVRFPWTKRQRISLKKRITVGIESFAIIHSNKMVREDHQAKILYPECSRFDTSC

SEQ ID NO: 110372 - protein, 382 aa, Triticum aestivum
  Clone ID: PAT_TA_4790.pep
LCARAGESVLRTRWGHSSEGCRSLGRACTALPRATHVFVKKQTEIHLFSARFKELNGDTDGARAEYQHLHSVLYPGLLEAIVKHANMEHRLGDKESACLVYEKAIAAEKEKEQSQLLPMLLIQYSRFLYMVGDLEKAREISGGLHGLANLTKPVLEAVIFLESIFQSEKRIDLLESLVEKFLTAEQTQGELASLSDKEELSSIYLEFLDTFGDVQSIKKATTRHTILFSRKRSILPSKKRRADDAVMSGRDKMAKTGDGTQPGMGTDPNAHNPAVWPATSEASAQQWGAAYAQQAAYPAYGAYDYSQQMPQSAPQAAAYGAYPPTYPAQAYPQQSYAQPAAMPVAAAVPTPAQAPAPAAAYPQQPAVAAAPQAYYGGAATYY

SEQ ID NO: 110373 - protein, 87 aa, Triticum aestivum
  Clone ID: PAT_TA_4791.pep
ITFNDAIVQYVVEGLPFGGIGQSGFGQYQGKYSFELFSNKKAVFKRSFLIEFMFRYPPWDDSKIGMLRHVFNTNYILLLLGLLGLRR

SEQ ID NO: 110374 - protein, 101 aa, Triticum aestivum
  unsure (1)..(101): unsure at all Xaa locations
  Clone ID: PAT_TA_4792.pep
DTSLVALLLLMVVISDMLFWMNNLQVLPLYKPLSLSAMQVVLSSALQDXTPSPAGASSGRCTYSPASRSPVAGRMNEPWALGPPGAGGRRSPPCEIHSTVT

SEQ ID NO: 110375 - protein, 472 aa, Triticum aestivum
  unsure (1)..(472): unsure at all Xaa locations
  Clone ID: PAT_TA_4793.pep
MSSNNAVQHVAWHSHLSVRNSRASALNPDAVAGGRIPGRGRGGGGTRHARWWAGARSPSCFAPFAAPRDAGMPPWQCWDCLVQVCVSSSDAVISFCRKRGVGMVVVGPEGPLVAGLANDLVKAGIPTFGPSSEAAALEGSKDFMKRLCDKYNIPTAQYRTFTDPAKAKEYIKDQGAPIGGQADGLAAGKGVVVAMTLDEAFEAXDSMMVDESFGSAWFPGRXFEEYXXGEGASFFALVDGENALPLESAQDHKRVGDGDTGPNTGGMGAYSPAPIVTEELKSVIMETIITPTVKGMAAEGCKFVGVLYAGLMIEKKSGLPKLIEYNVRFGDPECQVLMMRLESDLAQVLLSACRGELGKVSLTWSPEIAMVVVMASEGYPSSYKKGTVIKNIDKAEQVSPAVKIFHAGTALAGDGNLVAVGGRVLGVTAKGKDIEEARSRAYDAVDVVDWPEGFFRRDIGWRALKQEQTANY

SEQ ID NO: 110376 - protein, 358 aa, Triticum aestivum
  unsure (1)..(358): unsure at all Xaa locations
  Clone ID: PAT_TA_4794.pep
FVEFLSIEXGGSLFLYANADDSTLPQDIYRLLSRPYAFGCVLRLRTSPDFEPGHSYGHFFPDPQYENVQHIICCDSFATYAYDFDFTHADGFSRHTEPAVVQIAFQYSVIEPVEVASGNGPQSYPRFCLKRRLRIRTLQYRPANNINEIYDSVDQEAVLHILVHKVILVSLENGVREGKKXVHDWLAILITRYNDSVEIXDPRTPESHIDIDFSQCPHLQMIPQFVFGMLRSPLLRLHEEGIHPDYRIYLQCLFSSLEPSSLAKAIYPLLISYSSPNKQAFPRHTLSRAALTMSESPIFLLDAFTNLVXVYYSSTADPSLPFPPPHDCLLRTTINALKPDXVYHSLKLACSGGTRTSL

SEQ ID NO: 110377 - protein, 143 aa, Triticum aestivum
  Clone ID: PAT_TA_4795.pep
LNSARAEDPAVAGLLPSDPIAVSQIRCSVLAGRLPQPHRILHRPEKPLRDPIFLPLHQRWCFGASPVKLRCCHNEVQLAHCCSTSPAVHTLHACCPLGDCAFWCLHAGHRFGAASSYSSGRHWPMERHHTCATPSTSSRAAVP

SEQ ID NO: 110378 - protein, 511 aa, Triticum aestivum
  Clone ID: PAT_TA_4796.pep
MLTCGRYLSSAAATTPSFPPLRTLTFSLLRYHPIRFLSFSSAAATTAVEPETISGGGGAGGGATRPQWKAAIDFKWIRDNRDVVATNIRNRNSAANLDVVLQLYDQYLALQKEVERLRAERNAVANKMKEKLDPSLRQALVDEGKNLKESLIALEEDLVQLTYKLQLEAQSIPNTTHPDVPVGDEESSVTRKEVGSQRSFSFPIKDHLQLGKDLDLFDFDAASEVSGSKFYYLKNEAVLLEMALVNWGIAEVSKKGFTPLITPEIVRSSVVERCGFQPRAQNTQVYSIDNSDQCLIGTAEIPVGGIHMNSILVDSDLPLKYVAYSHCFRTEAGAAGAATTGLYRVHQFSKVEMFIFCRPEESDKYHEELITIEENLYASLGLHFKTLDMATGDLGAPAYRKYDIEAWMPGLDRYGEISSASNCTDYQSRRLGIRFRPAPLEPPPSTNSKKGKGGSSGPTQFVHTLNAPAVAVPRLIISILENFQQEDGMVVIPEPLRPFMGGLGVLTPKTK

SEQ ID NO: 110379 - protein, 186 aa, Triticum aestivum
  unsure (1)..(186): unsure at all Xaa locations
  Clone ID: PAT_TA_4797.pep
RASLDWARRLELLRAIAHGVAYLHAGSGESVIHRDLKPGNILLDDEWKPKIADFGTAKLFVDNRTGPDQTIVISPGYAAPEYVRGGEMTLKCDVYSFGVILLETLSGQRNGSLXKVLSQAWELWEQNRIIELLDMTIVPLPKSEPEILPELKRCIXIGLLCVPGDAXDRPAMPEVVAMFTSTTSPN

SEQ ID NO: 110380 - protein, 349 aa, Triticum aestivum
  unsure (1)..(349): unsure at all Xaa locations
  Clone ID: PAT_TA_4798.pep
ARDAGVGVLFFPSNLLMLSLMLHLPRLDGELQGEFRDQPEPIRLPGCVAVPGADILQPLQDRTSDAYRWMVHHGERYRDADGILVNTFDAIEPNAAAILRQPEPGRPPVYPVGPVIRQPDDGDDDXTGCIRWLDTQPDKSVLFVSFGSGGALPAAQKDELARGLELSGQRFLWVVRSPTDSGADPGANYYDGSKSKDYPPKFLPSGFLERTKEVGLVVPSWAPQVRVLGHRATGAMLTHCGWNSVLESVMHGVPMIAWPLYAEQRQNAVMLHEEIKVALRPKVRGADGMILGEDITKVVNDTMNSEEGDAMRTKVTELQKATRSGLAAGGMSHKTLNEMVAKWKERTFA

SEQ ID NO: 110381 - protein, 131 aa, Triticum aestivum
  Clone ID: PAT_TA_4799.pep
WSHQAARGGIRLPVVASRGAEALRGCRTRSVRGGRAWRSIGASTSSSPFPAPSPRMEEHASSVLRRPSVLLLPLSTDHFLAFVCCCYAYAFCCSRMLSLLDRAYHYIQRVSFRCTNLHTCAKLPCLFSDLI

SEQ ID NO: 110382 - protein, 65 aa, Triticum aestivum
  Clone ID: PAT_TA_4800.pep
VKELNLNNKLQYQINVSLRKAAALPHDSYERIMNHLMIFSLQVNYLALERLCQIMAQASCDFSCT

SEQ ID NO: 110383 - protein, 121 aa, Triticum aestivum
  Clone ID: PAT_TA_4801.pep
IKFVNSMPKPLAIYAFTKNEKLKHQIIDETSSGSVTFNDAIVQYAVEGLPFGGVGESGFGQYHGKYTFELFSHKKAVFKRSFLIEFMFRYPPWDDTKTEMLRRVYNTNYILLLLGLLGLRR

SEQ ID NO: 110384 - protein, 140 aa, Triticum aestivum
  Clone ID: PAT_TA_4802.pep
CCHRYMSVGESLGSHSLHSFAEFLQHHINSPEASSCLSSKRKPLKPLNILMPFSLKFMAAEKSARKGARQRQGEHQEICLMTSQSFTRPILNIFRRGSHARAPRGTRGNRGERGEQGPNRRRGPGVTGKPAKRRRGEISQ

SEQ ID NO: 110385 - protein, 317 aa, Triticum aestivum
  Clone ID: PAT_TA_4803.pep
MSSKKIELDHKDMVHDSAIDYYGKRLATASSDSTVKITNIGGASAPSQLVATLTGHYGPVWRVGWAHPKYGSILASCGYDGRVIVWKEAATGQWSQLHVFDNHKASVNSIAWAPYELGLCLACGSSDGTISVISMRLDTGGCDAATIERAHPVGVTAVSWAPAAALGSMVGSDQLVHKIVSGGFDCVVKVWEFVNGGWKLESALVSDMHKECVRDVSWAPVLGLAKSTIASASQDGKVVIWTSGKGGGKWEGKLMRDFEAPVWRVSWSLTGNILSVAAGEGDITLWKESSDGQWESLWTKASEEPPQEEQAIEEAMQ

SEQ ID NO: 110386 - protein, 416 aa, Triticum aestivum
  unsure (1)..(416): unsure at all Xaa locations
  Clone ID: PAT_TA_4804.pep
RPARPGLRFHVLRPRRIYLQLPLCRLSVTAGASIRPPPAATRGRASPPPPPFPFFLAPGRSWPSGSPPFLRRYQKFTGWRRTCPSEGKIELDHNDMVHDSAIDYYGKRLATASSDSTVKITSIGGASAPSQLVATLTGHYGPVWRVGWAHPKYGSILASCGYDGRVIVWKEAATGQWSQLHVFDNHKASVNSIAWAPYELGLCLACGXSSDGTISVISMRPDTGGCDAATIERAHPVGVTAVSWAPGATRGSRVRXYQRAHNPVSGGXDCVVVVWVCDFVDGSWKMDRVSDMHKECVREVSWASAPGLGQAKTTTAAPDGKVMVVIWTKGQGRWEGESKRHFELPASGVSGSLTRNSQTLSVGEGERAIWLWSSDRQWEWVWPWASEAQPQQERGIGEARRPYSRVVHTSPPDFGS

SEQ ID NO: 110387 - protein, 103 aa, Triticum aestivum
  Clone ID: PAT_TA_4805.pep
IRHEPGRVANSPSDHFFLPSSKDHHDSREPDSLIEEQKRSLPYPARMEPQGVLGQIMFDVCVPKNVEGWDIKPTASPNGRPTLASARQLGPFNPIKYLRRSRL

SEQ ID NO: 110388 - protein, 460 aa, Triticum aestivum
  unsure (1)..(460): unsure at all Xaa locations
  Clone ID: PAT_TA_4806.pep
MVGSVHVNGSVNGANGTEERLDELRRLLGKSDXGDLLKIVKHRRPAPGGSVLRRPPCXDALARLRQRVQGPVCRRPGRPAGRATAEHLFDVINSREDVLRXRLTRRCAYLKYVEARLGDRTLYADEILRDGFCLNMVDTPLCPLKVVTNLQEAVWDADIVVNGLPSTETREVFEELSKYWKERISVPVIISLAKGIEASLDPIPRIITPTQMISSAAGVPTENILYLGGPNIASEIYNKEYANARICGSTKWRKPLAKFLRQPHFIVWDNSDLVTHEVMGGLKNVYAIGAGMVAALTNESATSKSVYFAHCTSEMIFITHLLTEQPEKLAGPLLADTYVTLLKGRNAWYGQMLAKGELRLDMGDSIKGKGMIQGISAVGAFFELLSQPSLSVLHPEENKQVAPAELCPILKRLYRILIKRELPVGDILQALRDETMNDPRERIEMAQSHTFYRPSLLGKP

SEQ ID NO: 110389 - protein, 125 aa, Triticum aestivum
  Clone ID: PAT_TA_4807.pep
PTRPRTRGEELISPSGQWQTEWRATPLSCTSRPPRRPRAPQAASAPAVSVRPHSSSAEPLPCLCALGSPPAAPTPQPEKAPERAPGNSPRRRSGECWGRRAPTRRPLATTRSVAGSSSAPGSRPA

SEQ ID NO: 110390 - protein, 101 aa, Triticum aestivum
  unsure (1)..(101): unsure at all Xaa locations
  Clone ID: PAT_TA_4808.pep
LXXGSRQTLXTXWXXXTXWRLXRPPWIXFXCWTXGFSQXYFSFTTQETTERQFFFLCPLCYSCTYDFQLFIFLSSHVINLQIYRCRWFSHADEAYGKRLIF

SEQ ID NO: 110391 - protein, 232 aa, Triticum aestivum
  unsure (1)..(232): unsure at all Xaa locations
  Clone ID: PAT_TA_4809.pep
PHLRGLRLEGLGPRAPDRWRLPSLLPRATRPPPSLPDLPLPEKPLQLPVCGELHRWRLPSLLRRVLLYPRGAPSVCCAVCHAVTSAPPPGMEMAQLICVGCRTLLMYTRNATTVRCSCCDTVNLARPAPPVNSIAHVNCGQCQTVLMYPYGASSVKCAICNFITNIGMNTVRPLPPTMHAPNGISYSVPSTSAPSAQSQNVTVVXVENPMTVDDKGKLVSNVVVGVTSGGKK

SEQ ID NO: 110392 - protein, 188 aa, Triticum aestivum
  unsure (1)..(188): unsure at all Xaa locations
  Clone ID: PAT_TA_4810.pep
SYRKYLQSITAVRLLRATADASDLQPLFPCPPPTPPPLAPPVMSRWAPEIKVYSRRNPRKNPKRPPEDPTPDPNPPPEPSPDPNPHPEPCPIPNSDPLEQTLASFRRSIRRPEAEDAVPPLSDPAAPTYPXPXSPTSSPHGAPASGDFSSGLARDGAAPNGHADIDIRADADDKARKRRVRSELRRQL

SEQ ID NO: 110393 - protein, 96 aa, Triticum aestivum
  Clone ID: PAT_TA_4811.pep
EGDVRPSTPSGGSEVSSWRCAVLLTVIRAPVSNTGAACPLGQDSGIEAGGEEPARPGRRCEPARSERQCEPPTTWESVQGGNGARRRRPRQIVFLP

SEQ ID NO: 110394 - protein, 78 aa, Triticum aestivum
  Clone ID: PAT_TA_4812.pep
WHYEAHQLIVPSSTAPLACSASASFSCKVLIPITDLIWLLVTTDLRHPSTKRIITSVLVQQQDAVTYDLHVWLQRSDK

SEQ ID NO: 110395 - protein, 245 aa, Triticum aestivum
  unsure (1)..(245): unsure at all Xaa locations
  Clone ID: PAT_TA_4813.pep
KPSQNAVVSLTVFSLVGGPPGQDHPKAXIASLMKLDVPYIVALPLVFQTTEEWLNSTLGLHPIQVALQVALPELDGGMEPIVFAGRDPRSGKSHALHKRVEQLCTRAIRWAELKRKTKMDKKLAITVFSFPPHKGNVGTAAYLNVFSSIYSVLKDLKKDGYNVEGLPETPEELIEEVIHDKEAQFNSPNLNVVYRMNVREYQALTPYANMLEENWGKPPXHLNSDGENLLVYGKQYGNIFIGVQP

SEQ ID NO: 110396 - protein, 183 aa, Triticum aestivum
  Clone ID: PAT_TA_4814.pep
PPPPPPPAPPRAPAPCRRAACRCRVTRAPAPLPVAARRSPAPPLRPASPRPAPPPSPPCPAPASPPRPQAPGAARRPPPAPRCTPRGPGSPRPRRPAAALTTRAAGGRALAGNARPEGGGPAAPAGLGWTPGACPLSPGRWHRTGGRGSSVLSRAPIPVDHGALAPFREEAQIVIHAKKKKKK

SEQ ID NO: 110397 - protein, 430 aa, Triticum aestivum
  Clone ID: PAT_TA_4815.pep
MRWLKSLVGLRKVERQQHQQRRKEDGDAGRTKRDAVDQFHFQDQHSQDHASLVGPEEFPDGNGPSEDECDTPSCSGPGFSMLSVPLPQTEEELKEIWAATIIQTAYRALLARRARRALKGLVRLQALVRGHIVRKQAAITLRCMQALVRVQARVRARRVRVALENQMDEQQNNVEEQTDEAHVREVEDGWCDSIGSVEDIQAKLLKRQEAAAKRERAMAYALSHQWQAGSRQQAAITASELDRNSWSWNWLERWMAVRPWESRFLGMYAADGIAIDTGAHNAEGNATKAPYRKPVKKQVSALHSSVLIQKARPSNSEGGGSLSNPSAGSASAKPKRKLPPKEGSDEVSSRLSGLGARSSSNPKERPGQLQPRANKRFSLPGTGTETGKRQVNKPAVSRSPKATEDSPALEGKHRRAGSVDLLFKRVELQA

SEQ ID NO: 110398 - protein, 181 aa, Triticum aestivum
  Clone ID: PAT_TA_4816.pep
TTKVGDSFFTNLIKKSFKMNNGTRNGRARVFVNGFPIPDRAVRKAEKLAGPIYPGDYWYDYRAGFWGVVGQPCLGMIPPYIPEFNYPMPKNCGGGNTGIYINGRELHQKDLDLLVSRGLSDSPERSYIVENSGKVTDEASGEELYGLGKLAPTVEKLRRGFGMRVPKVIVTGQHATIITHG

SEQ ID NO: 110399 - protein, 57 aa, Triticum aestivum
  Clone ID: PAT_TA_4817.pep
LILHQQRRIVNSASAKHDECRNNCEEHYIMYMSFLMYQVSQQSQKAERVQYLNKFQS

SEQ ID NO: 110400 - protein, 182 aa, Triticum aestivum
  Clone ID: PAT_TA_4818.pep
TRMAGHFLLTNLLLENMKSACRDSGVQGRIVNVSSSGHIMTYPQGICFDKVHDPSGFNSLIAYGQSKLANILHMNELSRILKDEGVNISANTVHPGVIVTSLFRNRTIVSALMNTVGRIISRSVEQGAATTCYVAMHPQVQGITGKYFGNCNIANPSSQAVDAELAKKLWNFSLQMCRFQIK

SEQ ID NO: 110401 - protein, 234 aa, Triticum aestivum
  Clone ID: PAT_TA_4819.pep
MDGIEASAGAGLPRPPQFDCLFTDEGWALLSEETRRSIIGVLDHDREEKISLLQRRQARKDRRKALPDHRPDIRPSESLDSILSRDVRDSDQLLWIRQHRMLNLSESLLPPMRYTSCELLGNGCSHYPHPMLQFFGIFVQFYRNALNIMRDNTRSSHIDVYGLLAVRDTLDYSRNYIFQRSRENPQPIDVDGGYLSLSYPARGISAMGCLIEIDIKIKGKEVDKDLSIIDGSVK

SEQ ID NO: 110402 - protein, 72 aa, Triticum aestivum
  Clone ID: PAT_TA_4820.pep
LLDVRRIRELEDLHNSVLEISAAGALQMFHESIHQDNDPSEENSLQTIPIDLLLLLQECPDVQVPEEPAQVP

SEQ ID NO: 110403 - protein, 106 aa, Triticum aestivum
  Clone ID: PAT_TA_4821.pep
VRPRVRPRVRQLGQQAAGQERTEAGTTPGNVNLNSLMSMFSGLGAGGGLGGVPNVPTVPPEERYATQLAQLQEMGFFDPQENIRALLATNGNVHAAVERLLGNFGQ

SEQ ID NO: 110404 - protein, 523 aa, Triticum aestivum
  unsure (1)..(523): unsure at all Xaa locations
  Clone ID: PAT_TA_4822.pep
MGGGEGGAGGEPAAGAAPAAAAQATLHIRGTSGNKFAVRADLGATVGEFKAVVAESRHVPAPQRRLIYKSRICKDDETVXTFGWVVAHIFHLVRRASPPPPWALPAADWLASSHRRPAGRSWVPMGMSLPGLGGLVAAGGGAFGLSRSEPSGIMSMMQQELMYTLPGPGEIERQRLLDYYVFXAWLVSNLVLNIPQMCELLGRIPDLADVLNDPRILLHSCEAAWNPELMREMMRNTDRAMSNIESSPEGFNMLRRMYETVQEPFMNATTMAGEGYTNPNPFAALLGDQGSNQARDPTGDAPTTAPAPNTSSGRTRWGANAWCCTRSNKPFCCWQGVPQAGTYAGWVLQCLLIEXVLQNPAMMQMMQNIMSNPQAMNPLLNMYPYVRNMMESNTQMREMFQNPEFLRQLTSPETLQQLASFQQALTSQLGQQAAGQERTQAGTTPGNVNLNSLMSMFSGLGAGGGLGGVPNIPTVPPEERYATQLAQLQEMGFFDPQENIRALLATNGNVHAAVERLLGNFGQ

SEQ ID NO: 110405 - protein, 260 aa, Triticum aestivum
  unsure (1)..(260): unsure at all Xaa locations
  Clone ID: PAT_TA_4823.pep
NIITEAPSTRTASRSLFETCAGNGFREYHPKATCPPQNDRFGFSVLPFQNQSSHQQNMHAPPAYSPTTIGPHSHSCAAPTNGYFQYGQPTNFFSGPVGFRVPGNGPADFSVQYNNVHRYPAPAFSCIHPEQILKTPASFRVMPPPPLPPYRHGTAPTGGHPXGGLNPDRLNSMLKPMGPKDAPDGNKLPDKSASFSLFQFNLPIAPQGPPSRRDGKRGESAARMPPFAPVQVQPCSREQTDVKEYNLFSTDQSGYFPLSR

SEQ ID NO: 110406 - protein, 290 aa, Triticum aestivum
  Clone ID: PAT_TA_4824.pep
SPISPAGGSVVPADNVLAVSTGQLLVILGACSVMMKPSDMIKMARVAGRMTGRAVGRLMLYRRQMDDIFEQTAAKKINTELQDAMSKLQSIGYEVQNLSRITPGQFIKRQHNTEGMTEAGTSDGSATQSGEFRDDIRSIIRDEIESFCRKNPDQFTRRLNNPDGIQNSEQTAEATQFDVTSKFAMTSKDMESANTSSTNLHSQAMMYAKLSVSPGIKMSSSMSVSNGEQFKESNGLLNVPPRSAATTGLPPTPTGVPSASASPPEPVLEAEVAENAKFFVSQPHDQLPKE

SEQ ID NO: 110407 - protein, 352 aa, Triticum aestivum
  unsure (1)..(352): unsure at all Xaa locations
  Clone ID: PAT_TA_4825.pep
GRPGRYNPKAEVLWLMGAKEKWLAGDAPAARAILQEAYAAIPISEEIWLAAFKLEFENNEPERARMLLTKARERGGTERVWMKSAIVERELGNVNEERRLLEEGLKLFPAFFKLWLMLGQMEDRIGHVGKAKEVYENGLKHCPGCIPLWLSLASLEERINGLSKSRAFLTMARKKNPATPELWLAAIRAELRHGNKKEADSLLAKXALQECPTSGTSXWGAAIEMVPRPQRKCKEXSDAIKRCXHDPHVIAAVAKLFWHDRKVDKARSWLNRAVTLAPDIGDFWALNYKCDRPHGNADTQRDVLERCIAAEPKRGERWQAISKAAENSHQPVDAVPEESSSGGGRQINAPGC

SEQ ID NO: 110408 - protein, 221 aa, Triticum aestivum
  Clone ID: PAT_TA_4826.pep
MEGDGGTAAAWMATHRGMYERATRHPFTVSIRDGSVDLAAFKRWLGQDYMFVREFVAFLASVLLKCCKESDSSDMETILGGLASLSDELSWFKKEAAKWSVDLAGISPLSSNMEYCRFLQSLDDPEISYTVAITTFWIIETVYQDSFAFCIEEGNKTPAELLGTCQRWGSPEFKQYCQSLQRIADRCLANAPPDVVKSAEEAFLRVLKLEIGFWDMSSSLS

SEQ ID NO: 110409 - protein, 133 aa, Triticum aestivum
  Clone ID: PAT_TA_4827.pep
RIITRRCIHHGNHLFWTDIPSSMFPSIRETNAPTQSLDNDDHSKVGLWPDIPLHNASNNQRSAWTNTIIRLRAKRRGRRRRRMLSKRASLENMTDRPGSGGRGCRQAEGRQRRRDGDSGSERGRGGGGRWREI

SEQ ID NO: 110410 - protein, 126 aa, Triticum aestivum
  Clone ID: PAT_TA_4828.pep
CVWALGALRLRRPPAPRPPIPQPSPHPPAPVASCPEKAPAVPTYRHRPCGSWEIPDLKLGNQIKRFCCLRGFKFSSGSQEETPRRRRRRRRRDIGGSCPHTSCSTRRGQWRIGSGTRSLRTCKGFS

SEQ ID NO: 110411 - protein, 252 aa, Triticum aestivum
  Clone ID: PAT_TA_4829.pep
MMISWTLNYLPLYLTFNLPLQGEGMGRHGRRQQQSWGRRAARMGSQGYIWYEWSSPVVRLWSVRRLADPWLRDWTEGPGLPRLSCARGGLLVGAPGGAERAGHLGGGGAGVAGAEGPGATEGGGAAGDGGQGEGGDNDGGPSGGCIGDAGADRRKAGGEEGGGSRGKSRGGGRQGAGGAGACQLGDAAAGPRTARVMRRCSEGAARQRCGHEATDQGAAGPPVGRQRLPGGTAAAAAALRGPTQWGGGESAV

SEQ ID NO: 110412 - protein, 304 aa, Triticum aestivum
  Clone ID: PAT_TA_4830.pep
RSLGGFDTAHAAARAYDRAAIKFRGLEADINFNLSDYEEDLKQMRNWTKEEFVHILRRQSTGFARGSSKYRGVTLHKCGRWEARMGQLLGKKYIYLGLFDSEVEAARAYDRAAIRFNGREAVTNFESSSYNGDAPPDAENEAIVDADALDLDLRMSQPTAHDPKRDNIIAGLQLTFDSPESSTTMISSQPMSSSSSQWPVHQHGTAVAPQQHQRLYPSACHGFYPNVQVQVQERPMEARPPEQPSSFPGWGWQAQAMPPGSSHSPLLYAAASSGFSTAAAGANLAPPPPYPDHHRFYFPRPPDN

SEQ ID NO: 110413 - protein, 188 aa, Triticum aestivum
  Clone ID: PAT_TA_4831.pep
PTLWRRAPPPPPPPPPPPPPPPSPRVPDLHVPPPPPAPPPPPPAPPAAGHRDVGAACVTRLRFVLRDQRCCLCMTHCPAVFATKEMGDRTKAIGDLSALPAAAGEGKTGEYWYHEATQVWFDDADHYRMVRAMCRISCTVCESSGNKGKKGSKSSKAKHKIKFDSIEQLKAHLSNKHCLYMCDLCLDG

SEQ ID NO: 110414 - protein, 183 aa, Triticum aestivum
  unsure (1)..(183): unsure at all Xaa locations
  Clone ID: PAT_TA_4832.pep
LQHHLSRPLEGTSSWPPPHPHSPRPPPPPRASRFTEIPSSGGVKALELREGSGEVPVDGDQVAIHYYGRLAAKQGWRFDSTYDHKDATGDPVPFVFTIGSGKGIPGIXEAAVKSMRVGGLRRVVIPPTQGYQNTSQEPIPPNFFDRQRLFTTIFNPTRLANGEGSTLGTVIFDIELISIRQHT

SEQ ID NO: 110415 - protein, 132 aa, Triticum aestivum
  Clone ID: PAT_TA_4833.pep
SPHGPFFFNPYRIGLVFGRSLFLPRTQELDIINWWKVSGSRFPPLQKLARDILPIPITSVASECAFSTSGRVLSAHRSRLTPNVAEALMCMQAWSRADMLGGWNSTLFSTFQSVLEDEEEEMDESTSIITQE

SEQ ID NO: 110416 - protein, 91 aa, Triticum aestivum
  unsure (1)..(91): unsure at all Xaa locations
  Clone ID: PAT_TA_4834.pep
AHCTLIPPQFLGLCVTSLGYDQATKASGGQKQAKQGNECPFTCVVXFNIYVSCCXLWAVWEXHEWYPPVKKYKITPLGIKXLNFLRXDIXF

SEQ ID NO: 110417 - protein, 256 aa, Triticum aestivum
  unsure (1)..(256): unsure at all Xaa locations
  Clone ID: PAT_TA_4835.pep
MEMTSSLGADERRGPGSVEVQVAAAALQRSEVFHVVKELLGFVLYMHHQIPSVLQSLETEFAGLKEEMSEMTAPLAELKPSDQRKYNTRKREVRCRIKKQEKLMKGISTVLSAFQQALDKVSTIEGVALILGGSLVRPLFVYDITVTHXVRALISCGAGSLSYTGPTKLFLLVRCPCTLNLPLDFAPKREFRYSKKVVPQQMSIKCNTAYYQKARGHVASIVDPSCCTSESSPSDVIWFQCKHTIRGLPCKASLEG

SEQ ID NO: 110418 - protein, 263 aa, Triticum aestivum
  unsure (1)..(263): unsure at all Xaa locations
  Clone ID: PAT_TA_4836.pep
IVREPVFPTPRRGFYIVVVNXRCRISDTWSQTETGGYMITPLPGARPQKPGSATFPFFGVQPVIVDEKGREMTGECSGYLCIKKSWPGAFRTLYGDKDRYETTYFKPFSGYYFSGDGCRRDKDGYHWLTGRVDDVINVSGHRIGTAEVESALVSHPKCAEAAVVGIDHEVKGQGIYAFVTLVDGVPYSDDLRKSLIMAVRSQIGAFAAPDKIHWAPGLPKTRSGKIMRRILRKIASRQLDELGDTSTLADPGVVDQLISLSDS

SEQ ID NO: 110419 - protein, 140 aa, Triticum aestivum
  Clone ID: PAT_TA_4837.pep
SARRRARPPRPLGTYELGAESGTPPGSGSQGGGDLAEAAHHADDETRDAVLGAAVVPDEPPQRPVPREHAGAVQHRGRRLRRPARQERPQEPRRRPQEQRQQRHRAIGTARRLAGFGCSMRRPPASSQLAAAIGNGDDRR

SEQ ID NO: 110420 - protein, 128 aa, Triticum aestivum
  Clone ID: PAT_TA_4838.pep
WTSTPASHILTPEGSICNFNCIVVLMAKRTGLAHAPTLFSLLLLVCFPIHVHCRIMDGKVNKKINLPHGLCVHKSGIDCAGASRCECCLTNNLCYVSMDQCMDWCKNTYSSSGASATSAHPPLPSHTS

SEQ ID NO: 110421 - protein, 239 aa, Triticum aestivum
  Clone ID: PAT_TA_4839.pep
PRFPSSLPDRRHLSLFRSTSPPAIPFPSSHRAAPAAAGSIASPTHPSLSGPISTSLHTPPRHLRRLIQAAPGESHHHEAQPEVPIETRRRPMRLDPVLTATSALARVSAVGSGTGGQVILLWYSSLPTCKEEQAAYELNRDATDGDVNGRDVPRRRPASTEAGSGKGLHRQANSLVHLCEPATGLSSPCMPTCTRAGRSPSLRRRTSRGGTGCASCWCVAQPLLVHKFTIVPMCHHVFP

SEQ ID NO: 110422 - protein, 202 aa, Triticum aestivum
  Clone ID: PAT_TA_4840.pep
MDPPYAGAIIEPAKCRLMSVDEKKDLVRELSKRPQTAPDKLQSWSRRDIVEILCADLGRERKYTGLSKQRMLDYLFRVVTGKSSGPVVHVQEKEPTLDPNASNHQYPAKRQRKSDNPSRLPIAVNNPQTAVVPVQINNVRSCRNIACRAILSMEDKFCRRCSCCICFKYDDNKDPTIWLSCSSDHPMQKGSCGLSCHLECAL

SEQ ID NO: 110423 - protein, 134 aa, Triticum aestivum
  Clone ID: PAT_TA_4841.pep
QPKSSISGVEWCLVDRATAIINIFAVASRVYAILVAGLFGAPRSLLSMASCGCSFRSATSLIVRLARGPPGCLHHVCRPLLGPLGHLVGCHLAGRASASACLSLFAWHGDTIVASTMRATKKKGPRFILKVAIW

SEQ ID NO: 110424 - protein, 170 aa, Triticum aestivum
  Clone ID: PAT_TA_4842.pep
PDRQTAYKELANKYTQHENLKPSLDMRAQRYSITHSDHFWRAGDIVCLRSYFCIHVWNILHIIVTFLEKTERRQACAMPGAAVVDVGTSFEQVPDVALEGGIVYVEVLAQIHRVAVVAPKDGLQFIIHARAPQVLLDAAVKHKGGTHVSGAVCVIHCNRLVDATRLLRFT

SEQ ID NO: 110425 - protein, 224 aa, Triticum aestivum
  unsure (1)..(224): unsure at all Xaa locations
  Clone ID: PAT_TA_4843.pep
LVRERPYLLDEDLGDGSEDKQGLYTWQDLCVLVQSSDSELLEGLNSLSAVEIDGFWRTVDVGSVNTVLDMILHNSVLHDWLLNALPENAVLSVMEADGFTHKIVAHCLSRFGTKVEQEAGSCWKLDERLVCLQFARRALAAGKMKLNNFMDKWERSIPSGMRADLQMLEGEVAXERLGAETWVHALQMSPICPWTPAXEXCXTIPGXRQSXEXKNXXPLPREHC

SEQ ID NO: 110426 - protein, 62 aa, Triticum aestivum
  Clone ID: PAT_TA_4844.pep
IWPSIIVRRAIKTTTRPRGEQAFYPSRHEYKTKENIHDHKFAATNSSRIRHSKLNLEDNQYM

SEQ ID NO: 110427 - protein, 400 aa, Triticum aestivum
  unsure (1)..(400): unsure at all Xaa locations
  Clone ID: PAT_TA_4845.pep
WATIQYGRFKRKMAVEDLNKRWKHLILNTTPTTPIEPCEWLNKLLIEVWPNYMEPKLSKKFQSTVERRLKNRKPKLIDKIELQEFSLGSCPPTLGEQGMRWMTSGEQQVMSLGFDWHSKEMSVMFMAKLAKPLMGAAGRVINSIHIKGDLLLSPILDGEAVLYSFESTPEVRIGVAFGSGGSQTVPGMELPGVSTWLVKLLTETIAKTMVEPRRLCFSLPPVDLKKQAVGGVLSVTVVSASNLGRKSRTNELGNNQSSSGNTTPGIPLNRRAHTFXEVEVGTLTRKTTTCEGPNPTWNSTFNMVLHGETGVVKFLLYELDSDGVKYNYLTSCEIKVKYVLDGSTIFWAIGHNDGVVARHAEHCGKEVGMVVPFEEDITGELTVSLVLKEWQFSDGSVTLS

SEQ ID NO: 110428 - protein, 204 aa, Triticum aestivum
  unsure (1)..(204): unsure at all Xaa locations
  Clone ID: PAT_TA_4846.pep
PPLAPPCPAPSGAPVTPPTSXPPPTTPGNTAAPSLMSGHRRPXDPCGVRHPGGRGRLGSTTSPRGAPAPPPSTALPPRPRRAVPRATPGAPRPPPPPGRAPPAAVPVAESRAPTSAPSCPARRPPRRSRPARAAWPRPPTGRPARLHCRRPEATTLPSAPAPAPLRPGRCPXPGAAPPGPPRGSCEVGLRRLYFAPENCGNDSS

SEQ ID NO: 110429 - protein, 138 aa, Triticum aestivum
  Clone ID: PAT_TA_4847.pep
QAPPPPSPAPRRRPPCARPRGAGPRPRPPPPRRAPAPRPPPPPPPPPAPGTGPSTPAPAPSPGGPSGRRGGAGPRAVACRPHRPGRAARAARLRRPPPPPRPRRGWGPRASCRGPSPSHPGKWASGFLDVPPALGLRG

SEQ ID NO: 110430 - protein, 150 aa, Triticum aestivum
  Clone ID: PAT_TA_4848.pep
HRASSFAGIQTGMFRSSWRRRAPAPARRRHPASPPDVVIEFGGSINRRQWRGQGGAPGGTPEPADGPDGRAGGEAGAGTCKKSFMFRVEKHGTGYKLMSCFHAPCRDLVLFDYNGHRWLTVEKDGREPLVVVFKKFHLASLPPANPPQLG

SEQ ID NO: 110431 - protein, 97 aa, Triticum aestivum
  unsure (1)..(97): unsure at all Xaa locations
  Clone ID: PAT_TA_4849.pep
MTASALALAVVGWLARAREGRGGRTALGRAPPPSPAGXGPQRPPRSPATRSSPPRSPPASPSAAPAVPSPRRPPPPPRQRLRPRRHPAAAHSRPKTR

SEQ ID NO: 110432 - protein, 168 aa, Triticum aestivum
  Clone ID: PAT_TA_4850.pep
PRVAAAAGAPVAMSNPKGSKMLQFVNYRMRVTIQDGRQLVGKFIAFDRHMNLVLGDCEEFRKLPPSKSSKTTGEREERRTLGLLLLRGEEVVSMTVEGPPPPDESRAKASGGGGALSGTGVGRAAGRGVATGPLLQAQPGLSGPVRGVGGPAPGMMQPQISRPPMPNL

SEQ ID NO: 110433 - protein, 218 aa, Triticum aestivum
  Clone ID: PAT_TA_4851.pep
SKPVNGDGSSRPGQWAPAGGATAGTAGSAGGGGSWGKRNEDSWNSSRGTGGSEGGLKKEGSWDKAEGSGSQGGGGGSSWDKVASGGWDSNKGGDAGNGGGSGCAEEDQSFSKGKSSWGSGNNDSWGAPKPSGGDDQAGKKDGNNTWRGSWGKSNEDSWNSSKGTGGSEGGSKKEGSWDKAEGGGSQGGGGGSSWDKAASGGWDSNKGGDAGNGGGSGW

SEQ ID NO: 110434 - protein, 149 aa, Triticum aestivum
  Clone ID: PAT_TA_4852.pep
TRVKLAKDAYTPDLMAASDCMLGKIGYGTVSEALAYKLPFVFVRRDYFNEEPFLRNMLEHYQCGGEMIRRDLLTGHWKPDLLRALTLKPCYDRPINGGEVAAHILQDTAVGKKYISGKLSGARRLRDAIVLGYQLQRAPGRDVGIPEWY

SEQ ID NO: 110435 - protein, 442 aa, Triticum aestivum
  unsure (1)..(442): unsure at all Xaa locations
  Clone ID: PAT_TA_4853.pep
MERRKKMGRRMRSITARRRMKRNWTWRRWRKRRAAPPPAPPRASTATSAPIPDSKLPKVAVIGRPNVGKSALFNRLVGGNRAIVVDEPGVTRDRLYGRSYWGDQEFMVIDTGGVIALSKSXXGVMEELAITTTVGMDGIPMASREAAIARMPSMIEKQAVAAVEEAAVLLFLVDGQAGLVAADIEIADWLRRNFSHKCIILAVNKCESPRKGQMQALEFWSLGFTPWPGSAITGTGTGELLDVGGSELKKFEGLEGLDDVEEDENRVPAISIVGRPNVGKSSILNALVGEDRTIVSPVSGTTRDAIDTELTIKDGQKYKLIDTAGIRRRAAVASAGSTTETLPVKRAFKCNSSILMLLPLVIEAMACVXDQDYKIPERIEXEGKACVMVVNKWDTIPNKTCETTCPAGRSKTPVGMLRLPKWTKYPRSWKEAKLDPSTCKTS

SEQ ID NO: 110436 - protein, 140 aa, Triticum aestivum
  Clone ID: PAT_TA_4854.pep
PRPAPPPPPPPPPPPPPPPPPPPPPPPPSRLPSPPPTITSPRPPPPAPPGPPPPTPPRPSRSPSRPPRRRRPRPRPPLPSPPRPPPSPRRLRPPRPPTTPKPPAPHSMLPPTTPRARSKTMAAGSLSACPTPRGLLALLA

SEQ ID NO: 110437 - protein, 205 aa, Triticum aestivum
  Clone ID: PAT_TA_4855.pep
ALHRSPDLGLYYTSSWTSSSYASFPSPSSEKAGGDAHGSRRELRRRMGGSRLLYASRSAALFFLTASARKGWILEGTPLVTLAPGRDCSFSFAFISLNCALSSADLTGSGGDAHGSCRELRRRMSGSRLLYASRSAALCFFATSARKARMSEGTPLVTLAPGRDFSFISAWSSSSRALSSARLTGSMATVAVAASGAKRRRRRRR

SEQ ID NO: 110438 - protein, 185 aa, Triticum aestivum
  unsure (1)..(185): unsure at all Xaa locations
  Clone ID: PAT_TA_4856.pep
MWPLLIQRSKRQQVKIVESGIEEKYKAFKQFDTVGDHSDHFYLKFRTVKKPSKDWVKRIQHEWKVLGKDLPXDTIFVRADEDRMXLLRAVIXGPAGTPYHDGLFFFDVYFPSQYPMLTSLKVNYRSGVWRLXPXSYXCGKIRLNPLNTWTGMGVKCWNPPXQLSCXPWXPIKPXGLNAKTYFXEP

SEQ ID NO: 110439 - protein, 336 aa, Triticum aestivum
  unsure (1)..(336): unsure at all Xaa locations
  Clone ID: PAT_TA_4857.pep
TTEHAKSPSRPVHSPKNAFTELPGVLMAPPSPLGGNQMKVGNSQAECAPPRDVATKEVSSACSSSMMGDADSTKQSEPSEPDATXTHLDSSCKCSTLDTAIQKHDQTDMPSSELNTTNLQKSMPSNDDSSVSSALEPIXDTNVQEFICKDDIPCSKTVQSTPTITVQSEEDKFTVQELLSSVPYIAPDDSATKTIALDKGSNSIHQSSEKSPGPHSGPPVEDIIHVIRPSSFSVSDEQAVTRNAEMEAQSTDVGELGDVIKEEVDVRSITPSLIPSGLVGSATVKPNISEDNTIXSEAANSDVLKLPAXPEPIPPRPQPGGGVGPAETPALRRPAD

SEQ ID NO: 110440 - protein, 152 aa, Triticum aestivum
  unsure (1)..(152): unsure at all Xaa locations
  Clone ID: PAT_TA_4858.pep
MAATPASPQVHIESAQTGLPTRVVEPDRTRVIAVAAPPLPATALQRRLRAVFYYRGDDAPVEEGILVKESLGEVLCFFPEMAGRLRRHADGSWEVKLNDAGVRFXQATVEVTMEDFLADKERARKEAALAPWVDVSAEDPDMCSLLFMQLNR

SEQ ID NO: 110441 - protein, 236 aa, Triticum aestivum
  Clone ID: PAT_TA_4859.pep
MAALRHLAGATHNHRIAANSSSLFDLQRPPSCLAAARPLSLAPLRSRFTRLYALSSNDIKVGFNLEVDGAPWKILEFLHVKPGKGAAFVRTKMRNYITGNTVEKTFRAGSTIQEASISKETKQFTYKDGSQFVFMDLTSFEESRLNESDVGDRQKWLKEGMDCTLLYWNGRIIDFDLPITVRLTVTEADPGQGDSAQGGTKPATLETGAVVNVPSFVDVGDDVLIDSRTGQYMSRA

SEQ ID NO: 110442 - protein, 147 aa, Triticum aestivum
  Clone ID: PAT_TA_4860.pep
RTRGRTRGAKIGISVAKAIHAGALKLTLGGVVLGDSWISPDDFALSYAQLLHDVSRLSDEAVAPLNRMAAIVKEQIAAGQFTTAKMTWTNLVDLIDQQSDGVDMLNFLLDKGEGSSTSQVFPSTPNTIDGLMNGVIKEIVKVIPKNI

SEQ ID NO: 110443 - protein, 255 aa, Triticum aestivum
  Clone ID: PAT_TA_4861.pep
SARVMYEELHVMSPVVPTREFCFLRYCRQIEQGLWAIADVSVDLQRDARYGAPPARSRRLPSGCLIADMSNGYSKVTWVEHMETEDKTPINQLYRDLVLIGAAFGAHRWLAALQRACERHACLVTPPHRDIAGVTLEGKRSMMRLSQRMVGSFCASLSASQQHRWTTLSGPGAGVDDAAGVRVMVHRSTDPRQPSGVVLSAATSIGLPVSCDRVFAFVRDENTRSQWDVLSHGNPVQEVSRIPNGSHPGNSISLL

SEQ ID NO: 110444 - protein, 80 aa, Triticum aestivum
  Clone ID: PAT_TA_4862.pep
TYFVIMQSLVVPGEGEQCSLIAHLAGKFLLITETFKHNIGRSKKNRTMPCKYIPNGDSSSEMFVPLLQLADNWLFSNQPF

SEQ ID NO: 110445 - protein, 164 aa, Triticum aestivum
  unsure (1)..(164): unsure at all Xaa locations
  Clone ID: PAT_TA_4863.pep
LNVDLLDVHADKSTFHRFDKFNLKYNPCGQSRLREIFLKQDNLIQGRFLAELTKEVFADLEASKYQMAEYRISIYGRKKSEWDQMASWIVNNELYSENVVWXLIQIPRIYNVYREMGTINSFQNLLXDNIFLPLFEXVTVDPSSHPQLHVFLGEGGGGDLGGGG

SEQ ID NO: 110446 - protein, 258 aa, Triticum aestivum
  unsure (1)..(258): unsure at all Xaa locations
  Clone ID: PAT_TA_4864.pep
IIGYGASSTVYKCVLKSGKAIAVKRLYSQYNHGAREFETELETVGSIRHRNLVSLHGFSLSPNGNLLFYDYMXENGSLWDLLHGPSKKVKLDWDTRLRIAVGAAQGLAYLHHDCNPRIVHRDVKSSNILLDEHFEAHLSDFGIAKCVPAAKTHASTYVLGTIGYIDPEYARTSRLNEKSDVYSFGIRPPGSLLTGMXGVDNDSNLQQFIMSKKLDDNNGEWEGGLPEVRRSTDNGGLVGKGFQTWPLLVATKAGTPIQ

SEQ ID NO: 110447 - protein, 351 aa, Triticum aestivum
  unsure (1)..(351): unsure at all Xaa locations
  Clone ID: PAT_TA_4865.pep
FPPSPSDSAPSPAATLPDSGLPFAPRRRASRLRLPFAPRRRSGPPASHSSPTPLRSLPHPSHLPIGKVTVALLPPPLPPAVPQGHRLPAARGGARRPRGPCGGVDLPGREVREYTNLSDPKDLRRAEGRALAAVEHAAVLADSXLLFLRLFAACLHPMLVVGGVSAGCRLGRAALGGHESPALDEQQRAIDLAGRMLRRSGKRPRPAVKMAPTLADSAPALPAALCVDARPKSDIRQRDLLKNIVGIKPKRPKVCSPRQAAENDGPKRNQEVSVSKMSSCQNEPKPAEATESRPQNVTGMLAWFGVRRVRMKNDQWWGSHSAVGCVLVHPATLLDCVSAPGVQDNSKNSFC

SEQ ID NO: 110448 - protein, 197 aa, Triticum aestivum
  Clone ID: PAT_TA_4866.pep
GGSFVTFLLVGGDFPPLAGYDVVHALAVAPVPAPGGAGGRARPLSLDRPPPEQGEGGSAAQQPLLPVELWSQQGKEGTLSSRVSWGKGFVGPGPRRSWGGGGRPRRRYEESGMVSRNSGSRGRCAEGGTGGRGGSPSVRGGRAVPQRRRWRALRLGGGAGREGGDAGERKRRDLEQPEGGRRFSGGGALVPLALPSP

SEQ ID NO: 110449 - protein, 807 aa, Triticum aestivum
  Clone ID: PAT_TA_4867.pep
DPASEIAYRYFYELVNKGMIQPEQINHNDEVLSCTLHHTVRDLIMYKSKEENFITSIDYSKAITGNSNMVRRLSLHFSSAKYATKPSGVILSQSRSLFFFGLLRCLPSDVEFKLLRVLILDFWGNQYGLTSLNLTRIRSLVHLRYLKISCDIIVELPAQMRGLRYMETLEINARSSAVPLDIIHLPGLLHLSLRDETNLPDGIGRIRSLRTLQYFDLGNNPAGRVLSLCGLMNLQYLHLTYSTVQSDEHLKRNMVALASSVIKLVNLKSVIPTPGALSTAIYHDVLSSVSSPPVFLQGLQRLVVLPPICMFSRVPKDIGAVRKLCYLSLVVRELRRNDIDSITGLPALTVLSLYVRQPPAESIIFNNGVFPALKYFKYMCGVLCLAFQEGALPNVHRLKLGFNARKGQQYDVLLAGIQHLVNLKKIDGIIGAAEGAEEPDRGAAESAFKDTIHKHSRFPSYVNVKRVDWVEEENEPRTEVNSSSSKCHEILQEQRGVNETEEDTKQFADSGVTNQIMQVSPQHMDLCAADTKLTMPSNNRMSFPEKLHDSIAAEAVSFSCTTSSGSSPKSSSAPSSHHSLPETYTWDPGGSPWSRALSSPSLTPRNTSAPQSAMHPMLSPEDHISRAEGTWSTAYFHPLPLPPSAISQVKATLSNQPAPKVEMSLVAGQWEKRKLIGSGTFGDVYEATNRHTGALCAVKAISIPNDSKSAESLKQLDQEIKLLSQFKHENIVQYYGSETIEGHLYIYMEYVHPGSINKYIQQHCGAITESIVCNFTHHILRGLAFLHGQNIMHRDIKGANVLIDGNG

SEQ ID NO: 110450 - protein, 376 aa, Triticum aestivum
  Clone ID: PAT_TA_4868.pep
PRVRRFSDYNAGYAIPAVAVGFMIYVLLLLLITSAQDPGIVPRASHPPEEDFAYGNPLAGETPGRLQFPRIKEVMVNGMLVKIKYCDTCMIYRPPRCSHCSICNNCVERFDHHCPWVGQCIGQRNYRYFFLFVSSSTLLCIYVFAMSALHIKFLMDGDYPTVWKAFKHSPACLVLMIYWFIALWFVGGLTGFHSYLISTNQTTYENFRYRADSRPNVYDRGCLNNFLEVLCSKGKPSKHRFRAYVQEEVRAPVVNFGRQMEEEPAGGPRAKVEDDLEIGSDLLKISRRRNYEDVDVEMGNQDDGETEGTGDAKLAAGSGSQIPAVGSEVRVRHSSWDRRSGNWDMSSDVIGRSASDVLGRSASLTEAAPRSQRETH

SEQ ID NO: 110451 - protein, 306 aa, Triticum aestivum
  Clone ID: PAT_TA_4869.pep
GTRAGGEDAGDEMPRELPEELARGVVCLECQTSAEAVAAGEGETCRVYVVGTAHVSQESCVLAAAVINFLKPQAVFLELCSSRVSILTPQNLQVPTMNEMIDMWKKKKMNTFGILYSWFLAKVASQLDVLPGAEFRVAFEEAMTYGGKVILGDRPVQITLRRTWGKMSLWHRAKFLYYIVFQSLFLPSPEDLNKMLKDMDDVDMLTLVIQEMSKAFPSLMETLLHERDMYMSSKLLKVAREHSSVVAVVGKGHVSGIKKNWQQPIEVQSLMELPVPRKGVSKLKILASIGAVSAVVASGIYIWGKK

SEQ ID NO: 110452 - protein, 100 aa, Triticum aestivum
  Clone ID: PAT_TA_4870.pep
APPLIVSSRRPPLAREPHQLAALSPIIPSLALFPVHFQNPNPALPNHAWCLLAAGEERGDFFSPNEGEAEATTGNCSLYICHGPEATEQEILHSYLVGWR

SEQ ID NO: 110453 - protein, 521 aa, Triticum aestivum
  unsure (1)..(521): unsure at all Xaa locations
  Clone ID: PAT_TA_4871.pep
AATVHLDPPLGRHPGAGHFPALPRPDGHGEPNVSLTTPGLSPAERVREAVDCLPTRLESTLAADAPTXASLKRWTIMDFSRAYSSGETTPVQVAXRFLAAVKECSGPTMNMAFFISCNPEDVLKQAEESTLRYQTGTPLSVMDGVLVAVKDEIDCLPYPTTGGTRWLGKARPCEADAACVAQLRACGAVLAGKTNMHELGAGTSGINPHHGSARNPYNVGKVAGGSSSGSAAVVCAGLCPVALGVDGGGSVRMPAALCGVVGFKPTAGRLSNAGVLPLRSPAGLARPLAGTPDHAVVAYSAIVDQSQPSYLRPELNLPMLTSTPSISNVRLAKYGKWFNDSSEDIRTCCDKALQTLRAQYGWETLDVTVPEIEEMRLAHYVTIGSECTASLAKYLDKLKRSEIGWDVRVALGVYGSFSSRAYLNSQRLRNRQMFFHKEIFKTADVIVSPMTGVTAYTLQDDALSSGELDYINGAALIRYSIAGNFLGLPAITVMVGQDKGGLPIGLQFIGRPWSEATLLNI

SEQ ID NO: 110454 - protein, 101 aa, Triticum aestivum
  Clone ID: PAT_TA_4872.pep
TKKVLLGWGRVQTPTGLYEDECAFCQSFRTSEPVHGPLVLYHNGRIVSSDEADATNAIYVHFKCMVWAPKVKSNDDGTFENVESEIERGSRWDCSRCNLRG

SEQ ID NO: 110455 - protein, 274 aa, Triticum aestivum
  unsure (1)..(274): unsure at all Xaa locations
  Clone ID: PAT_TA_4873.pep
MKYVLVTGGVVSGLGKGVTASSIGVLLKACGLRVTSIKIDPYLNTDAGTMSPFEHGEVFVLDDGGEVDLDLGNYERFLDIKLTRDNNITTGKIYQAVINKERKGDYLGKTVQVVPHITDEIQDWIERVAMNPVDGTDKPADVCVIELGGTIGDIESMPFIEALGHWAYRRAXGGPGPGSRGPGTLVPPLSVVGEPKPXPSISVRGLRGLGLXPDILACRXSTQPLGKKMVKLKLXQFCXXPXSNIGNXNDVTNIWXNPLXLKDXRAQSFESGAL

SEQ ID NO: 110456 - protein, 405 aa, Triticum aestivum
  unsure (1)..(405): unsure at all Xaa locations
  Clone ID: PAT_TA_4874.pep
ESLRHLPVSAQPQPQPTAFSNQDLFDMSTLPQPVVCAPPIDLFAGFNQQTASVPNGHSDVVKEAVHNAVXVKKVVTASRVCIKQEAVPTSHPVHQDLFSLSIAQDSATSSSPPSVDLFAGFDQQLPPTSSVHHITPAAPLPANEGWAFFDTPQYGSSTSVSNVQSQVPAALPSVVAKAIDQSTLPNSPPSAIMSQTSPPTMDQWSINAEEVKIPVSKENSQDWNAFGESTGNMPNNVFAFNDMPQVAPHQFAIPSVPYMESRTSQDLVRGEPERSTPGDIFPGFNVSPGVLAEPSFPAPLQPQLGMVSHAGKSTNPFDMAFESDVEAIDMFMDLTSLQATLPDTHLPAEYSINLAEPWMSQNSTVPYIPSASQGGLSYIPGQVQDSHMLNSAQQGQFPPRNPFDE

SEQ ID NO: 110457 - protein, 77 aa, Triticum aestivum
  Clone ID: PAT_TA_4875.pep
HASVFVHAASVSSQLSALALLSEERAEQVVLQRLIAPGVVSFCSAPSSSSGRSGSSRRSCRSRTSRRRGPAAARCTG

SEQ ID NO: 110458 - protein, 134 aa, Triticum aestivum
  Clone ID: PAT_TA_4876.pep
YESVSPSSSSSIRGFEILRQAIVRPPAPASPPRAQVPGAPRPRSPTSPQRSQAQVLVSSSSDPGASSSSDPGASSSSDPGAPRRVLVSQKEHAAAAVPGPRSRSSSSDPRSSGPSPDPSSPGRAPSPDAGHRKK

SEQ ID NO: 110459 - protein, 190 aa, Triticum aestivum
  Clone ID: PAT_TA_4877.pep
HRFSDSTSSLVTMEGGVLLRSGRTIFYRRDDEAVVSGELVLQEKEHAQGPLSSPPTRPPSPLFPRRRPPASPPPDHRALFPRAAHFLRPRRAHRTEDESFACARRVDGRLRGVGGPGVQLGAGGASPRRRSSAIPPCPRGPCAGGRKQRPASPGHLGATAEDSNALPAAARKLWTRRRRHAGSSHAYGLL

SEQ ID NO: 110460 - protein, 177 aa, Triticum aestivum
  Clone ID: PAT_TA_4878.pep
VGRLFTKDVARHRLEMETQFILFASQGAQWSQGHVRWKTPLNSHLVLLPQHWTRAFVVQKRVLKSSVLHPEVSADSVKAVVASAKDLKHHLEEGKFKEMLAESASSELRSSAWADDVCNFMRSAKRRCIQNTGTSQDSEAIRKQLISDSGRVFRSKIPELLREDLIQSLRSYFEDKF

SEQ ID NO: 110461 - protein, 54 aa, Triticum aestivum
  Clone ID: PAT_TA_4879.pep
MLTMDANCTLIKLTMRRMRGEKEGSVQRNFCARWCPMLGFDRSNCPSTRISSGK

SEQ ID NO: 110462 - protein, 109 aa, Triticum aestivum
  Clone ID: PAT_TA_4880.pep
RTRGCGEMSSHSAKALKELSTAIRTMIVPSPANITMSAAIKAAKDLRNELSEEAALLQVMHVAVTATLLSDLVTTIVKIAETADNLARLGHFKNPEKTQKDVAINIPSR

SEQ ID NO: 110463 - protein, 186 aa, Triticum aestivum
  Clone ID: PAT_TA_4881.pep
RPPMPAKRPLEGGGGGDSPSPARSPALKKRCRSFDLEIRGCRHLEEMVTNCVQRVEAAVESVIESAISRIPEAVTKAITGYLSRAPSLCRTVVDQNQPPRYKLRFLNGLSNEIFTKKGIRAANGDPLKICLEDNNQQENNSHRLLSAKIKIVVLDGDFNIDNEDCWTLENFSRHIVRPTGQKLGQC

SEQ ID NO: 110464 - protein, 308 aa, Triticum aestivum
  unsure (1)..(308): unsure at all Xaa locations
  Clone ID: PAT_TA_4882.pep
MSMSFLSMVETELPPGFRFHPRDDELICDYLAPKVTGKVGFSGRRPPMVDVDLNKVEPWDLPVTASVGGKEWYFYSLKDRKYATGQRTNRATVSGYWKATGKDRXLARRGALVGMRXKTLVFYQGRAPKGRKTEWVMHEYRLEGAHEQASKQEDWVLCRVICKKKSGVGATPRPRNLTNIVHGTPTDRPSPPPPPLRNITLADLRASMDTSSAAAAAAALEQVPCFSSFSNNSASNSSYLPMVTGNSNGMSYLDHGLPDFGSYLDPAMNCDKKVLKAVLSQLSSMGGEVVPSMSPQMAAAVSSTWNHF

SEQ ID NO: 110465 - protein, 267 aa, Triticum aestivum
  unsure (1)..(267): unsure at all Xaa locations
  Clone ID: PAT_TA_4883.pep
MAGATLAAARFPAAVALLRTRRSPVVAVPLAPSGLRHHRRSVAMAAGAAPSPIPASDPLPKGSDLFFRSVLSNMQKVYLSRNPTAEKILDLVHSYDGDHICFDHFAFRTFGVDGYGINSLAEFFTDFGYESREELRFPAKKLRALWFSPPNNDGYARAGIYGPLPWIFISELLVDELSXPSQEIIRKYIKTSANGNKYAVLASTFGELTWEKPTYSDFQVLSRESEYAGWTLVNGYALNHATVSTHRLXSHIRSISKFTHCGGHGSI

SEQ ID NO: 110466 - protein, 277 aa, Triticum aestivum
  Clone ID: PAT_TA_4884.pep
CSHFSSEGLRLIGKRFCHLEELDITDSDLDDEGLKALSGCRKLSSLKIGICMRISDEALIHIGKSCPELRDIDLYRSGGISDEGVTQIAQGCPMLESINLSYCTEITDVSLVSLSKCAKLNTLEIRGCPSVSSAGLSEIAIGCRLLAKLDVKKCFAINDVGMLFLSQFSHSLRQINLSYCSVTDIGLLSLSSICGLQNMTIVHLAGITPNGLMAALMVSGGLTRVKLHAAFRSMMPPHMLKVVEARGCAFQWIDKPFKVEQERCDIWQQQSRDVLVR

SEQ ID NO: 110467 - protein, 146 aa, Triticum aestivum
  Clone ID: PAT_TA_4885.pep
LGLLTKHMVPLHHPWMCPDRSITHRHTQKHIPTLIDNIAVPPSVCLVGLSHHLREATPSPIQHSTPLPPPLSPLSLSVPSYFPSFSYVWMSTHLPQDIAGSLLLNTYTCRSTSLVRPLPPPPPHTHQYIERSSHVSLPHTNLPCAL

SEQ ID NO: 110468 - protein, 63 aa, Triticum aestivum
  Clone ID: PAT_TA_4886.pep
CTILNHKQLQYFSVADWTKRRIHAELSATSNFPSTRSSRKPLKERWDEPPSMTAPREASRSCA

SEQ ID NO: 110469 - protein, 495 aa, Triticum aestivum
  unsure (1)..(495): unsure at all Xaa locations
  Clone ID: PAT_TA_4887.pep
HASASATAARHMVALPYPGRGHINPMLAVCRLLVAADGALTVTVVVTEEWHGLLASAGVTPTLPDRVRLATIPNVIPSEHGRGADHGGFIEAVNCKMGEPVERLLDRLALELGRRPDAIVADTYLQWAVAAGARRGVPVCSLWTQPATFLLALCHLDLWRPAVEGVSDEELSRKSLEQYVPGLSSVRLSDVKIFLAWKGPIKIAAEVFVNVRKAQCVLFTSFHELEPSSMSKIAESLPCPIYPIGPAILRAPDNGESARDEEHRRWLDAQPQNSVLYVSFGQXVAMPPKQFEEIAVGLRDSAVRFFWVARDRATAGLREMCGDRGLAVPWCDQQEVLRHPSVGGFLSHCGWNSVLEAVCAGVPVIGFPVAWDQLVNARMVADEWKTGINLREQRGEDGIVSRAALSGAARKLMDLDSGAGQEMRTRAAXLREASRGAVIEGGSSHRSLRGGRGDRGGGEAEGAGRWGRPRGEDQGRAAARQPVVGPTGAARPGDL

SEQ ID NO: 110470 - protein, 402 aa, Triticum aestivum
  unsure (1)..(402): unsure at all Xaa locations
  Clone ID: PAT_TA_4888.pep
GSGSLSTQSGLGRAARKQLAAHLDEFWGHLFDYHGKLTQEANXXRYNFLLGLDLRAANSAVRADNQTIEASKSPLMRDALRASATSLNSWDPMSRDKDIRSLDWSSGHQMGPMGSSNWSQSMNSPYTDILSSSSSLLEQNPKYYSNFNMPSYSDNQFYQPATIHGYQLAYLRGMNASRNQHSNIPLDPRRVPRLSEHSFPNYADPVMHARNQNLPGPLGANSPQSPAMNRFNATVERPYYDSTSVDESESVGSPGYSKKYHSSPDISAVIAATRKAALNEANFGGAAGNQSYLSKLASERLQYVESAARSKAQIAFNERSQHNLQRDVLSMQLRMNPNNTSLWAQQPFEQLFGMSSAELNKSEVNTGQRSSGMTKDDSSYTECEAELLQSLRLCIMNILKLE

SEQ ID NO: 110471 - protein, 71 aa, Triticum aestivum
  Clone ID: PAT_TA_4889.pep
RYLFAMNMLSQTETVPASTHTITYVMHEHYRSTDPCRFTDLTSHTQEYLTDHAHGHTNNFKKISHKHTHVH

SEQ ID NO: 110472 - protein, 258 aa, Triticum aestivum
  Clone ID: PAT_TA_4890.pep
MSSAATKLATAADATSTEAQTLVLDMRKALSSMKSLAVEYERAGKPDKVKQLEDAVQELVASYEDCAYLAEAVKKVPGAYQPSDQATDFRKLIDAEVERVKGTSRSSGHKDQLIRQFKEAVWDVHHAGQPMPGDEQEELVMTSTQNNILNTVCPLTGEPILDLENPVRCIDCRHIYDKDPILRYVRADIAPHCPGPGCPAVRRTTRTGDDAFRDMNLVGFSVLCRDDGRSWYFVQVSPVSARVPHFQGVGCVVWGSRD

SEQ ID NO: 110473 - protein, 131 aa, Triticum aestivum
  Clone ID: PAT_TA_4891.pep
LAMSSAKRCIATIMIMVLVFSLQAAVDGGRLLSNSRVRIFPSCPVGQLMKCRTTFPPTGCRCVPVSNLRPMDTHILPQHTVVNGIIWLPSYVEDDQVIAGVSQEDNKLNYRCEQDCPPERIQCSEVECCCM

SEQ ID NO: 110474 - protein, 93 aa, Triticum aestivum
  Clone ID: PAT_TA_4892.pep
STTYSWRRTPRPFNFGTPGRSTPPVLLLDYLQSRLNTKYQSIRYSAVVLISLSCKQKRNARTFCRYEMGRKCELPLWNFIYTPLPLKKKKIAV

SEQ ID NO: 110475 - protein, 291 aa, Triticum aestivum
  Clone ID: PAT_TA_4893.pep
PASSDENALYNVDLVSSILEEFMVQRNGDDEALEDGESYPASLVSGGDSELALVRGVDGYLADIAKDPIRRGEKFIAIAEMAPLAARPTHDGLYRAIDMYLKEHPSLSKSEKKRLCGLMDCKKLTAEASSHAVQNERLPLRLVVQVLFFEQLRASASADAAAASDHHPSSALRSLLPRENGNSYGSSRSAATTATTEDDQWGGGGVPASGDTSSFRSMSGLGNNKSGGNGGKATAKGPLQMPRKMLSKLWSGKASSGENSGGSDTSESPGSVNLEAETKSTHSRNTRHSVS

SEQ ID NO: 110476 - protein, 168 aa, Triticum aestivum
  Clone ID: PAT_TA_4894.pep
MASGALVLTVCFLGFYVPAPSLASSSHNHNDFLRCLSTSLPSQLVLTPSSPSFTPLLVSSIRNARLVAPATANPPLCIVTPTNASHVQAAVRCGRRHSVRVRVRSGGHDCEGLSYRSGTPGSEAFAVIDLAKLHAVRVNPHEATAWVETGATTGKLYYRIATGAPGLG

SEQ ID NO: 110477 - protein, 253 aa, Triticum aestivum
  Clone ID: PAT_TA_4895.pep
AAKEVLAVDDTSRLEESSSRWPNPLWSPTRFVHFLRPQRAVPPAYLSFRHPTYLSLLDRRRHHWPAQYATRAALVSLVYVGVVRKDITGLWSIDMKGKVNGAVDTCGESFHSFDRYLNFSSPVVAKNFDPNACVWAFGMNMFDLAEWRRQNITEIYHFWQKLNEDGLLWKLGTLPLGLVTFWNKTFPLDRSWHVLGLGYNPHVSSGDLERAAVIHYNGNMKPWLEIGLPKFRSYWSEYLDYDQPFLRECNINP

SEQ ID NO: 110478 - protein, 297 aa, Triticum aestivum
  Clone ID: PAT_TA_4896.pep
MPPPSLTAANDRVAAASAANGHAGPDARRRAGKGKKVHPLPADGAAMGDGASGGERLAGGRRPMDWLSPAGVAGILRRHPLPALFACGLLLFMGVEYTIPMVPAAAPPLDLGFHATAAMHAGIAARPWLNSLLAALNTVFVAMQAAYILWAVLAEQRPRAAIATLMMFTCRGLLGCSTQLPLPAEFLGSGMDFPVGNVSFFLFYSGHVAGAVIASIDMRRVGRRRLAVLYDTLNLLQFVRLLACRGHYTIDLAVGVGAGLLFDMLAGWYLDSKNIDSGDNRCCSSCQKALVSQKLTS

SEQ ID NO: 110479 - protein, 215 aa, Triticum aestivum
  Clone ID: PAT_TA_4897.pep
MERQHPAVPLLPILLLLALLSPAARGSESPQYATVHAESDFEVRRYRDTVWMSAPSDDISFHVATKLGFHRLFQYLMGANLNSSRISMTTPILTSIVPGAGPLHSSAYFVRLYLPLEFQASPPVPLPELNLHPDRWPGHCVAVRSFSGYARDHNVVEEAEKLAVSLSRTPWVNSTDHPSKNAYSIAQYNSPFRIIGRVNEVWFDVDCRSAGVEAY

SEQ ID NO: 110480 - protein, 453 aa, Triticum aestivum
  unsure (1)..(453): unsure at all Xaa locations
  Clone ID: PAT_TA_4898.pep
MACAPNFLYRLTLLFCAFGTCIEAGGAALACPPPAPPAPPDPLPGEPAGARRGGRGKAARGRWWCAPRLLLLVAAAGAQWPGDSMRHWLCCNGRSGDDDDRHEVEHSKAQGNKIDGKQKSSKPADQPEPDISPPTIDVPELSFEDLKEKTDNFGSSSLIGEGSYGRVYHATMDDGRQAAIKKFDASENEPNDEFLKQVSLVSRLKHENLVEMLGYYVEGNYRILAYEFATMGSLHDVLHGRKGVQGAQPGPVLDWMQRVKIAIEAAKGIEYLHDSFMYLCATIIHRDIRSSNVLLFEDFKAKIADFNLLNQAPDMAARLHSTRVLGTFGYHAPEYAMTGQLTQKSDVYSFGVVLLELLTGRKPVDHTMPRGQQSLVTWATPXRLSEDKVKQCVDPRLKGEYPPKGVAKLGAVAALCVQYEAEFRPNMSIDVKALSPLLQQRAAGSELAPAPGA

SEQ ID NO: 110481 - protein, 127 aa, Triticum aestivum
  Clone ID: PAT_TA_4899.pep
GDSSWSTLSTICNCSEGLGDALLGNIIFTAMLLLGVRYILKFSFDITRYREILLAIIISSYFKLFLLTMMVWEFPSSAIFIVETFVLSSNVVALRVVTRFPKAHCVGVCFMAHAAKHLTERWLMWTP

SEQ ID NO: 110482 - protein, 260 aa, Triticum aestivum
  unsure (1)..(260): unsure at all Xaa locations
  Clone ID: PAT_TA_4900.pep
MTPRVPPYRHQPAHLVLTDAVAAWHPFHKKPCLSDRSTAPPSAHHADAAAAGAETTTPPPSAVGSGGSFRLLGLRKRRRRGGISRSVSGRSSDRRXRSGTCSDFHVTCGPGGGGATDSSGEMWASDVGELRARDVPMAPEFASAPIGLAGSGAGGTAAGVELASAESGYGSEPGYRGDVELGYXDEIXEEXEDGRQQVFFWGGEIGDCIADMDKMVIVGDSSFGEQKSHHRCRRKHDVRMLDALMKMLMRPVKICTSLLS

SEQ ID NO: 110483 - protein, 105 aa, Triticum aestivum
  unsure (1)..(105): unsure at all Xaa locations
  Clone ID: PAT_TA_4901.pep
DPSQNYCVALVVAAHGELEXWASKQGIAYSDFPDLCQKQETVKEVLQSLAKAGKQSRLEKFEIPARIKLIPEPWTPESGLVTAALKLKREVIKKGYQDDLAKLYR

SEQ ID NO: 110484 - protein, 198 aa, Triticum aestivum
  Clone ID: PAT_TA_4902.pep
SEEIGYVLHAPPITSQEGPEAEEVAHHDEAEARGEVDPAEDVSWVGGEEDPDGAGVHAMEEDGDRKGEVGEGTAGPATAAWEQQRQRRRGCLGWGAAHHPDAEGDYPGGLRVRQLDARQNEGGLAARDMDVLGYVAACYAADRGEGVEERPSADQWDVIPDLLFGLAQTQRQQMRRLAVHGDPSAVTRWSDAREGGSS

SEQ ID NO: 110485 - protein, 187 aa, Triticum aestivum
  Clone ID: PAT_TA_4903.pep
TRPGGPDPLTIPDPASRLLRATASRHPGSARWRDFSARRTVSSPLAAAVLLTKGLTRFNPAVGPSGARSRPARTRPPVRTNLRAALAGAPQPFLGTTPAAHPKSRRTSPRALHTQPQRALNEPGANGMPPPTPPTRSKLHKPGSQHHPTHIWGQFAQPGCTTTILPWPAPPSVLSMRPSQPYKIAHR

SEQ ID NO: 110486 - protein, 179 aa, Triticum aestivum
  unsure (1)..(179): unsure at all Xaa locations
  Clone ID: PAT_TA_4904.pep
FAREGRGDFISEHSAAVFLQGSLVYGEHANXIYRANLHVYICKEACLYSLKHRIPLXAYCEEQCLTLFEHPXVDLLHTVHHETKVKVMPSVEDLLEYSSIQKLLFLGNTDEDFSVLTRHWSELTEGKACVIKEQPNAIEIVPLNASKGGGIRALLDHLGLTEDSDLEAVGDYTRWLSNK

SEQ ID NO: 110487 - protein, 462 aa, Triticum aestivum
  Clone ID: PAT_TA_4905.pep
NMQKLHESAQSQLFELGTQSEEDRTAKEAEVSLLMDEVERAQSRLVSLEREKGDLRSQLQTTNEDTSNNSDYMDPSDILESSLNAKEKIISELNAELRNIESTLSSEKEMHVNEVKKLTALLSEKETAITELKKELQERPTTRLVDDLKKKVQILQAVGYNSIEAEDWELATNGEEMSKLEALLLDKNRKMEHELTQLKVKISEKSSLLEEAEKKIAELTSKVEEQQKLILKLEDDILKGCSSTDRRSSLLNDWDLQEIGSNEVSEGTDPRNSSPDQDQSSMLKVICNQRDRFRTRLRETEEELRRLKEKYEMLAVELEKTKADNVQLYGKIRYVQDYSHEKIVSRGPKKYAEDIESGSSDVETKYKKMYEDDINPFAAFSRKEKDQRYKELGIRDKITLSSGRFLLGNKFARTFIFFYTIGLHLLVFTLLYRMSALSYLSITPAHDEIILDAGNQTLSHMP

SEQ ID NO: 110488 - protein, 252 aa, Triticum aestivum
  Clone ID: PAT_TA_4906.pep
RPVIDSFTKHGNLHMVECLFREMVTLGVHADAYVYSILIDTYAEAGNVQQAAAYFGLVTKAGLCESASIYNSLIKLYTKAGYLAEAQKTYKLLKSLDTDTNLYASNCMIGLYSDHCMVNEARELFENLKITGSANEFSYAMMVCLYKKVARYDEAHRISKEMQALGLLTQALSYNSVIQMYVSGGKMEEAVKIFQKMLASSTPPNDVTFKALKPILVKEGVSNIEIAKLESLRRCNTQDCLNQWYRALALVV

SEQ ID NO: 110489 - protein, 150 aa, Triticum aestivum
  unsure (1)..(150): unsure at all Xaa locations
  Clone ID: PAT_TA_4907.pep
NPAXXSITPXPPCSASKSGSSLSSVTAAPXLSPPSPSPPSTATSAPPPPPPRPPPPSPLSPSRTTSSTPAASPGRNPSRRPGPSPISGPPPTPTPSAPSSRASASPAPTSPPSSPPTRSSSAPGWTGPSPPASPSSAISGYPLPRSRASS

SEQ ID NO: 110490 - protein, 120 aa, Triticum aestivum
  Clone ID: PAT_TA_4908.pep
MEIIDAELRLGPPGSGGDAAFGSQKKRSSSTVAAAATSEASGTDDHDAAPASKVPPAASPRAGAYRECSLPAAPAAAAAGCVRAGVAGLGGRRCGRAGRARGLYVKVSMDGAPYLRKVDL

SEQ ID NO: 110491 - protein, 341 aa, Triticum aestivum
  unsure (1)..(341): unsure at all Xaa locations
  Clone ID: PAT_TA_4909.pep
MGCSLSGLNALYDAATGGGDVWINERRFRVLRQIGEGGFAFVYLVKEHDASSDAARDRHPSHVSDDGTYAMKKVLIQSREQLDLVKEEIRVSSLFNHPNLLPLLDHAIIAVKSTQGDWSHEAYLLFPVHLDGTLFDNAAVMQSRKEFYSVVDVLRIFQQICEGLKHMHSLDPPYAHNDVKPGNVLVTCRKGQAPLATLMDFGSSRPARYRLPSRSDASRSQALPAARRASXHCSAPFRAPELWDCPSHADIDERTDIWSLGCTLYAIMYGVFPFESALGESGGSLQLAIMNAQLKWPALPSPYPDALHKFVTWMLQPQPEMRPPINDILLHVDKLVEKYSP

SEQ ID NO: 110492 - protein, 123 aa, Triticum aestivum
  Clone ID: PAT_TA_4910.pep
RLGKREKEIGGHATRILLSPPLPQKRELLLVIPNPTAAAAPTPTPLPPQSDRWRPPPPLEPPLQPFTFYLYPNSIPREGKPRITRQGEGAPRSAAAPPRPRLPGPRGRPWRSDPTHGWMGAKP

SEQ ID NO: 110493 - protein, 635 aa, Triticum aestivum
  unsure (1)..(635): unsure at all Xaa locations
  Clone ID: PAT_TA_4911.pep
QTCSSEVTTSTTVKTENHIVEIKARPAAGTLVVCPTSVLRQWAEELRNKVTSKANLSFLIYHGSNRTKDPNELTKYDVVLTTYSIVSMEVPKQSSPDSDDEEKGKADRYGAPVSGSKKRKASSSKKTKKATTEKSNLPEKPLARVAWFRVILDEAQSIKNYRTNVAGSCWNLRAKRRWCLSGTPIQNAVEDLFSYFKFLRYEPYCEYKHFCTMIKMPISRNPINGYKKLQVVLKTVMLRRTKATMLDGKPIISLPPKTITLKAVNFTSEERAFYNTLEAESRAQFKVYAAAGTVRQNYVNILLMLLRLRQACDHPHLVKGHESSWTSSLESANKLPMERKQELLVCLQSCSAICALCNDAPEDAVVTACGHVFCNQCILXEQLTGDDSICPXVSNCRVRLNATSLFSRGTLEXSSGKSTSEFQSNDSCTEMVHTENQTGIDSSYASSKVRAALDIILSLPKVDPTQSSDSKKTIGLASENTNGMSSEYADTKTTEKAIVFSQWTRMLDLLEVHLKASHVTYRRLDGTMSVAAXREKPXNDFKTXXEVPVMIIXSQTAILGLNRWAACHVLKLDLXWNPTTXEDKLXDRXHRIGQTRQSQYXXLTVKDTVEVVXXTQXKNREWCSXFGEENWWRQT

SEQ ID NO: 110494 - protein, 141 aa, Triticum aestivum
  unsure (1)..(141): unsure at all Xaa locations
  Clone ID: PAT_TA_4912.pep
RGLLYLHEDAHTPIIHRXPRPSXILLDERWVAKIADFGMARLFPEAGDGHSHVQTRVAGTNGYMAPEYLMHGHLSAKADVFSFGVLVLEILSGRKNSSFIPPPRSSADNLLDYAWKLYKEERSMELLDPSVKSTAAPDQVL

SEQ ID NO: 110495 - protein, 170 aa, Triticum aestivum
  Clone ID: PAT_TA_4913.pep
MKPRDLLERIRRPFASRRGTSASARREEEDLEAIAAREQRAFRYEALAAATRNFSEKQKLGQGGFGPVYRGQLADGRDVAVKRLGAGSRQGAREFKNEANRLSRVQHRNVVNLLGYCAGGADEKLPVYEYVANESLDKIPVSALSGTTPTNGSTHTPAAAAIPQGHRTPI

SEQ ID NO: 110496 - protein, 145 aa, Triticum aestivum
  Clone ID: PAT_TA_4914.pep
MQACELYKEERSMELLDPSVKASAAPDQVLMCVRIGLLCVQADPRLRPDMKRVVIILSKKQSTLEEPTRPGAPGSRYRRRAHGLRSSSQYSDGSSSGTTPSTSHASASASASASASNAMTTSSTRTLRSRGLPSQREEQELPNGS

SEQ ID NO: 110497 - protein, 170 aa, Triticum aestivum
  Clone ID: PAT_TA_4915.pep
MLPLSLLKTAQGHPMLVELKNGETYNGHLVNCDTWMNIHLREVICTSKDGDKFWRMPECYIRGNTIKYLRVPDEVIDKVQEETSKSRSDRKPPGVGRGRGRGDIGTKPGGRGIGRGQDDGKGGGRGRGGIGSKGGNKGGTWIVCRADFEMRECRFFGTVFVGLCRLLRTW

SEQ ID NO: 110498 - protein, 203 aa, Triticum aestivum
  unsure (1)..(203): unsure at all Xaa locations
  Clone ID: PAT_TA_4916.pep
MATAARFLRRTLRASEVASRLLSTSHSIVRRAAYTTGGIIDVGQPTPKSHPELLADEEITPGITSEEYMSRRKKLVDALPEKSLAIIASADQQMMTDVVPYSFRQNGDYLYITGCTQPGGVAVLSKETGLCMFMPDKHKEDVVWEGQTAGVEAAVDFFKADKAFPLSEMKKILPELIGQSSCAFPXANASTSSYXNFDAFRXX

SEQ ID NO: 110499 - protein, 228 aa, Triticum aestivum
  Clone ID: PAT_TA_4917.pep
QRESEPPWAPWSRGTRRPQPRATDDTAKRRTQKSKSFKEVEKFDVFVLEKSSGCKFRSLQLLLFAIMSAAFLTLLYTPSVYEHQLQSNSRFVNVGWIWDKTIPDPRYVSTMPVQWDDVYKTIESLNGGEQKLKVGLLNFNSTEFGSWTQLLPESEFSIIRLEHANESITWQTLYPEWIDEEEETEIPSCPSLPEPNFPRGTHFDVVAVKLPCTRVGGWSRDVARLHLQ

SEQ ID NO: 110500 - protein, 259 aa, Triticum aestivum
  unsure (1)..(259): unsure at all Xaa locations
  Clone ID: PAT_TA_4918.pep
MEPPPPFLAISVTVATLAAGVFAIYFYAPSWRVRRVPGPMAYPLIGHLPLLAKHGXPAVFTVLSRXFGPIYRFHMGRQPLLMIADPELCREVGIQKFKSIPNRSVPSPIRSSPIHNNGLLVTKDSRWQSMRNVIISIYQPSHVASLIPSFQPYIEWTERLLRHGEEITFSDLSLKLFSDTIGQVAFGVDFGLTKGTTSPPPKHHVDCAETVDMTTDFIEKHFYASTSLTMDLSGSVSIILGMLVPFLREPVRQLLLRMP

SEQ ID NO: 110501 - protein, 81 aa, Triticum aestivum
  Clone ID: PAT_TA_4919.pep
NLNETVGPLSPRLVVVVFVGLGDFWTHGVILLAYFSYHTELEASHTSQRLPMNLLLFALVLVLGKLLGAFEVFFIFFPGGK

SEQ ID NO: 110502 - protein, 132 aa, Triticum aestivum
  Clone ID: PAT_TA_4920.pep
HNKLIVDELENLRKLHPGVVIIYADYYGAAMEIFSSPEQFGIEDPLMACCGGGGPYGVSATAGCGHGDYKVCDDPQEYASWDGFHPTEATYKGIANGLLRGSYTQPPISTTSSCPQTTELASSLEYKVLYDM

SEQ ID NO: 110503 - protein, 160 aa, Triticum aestivum
  unsure (1)..(160): unsure at all Xaa locations
  Clone ID: PAT_TA_4921.pep
MGQCSEHSIEQIDPKTGRVGQRVHVGAAALRRPPCPDRVTALEKTDREFAEHPGDIVMVPKIGTNFDTLGEAYDFXSWKKGFGIRYGKSRLNVSRTKCMQDIVCGCAGKPIVENTRSCRCECPSLITLLRTKDNGWYVAEHRDGHNHALSQTYGQTIHWP

SEQ ID NO: 110504 - protein, 193 aa, Triticum aestivum
  unsure (1)..(193): unsure at all Xaa locations
  Clone ID: PAT_TA_4922.pep
MLGAAADFVGSSGSSPPPAPVLPGFLLDRLPDSPPLPPHSLAALCGDFPGKLLPGLTRRQSPSCCASCPANSGTAGFLGEMLSAAFNIVGFSWITSPAATELEVIVLDWFAKMLKLPSQFLSDAXGGGVIQGTASEAVLVVLXAARDRTFKEXHGKKPLEKLVVYASDQTHSAXLQKACQIAGIFPKRLPDSN

SEQ ID NO: 110505 - protein, 267 aa, Triticum aestivum
  unsure (1)..(267): unsure at all Xaa locations
  Clone ID: PAT_TA_4923.pep
EGLMDVIHKRYRFKXHCLAIKRYLLLGQGDFVQYLMDVVGPELSEPANRISPFHLAGLLETAIRASDAQYDDRDILDRIKVKMMDHGDGDVGWDVFSLEYDARVPLDTVFTASVMKMYLKIFNFLWKLKRVDHSLTGVWKTMKPNCILSSPFYKEGAGIRAQFVSVLRKCQVLFNEMNHFVTNFQYYIXMFEVLEVSWARFSEEMDAAKDLDDLLLGHDKYLTSIVEKSLLGERSLGILRNLFALFDIILQFRSHADRWFERIYELQ

SEQ ID NO: 110506 - protein, 338 aa, Triticum aestivum
  Clone ID: PAT_TA_4924.pep
MFALRKTLLHGRLPAPPATAASRISSFLRSLSTSPGGEGVGDEWGSSWSTGITKDHFDGSASAVGRPSPSAPVSKELAAVRTMDEEDEILRSVDRDNKEGRAYVDSWDKRFQETCELLKQVREPGSRGAYLKDSEKQEMYRLHKEDPATYTVERLAKDFRVMRQRVHAILWLKEMEEEEERKQGKPLDDSVEILLDSCPEFFNSHDREFHVASLPYKPDFKVMPEGWDGTTRDPDEVLYEISMKEDQMLYEEFVQRLEFNKKKVAGEVKCHKYSRRRPDDGWAYMVEKLGPQGRRGSGGGWKFISLPDGSSRPLNDTEKMYVKRETPKRRRRIIAPYK

SEQ ID NO: 110507 - protein, 73 aa, Triticum aestivum
  unsure (1)..(73): unsure at all Xaa locations
  Clone ID: PAT_TA_4925.pep
MAPCATAGVQMLAARPCVSASQSMLASRAAVSRIDXGRSALVASRSCPKISCSRSLGSSRSGAVAVRAVSGRT

SEQ ID NO: 110508 - protein, 261 aa, Triticum aestivum
  unsure (1)..(261): unsure at all Xaa locations
  Clone ID: PAT_TA_4926.pep
VTIMRTLYQKCKLVXGDLSEYNILYFKGHLYIIDVSQSVDVDHPLALDLLKEDCLHVSDFFMKRGVAVMTVMDLFNFVIDQNIADDDVDDYLEKVQQKMLENGDTLANDDDISPTVMVQTLDYAKQCEADIVNMSMLQRPSLCYEPPADKLYNQPLLGFVRAEKNKRTAEKQKKQLPHNKCSLLSSGSCSSSXKIRGIEADPKMAGXERXPLXXXGXKNXXKEXRELRKTKEPKXIKKRRKKWQKXXQEVTIGLINSLLVN

SEQ ID NO: 110509 - protein, 442 aa, Triticum aestivum
  unsure (1)..(442): unsure at all Xaa locations
  Clone ID: PAT_TA_4927.pep
RHRPLAAAPPTHAKPHRPPSQAAAAPMMMAGPYHQPTTLXEVRTLWIGDLQYWADENYLYGCFAHTGEVQSVKLIRNKLSGLPEGYGFIEFISHEAAEKVLQAYNGAQMPGTEHTFRLNWASFSSGEKRPDAGPDHSIFVGDLAPDVTDYLLQETFRVNYSSVRGAKVVTDPNTGRSKGYGFVKFADENEKTRAMSEMNGVYCSTRPMRISAAIPKKSSGSQLQYGAAKAMYPATAYAIPQAQTVLPDSDPTNTTIFIGNLDPNVTEEELRQICVQFGELIYVKIPVGKGCGFVQYASRASAEEAVQRLHGTVIGQQVVRLSWGRSPANKQDQSAAWGQQTDPNQWSAYYSYGYDPYGYPQDPSYAYGAYAGYAQYPQQVEGATDMASAAGGHAPGMEQNEVYDPMSLPDVEKLNASYMAVHGNAMLGRHLWLKTSPLSQSA

SEQ ID NO: 110510 - protein, 45 aa, Triticum aestivum
  unsure (1)..(45): unsure at all Xaa locations
  Clone ID: PAT_TA_4928.pep
LEYIPSTLYDQQSYKVIXNDAFPFKWIDKTWTEGFYATSMATAGC

SEQ ID NO: 110511 - protein, 313 aa, Triticum aestivum
  Clone ID: PAT_TA_4929.pep
MDNSVSAEYTPNRSISKRECNDLSSKSKRFHTVDAEAFYSDKENLTPISTGGMKARSCLPKNLFPVDADQDQEAFCSDKENSTPISTGGMKARSCLPKNLFPVDADQDQEAFCSDKENSTPVSCVAQKTRDVSENRARIESAITKKRVVVDRLPFQTLLSNSPLRPTSSFDCTQADASEANLSIRLEDELNSLPHKNHESNRVGEGMKVWTMLADTDCLLDDESRKSIMLLKGIKGTHLIIPRIVMRELEGMKQREGMFKRSSKATSIMQWIEDCMENESWWIHVQSSSEMLPVAPTPPATPTETQRNSEKSE

SEQ ID NO: 110512 - protein, 73 aa, Triticum aestivum
  Clone ID: PAT_TA_4930.pep
AQELEPPIHLLLTLPSTYKVVQIQYSTATKPLPTTAMQMQWRPVSSHIISSHLISSHLIYYNTDTHLNAEHPT

SEQ ID NO: 110513 - protein, 92 aa, Triticum aestivum
  unsure (1)..(92): unsure at all Xaa locations
  Clone ID: PAT_TA_4931.pep
MAAASFGLMDKAYFVGRGEILSWVNATLQLSLNKVEEAAXGAVQCQLLDMVHPGSVPMHKVNFDAKTEYDMIQNYKILQDVFFERPLGQVQW

SEQ ID NO: 110514 - protein, 323 aa, Triticum aestivum
  unsure (1)..(323): unsure at all Xaa locations
  Clone ID: PAT_TA_4932.pep
APPAPPRSPQPPNPPSPHRPFPPAQTSPPRPRGRPPVPDSADLAASAPAASFGLMDKAYFVGRGEXILSWVNATLQLSLNKVEEAASGAVQCQLLDMVHPGSVPMHKVNFDAKTEYDMIQNYKILQDVFNKLRIGKNIEVNKLVKGRPLDNLEFLQWLKRYCDSVNGGIMNENYNPVERRSRGCKERTHKGPNKSSKSLQANRLSSANSADGGALNSNTDLASPVGKVCNAVNEEHYMEQIQQLSEKIADLKVAVDNTEKERDFYFSKLRDIEILCQRPELEHLPMTKGIRKILYAADAKDSSLPEANEIITRSPGMFSDSAE

SEQ ID NO: 110515 - protein, 115 aa, Triticum aestivum
  Clone ID: PAT_TA_4933.pep
ARSQAWGRGSSPQPLVPTRNLKILLPRRQLGSERQAAPCHCRRFSNAADPPFGAHTHGLLQRHLDHCLPGAMCRQPSSTRLSPTSIRVDLLIGGGNPSLSVVCSSTPSLASEVPK

SEQ ID NO: 110516 - protein, 398 aa, Triticum aestivum
  unsure (1)..(398): unsure at all Xaa locations
  Clone ID: PAT_TA_4934.pep
DPARHVLSRAFTPWPSLGLVSSALRAGASTLKGNRPDFFVVNSVGPGASAPVVCLLLPFLPILRGAQLPELSCHLSLGPECSLGFGDAPFECGRARFRPLLFTSAIMALHMSRFDLIDLSSALGAAPGASSGAPIPGPALPILSPSFPVCQLLFSALLLGKTYSLRQIIGCFLVTSGVILAAACGVKESHLLSGVKLIWPLLIVLSSAFQAVASILKESVFVDGAKRLKGKRPDIFVVNSFGSGFQALFVFLLLPLLSNLRGIKLAELSGHLNGGAECFLNVGESPIDCGGAPFLPLLFIFINMAFNISLLNLVKMSSAVVASLTATSAVPISIYILSLPXLPYIPQGAELSASFILGGMVWLSGLILYNLPQSSKVPTSDCYLVPFAWLSPPRPLIW

SEQ ID NO: 110517 - protein, 217 aa, Triticum aestivum
  unsure (1)..(217): unsure at all Xaa locations
  Clone ID: PAT_TA_4935.pep
FMQAYDLIEVYCELIVARMSIIDSQKTCPIDLKEAIASVIFASMRCSDVTELAXVRKNFTSKYGKEFATSALEVRPDSGVNRLVIEKLSAGAPDVQTKTKTLSSIAAEHNIKWEPKAFEEQKQNEDRMYGSTYSGGNIPTSGSPASSVPTPQPAAAPYSSVQSATSRVPAGPSYESSEALANRNPHGTANSNASTQENRRGSDASVPSSHMVQLLIP

SEQ ID NO: 110518 - protein, 72 aa, Triticum aestivum
  unsure (1)..(72): unsure at all Xaa locations
  Clone ID: PAT_TA_4936.pep
SFFKLQSHKHSWTNXGFVAAGVAAFLIISASGALYCRAKKVGTVKPWVTGLSGQLQKAFVTGVPALKRSELE

SEQ ID NO: 110519 - protein, 63 aa, Triticum aestivum
  Clone ID: PAT_TA_4937.pep
FTSLLLLNTISCLSTKELTEIRFCSANGFQSNFSLTFYRPTFFLKICLPPLVPSILKVVFHCH

SEQ ID NO: 110520 - protein, 229 aa, Triticum aestivum
  unsure (1)..(229): unsure at all Xaa locations
  Clone ID: PAT_TA_4938.pep
MASNGMASSPSAFFPPNFLLHMQQAPPQHDPSQEHHQQHHHHHHHEHHLPPPHPQHNPFLPSPQCPSLQDFRGGLSPMLGKRPAMYGGGGDGGCGGDEVTGGGGGGGANEEETSDDGSQLGGEKKRRLNVEQVRTLEKNFEVANKLEPERKMQLARALGLQPRQVAIWFQNRRARWKTKQLEKDYDVLKRQFDAVKAENDALLPQNKELHPETGRLRASGAXSXLLTPR

SEQ ID NO: 110521 - protein, 221 aa, Triticum aestivum
  Clone ID: PAT_TA_4939.pep
PPPPTRSRSPRRGKPSPSPRPPRRGSPTPAMATVPSKPEPLSDVSDLNLHGSHAPATATLSGKPEPLLSDLNLQDKEAGLTNGLADSSDKNDKEAPSPEINSEESLEGDKVIDIGQKVLNALDDLPAADLAPFLACDDIEGNPNPWVQVEPRGRRQGAHTVAPVDNTGDVDGLGEQGVDEFEDVFWLTKIRQHRVSRRSTKSRPRALVGVRSGPGVFVFNY

SEQ ID NO: 110522 - protein, 386 aa, Triticum aestivum
  Clone ID: PAT_TA_4940.pep
MSSNSTLTESLHEKTIVFGLKLWVVIGIAVGASLLGILLILVICLTIQTWIRRSRKAFKELPMTQIPSAFKDITEVRVADQFSPNDYVVHDGLLLAIENGPVESMDKDAVQLVQEDNSRHREENNLSGSLVHTDGCDGIQSVSVCEQPSVHATADSAPLDGLPGFSYLGWGHWFTLRDLDVATDHFAKDNVIGEGGYGVVYRGRLSNGTPVAVKKILNNLGQAEREFRVEVEAIGNVRHKNLVRLLGYCVEGTQRMLVYEFVNNGNLESWLHGELSQYSSLTWLARMKVLLGTAKALAYLHEALEPKVVHRDIKASNILIDDEFNAKISDFGLAKMLGAGKSHIATRVMGTFGYVAPEYANSGLLNEKSDVYSFGVLLLEVITGRD

SEQ ID NO: 110523 - protein, 129 aa, Triticum aestivum
  Clone ID: PAT_TA_4941.pep
MPGLGFAEPPPPAPPPQPAPSPPRPRFRSNDGGGWDDYGAGRVTIDHLEGSTSEKEIVLAVIDAENKETMLSPPITPDDIYRRRRGTFISWFDPETGLSISLSFLDAAACSDVWDTICQVQRKLRPDGW

SEQ ID NO: 110524 - protein, 185 aa, Triticum aestivum
  Clone ID: PAT_TA_4942.pep
MNHPAISSQAIPTHLSTPRILSSPPAQQLAMDASATVATGKGKKGAAGRKAGGPRKKSVSRSVKAGLQFPVSRIGRFLKKGRYAQRVGSGAPVYLAAVLEYLAAELLELAGNAAKDNKKSRIIPRHLLLAVRNDQELGRLLAGVTIAHGGVIPNINPVLLPKKTAEKSPKEPKSPKKTAKSPKKA

SEQ ID NO: 110525 - protein, 174 aa, Triticum aestivum
  Clone ID: PAT_TA_4943.pep
EIDAHLSGEPSRLLDKKDLPHLPYLHCIINETMRLCPAAPLLLPHEAAADCQLHGYDVAAGTIVLVNAYAIHRDPAEWGPAPEEFRPERFEHGGAEGKLMMSFGMGRRKCPGESLAMRTMGMVLGTLIQCFDWKRVGDEEVDMAASSGIVMFKAVALEALCTPRAGMETLLHKL

SEQ ID NO: 110526 - protein, 147 aa, Triticum aestivum
  unsure (1)..(147): unsure at all Xaa locations
  Clone ID: PAT_TA_4944.pep
MLGGVLSNTLLLLFGYAMPAFECFKTVEARPNDAHMLRFWCXYWIIVAMGIAFESLISWVPMYGXEIKLAFFVYLWDPKTKGSRXVYDTFLRPXVMQYEPNIEQRLLHLTAKSGQPRPAPSRPGDSTVASTNAPGEVVLQASTRGKG

SEQ ID NO: 110527 - protein, 172 aa, Triticum aestivum
  unsure (1)..(172): unsure at all Xaa locations
  Clone ID: PAT_TA_4945.pep
MAPPPRHGPGKAASLSFLLQGTLKAATDLSRFGNDWIEFGWVKGLTVAGQNGAXIDGQGAASWPFNKCPIRKDCKVLPTSVLFVNNQNTVVRDISSVNSKFFHFALLQSKNTQLINLQINAPVNSPNTDGIHIERSTGVVISDTHISTGDDCISIGQGSDNIDIARVHCGPG

SEQ ID NO: 110528 - protein, 207 aa, Triticum aestivum
  Clone ID: PAT_TA_4946.pep
SSPTPLPWSSPPWRATKPLHPVLQAVDDGNLRLLKETAGVVADDGIWSRALVLAAMNGRLDVCRCLVEDLRVDVNQRTFTGDTALAISAAYGTAAITKYLLDRGADPTLVGALWPPLHGAAMSGECEILELLLSAGIDVDCFDSVYGTPLHAAAAVGEDGAVNILLEHHADPDKILNLHSTPLNLSILSKSLECVKLLIKAGADVNK

SEQ ID NO: 110529 - protein, 162 aa, Triticum aestivum
  Clone ID: PAT_TA_4947.pep
GAPVRRGGKPPRHAGRCSALWKDGGRPDLGRARSMILVAECSARVEPSTRSSQHSGTRLLWLLPPNQLLLTSRPSPMTPDANGSRGGQRPCQGEILGSRFKLLRCQIKRRGGQIHLHGGSRFHHRKDDERPPTSRASLPERSGRAPPLAGFDGEDSSTPDLG

SEQ ID NO: 110530 - protein, 79 aa, Triticum aestivum
  Clone ID: PAT_TA_4948.pep
MTAARGINPLKLQGFTDADWQGDLDDRKSTSGYLFTLAGGAISWSSKKQDSVALSSMEAEYIAASEAVKEGVWLKGFLA

SEQ ID NO: 110531 - protein, 128 aa, Triticum aestivum
  Clone ID: PAT_TA_4949.pep
FLRESSVQKVQISSCHSYCVDAQADHNLYTSGAEILFGFISLSSGALPTLTLRVQPLVASEHTSPTTASTCGRAQPAAANTSFGTLMESWDSNGKTEVLLAPDAAEIPLISTPLVDISPAPEQHGRRC

SEQ ID NO: 110532 - protein, 226 aa, Triticum aestivum
  unsure (1)..(226): unsure at all Xaa locations
  Clone ID: PAT_TA_4950.pep
HPGPARQVVVVASKPKLGAAERSSEEKEVPFDELCDEDKIVAFFKRLLSEWSQELDEMPDAERRTAKGKAAVATCKQCAXYLEPLFKLCRKKALPGDVRRALLDVVWCCMRRDYLAATDSYIKLAIGNSPWPIGVTMVGIHERSAREKIHTNGVAHVMDDETTRKYLQLQFVKRLMTFCQRRYPTDPSXSVEFNSLANGSDLQSLLAEKGAEKKHPEETLRLVAAS

SEQ ID NO: 110533 - protein, 94 aa, Triticum aestivum
  Clone ID: PAT_TA_4951.pep
SIEGRAEGRGNLVGGTFMSEKWCARIEAANFVVPTRGACSRLAASMEPGRYTPYAGGLAGQGRRTAWSARNSCACAMAEWGGLKRTSSFDVTVR

SEQ ID NO: 110534 - protein, 94 aa, Triticum aestivum
  Clone ID: PAT_TA_4952.pep
QNQNITHPQNPRRLVTVRRLKIVREASTREIHHLSAGIFAERKRNLHTNLARIDLRSREKKTESEQEWAVWLDGCSGNPKPMNITPPPMKPADQ

SEQ ID NO: 110535 - protein, 250 aa, Triticum aestivum
  unsure (1)..(250): unsure at all Xaa locations
  Clone ID: PAT_TA_4953.pep
MERGSGSCFQGVLCHWLVLVLIWLCGCQHVLSQQTTLEPKDKFLLSDPPIGLFDPIEISPSVLPHNTNPVEPLSPMYPNYTSYDPVLXLGKCHVNFSKLSFMMDKTASDCSVPLAPLVADVICCPQVSSLMNIFQAAYGGGNNTLALNPASPFACLSDTMSVLATRGATAHIPGLCTLRPSNLTDASCPMKDISSFERMVNVSKLLDACNSVDPLKECCRXICQPAIXEAAVIYLXRXSMFGXHTGNALG

SEQ ID NO: 110536 - protein, 268 aa, Triticum aestivum
  Clone ID: PAT_TA_4954.pep
HDVLIDGMLKDGLWDVYNDFPRPRRPELCADQHSITREEQDAYAVQSNEHGIAARDSGAFDWEIVPVEIPSGRGRPPVVVDKDESLAKYDPVKLKKLGPAFKKNGSVTAGNSSSISDGAAAIVLVSGEKAKNLGLQVLARIRGYADAAQAPELFTTTPALAIPKAISNAGLRDSQIDYYEINEAFSVVAVANQRLLGISPGKLNLSGGAVSLGHPIGCSGARIIVTLLGILRQKQGKFGVAGVCNGGGGASAIVVESMQASSRLRSSL

SEQ ID NO: 110537 - protein, 300 aa, Triticum aestivum
  Clone ID: PAT_TA_4955.pep
MAKFQITPFPGLVENTEFNFGSLYLYNISNPPSYASIKENNATTGWGGASLVNWQIYDGDGSGANLVGHAQGMQIHAGASHQSFTLVFENGRFKGSTLYVVGQTVRVEQAGEWSIVGGTGDLAMARGVVKVKFHEKVKDGNTWELRFHGFCSMQSLPTLTKTGPWGGHGGSVTESEQPWRIESMTIVHEGIIAMFSCSYVDLSGKRRTTGSWGGGNGIRTKVELGPREILKAVSGTYVSLYNGQTVIESLKFVTNEGTYGPYGRTTGTPFNADVPKDQSIVGFFGRADDTQLIAFGVYTV

SEQ ID NO: 110538 - protein, 224 aa, Triticum aestivum
  unsure (1)..(224): unsure at all Xaa locations
  Clone ID: PAT_TA_4956.pep
MEMEEYLNWKKNAPVLYDLIVSHPLEWPSLTVQWLPSGSPASARSHRLVLGTHASDDSPNHLMLVDAVLPLPPRLAAAAAAEGRAVPAPSVSIGRSASHQGEVNRARCMPQRPYTVATKTCVDEVHVYHLGEDGDKGGADAVLRGHGAEGYGLAWSAMKEGFLLSGSYDKXKICLWDLKGREWEPPVSWDAQPVWGSGRRRWNVFLGRPVALGTPFWGKNPFWN

SEQ ID NO: 110539 - protein, 130 aa, Triticum aestivum
  unsure (1)..(130): unsure at all Xaa locations
  Clone ID: PAT_TA_4957.pep
TAPTRPVFPRSPPHTLTPRSPSPPLLSQISNSPTLPSHSIRLLPETXPPPLPWGARTAGRTTTSPTPTTTTPPPAPSTPPPTSPPLPPPPPPKPPDWRPRPPSSTTXPPPSQPPXSSTPSPSPRTLAPPP

SEQ ID NO: 110540 - protein, 142 aa, Triticum aestivum
  Clone ID: PAT_TA_4958.pep
MQSAQQKARRKNAQVLDGSDIRELVENEGAFAKFVENKFRHLDADGDGRLSLRELQPAVADIGAAIGLPAKGSSAQADHIYSEVLNEFTHGKQDSVSKPEFQHVLSDILLGMAAGLKRDPIMILRMEGEDLNEFVESTAYEA

SEQ ID NO: 110541 - protein, 126 aa, Triticum aestivum
  Clone ID: PAT_TA_4959.pep
VIGFVPWWVAGPHICKIFGQTGGCGNPSSPLCSSATKKKEYRQQVSQSVSQFQCCFIVQPASDSLFVDLDLNGEDKMYVSEPKLRAVVCNAMPEGCIIMYVQTENNLYFLSVKARMPFVIEEAAHY

SEQ ID NO: 110542 - protein, 95 aa, Triticum aestivum
  Clone ID: PAT_TA_4960.pep
DFEIKRWAAGKEGNLRALLSTMQYVLWPECGWQPVSLTDLITAAAVKKVYRKATLCIHPDKVQQKGANLQQKYIAEKVFDLLKEAWNKFNSEELF

SEQ ID NO: 110543 - protein, 526 aa, Triticum aestivum
  unsure (1)..(526): unsure at all Xaa locations
  Clone ID: PAT_TA_4961.pep
MPYVIEEAADDMSSLMDPLXGKKVCHVEFSQRFDSIVRHHPSAYNHVVFFDINMXALDGIQGPXIYVGTGCVFXWQALYGYVAPKRKRSPSWTCSCWLNWFACGIRFVNRLIEKQLTEPMAEEKRRLVFLMEDNQSXAYALSEINEAAAGAETQKAGIVNQQKLEKKFGQSAVFVASTLLENGGTLRCDSPASLLKEAIHVIGCGYEDKTDWGKEIGWIYGSVTEDILTGFKMHCHGWRSIYCIPKRPAFKGSAPLNLSDRLNQVLRWALGSIEIFFSNHCPLWYGYGGGLKFLERFSYINSIVYPWTSIPLLAYCTLPAICLLTGKFITPELSNLASIWYMSLFICIFATGILEMRWARVAVDDWWRNEQFWVIGGVSAHLFAVFQGLLKVIAGVDTSFTVTTKAGDDEEFSELYTFKWTTLLIPPTTLLLLNFIGVVAGISNAINNGYESWGPLFGKLFFAFWVIVHLYPFLKGLLGRQNRTPTIVIVWSILLASIISLLWVRVNPFLAKTDGPLLEECGLDCT

SEQ ID NO: 110544 - protein, 116 aa, Triticum aestivum
  Clone ID: PAT_TA_4962.pep
KNIARKENETVRYRLPRSQAVAAALKIVGHGTSQEKAMERKMVSFLPYLHSSSPRRRCASGQPPGHLMPWSHMLLAATLTPNRLLDEPVHAVVCDHSHTIRVSHCHVAALLAAHVL

SEQ ID NO: 110545 - protein, 220 aa, Triticum aestivum
  Clone ID: PAT_TA_4963.pep
GHEILASCCQPWLEFRRRWLSLVRRTLEKAGPAFIKWGQWAATRPDLFPARRCVELAKLHSGAPVHGFAYSKASIEKAFGRKLSEIFETFEENPVASGSIAQIHRATLKDRPDSNSTRKKKRDQHPVKHVAVKVRHPGVGESIKKDFLLINFMAKVSNAVPGLSWLRLDESVRQFAVFMMSQVDLSREASNLHRFRHNFRRWRHVSFPEPLYPLVHPAVL

SEQ ID NO: 110546 - protein, 126 aa, Triticum aestivum
  unsure (1)..(126): unsure at all Xaa locations
  Clone ID: PAT_TA_4964.pep
QQQQLPXPAHHPLPNQPPPQLYQANSHVSSHYNSQSMQVDRSAPWGRGNQEASSAGSHFPGQFQGLPGQMTQGIGGMQTGRLEAPLTADMEKMLVQQVMSMSPEQINALPPEQRQQVLQLRDMLRQ

SEQ ID NO: 110547 - protein, 136 aa, Triticum aestivum
  Clone ID: PAT_TA_4965.pep
WPLQGGGWEHDGETREVAWSWAGSWHEEEELGGIGASGSSIRAAAELQAARLPSCCGGALGSHVMLPHRRASSMSPRVVPRWRLLLDLNDDIGGARGGEVVAAPPHHSSRRHGSSCGYRAAGAVWDRSSSAGPWRA

SEQ ID NO: 110548 - protein, 254 aa, Triticum aestivum
  Clone ID: PAT_TA_4966.pep
MALASGSGGGGGSDFSVMVIGSDFAVDAGAALLASPADREEWHDCAPDLGDDFSDLEELQVVRVQGADRSGRPVVRVVGKFFPAPVIDGGRLKRYVFHKLRTELPEGPFCILYVHTTVQSDDNNPGMTILRGIYEELPADYKERLQIFYFLHPGLYSALARASPGRLVLCGGFYWKIKYVSRLEYLWGDIKKGEVEIPDFVTEHDKILEHRPLTDYGIEPDPLHLADIPAAGYSLGRYEDKWSPEDRWNSRNYM

SEQ ID NO: 110549 - protein, 125 aa, Triticum aestivum
  unsure (1)..(125): unsure at all Xaa locations
  Clone ID: PAT_TA_4967.pep
RPVNPASPNELARAARASCGNERTNLRKSSSSRTLLQLGVALNKNNGGNMEAKSYLSASLNLMTDAWDSXPLESSPVGVLQRTAFGSVSSSTGSSPRQEYHGVYDGNPRDDLGSIVVNHPSIRLM

SEQ ID NO: 110550 - protein, 112 aa, Triticum aestivum
  unsure (1)..(112): unsure at all Xaa locations
  Clone ID: PAT_TA_4968.pep
MLFSSARSAYNSQRRQQVQEEIDKVQARSQVHCCLFLFEHFLIWSCSRFMVCQPTWLRMYCSWFGCINQQVLLCIAVGLVPSADWPVGKPAGKTCTVSSPRIQSLELDXQCC

SEQ ID NO: 110551 - protein, 115 aa, Triticum aestivum
  Clone ID: PAT_TA_4969.pep
IMLAAMPSLCFWRSSGREKFARADEKRPSACWFWRSSVQERFARAAAGARYKKELPPHSVCRPLVSPPLTSLVASAPACRCAAWALWIFAESASVAPAPSPPRSGLARNASSSAP

SEQ ID NO: 110552 - protein, 366 aa, Triticum aestivum
  Clone ID: PAT_TA_4970.pep
MAAALRLLPSTATRLRFRPRLPLSTAASLFSPPSKAVLYDQHGPPDQVLRVEDVPPVELGERGVCVKMLAAPINPSDINRVQGVYPVRPPLPAAVAGYEGVAQVHAVGPAVTRPLSPGDWVIPSPPSFGTWQTYIVKPEDVWHKVRDDVPVEYAATVTVNPLTALRMLQDFVKLKPGDAVVQNGSTSIVGQCVIQLAKVQGIRTINIIRDRPGSEEAKEKLKQLGADEVFTESQLDVKNVKSLLGALPEPALGFNCVGGNAASLILKLLRQGGTMVTYGGMSKKPVTVSTSSFIFKDLSLRGFWLQKWMNSDKSEECRTMIDYLLGLVHEGKLKYEMELTPFSEFSLALDKALGKHGSQPKQVLRF

SEQ ID NO: 110553 - protein, 333 aa, Triticum aestivum
  Clone ID: PAT_TA_4971.pep
LTDLLNAFTNDIVCEAVSGRLFRERGHKKLFRELVEANSLLLGGFNLEDYFPMLVKMDIIKRIVCAKAQKVNKMWDNLLNNIIDEHARKSVPEHNNEDSDFTDVLLSIQQEYKLTRDHIKAQLEILFEAGTDTSFIVLEYAMVQLMRKPHLMNKLQAEVRSTITKGKEIVAEDDLDSLAYLKAVIKETLRLHMPGPLLIPHLSMADCNIKGYTIPSGIRVIINSWALARDPSSSEHADEFMPERFMECGSAATMDYKGNDFQYLPFGAGRRICPGMNYATASIEIMLANLMYHFNWKLPVELMDEGGISMTEFFGMTVHRKEKLLLVPVVPED

SEQ ID NO: 110554 - protein, 112 aa, Triticum aestivum
  Clone ID: PAT_TA_4972.pep
MKATAQELDSLERVRRASVALNVWQPQVVHGRQKQLVQQCTVPVDSRLSALHMELKVCKQQIATYKNAYNKEKLKLNEYEEALRRAKYHPMQNSSDTSAPGNEPQAKRKRLK

SEQ ID NO: 110555 - protein, 375 aa, Triticum aestivum
  unsure (1)..(375): unsure at all Xaa locations
  Clone ID: PAT_TA_4973.pep
MWRRHLLRRLLPSPATAGTPSPLVRHLSTTPTPFSTTDTTSIASSLAAAVTKLSSTPAPATSPDAYFSLHFSDVRPTNALLAETLSLSPPATSRAAADLFRFLVRRSLHPSDGALALVVRHLARRRDFPAVRTLLQEFPSALGPDTVDAYLFHLARAGRATDALKVFDELPGELRTRGALTSLVSSLSSEGFPQLAERAVKKIAHEIFPDDNICTLLVSGYADAGKLDHALRLIGETRNGGFQPGLDAYNAVLDCVCRLCRKKDPLRMPVEAEKFLVDMEANGIPRDAGTFRVLIKNLCKIRRTEDAMNLFRQMGEXWGCSPDADTYLVLIKSLYQAARISEGDELMIWMRSAGFGDKLDRKAYYGFIKVLCGIE

SEQ ID NO: 110556 - protein, 62 aa, Triticum aestivum
  Clone ID: PAT_TA_4974.pep
AFRARFYMEPKSSDSGSMASGPGGRGPTSGSSASRGTRAPGGAAVKPLPALKDNVKNVMFYC

SEQ ID NO: 110557 - protein, 300 aa, Triticum aestivum
  Clone ID: PAT_TA_4975.pep
IPLVTDRPTIIFGADVTHPHPGEDSSPSIAAVVASQDWPEVTRYAGLVSAQAHRQELIEDLYKVRQDPQKGPVSSGMIRELLISFKKSTGEKPQRIIFYRDGVSEGQFYQVLLFELNAIRKACASLEANYQPQVTFIVVQKRHHTRLFAHNHNDKNSMDRSGNILPGTVVDTKICHPTEFDFYLYSHAGIQGTSRPAHYHVLWDENKFTADELQTLTNNLCYTYARCTRSVSIVPPAYYAHLAAFRARFYMEPDTSDSGSMASGARGPTQGGRNTRPFGNVAVRPLPALKENVKRVMFYC

SEQ ID NO: 110558 - protein, 542 aa, Triticum aestivum
  unsure (1)..(542): unsure at all Xaa locations
  Clone ID: PAT_TA_4976.pep
FDVECPPCILCSSGRLPCPFLDGVRKLHHRAYYKDPXAEEFGIKIDEQLASVEARVLPPXAPKIPIDRLAGREGXVLPRVGQWNMMNKKMVNGGRVSHWACINFSRNVQDNAAKVFCHELAIMCQISGMNFAPEPVLPVLSARPEHVERALKARYHDAMNASKPPGKELDLLIVILPDNNGSLYGDLKRICETELGLVSQCCLTKHVFKMSKQYLANVALKINVKVGGRNTVLVDALARRIRLVTDRPTIIFGADVTHPHPGEDSSPSIAAVVASQDWPEITKYAGLVSAQAHRQELIQDLFKVWQDPQRGTVTGGMIKELLISFKRATGQKPQRIIFYRDGVSEGQFYQVLLFELDAIRKACASLEPNYQPPVTFVVVQKRHHTRLFANNHNDQRTVDRSGNILPGTVVDSKICHPTEFDFYLCSHAGIQGTSRPAHYHVLWDENKFTADELQTLTNNLCYTYARCTRSVSIVPPAYYAHLAAFRARFYMEPDTSDSGSVASGARGGPPQGGPRSSTRFGNVAVRPLPALKENVKRVMFYC

SEQ ID NO: 110559 - protein, 150 aa, Triticum aestivum
  Clone ID: PAT_TA_4977.pep
MKSPFRPRAAPFVSALVLLLLALVPSPEAAEPTTPGTRTRKLGRDAGSSVFSLFNMKPQSKFWTESVMRTEFDDLEGSKSRDSINIGLLNFTRAGNVANYMNLAEVDSIYFSIPVNFIFMGFDGKGGHEFKLGREELERWFTKIDHIFEH

SEQ ID NO: 110560 - protein, 61 aa, Triticum aestivum
  Clone ID: PAT_TA_4978.pep
MDVFCTSILTYHHKVRGGQVRWGEQRYFFCTFEYFNDIDKNLGYVTVIVYVILCPVMSFTS

SEQ ID NO: 110561 - protein, 73 aa, Triticum aestivum
  Clone ID: PAT_TA_4979.pep
SHRLHQTNWIVLISLCGCACDPGDLSCGLDGDVGAVQEACWGCLFQGSEPGQDLWKEFTTPTRREMVVLHFFF

SEQ ID NO: 110562 - protein, 217 aa, Triticum aestivum
  unsure (1)..(217): unsure at all Xaa locations
  Clone ID: PAT_TA_4980.pep
PAGTGPEFGGGAAGPGKKKGMPAKNLMAERRRRKKLNDRLYMLRSVVPKISKMDRASILGDAIEYLKELLHKISDLQNELESSPSMPSLPPTPTSFHPLTPTLPALPSRVXKEELCPSALPKPXTGQQPTVEVRLREXPGPSNIHIAVPSQGXGLCGSLPMKGXEAPGGDVQQAVISCFNGFALDVFKAEQCKDGPGLQPEEIKAVLLQSAGFHPAM

SEQ ID NO: 110563 - protein, 291 aa, Triticum aestivum
  unsure (1)..(291): unsure at all Xaa locations
  Clone ID: PAT_TA_4981.pep
IRRAVHPAAACAALQGFVLVRRASAGPGQAVAPTSPCIAWCRPCPDVRAFQEALPNGPSALSGGVFGCLLQSFTSPAPCLAEPRGSXAVGSWGGASDFCIAHCLFGMGXMNGMNCHSGGVGSRRLKYTSFFHNINASSLRTAKMMCPDPFDDLLKTVIMNDQLACDPDVGGCGKPNHIHHILSSSPHVFTVVLGWQNSKESVGDIAATLAGISTEIDISVFYRGLDQGSKHFLVSVVCYYGQHYHCFAFEDEHWVMYDDQTVKVIGSWADVVIMCEKGHLQPQVLFFEAAN

SEQ ID NO: 110564 - protein, 358 aa, Triticum aestivum
  unsure (1)..(358): unsure at all Xaa locations
  Clone ID: PAT_TA_4982.pep
FPXKKXFXXXXXPXXXXKAPKFXFAPNXXGFXPPKKFFXSFXXPRVFFGPXEGPXNFXXXGXXKXFXGXNPXGFFGFPQNSLFXXXXNQIPLXPGXFKXVKFVSIPSPKXPPFPFFXPFQSPPPXXXXXGAFHPLXFSRXLNGXXFVXKNWFQGXKAQYPFLGSLGAHSGFFXXDNPXGTWSTSSXILAXSPPGQSSSRRLRHPVHHLPYLPPQRPPLXVRHPHGAFVVVFGVGVGVGAARPAADHQPASLGVARTQCPGAGGEHGSQARPGPRARAEADDEARRERVPTGVLWPFGAKHRTGRGQGTAKRHSWPPARARLLFWPASTLPGVEIRRWSLARCRCRGNWLMNLVRDSRQ

SEQ ID NO: 110565 - protein, 197 aa, Triticum aestivum
  Clone ID: PAT_TA_4983.pep
GWVPTWLAIRGTQFAAHFQSLDLAAPGLALWHPSRCRRDPSALVRIPDQLSLACDFRTLPHLSRARIIRNHGCILLELCSGETLFQTHENLEHLAMMERVLGPLPRLMLERADRHAQKYIRRGRLNWPEGATTRESMRAVLKLPRLQNLVMQHVDHSAGDLIGLLHGLLAYEPSARLTAQEALSHRFFRRHRERRSL

SEQ ID NO: 110566 - protein, 55 aa, Triticum aestivum
  Clone ID: PAT_TA_4984.pep
ITLECHLFSCIFPSRKSSMKILIDPSSSFRCSFASYQKYVQVFRGQLMFVIGYIK

SEQ ID NO: 110567 - protein, 157 aa, Triticum aestivum
  Clone ID: PAT_TA_4985.pep
GIRYDPPDSLPLRPGRTYDPVVQDYFAINGARLPHCSSSPRAHPCILVSVPPIFAPPMPMPVPRRRPLDKLCPITCARGSHGGAPLAATLLTPAVAAALAMACSASLSAARRPSSHASGCSLPTLVDFYTAGQERRAAKSRGQLDQRAALALLLEDV

SEQ ID NO: 110568 - protein, 142 aa, Triticum aestivum
  Clone ID: PAT_TA_4986.pep
TLAQAAIGPCPCRNTKSANSHFSTNSGNRLQLERNGVKSTRRHTTTPERKAKHVQTRSRASTVIRLLHTRRADPPAALIRLTRQDALLQGCTRTCSDCSECTVHTHETWQIQASSSSSWLSLAAVVIAAPTPPALVRAPASL

SEQ ID NO: 110569 - protein, 172 aa, Triticum aestivum
  unsure (1)..(172): unsure at all Xaa locations
  Clone ID: PAT_TA_4987.pep
CAAVSLECCCFSGDKEXGSGSDDGSLELWSVMRKKPTHIIKNAHPALAPSSLDSADEKLPKENGICKPQSLSSAHSWISAVAARKGSDLAASGAANGVVRLWTIQPDSKGMQPLFDLPLDGFVNSLAIAKSGRFIVAGVGREPRLGKWGRVATAKNGVAIHRLSLQDDSEDL

SEQ ID NO: 110570 - protein, 307 aa, Triticum aestivum
  unsure (1)..(307): unsure at all Xaa locations
  Clone ID: PAT_TA_4988.pep
LARCMTCQLCHRLLRNATTISECLHTFCRKCIYKKLNDEECDHCPVCKIDLGCAPIEKLRADHNKQDVRSKIFPLKRNKIDAKGSPVTLPIKRKERSISSLVVDTPRITTGLTGRRTRAVTRKAAAALRGLGPILDPVERDNGSANKHPDNLSLLDSLSKVPQTRRKASSIAETSSHNSNKDKAGDDKDLDKADLWKPLNCLVEAASKTKSFRSNQPNGSPSSEHASKEKSVENLRKTRFQDDKKDAPQPVMLKKKGTGRTKNATSVAAASQKAQNSRALNPVWFSLIASFEQXGLPPLPQIPAHYL

SEQ ID NO: 110571 - protein, 192 aa, Triticum aestivum
  Clone ID: PAT_TA_4989.pep
QLLLGYLPMDHALWAYELEKKRSQYSAFKDELLVNPSEVTRRMEMTISKRKEHNSEGTGFLPRAEIVQDEHPLSLGKTSVWNQHFQESETVEQIDRDVKRTHPEMQFFNGGSSDALSNQESLKRILTIFAKLNPGIRSLHSPIPVSAPLLVPLASDPAQSPSGSSPLLPIGSGLAFSVFLWGGAALAVLRRL

SEQ ID NO: 110572 - protein, 243 aa, Triticum aestivum
  Clone ID: PAT_TA_4990.pep
MDATAAAAGGGDGTQRTLNPYVTGNSVIAMKYKDGVIMACDTGASYGSTLRYKSVERIKEGGKHSLIGGSGEFSDFQEILRDLDELTLNDHMGDDGNSLGPKEIHAYLTRVMYNRRNKFDPLWNSLVLGGVKKGPKGDEKYLGMVNMIGTHFEENHIATGFGNHMAIPILRGEWREDMTFEEAVKLIEKCLLVLLYRDRSSINKFQIAKITTEGSTIYPPYALKTNWGFAAFENPSKGAVGTW

SEQ ID NO: 110573 - protein, 241 aa, Triticum aestivum
  unsure (1)..(241): unsure at all Xaa locations
  Clone ID: PAT_TA_4991.pep
MGRRNPYVTGKSVIAMKYKDGVIMASDTGASYGSTVRIQESGVYNXLGKHSLIGWSGELSDFHGDFDDIWMNLTEXTMNDQMXDDGNXLGPKEIHYYLXTRVMYNXRNKFDPLWNSRVXAGWKVKKGPKGDDXYLGMDNMIGXHFEENHIATGFGKXIMAIPQLMRGEWRXDMTFEEAVKLIEKCLLXVLLYRDRSSINKFPRLPRSRTXGSTIYPPYALEDLTXGFAAFENPSKGAVVTW

SEQ ID NO: 110574 - protein, 181 aa, Triticum aestivum
  unsure (1)..(181): unsure at all Xaa locations
  Clone ID: PAT_TA_4992.pep
TPASTRRLIEKLYEDVPPMPLMALNHISRLCKSXVDASVRFYVKALGFVLIHRPPALDFSGAWLFNYGIGIHLVQRDDARRAADVNPGELDPMDNHISFQCEDMGAMERRLKEMGIRYMKRTINEEEGSPIDQLFFKDPDGFMIEICNCENLELVPAGALGRLRLPRDRHNPPLRMDGADE

SEQ ID NO: 110575 - protein, 69 aa, Triticum aestivum
  unsure (1)..(69): unsure at all Xaa locations
  Clone ID: PAT_TA_4993.pep
QFELLLTXATFVVAIFGVVSGVFGMNLEGVAVLKVPHAFEWTLIITGVCGAVIFACLLWYFKKRRFFPL

SEQ ID NO: 110576 - protein, 126 aa, Triticum aestivum
  Clone ID: PAT_TA_4994.pep
MDAELLELQRQLEAAQSARSSVRLSERNVVELVQKLQERGLIDFELLHTVSGKEYITSDHLKHEIKVEIKKRGRTSLVDLSDTLGVDLYHIERQAQKVVTEDPALMLINGEIMSQSYWDTVTEEIN

SEQ ID NO: 110577 - protein, 132 aa, Triticum aestivum
  Clone ID: PAT_TA_4995.pep
TSDDSMEKKDLLGARTKPAAGKRRRKVAAGPGLAKAIAEYLASDSYMYAPLVSEPQEPPPPPPPAAAPATSTPASAEKGAALVQKYRGSWAWVHLLPARSICGDVAVLPFSISFKAFPMLFYSPSAMHICFL

SEQ ID NO: 110578 - protein, 78 aa, Triticum aestivum
  Clone ID: PAT_TA_4996.pep
KETTANLSPILRCFDLCIHLFFRIKDCHFINLMEANNIHLQSYFPMQNNIHLCMAQSKSNSLNLRLDGHCDMTWLTYT

SEQ ID NO: 110579 - protein, 161 aa, Triticum aestivum
  unsure (1)..(161): unsure at all Xaa locations
  Clone ID: PAT_TA_4997.pep
LLGARPPPPPTFFPARVRTRILAAGAPIPWPSSLPAYPIQPLSSPPARPIPPSPSSSARPILRPSSLPARPITXPSAPPARPIPPPSSSSACPXLRPSPPPPVPLHPPSXPPPPCPDPDRPDXTPPPTARADLPPSTASLLSSGWLPKAPTRGHLPNPRIS

SEQ ID NO: 110580 - protein, 228 aa, Triticum aestivum
  Clone ID: PAT_TA_4998.pep
LPLPPTSHCFEALIYGHHPGIDYLPECWYWRSLPPPPFRNSNHRLDDNQFIGGGYADEDGDLSRVTAYTVVNDLDIWVSQGGTTYSFDTVSSAWTSLGEWTLPFRGHAEYIPENKLWFGLSSDGDLLCTSDLSSTSRPPQLHNLWKELAPPKEWFLHNSYLVHLGSGKFCIAKFFETGRISNTQYNERFAVLTGVEVKRCGKHGTELRMVKHGSRRYSLNKQSYFRVF

SEQ ID NO: 110581 - protein, 125 aa, Triticum aestivum
  Clone ID: PAT_TA_4999.pep
AACPHTSLVRVKRKRGPALKAEPRHPAEDEGEADQAPPYEPGASLVLRWDGTISTTRTSARFRRHAKQTSPEEARTQLDVRKKVTRGKRTHRSSAPRPAALHEPRPPPRADTTAAQTTVPPTPQR

SEQ ID NO: 110582 - protein, 103 aa, Triticum aestivum
  Clone ID: PAT_TA_5000.pep
LDRMAREGETGLPGGAARKGLLAQERLPDGRSRGGETRKEQLGEEGYREMGHKGGETRKEQLGEEGYREMGRKGGLSTMEESGGERAAREGIEIDESKFKTKS

SEQ ID NO: 110583 - protein, 174 aa, Triticum aestivum
  unsure (1)..(174): unsure at all Xaa locations
  Clone ID: PAT_TA_5001.pep
AADLSPKLKSLLADXERSKLLRKLSEANQLNRFLXKRRARPGRAEEIANFDVPSGSRKVNGKYIQSHLLSRLEAVHDKVMAQIKDIESLRPREITVHWVGMAENVQIMGSFDGWSHGEAMSREYSGDYARFSATLRLRPGSYEIKFLVDGEWKLSSEYPITGEGLTQNNKLVVQ

SEQ ID NO: 110584 - protein, 348 aa, Triticum aestivum
  unsure (1)..(348): unsure at all Xaa locations
  Clone ID: PAT_TA_5002.pep
MAEASRTSEARRDAVFARWVIFSPARSRRPTDLKSHGPANPSPGPDDGAPKPSCPFCLGRESECAPEIFRVPPPDASPPWRIRVIENLFPALRREAAPPAPEDEEPVGAGECAVRGFGFHDVVIETPHHXVRLWDLDAEGVRHVLLAYARRVQQLAEHPAVKYVQVFKNQGASAGASMAHSHSQMLGTPFVPPSVTSRLNCMKEVFERSGKCSLCVVPSKDILVSETHNFSAFVPFAASYPFEIWIVPRQHSSYFHETDQDKVLDLAGLLKSMLHKLCKQLNDPPFNYMIHSAPFGLSSSCLPYTHWFLQIVPQLSVIGGFEMGSGCHINPVFPEDAAKILREIDGSV

SEQ ID NO: 110585 - protein, 207 aa, Triticum aestivum
  Clone ID: PAT_TA_5003.pep
RRSKTAKENKKGGEGRRHAGRTHRGECSRLGHGWDPADSEACMRLHPLAKLTTHHAGGRSRSNAGGRRGNHQELGKADVAERVSSAFELHTGACRGPVLRRRTMPPTAAGPDAGERGGRTCTPRPAGRPSRWPSPCTWYAMTVANSTANILAFGFASRDEGAPQRDPGSWVSGKAWASGSEVGEDGRPQRRAPPGEGAAARAAGARG

SEQ ID NO: 110586 - protein, 157 aa, Triticum aestivum
  Clone ID: PAT_TA_5004.pep
MTPCYPVPPWAQPRRRPPPPRHRRGASRSASIQARPPCTHEAPGPPVSSWVQAGDGASSQRPELPPTPPPPLPPLPSPAPEGGSFVEDYLLGHDEASRQLAPRARCAPPSRHRRSAGGPPGGREAGGVRAACPRRACAPGADWPCLGWSGALSALPR

SEQ ID NO: 110587 - protein, 168 aa, Triticum aestivum
  Clone ID: PAT_TA_5005.pep
MRPVCASMIRRRTTQCDLKCQHHQVPARKKQCVDECHSREHHQPQQTHLARTSVATGKTRRGRTSACNSACAAASASLWAAATTSTSTATPKRRRSPGVRATGSANCLAKGSVRAGNIGPSTNSACDSAFAAATSSTTSTSAAGKRWPAPSSRRCECHVTHLIIIIIM

SEQ ID NO: 110588 - protein, 395 aa, Triticum aestivum
  Clone ID: PAT_TA_5006.pep
MPAQKRPHPSPDADDAHVDQEEEAAAAAAGAAGSGTEGGAAPRAANGGSAELAKDGGGGDSDAGEDEDEEEQRKQQQQQDEHEEGGGSGGDDEDADHSQSSESDAADVDEFILVKLMDIRKEVQCPICLGIIRKTRTVMECLHRFCRDCIDKSMRLGNNECPACRTHCKSRRSLRDDPNFDALILALYPDIDKYEEEERPPARPEKTRNKKIQDSIAETFRRQTEALVKKRSNAKAIASTRKTRGSMRTKKRGRTSSPDNAPTDIDDDEREENGNDGSKESSSVDDRSPDVKMKRARRWPVPRSSPAKTIGSVDSSYEENDDLGGARDILATSPLRGEMLAWGKNGTRSQTRHGSAGGSSGRMVKGGRVAKLVDHLRNADEFDTKFNLYLALISA

SEQ ID NO: 110589 - protein, 469 aa, Triticum aestivum
  unsure (1)..(469): unsure at all Xaa locations
  Clone ID: PAT_TA_5007.pep
QRRGGAAAADGAPPAAAAEEKVVVAVRAAIREISKTAIVWALTHVVQPGGSIILLVVIPAQSSGRKFWGFPLFAGDCASGHKTMLDQKSDVSELCSQMMLKLHDVYDASKINVKVKVVSGSPPGVVAAESKRAQASWVVLDKELKHEEKRCMEELQCNIVVMKRSQPKVLRPRVRGSPDKESKGSCSLPAVLDSSVGKTATDVKEPRSSVRGPAVTPNSSPDLETPFGSTEAGTSSVSSSDPGTSPFCASETTVSLKKEVQATKDKIQHSDVNISDTDSEILSPSATFSLQPWMVDILQGSASSKPPRKTRTPTADTLLEKISKLDLLHEISSMRSRSDLNFRGNVRDAVSLARSAPPGPPPLCSICQHKAPVFGKPPRWFSYAELELATGGFSQANFLAEGGFGSVHPGVLXDGQGNLLSSNNXSFASSQGGGVFCLPLEGGSCPHLRHVLRLWGFWAQGGWGVLGYG

SEQ ID NO: 110590 - protein, 157 aa, Triticum aestivum
  Clone ID: PAT_TA_5008.pep
AVVITTYEGKHTHPIPSALRGSTHLLAAQAAHLHHQHHGHLGMLPQMGMGGRAGSPFGRSSGGGIDVLGGLLQPRAHHGMTPPMIGAGAGHQASTQGLPGSISSVASATASSPPSLQMQHFMAPDFGLLQDMLPSFIHGAGGNNNNNQPSSPYGKLH

SEQ ID NO: 110591 - protein, 329 aa, Triticum aestivum
  Clone ID: PAT_TA_5009.pep
MSYVNTEQPSKVISFPRRSISTDENRSYTERGRASVREKLEQSAIRERHRSRGRERKETMASRGVGTPIKSRDGKGKAAMLESETERSHHASQTVSFPRTPSVPPSPPYRATGVYGTPRYHTEQSLPVQKDDEMLHPRRVARAEDNANMNYRGKGNVDKWLHMLMDDQQEGNEAAYRSSEDHNAAEKNGSDDEQEIQSRIDDDDESCRNEITECVDEITESVDKIVDVGGESAATHHGTPRCRDSFDIKEEKVERKIWFPRSDSGRGFRSLPSSPSKILGMRRGSDCAGRKPKVGRDDDHRYGYEDSVSTSSSKFLSKCKQAIKKTVHK

SEQ ID NO: 110592 - protein, 210 aa, Triticum aestivum
  Clone ID: PAT_TA_5010.pep
PPNPSSTAIQARSKPKAPKLTEAMSQFDGGLAGVYPEEEDDRLADLAGDSDCEDDEYVQSISKASEDTSAMDVLKGKDIQGIPWERLTITRDGYRKSRLEGYTNFENIPNSGQLSEKVCTPVEKGQLYYEFAHNTRSVRPTIFHFQVRKCGRPTPGFHGVLLSPCSARQGSPPSSVKHEVGDRLRPAAPAEMRLGSCCVYLLQIFFFDVQ

SEQ ID NO: 110593 - protein, 225 aa, Triticum aestivum
  unsure (1)..(225): unsure at all Xaa locations
  Clone ID: PAT_TA_5011.pep
SGCRVLIPVRSPRPPLPPRAPPAGPLPSGSCVPVDIEWPPSXSTSSDFNAPFSANKDSKSGGLSNDGVDDVDPFADWPPKPSSAASISAVERLPSTNQSISGLNTGNMGFGWSQXRLARMKTNQVSWSAKPNNTNIMGMNSTASYLNQGNSSLGYGNPIGRTELRSPQCSYYPGGAHAPTRLGNAPTAGVGRGRGRNQGQSALSRASRTPNSNVSSEQPPFLDLL

SEQ ID NO: 110594 - protein, 167 aa, Triticum aestivum
  Clone ID: PAT_TA_5012.pep
LFLFCFSFYLEVTFLIWCALRSDYEDFIRDLTRQLCRLSPVRVDSYLESAIQAFDAPWPVIQANAVCLVSCMLSFLDDQRFLAPYFSQVFAMLVGRISQSPEAVVRAAASSALGLLIKRSNMLKSLSSRFDRTDPSQSSQHGEPHAKTSSELQEEAAAKPNGAQGEQ

SEQ ID NO: 110595 - protein, 298 aa, Triticum aestivum
  unsure (1)..(298): unsure at all Xaa locations
  Clone ID: PAT_TA_5013.pep
EKHKDKKKDKSKDKSRESEGADRHGEALLGQKFGESSRKSEEIKDPIFREELARKTQDQKVVENXSCXNNFTISNERSREGFSAAPALENDRTAARGLRPHSIDASRRSEGLGQQTITINQQKNGTSIRRSENLNSSSQGGSDGFSTTPMVEKERVKVTRPLSNSTDSVPRKEGTGQRISNISILVQKRTESPNKETARKEIGTNSPLLRSPANALHKGNGKVGRPAGQXPTSMQRFESPSTSGASTGMDRSLPRSTIPSPSITIRRPNGMVRPTESLPISASKPNAGGVSPAMGKEK

SEQ ID NO: 110596 - protein, 93 aa, Triticum aestivum
  Clone ID: PAT_TA_5014.pep
PQQQPQPKRKRLPGALGTPRSAARRGRGTHSRLLASDRGESGARNQGDTPTGRASAGLLVGGPDRNLRYLVSSSVGLAVEKTKTTAAAAACVL

SEQ ID NO: 110597 - protein, 377 aa, Triticum aestivum
  unsure (1)..(377): unsure at all Xaa locations
  Clone ID: PAT_TA_5015.pep
TRLRFSGPASPVPLPAGQPKLLRRLDIAPPKRIKPSALRHVINAAANHGLSELAVRLHRRVCLPKKVFAIRSLAVLSLNTCSVPPLPAVACARLRTLKLHRVYIKQVVLTAILSAATGLHTLEMVHCTGLDAGCTVESLTVRSFLFMPNVKQRQVTLRAPGLRTITLHTRPKTQKVHLEPSPDVSKAYLHVAKSQEKVLFRMRPFLDAATGLASLTLRGCAXKLLAGEYKDIAKLPITFEGLRILSVSLNFSRESEAVFLVLLRQCWPSRHPLTVSAAENKMTEASFSFADHKKMLAKASCLTNSLLKIKFLGFKSGEYEKDLLVFLLNRTNKLKKIGVQFPASEETAVKWALSVRPAPIERRSTMFNKGYLQLEYT

SEQ ID NO: 110598 - protein, 88 aa, Triticum aestivum
  Clone ID: PAT_TA_5016.pep
NQKKNLESLSFPSHTCCPTNGQIEVSCTASRKCALDCLSHVCLQHALALSLLCELASPHFSRIISVLLGFLECTNPTSTRLPVWWCTP

SEQ ID NO: 110599 - protein, 137 aa, Triticum aestivum
  Clone ID: PAT_TA_5017.pep
HEEELSVIDPIFEDDNEDIPAIGLLGMEDGMLLFATVLEPRLYLWSMEAGSNGAAPLAQRRVIELAPLLPCRALLDVSVVGFAEGVGLIFLNTEAGLYTIELNSGRSKEVHRATSFKRVMPYTSFYTRAWGRMPTSD

SEQ ID NO: 110600 - protein, 302 aa, Triticum aestivum
  Clone ID: PAT_TA_5018.pep
MNNLLTDSFELPRRDSSRDGDVEMGMHQPDASDNLKGFLKKVDGIESLIAKLTNLLTKLQTANEESKAVTKASAMKAIKQRMEKDIDEVGKIARMAKTKVDELEKDNLSNRQKPGCGKGSAVDRSREQTTGAVKKKLKERMDDFQVLRESIRQEYREVVERRVFTVTGNRPDEETIDDLIETGRSEQIFKDAVQQQGRGQILDTVAEIQERHDAVRDLERKLLELQQIFLDMAVLVEAQGDMINHIETHVSNATNHIQQGVGALQNAKKLQKNSRKWMCYAIILLLVIVVIIVVAVIQPWKK

SEQ ID NO: 110601 - protein, 136 aa, Triticum aestivum
  Clone ID: PAT_TA_5019.pep
VADFFHPISSDIPNTRLDRGDEAHSSRESSAAGDSISQGKGRGEGWLSSATMLRSRSTATSKAASGGGWASSVHGHTRRKPRGGGAASSMRWCSSARAQRRPTMEEARGRLRRKRWGSFGSVSGGRTKDDGQPETG

SEQ ID NO: 110602 - protein, 145 aa, Triticum aestivum
  Clone ID: PAT_TA_5020.pep
CQRQTNLSNDSIRITEGILNPSRENRKKLNSTFAMEREKIGAIVVLLQALEVVGLLEAARKRIQAPAFDYQHVEQALRRCISLYNEPHTRNVVSKALRQHYLKCLHSLTLIVQHDPDISNAPQMQGLLGESQRIVKELGGESNTK

SEQ ID NO: 110603 - protein, 159 aa, Triticum aestivum
  Clone ID: PAT_TA_5021.pep
MTVPGSPVSPGASKMSSVPWKRLELAALCAYAVVFYSAMVQRSLRLARDYTGKLYGLRAGSIPGRLNDSSDAQWRNFRGNLPILTVVMAAFLIVAKGLRYGCSLKGRGASLVWLILSLIYLCYLHGACVGFILVIAGVNYAIVKLFARYKYCTGIIWSF

SEQ ID NO: 110604 - protein, 57 aa, Triticum aestivum
  unsure (1)..(57): unsure at all Xaa locations
  Clone ID: PAT_TA_5022.pep
FRILVEEXLAXLLDFCSKXPGVIIHHPAQRISFCECPSLEIFPLFIIDVLSMIVVPP

SEQ ID NO: 110605 - protein, 107 aa, Triticum aestivum
  Clone ID: PAT_TA_5023.pep
AAYRPKLKTDLFKCNEETQLHAMLSRNSHEYMPNFVENKSSNQHSSSYKHTYYRSMRVCMLHESLHMLIKKVVPNKGDEYKRGNYVALYWKPSTSARVSSSLNSCRI

SEQ ID NO: 110606 - protein, 88 aa, Triticum aestivum
  unsure (1)..(88): unsure at all Xaa locations
  Clone ID: PAT_TA_5024.pep
GLNKKLAHWMHFPSVNWLISYSXYSQALESYEKFXTKACEALHREDDLSEIVQGEGHNQALQKNSELLSVKHCTRFCIREMASHYHAP

SEQ ID NO: 110607 - protein, 152 aa, Triticum aestivum
  Clone ID: PAT_TA_5025.pep
GGRVFVHGVGREGLMMRALCMRLAHLGLTAHCVGDVTAPPALSGDLLVASAGPGAFSTVDAICGVARGAGTRVVLLTARPEGDFPGRQADVVAHLPAQTMADDEDGAAAQAKLPMGSLYEGAMFVLFEMVVPEGGGVPGQSPAQMRARSCRI

SEQ ID NO: 110608 - protein, 250 aa, Triticum aestivum
  Clone ID: PAT_TA_5026.pep
NSARAAALWRGNQANVIRYFPTQACNFAFKGYFKSFFGYDKEKDGKWKWLAGNVACGSAAGATTSSLLYHLDYARTRLATDAIESRANKRQFRGLLDVYKKTLATDGIRGLYRGFSVSIVGITLYRGLYFGIYDTMKPIVLVGPLEGNFLASFALGWTITTFSGACAYPFDTLRRRMMLTSGQPFKYRSAFHAVKQIVSTEGFFTLFRGVGANILSGMAGAGVLAGYDQLQRFAGQHDYKIENKMKGALK

SEQ ID NO: 110609 - protein, 179 aa, Triticum aestivum
  unsure (1)..(179): unsure at all Xaa locations
  Clone ID: PAT_TA_5027.pep
MAPKADKKPAAENKVEKXAAEKAPAGKKPKAQKRLPAGKTAGQGRKAARQGPAGRKPRAKKPRRGTREAAGSEGKTRGRKKGSKAKKGVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 110610 - protein, 413 aa, Triticum aestivum
  unsure (1)..(413): unsure at all Xaa locations
  Clone ID: PAT_TA_5028.pep
MAEECCSADLLEWIGPDVSACVFGRLDHPADLVRAAAVSRTWRRCVVESGLSKSLCLRLCPEVATVAAAAEVARSPPSTAAHESGHERDYRIYSNLAGAYVSDSAAKPSAECILDCIGASSTDDFPAETMENTLDEEEIINFRPSYWSSGGADDPEAPESLTYRLNSDICIVDEIRVRPYQAXFQDGDPIYSSKMVRFQMGHYDVWASKVVRFRMGHYKLPRGSETFVMDDYENKMVNADEKYMWTYTSPEFPMLQKNELQSFKLPRPVLCIGGVVMIELLGRVQKQEADDRYYICVCHAEVMGRSLSPLFMVEISDPEGYSILKYLPGAKDLSIDDFLQDDTKDSPEWHYLVDRYRQMNHRAVVVSALLEPVHYMHDVGGISDDDHEDDVGGISDDDHEDDVGGISDDDYLV

SEQ ID NO: 110611 - protein, 384 aa, Triticum aestivum
  unsure (1)..(384): unsure at all Xaa locations
  Clone ID: PAT_TA_5029.pep
PTHLLAPARCGLSLSLRPALPSARGPRGALPPSLPPLPPPLGRLAVGFCASAPASSPVAALARSAGSSNAATAGRRHEAVARRVEERVFRSFPAAGHTLLLVHRCIFADHLPLALAFRCLVRLDDREPPSFLSDSVLRAAGAPYVGRFCVAGAQPAMGVVAMADQGTVVGLEMGTKGGQYAADPMTGPMGDGMVLWNPQITLDGRPDAFCGGWVGFFSYDTVRYVETKKLPFSKAPEDDRNLPDIHLGLYNDVVVFDHVEKKTHVIHWVRLDCYHSIDEAYEDGKNRLEALLSRLHSSNVPTLSAGSIKLNVGQFGSALQKSTMSSEDYKKSVVQAKEHILAGDIFQVVLSQRFERRTFADPFEVYRXRLRIVNPSPYMAYLQA

SEQ ID NO: 110612 - protein, 237 aa, Triticum aestivum
  Clone ID: PAT_TA_5030.pep
RGCILVASSPEILTRVAKRTVVNRPLAGTIRRGKTKDEDKVLEQLLLSDEKQRAEHIMLVDLGRNDVGKVSKPGTVKVEKLMNIERYSHVMHISSTVTGELRDELTCWDALRAALPVGTVSGAPKVRAMELIDEMEVTMRGPYSGGFGQISFRGDMDIALALRTIVFPTASRFDTMYSYGTDSSNARQEWVAHIQTGAGIVADSKPDDEQQECQNKAAGLARAIDLAESTFLDLSDA

SEQ ID NO: 110613 - protein, 345 aa, Triticum aestivum
  Clone ID: PAT_TA_5031.pep
SRASGLLLRQGGLFVNKDENLLTRLQNINLCFHFEVEQQVNGAFLNFFGFNGTAGVWRIKALEDSGGWMERTTVEDMDIAVRAHLKGWKFLYLNDVECQCELPESYEAYRKQQHRWHSGPMQLFRLCFVDIIKSKIGFWKKFNLIFLFFLLRKLILPFYSFTLFCVILPMTMFAPEAELPAWVVCYIPATMSLLNILPAPKSFPFIVPYLLFENTMSVTKFNAMISGLFQLGSAYEWVVTKKSGRSSEGDLVALVENEKQSKQQRVGSAPNLDSLAAKEELYPKSEPKKKKHNRLYRKELALSFLLLTAAARSLLSVQGIHFYFLLFQGVSFLVVGLDLIGEQVE

SEQ ID NO: 110614 - protein, 77 aa, Triticum aestivum
  Clone ID: PAT_TA_5032.pep
IRHEPPVRDSSHGRESWPNRPPLLIPSAVHRSAPCACYYSGDSRGRHERNWACGGCVGERRQGIMAVIVSTGDERGA

SEQ ID NO: 110615 - protein, 102 aa, Triticum aestivum
  Clone ID: PAT_TA_5033.pep
NSARGNIDVAVLRIVITDQPSCESAQKKKSSYACGDSSDGVGVPSGGYSCSSRPDTTGNNPYLMDGCQQGRLTKGRNIMKRGVHTTCGSRSISYRHTVHSDK

SEQ ID NO: 110616 - protein, 219 aa, Triticum aestivum
  Clone ID: PAT_TA_5034.pep
NSARGEFSYNSTKWRPSVPFEDQLKAFQELIDEGKVRYIGVSNESSERPPGLVQAAKLQGLPKIVSIQNSYSLIVRCRFEVDLVEVCHPNNCNVGLLAYSPLAGGVLSGKYLDANSAGAKRSRLNLFPGYMERYNASLAKEATDEYVKLAKKHGLTPVQLALGFVRDRPFTASTIIGATTMDQLKENIDAFTSAPRPLPPQVLDDIEILFKKYKDPAIL

SEQ ID NO: 110617 - protein, 127 aa, Triticum aestivum
  unsure (1)..(127): unsure at all Xaa locations
  Clone ID: PAT_TA_5035.pep
LTWEPGQLYWQPQRRGGARRXGGRGEGGRWXLVGGGGPFLSKGTGIVEDFEEASVQSRGFGILDVGYRSKDEAWAGGGSGVLVKTXGGGRPWVGTRAADNIPGHPHPVKFIGGQPXFVRWNDGDVLL

SEQ ID NO: 110618 - protein, 136 aa, Triticum aestivum
  Clone ID: PAT_TA_5036.pep
EHCVCSSGCRVSHSSVVRVETLAVIIFFLQKNSGHALPCGSSSSHALNYSLSPTCGIASIGVHQPCIKLLRSRVTADYPDRSAAVMSNEPSNHRTPSFPAVSWTDEATIISLFSLSFLSTQPSLLPHLVPHFFKKT

SEQ ID NO: 110619 - protein, 264 aa, Triticum aestivum
  Clone ID: PAT_TA_5037.pep
MALSLARSPHPAAAAALPLPRIQGRISQYAPLLHSPRRAYPGLRLRLPAAAVAASSPPEALAAEPAAAAEGDEELGETRRKLFVGNMPFTFSAAETEKLFAECGVVKDVEVIKMKDGRKRGFAFVTMATAEEAAAAAEKFDGHDVMGRIIKVEFSKSFRKPAPPPSPDTIVAKYKLYVSNLAWKARSADLKEFFLQFNPVSANIVFEDRKSTGYGFVSFGTKEEAEAALTELNGKELMERPVILRWREDKETVKLMVNLSLRFV

SEQ ID NO: 110620 - protein, 226 aa, Triticum aestivum
  Clone ID: PAT_TA_5038.pep
MDLSSSLASTSDEETRALNALLDAFSCAFSLEDIANAYCRANGDVNKAGDFLTDLQLSMPQSDEVDSSVETNLPQFGTAVEENSLDNSNQTRNLSCVGKAAEESSVENSSQTRTREKSQKSSASFGTVSSMLGKGSARATTAPANTAPGKGKPIKVELPEYMRDDLKTDESDSAPKRETLNNRDVEEFLFSMLGEGFKLNMEVIRDVLCSCGVPHEKHPGGINVFF

SEQ ID NO: 110621 - protein, 55 aa, Triticum aestivum
  Clone ID: PAT_TA_5039.pep
ILQRLSMSCAPGIGWQVHFWSVCCPHNALLADKLPHGIGWNGAHLVCPLLSCLSP

SEQ ID NO: 110622 - protein, 134 aa, Triticum aestivum
  Clone ID: PAT_TA_5040.pep
ILSPVISDAGVLKGDYGMHEGNNNVDSSDDINSFPTMENESSTSEAEVSVHPGGEQSVLCCLSKVNNSEQHVVEANSIDEVNSLFRSRMEEVLVQSVSEPVMGQPLTVTLEDDSSDPALCPNPGMHAIEASSVE

SEQ ID NO: 110623 - protein, 450 aa, Triticum aestivum
  unsure (1)..(450): unsure at all Xaa locations
  Clone ID: PAT_TA_5041.pep
ARGKSSLLLNPKQXVPSWTETGARLLVTRFLNQYVTIGNMTILEEGGTMFSFGEVDKKCLVKTVLRVHDPLFYWKVATEADLARADAYINGYFSFVDQREGLLNLFLILIANRDAQKSSSSAAGKRGWWTPMLLTAGIASAKYFLRHISRKNTVTQTRRNISQHYDLSNDFFSIFLDPSMTYSCAVFKVEDESLEVAQQRKVNLLIKKAKVERNHHVLEIGSGWGSLAMEVVKQTGCKYTGITLSEEQLKYAQMKVKEAGLEDRITFLLCDYRQIPSRCKYDRIISCEMIRRVGHEFMDDFFGCCESLLAPDGLFVLQFISIPEERYEEYRRSSDFIKEYIFPGGCLPSLARITSAMSAASRLCIEQVENIGYHYYPTLIRWRDNFMANKDAILALGFDEKFIRVWEYYFIYCAAGFKSRTLGTYQIVFSRPGNDKLAYADNPYASLPAA

SEQ ID NO: 110624 - protein, 93 aa, Triticum aestivum
  Clone ID: PAT_TA_5042.pep
FLYLGENLSLQYNKNAKLPSRTRASKVRVFSAYMRDGAIWWRRWRSGGGGTSGDGGLRTATLGPGGHWYGRGDSGAKTAHSGGGTRPSVVKGP

SEQ ID NO: 110625 - protein, 340 aa, Triticum aestivum
  Clone ID: PAT_TA_5043.pep
MEDEEMERKVQQYLHRKGFRLTELALQEERNRLSTTSLSDVSLSRPDNDPARYYDGYNKLRSWAYNSLDQYKHELLRVLYPAFIHCFMDLVSEGHTLEARAFFLKFREDHELMHSRDLQKLEGTLSPLHLEEMDLARSLRENKFRIKLCEYSYELLLQYLQKTQALVMLGIINERILLEVSVDQPSLISDDADVVALVGTSKDLAKQINQKEVHWGLLEDSVEERMEKALLDSDRAEAESKDADAEDNNKARNSLVVWNSCYMMFVICSLPLKPGHSFFVNTQQHVFVLLFFCCYLKNRNAIHIPFSVTNLDLSLFLIIFATEKILKRWKAGWSSEQKAQ

SEQ ID NO: 110626 - protein, 136 aa, Triticum aestivum
  Clone ID: PAT_TA_5044.pep
MMAEAWVDVLPPPAPYFAGQPCWAVQQERRGGGAWTLEENKVFEEALAAIDLDAPDRWEMVALMLPRKTVADVVNHYRALENDVGFIEAGLVPFPHYDSSSPSSGFTLDWDGGAAGAGGFRRGYCLKRGRADQERK

SEQ ID NO: 110627 - protein, 115 aa, Triticum aestivum
  Clone ID: PAT_TA_5045.pep
AEILRGHGGPSLGFVKLRAGDRRAGAGVGGIATRWSNVLRTGSVAAKFVAVDFGTLMFTMERGRDMRELKEFILGQPEAYEFKVGDQFFRRPGDPPLDQVIQMLRKHKDKSEDEL

SEQ ID NO: 110628 - protein, 103 aa, Triticum aestivum
  Clone ID: PAT_TA_5046.pep
FHSNCILPWLELHSSCPICRFQLPTEESKNPCESGSGGGTVSADGDHAESSNSDIEGANHDGGRLLDGSSINDRDVTSALNAIFGDGSSSSSSDENGPRASES

SEQ ID NO: 110629 - protein, 169 aa, Triticum aestivum
  Clone ID: PAT_TA_5047.pep
MEEGQESRYWCHSCAEVIVPVEPEKKCPDCDGGFVEEMGSEGFEPSTNVRSERNLSLWAPLLLGMMGGSSRRSRPQRDMMDSSSDEDSRQARIRSALRDTDDEDEDDDDDDSDRELEDMIRRRRRRGSSLVRLLQTLRDDLRGLDGIGRDRDRDSERDRERERERRDRE

SEQ ID NO: 110630 - protein, 328 aa, Triticum aestivum
  Clone ID: PAT_TA_5048.pep
TQTSHINHLLNLDLADRLHQGKPPNYDYYLAQHDLHQESRSHHQCVIHLGCLTPRFAIVKTKLAEKCVVAVMKGCSWSEIFFGKRSPTPTSPIVTPQDKLYSPVLPGCSQLAMLPQIPFWQAEFQNDSGHCLPNAARAYLGQDQECTHQLKRQYLCCSSSLGCPYSPLFLGDQRPLYCRLTLKYFQAFTPYSPRPHQMPACVHRAGRGGSGASARQGAVRIPRLGHSHRGRQEADPSSESPPSSGTPRAMSIFAGLTLEASVCPIMACTVLSAVLLNLRIQVEPQPPDPRATAMDATWGPSRAPIGSLQETKWASPATQPNNLRMQLA

SEQ ID NO: 110631 - protein, 124 aa, Triticum aestivum
  Clone ID: PAT_TA_5049.pep
SPSRRCHEGRLPWRGIVTPACFGHWQARLQPLVKSLSPAPPQDRLLAGPGPGSAGRPLPGVPWRHRNPCVLWPLAGSPPAAGQVIEPGATPRPPPGGSRARIRWTPSARRSPPMESTSPLRASA

SEQ ID NO: 110632 - protein, 86 aa, Triticum aestivum
  Clone ID: PAT_TA_5050.pep
MRPYFDPEYENFNQRINPPRVCIDNNTCRDCTLVKVDSMNKNGILLEVVQVLSDLDLTILKAYITSDGGWFMDVFHVLDKQGHKVT

SEQ ID NO: 110633 - protein, 153 aa, Triticum aestivum
  unsure (1)..(153): unsure at all Xaa locations
  Clone ID: PAT_TA_5051.pep
MGQAARVAARASLHRNPARISLCHGQGAASAGRQPGADLGIVEVDKGWARWAVLPGWAPVMAVADEAVVIELADGRVLPWRSAENERVLVVADRKRKEVVDEGIYVLXREGSVVVERGKKLLEEGISQAAAEVVTVVRPPKDEEDIIVGDEWD

SEQ ID NO: 110634 - protein, 412 aa, Triticum aestivum
  unsure (1)..(412): unsure at all Xaa locations
  Clone ID: PAT_TA_5052.pep
SAEKELTAELSELEKQRDELEAQLKKVNISLNAAVGRLKLTREERDQFDEANNQMIFSLKAKENELSKTIASCNVEAGVVKTWINFLEGAPRLQSSYDEQIEQKTNAELERCTSNFMKLTKYHLSTFKEVLSPSIERIHTYVDNLAFLNSRDDSTELEDEEVSEKTSPQKALEEEYLETEKKIVIAFSITDHMKKLFYSEQGYSSRRDDPEVRSLFSEIEKLREAFESIERPTLEIEIRRAKVPTKERIESSSSPVQAPSTPKAAPVGSPKSPVKSEQTLDLGAELAELELEFGXKSNRYSPEDISGWEFDELERGAASRHIQIERYEMTTCIYTGEMHTMGAPLWGTARIPEHPIVHSVVLLCPLLSFFFAGALLCPYCMRNANVLRLPLGALTSIVFVWSCQGHVCIQKQ

SEQ ID NO: 110635 - protein, 76 aa, Triticum aestivum
  Clone ID: PAT_TA_5053.pep
RESSARRRSSSPPSTSPSPCSSSSCWCTSRCGSLWSSSSPTGSSSPCSTGTPPSPTGAGAPPSAGPSAACCGCGAR

SEQ ID NO: 110636 - protein, 153 aa, Triticum aestivum
  unsure (1)..(153): unsure at all Xaa locations
  Clone ID: PAT_TA_5054.pep
MTATAAASLSLHLRLRPPPHAHRSPLRHAPFLLSPSPSTPWPPHHLHVANGRLPPPCRPSVKARVGTIEAPSLARLGGAVETDRLPADVRDRAMDAVDHLGGRVTIGDVASRAGLQIDQAERALQALAADTXXFLGGFGEGEVLFXFPEDYXG

SEQ ID NO: 110637 - protein, 101 aa, Triticum aestivum
  Clone ID: PAT_TA_5055.pep
DGATDFKAVGSLPATIYDIKLNVVLHKRHDEENPAITVEYRVKNTVYSDNVTGPHQCCTEGDFRYDQGVEKHLESSPDGCVEAYLPFGASFTNHCICDTDL

SEQ ID NO: 110638 - protein, 87 aa, Triticum aestivum
  Clone ID: PAT_TA_5056.pep
NSARGHMLKVLDYRNIKELPHIYLLKRWRRTAKSTDEDSQGHAANDNRSSLNVSVPSANHHGLQSINARIQDTSLSNMHENPFHRSS

SEQ ID NO: 110639 - protein, 188 aa, Triticum aestivum
  unsure (1)..(188): unsure at all Xaa locations
  Clone ID: PAT_TA_5057.pep
EFAARSASADRAAPPPCPGRPPAPGRPPAPXPPPCAPPPPPPPAPPPPPPPPXPPPLPPPRPXPPGPRRRRVPGLAALPPPPPPPPPPPPPARVPPAXPPDNYPPPPKGLKEGKASNALPTVSFPPAASSPSPSASSAAVPARGGPRARARPAPRRPRACVGPGPDRAAVCRAHRAPMRSVKRGPGLE

SEQ ID NO: 110640 - protein, 119 aa, Triticum aestivum
  Clone ID: PAT_TA_5058.pep
MAKTCFKTEHPLERRQAESARIREKYADRIPVIVEKADKSDVPEIDKKKYLVPADLTVGQFVYVVRKRIKLSPEKAIFVFVNSTLPPTASLMSAIYEENKDEDGFLYMTYSGENTFGSA

SEQ ID NO: 110641 - protein, 111 aa, Triticum aestivum
  Clone ID: PAT_TA_5059.pep
RGFGSISLVVSLRCRARYVGEFGSSPATGRTERGAGLYHRPTDLRLATVACNVSAVVDGRFLQSPVVTTEPYATPILVVSPSLYLPSDCSGRCVTFWTAAMVNWPLWNWMV

SEQ ID NO: 110642 - protein, 423 aa, Triticum aestivum
  unsure (1)..(423): unsure at all Xaa locations
  Clone ID: PAT_TA_5060.pep
MASRILLPALLLLLCSHCGEAARKARGGESSSQVKFDFSPFLIEYKSGVVKRLMGTDRVSAAADPLTGXVTSRDVTIDPAAGVDARIYLPSFRASTKVPVLVYFHGGAFVVESAFNPIYHAYLNTLAAKAGVVAVSVNYRLAPEHPLPAAYDDSWAALKWVLANAAAGTDQWLSQYGDLSRLFLAGDSAGGNIAHNLALRAGRRAWRAGRGRRGGAPGRGAARAGARGAARGGRRRGGRGGRAAGGSSARARPRGPARPRPPVRRPTGSGERLGASRRLLPGAGHGAAAGAAGRVVPRLPQHAAARPRGGARGPRRGPRGAPRRRGHAAGAGRDGDPRRLHQPRRLVARRRPRRRPHRRAPRRRGHATNGHRRRDGRWFGADFSGGPPRLQLGVRSGVLPRPRQRGEGGRDVLLPRPIRRSAS

SEQ ID NO: 110643 - protein, 258 aa, Triticum aestivum
  Clone ID: PAT_TA_5061.pep
TLVHLNVIGSTVDPLERDLEELQSKISAEIESGLSLGFELKVLNELKDSLVTLGWMLTALSFCCRIPLLQAIDRAIEEAVHLPASLSSCPLATLLMSGLSWLRKALVLLPGSENSVKYRLEDVENVLAEHQEIAVPYSMMTAKLEDAINKHKSCTEQCNAFFTSRDHQSWTELLRLRDSGRSVALDCCEMDRVVLDIKKIDGWFNQCRCTLSPDVTHLRSRLSIRPYRGVHWAILLCGMLFTVFLKATTSEPNYPLFL

SEQ ID NO: 110644 - protein, 385 aa, Triticum aestivum
  unsure (1)..(385): unsure at all Xaa locations
  Clone ID: PAT_TA_5062.pep
MAASVEPRQSSFGRLDAPATAPPARNGASNGGIRRRADSPVRGCGFPPLISPPRKALVEEEEHDDEDEEPEEDWREAYGSQLQLEVEPSTRDPRDEGTADAWIDRNPSLIRLTGKHPLNCEPPLARLMHHGFITPAPLHYVRNHGAVPRGDWATWTVEVTGLVRRPARLTMDELSSARPAAELPATLVCAGNRRKEQNMVQQTVGFNWGAAGVSTSVWRGARLRDVLLRCGIMSPKKGQALNVCFEGAEDLPGGGGSKYGTSVTREWALDPSRDILLAYAQNGDPLLPDHGFPVRVLIPGCIGGRMVKWLRRIVVTPAESDNYYHFKDNRVLPSHVDAELANAEAWWYRPEYIINELNTNSVITTPGHDEILPINAFXTQRAYTM

SEQ ID NO: 110645 - protein, 128 aa, Triticum aestivum
  Clone ID: PAT_TA_5063.pep
FRFVYCNDIVPRVPYDDSTLLFKHFGTCLYCVRLDAGQQVTAEEPNKNYFSVLAVAPKLVNAWGELARSFLIGYAEGPEYTEGWLMRLARVAALVMPGLPPHAPQDYVNATRLGAASLGPLELAEQPL

SEQ ID NO: 110646 - protein, 132 aa, Triticum aestivum
  unsure (1)..(132): unsure at all Xaa locations
  Clone ID: PAT_TA_5064.pep
GAMVPESSXGLYVRTAIGLKTNGLMKMSNPGNADIISEMLTLGASTNPPYNFPMQSETVLKQHHDGLKTKAPPFMNSATRVEGHRFPYTYARRKPHRAVDLVDPVETPTMVGSETASGLASMANVKAKGIKL

SEQ ID NO: 110647 - protein, 73 aa, Triticum aestivum
  Clone ID: PAT_TA_5065.pep
TRPDRSHYYSSEKIIEFINPSSYSSPFLPYYCFGEPVCQSVRQQLDIVAWVACMRVKKEREPARQLKLAIEIL

SEQ ID NO: 110648 - protein, 486 aa, Triticum aestivum
  Clone ID: PAT_TA_5066.pep
MSLSTLNHPAAAAAAGRGRSFSPAAPAPSTVRLPRRQAPAPAAASALAVEADAAADRVSALSQVSGVLGSQWGDEGKGKLVDVLAPRFDIVARCQGGANAGHTIYNSEGKKFALHLVPSGILHEGTLCVVGNGAVIHVPGFFGEIDGLQSNGVSCDGRILVSDRAHLLFDLHQTVDGLREAELANSFIGTTKRGIGPCYSSKVTRNGLRVCDLRHMDTFGDKLDVLFEDAAARFEGFKYSKGMLKEEVERYKRFAERLEPFIADTVHVLNESIRQKKKILVEGGQATMLDIDFGTYPFVTSSSPSAGGICTGLGIAPRVIGDLIGVVKAYTTRVGSGPFPTELLGEEGDVLRKAGMEFGTTTGRPRRCGWLDIVALKYCCDINGFSSLNLTKLDVLSGLPEIKLGVSYNQMDGEKLQSFPGDLDTLEQVQVNYEVLPGWDSDISSVRSYSELPQAARRYVERIEELAGVPVHYIGVGPGRDALIYK

SEQ ID NO: 110649 - protein, 117 aa, Triticum aestivum
  Clone ID: PAT_TA_5067.pep
ANVTRGRGATERAAKAAAEARKTAVARGVNLRNGPAASVSDINQILNLINSAASASAASSGNAQATESEVPQSNGPALNGAKESKDTSRPSAKADGQAPVGLGASLELKKQKSKQKA

SEQ ID NO: 110650 - protein, 769 aa, Triticum aestivum
  Clone ID: PAT_TA_5068.pep
LGEAAGRLQLLPHVGVVGSAEPVVRAATLVGKGILGRGPGHYIAPPMRVTPRDSNYIGLQHRFCVLRPDLVASFVEGECIKKSPTQKVPDVPTESNGQESDDIASGSDATAVSAEEHDKSDETPVSTPAESNDSTAEILFNPNVFTEYKLAGSPEEIEADEALVKKVGSYLLDTVIPKFVQDLCSLDVSPMDGQTLTDVLHSNGINVRYLGKVAGLIKHLPHLWDLFSAEIIVRSAKHVVKDILRQSPDHNIAPAVAHFLNCFFGKVLAASTKGSTGSPQSKTQKKSSQSASSKKGQSAFSQLTSDGVWSDIKEFAKHKYQFEAPDDVRVGAKRVAVLRNLCQKVGITIAARKYDLHSTTPFQPSDILNLQPVVKHSVPTCTDARKLMEAGKIRMAEGTLNEAYALFSEAFSLLQQINGPMHKDAANCCRYLAMVLYHAGDTAGAIVQQHRELIINERCLGLDHPDTAHSYGNMALFYHGLNQTELALRHMSRTLLLLSLASGPDHPDVAATLINVAMMYQDASNMSTALRYLQEALKKNERLLGPGHIQTAVCYHALAIAFSCMGAYKLSVQHETKTHDILVKQLGSDDSRTKDSENWLNTFKGREQQVIAQKQKGQGTVPSANAVEFLKAHPGLFQAMKAAAIQSGGDGPANVNRGRGGDERAAKAAAEARKTAVARGVNLRNGPAASVSDINQILNLINSAASASAASSGNAQATESEVPQSNGPALNGAKESKDTSRPSAKADGQAPVGLGASLELKKQKSKQKA

SEQ ID NO: 110651 - protein, 400 aa, Triticum aestivum
  Clone ID: PAT_TA_5069.pep
SLLTSIATTGKAPYSSVITHGFVLDKDGLKMSKSVGNVVDPEKVILGGKDSKKEPPYGADVLRLWVSSVDYTGDVLIGSEILRQMSDMYRKLRGTMRFLLANLHDWNPENSVPYSDLPKIDQYALFQLENVVASMKDGYDNYQFYKIYQITCRFAIVGLSNFHCVLAKDRLYVGGRVSCTRKSCQTVLAAHLLYLVRAIAPIMPHLAEDIWQNLPFQHTLDGGSVAKFAFDLKWPDKNEEWCSVQKDDVDFLGVILELRSEVNKILESARTGKLIGASLDAKVYLHAENPDTVSKLKELASATNDADALHRLFITSQVEILPSLSEETTSGVSYAGKFSDPRTGEIWIGVTRADGVKCERCWVYTKDVGSFVDHPTLCSRCHGVIDLQPQASPAAAAAVA

SEQ ID NO: 110652 - protein, 188 aa, Triticum aestivum
  Clone ID: PAT_TA_5070.pep
MLTATKSLVGGACAAPSPARRRTFVVPEARRKPGNGRRTSVSKVGSTSTTTTTTTTLSTDSNGTAVGTVARPDAHVRDRTQTTEMKATVTVHMSKAAGVRDFLYDLILKTWLHVDLVSSELDPQTGQEWEPISGAVKHSGRVDVEWHAKRILIGRQQNSHRFWEAPRQRSSHDPRVNLRGAPRDWGGI

SEQ ID NO: 110653 - protein, 191 aa, Triticum aestivum
  Clone ID: PAT_TA_5071.pep
PPVPPRYSAREKTLSHEPHPHPRSSSSPPLSPRRRRHPRRPVPASSGRAQHTPKLRPSIPPSRSAPQGLHPCPPLGFQAPLVFLPESTTIGDGEAGACGIRLRCCPGHHGAETTMMARGHKPCPDRGGGGGGGAHLDASPALLEEEGWEGSAPRATKRSCPSSSMAMMTHHSSDDILVIYSSNCVVGALPS

SEQ ID NO: 110654 - protein, 146 aa, Triticum aestivum
  unsure (1)..(146): unsure at all Xaa locations
  Clone ID: PAT_TA_5072.pep
EVPMPASPASPNGPRETQPRDYQLPLPSTLTMPCPWPSTQICPIEQRSPNHHHRTLHPQGEGPHRPRAPPAPSPPSPTQSESSXLGPQSSPPEHEPHVVAISATRTTRAADPSPGEGRSHHHPHPTDARQPPPRPHQRPVQSPTGR

SEQ ID NO: 110655 - protein, 183 aa, Triticum aestivum
  Clone ID: PAT_TA_5073.pep
GGLIVQQYMSCLQGSEPLHPKLSGAVLVCSVPPSGNSGLVWRYLLTKPIAAIKVTLSLAAKAYANSLPLCKETFFSSQMDDELVLRYQNLMKESSKLPLFDLRKLNASLPVPSATDGTLEILVMGASNDFIVDAEGLSETARFYNVQPVCVEGVAHDMMLDCSWEKGAAIILSWLDKLAPRSA

SEQ ID NO: 110656 - protein, 101 aa, Triticum aestivum
  Clone ID: PAT_TA_5074.pep
VAWLASEATGRPVAFARAAGDGVFNAVVWDVVVEPSCQGLGLGRAVMERLVAELRRKGVGNIVLYAEPRVVGFYRPLGFAMDPDGIRGMAYYRSKQNQKQQ

SEQ ID NO: 110657 - protein, 174 aa, Triticum aestivum
  unsure (1)..(174): unsure at all Xaa locations
  Clone ID: PAT_TA_5075.pep
SRCAVLPHPAGVAPRRRQHLPAQAFWGTERRRRRRLVSFEAPPRCHKMYVPGFGRGLTXEKKAAISLLNFFNYLAVRIVLAQLESYNREAYVELKEFTTRNSVNDADSFCKNLIRESPRHKALAMRILEVRSAYMKNDFEWDNLKKLSFKMVDEGNIKLMRDYVLETSHIEDDE

SEQ ID NO: 110658 - protein, 138 aa, Triticum aestivum
  Clone ID: PAT_TA_5076.pep
MKFTLHFWVLFCCLYALSKNIYARPDTVSVGALFTFNSTIGRAAKIAISAAVNEINTDSSILPGTNLVVEMQDSNCSGFVGIVQALQFMEKDTVAIIGPQSSVIAHVISHVANELQVPMLSFGATDPTLTSLQFPFLV

SEQ ID NO: 110659 - protein, 251 aa, Triticum aestivum
  Clone ID: PAT_TA_5077.pep
MTKDEDFKLVKIQTHVLRVNIHCDGCKHKVKKLLQRIEGVYSVAIDVDNHKVTVTGSVDSETLIRKLTRGGKHAELWSHQKGGNGGNNNNQGHKGGGGGGNNNQQKQQQQQQQQKQAANVSKDGGGKGNGGQKEQGKLGGGGVGSLMQGLKAFKSQHSKHQLPELSSDDDDDDMYDDEDDEEDDEFDDEYEDDLRFLGDKMSQLGILRQRAEAAAAINAKNKNAANVGGKKGAPAGNNHHQSNQNQKMNMG

SEQ ID NO: 110660 - protein, 84 aa, Triticum aestivum
  unsure (1)..(84): unsure at all Xaa locations
  Clone ID: PAT_TA_5078.pep
MASRPSLKRKRRAKGKGGXRGSSAAEDEQSTAAVAVQLAKEWSTWTMKTAKVVAHWGFIPLIIVVGMTKGDEPKPSLFQLLSPV

SEQ ID NO: 110661 - protein, 128 aa, Triticum aestivum
  unsure (1)..(128): unsure at all Xaa locations
  Clone ID: PAT_TA_5079.pep
MEERLYDAGDGSAGNPSAEDAAGNPRGEDVAANSRGDDDFRSCCGDEEEWEGTEESFTAGVSEAELDETSVRLFFKGVSSSDADGKKLSGIGVVMERTPGVPLHRVQKKLDFYVDELVAXHLALMDGL

SEQ ID NO: 110662 - protein, 105 aa, Triticum aestivum
  Clone ID: PAT_TA_5080.pep
CEEVSNTNCILLIYYSLGTDFSIQHQQQDTLSLPPSSWPSGVVRRLAHAWSGAPDSAASAFFRWPASSFCQSNDFPFPTMESHPKNHVPVSSPAPATRPHLISTK

SEQ ID NO: 110663 - protein, 576 aa, Triticum aestivum
  unsure (1)..(576): unsure at all Xaa locations
  Clone ID: PAT_TA_5081.pep
MLLLRGLLLAALLAVARQPLASASESDHKYKXTNHVKLWVNKVGPYNNPQETYNYYSLPFCQPCXNPAHKWGGLGEVLGGXNELIDSQIDIQFPFFVDXRFSLQNLFLTLKIFYHSFAAIPFGTMFVIFVLWAFISFPLGLSGTVDGSNCCRAPHKTIGVKSIPRPIIEVNLTQEPSVLPVMGGLLPFGSIFIEMYFVFTSFWNYKVYYVYGFMLLVFVILLIVTVCVTIVGTYFLLNAENYHWQWTSFFSAASTALYVYLYAIYYYHVKTRMSGLVQTSFYFGYTLMFSLILLLIVFAIESMHYVGAGTIILSFIVLLALTSFISVDVSGGLYSRNGGKNWIKSMVLTASLFPFLCFSIGLVLNTIAIFYHSLAAIPFGTMVVIFVLWAFISFPLVLLGTVVGRNWSGAPNNPCRVKTIPRPIPEKKWYLTPSVISLMGGLLPFGSIFIEMYFVFTSFWNYKVYYVYGFMLLVFVILLIVTVCVTIVGTYFLLNAENYHWQWTSFFSAASTALYVYLYAIYYYHVKTKMSGFFQTSFYFGYTLMFCLGLGILCGAIGYLGSTLFVRRIYRNIKCD

SEQ ID NO: 110664 - protein, 137 aa, Triticum aestivum
  Clone ID: PAT_TA_5082.pep
RRHLDACHGVRALKLQHQPRLPTPRRRPRSYAPTAPDTRAGDPFGPRHAGDHQEPRHLLASACDGGPRVWEPATAASSSVSSGVGGGGGLRRGCGRRLAAGGGGALEMEMRLGVFFFFLSLVTVWVDLGLRVDSYKL

SEQ ID NO: 110665 - protein, 173 aa, Triticum aestivum
  Clone ID: PAT_TA_5083.pep
RHELMRFHTMKMEEINKIIKELWQQTYRGQDIDCISINSDSEGAGTRSYSYRVVMQNGGAELEMRGRCSAGQKVLASLIIRLALAETFCLNCGILALDEPTTNLDGPNAESLAAALLRIMESRKGQENFQLIIITHDERFAQLIGQRQLAEKYYRISKDEQQHSKIEAQEIFD

SEQ ID NO: 110666 - protein, 192 aa, Triticum aestivum
  unsure (1)..(192): unsure at all Xaa locations
  Clone ID: PAT_TA_5084.pep
PRTPEGERSTRPAPTPPTPSTAAPSTAPSPPXGQVPAAAAAWPRGARAGPERAATEREGRGSRRSTRTAPTPTTPSTAAPDYCPVAAPAVKSPPLPPGPGGQNGKTHSDGELQPGPPPRQGRRLPRRLPSKSPALSSDGKGFPVPNAPTLQVSQTMLPNIKVPPRGNPNPSASAPLSRNELIREKGPIRPLK

SEQ ID NO: 110667 - protein, 101 aa, Triticum aestivum
  unsure (1)..(101): unsure at all Xaa locations
  Clone ID: PAT_TA_5085.pep
ADDIYGAGLLIAYMAFIPFCEXGIMDSISLQRLLENTFRLDIYAARHECLEDDKLSEAVNFLDLGDGAGWELLQAMLNPDYRKRPIAEAVLNHRFITGALL

SEQ ID NO: 110668 - protein, 83 aa, Triticum aestivum
  Clone ID: PAT_TA_5086.pep
TNQFYNKALPKFEIITIQYPVLRPLVAIHRAEPPSAGQNLDLPPARTLSSIPSTRTPSPASAPRAPAPSTSSSPPPSTSPTRP

SEQ ID NO: 110669 - protein, 167 aa, Triticum aestivum
  Clone ID: PAT_TA_5087.pep
DAARAKREETKTKSQHQKQQDIYNPRSVLGYFKPTPSLLIPSLESSGSALSPRPVLCLGLPASSSRGTSHPRWRGSGSGLASGPVLALPLRHRKSKPCAFPSVDGTVCALPVDRPHLHLKRIGMATFFSTSHDQEGLRRRWRRRRRHVIPPPLPHVQPNTQTRRPAA

SEQ ID NO: 110670 - protein, 163 aa, Triticum aestivum
  unsure (1)..(163): unsure at all Xaa locations
  Clone ID: PAT_TA_5088.pep
TKTDDTIHERATSATRPYRLSQHTKLPKKRLDKTPTTPTPNTPEQPRPPRQTTNSTTTKTREQHHTPPAISTKILTQXPSKIQPKMQTPNDTQTDPHSKHKQXQPNNPKTKQTPTQPPKPKKTKQQQQQQTPPSLHTQQKQPQKNQNNHKNKTEAKKNPAKLK

SEQ ID NO: 110671 - protein, 182 aa, Triticum aestivum
  Clone ID: PAT_TA_5089.pep
MAAAALQCCPLLSSPPASSVLPPPPVRTPAVSRTGEARTRRLQRCRCSQSAEGRSPGSSPPQLERLFSNVNQATMKHEPGSITGSVFLVAGTTVGAGILAIPAVTQEAGFLASAGTCVFCWAYMVVTGLLVAEVNVNTMCELGSGSVSLVSMAKRTLGTAGVRTPIFSYLFIHYALLVAYVA

SEQ ID NO: 110672 - protein, 127 aa, Triticum aestivum
  Clone ID: PAT_TA_5090.pep
FLAIGTSYIGFVLGLSDFIADLLKLPSGQNKPLPYLVTLLPPLVLSLLDPEIFFKALDFAGTYGVLVLFGVFPAAMSWSERYSNDLEAPISPIVPGGKLTLSFVMGGALLVIFSEIFKDIMQLQGLH

SEQ ID NO: 110673 - protein, 278 aa, Triticum aestivum
  unsure (1)..(278): unsure at all Xaa locations
  Clone ID: PAT_TA_5091.pep
MMFSSQVDAFSPSQFTASQNAAADSTPNKFRGASGTMPLTVKQIADAQLAGTGEKGAPFVVDGVETANVRLVGMVSGKAERNTDVSFTLDDGTGRIDFIRWVNDAADSAETAAIQNGMFVAVIRSLKGVQDKKRATAFAVRPITDYNEVTLHFIQCVRMHIENTKSLXSSPGRKRLAEQTPRSNRLSEAATPPSANPHPAPVTSGTNGSATDFYTQVLNVFREPANIESDHGVHVDDIAKXGLKLPALKIKEAIDYHVDVGHIYSTIDDFHYKSAFVD

SEQ ID NO: 110674 - protein, 252 aa, Triticum aestivum
  Clone ID: PAT_TA_5092.pep
MATTASPSTTTTPRSFLSSPSFSLRASKSNHLRTTRRLPVNVRCASSSPAADTSYTTKVSRNANIAKLQAGYLFPEIARRRAAHLLKHPDAKIISLGIGDTTEPIPEVITNAMAERAHALSTVDGYSGYGAEQGEKKLRAAIAATYYADLGIDETDIFVSDGAKCDISRLQVLFGSKVKIAVQDPSYPAYVDSSVIMGQTDLYLPDVLPLGDSPPLACWPENGFFPDLSKVPRTDIIFFCSPNNPTGAAASR

SEQ ID NO: 110675 - protein, 285 aa, Triticum aestivum
  unsure (1)..(285): unsure at all Xaa locations
  Clone ID: PAT_TA_5093.pep
TRNFCILSAANHIMRGETDLMLCGGSDAPIIPIGLGGFVACRALSQRNSDPTKASRPWDMDRDGFVMGEGAGVLLLEELEGGTQXEAKQRGADREAALRGGSFTCDAYHMTEPHPEGKGVILCVENALADAGLTRXNAHATSTQLGDFKEFEALGRCFGQNPQLRVNSTKSMTGHLLGAAGGIEAVAAIQAIRTRFGSIPNINLDNPXEKNVDVKLAGGIQQRERCDVKVALSKSLGXIGGHNSSILIAPFGAMFGVRADDTVVSGTWNFDKAQPDSYISRATNM

SEQ ID NO: 110676 - protein, 93 aa, Triticum aestivum
  Clone ID: PAT_TA_5094.pep
MADAKQQQPPQTALAASGVWKTVKPFVNGGASGMLATCVIQPIDMVKVKIQLGEGSATSVTKKMLANEGVGSFYKGLSAGLLRQATYTTARLG

SEQ ID NO: 110677 - protein, 306 aa, Triticum aestivum
  Clone ID: PAT_TA_5095.pep
MADAKQQQPPQTALAASGVWKTVKPFVNGGASGMLATCVIQPIDMVKVKIQLGEGSATSVTKKMLANEGVGSFYKGLSAGLLRQATYTTARLGSFRVLTNKAVEANEGKPLPLVQKAAIGLTAGAIGACFGSPADLALIRMQADSTLPAAQRRHYKNAFHALYRIIADEGVLALWKGAGPTVARAMSLNMGMLASYDQSVEVLRDKLGAGELSTMLGASAVSGFFASACSLPFDYVKTQVQKMQPDATGKYPYTGSLDCAMKTLKSGGPFKFYTGFPVYCVRIAPHVMMTWIFLNQIQKVEKRVGL

SEQ ID NO: 110678 - protein, 209 aa, Triticum aestivum
  Clone ID: PAT_TA_5096.pep
SIGDSCSSCWAFTSVATMESAHAISTGGSPPVLSEQQLVDCRINGCGNSWMDKAFEWVIQNGGITTEAAYPYTGKVGTCQRAKPVAVKLRGYKKISPPGDEAALMAAVAQQPVAASFDYSDPCFQHYIRGVYNAGCSRSGVYNKGACGTTQNHALAIVGYGTKPDGTKYWIGKNSWTDQWGDKGFVYFLRDSPPLGLCGIAKYPLYPII

SEQ ID NO: 110679 - protein, 171 aa, Triticum aestivum
  Clone ID: PAT_TA_5097.pep
IAAKVDEYARGMISGSGSSLFEELGLYYIGPVDGHNIDDLITILREVKGTKTTGPVLIHVITEKGRGYPYAERASDKYHGVAKFDPATGKQFKVPAKTLSYTNYFAEALIAEAGQDSKIVAIHPAMGGGTGLNYFLRRFPNRCFHVGIAEQHAATFPPRLACEGLKPFCAI

SEQ ID NO: 110680 - protein, 432 aa, Triticum aestivum
  Clone ID: PAT_TA_5098.pep
HPNLWWFRDLAWVDGVLKFIEMENLAPESQSDKGDVIYDSDLIMSLERKAVDWHCKQLSIGGAWRAVTWTRTVSSNCWRQTCAANVADILVVDGSAHSSLSPGLKGEKLTFRDLYSAFPILSPDGDDILYLKSMVEPSNKDGCVAAVDLRNKAVKAVGKYYLPDDFYYHFRYDPEHPFRVCTLSRHLDMTPGIEVTACRKITGDASSSSNFPRNTARGVSELNSCEPRSKIQRPLELAQKNKRARNAAGIIMQNDHISKLDDKVLELERELEQKKEQKPQQQCFKKWDAASYPPGHSLWPQNNLPVRQYFSKPPPSFAPLHGRHNYQALWQQPPPSKQQFTYNSEFEPHEAPLPSFNNCSGAGYHWYSQQFSAPNSFDYGAHTGYGNYQHQWEQLPSTLELPIASWQHPPPPLHCDPTPSEGTSSLLPLGDA

SEQ ID NO: 110681 - protein, 171 aa, Triticum aestivum
  Clone ID: PAT_TA_5099.pep
NSAREMVGGVLAAGVRRSLRKRIQNVKVSTVGVGAMGYIGNKGSIAVSMSIYQTHFCFLCCHLTSGEKDGDEQKRNADVQEIHRRTVFNSRVSTPKTIYDHERIFWLGDLNYRINLSYEKTHEFISTHDWNGLFEKDQLRVELRKGRLFDGWSEGVISFPPTYKYLPGRPL

SEQ ID NO: 110682 - protein, 168 aa, Triticum aestivum
  Clone ID: PAT_TA_5100.pep
RSLCVRRLISADLKTWYEFPLCPACSLSVTFAPRSRRRLPVRLRARPALLLVAPGGLGALPCGLVLRVMSPRLRWLRLGPLCAPLPGLPLGVFLPLAIGGPAGLRRRVIGGPLPVWGLPLLLGLAVATCRCRATSAVSGPPPFVPPLSIGARPAAVPRPAVGRRLLSF

SEQ ID NO: 110683 - protein, 178 aa, Triticum aestivum
  unsure (1)..(178): unsure at all Xaa locations
  Clone ID: PAT_TA_5101.pep
MASAGGSLLVLPAVLHLRRSDADFTAALRERFRVLDFFASGQPRPAFLAAAAAAPEPPRAAVVVGGGSVRVDASFLDAVPSLRCVLTTGAGVDHIDLAECARRGVAVANSGEVFSTDVADYAVGLLLDVLRRVSAAERYVRRGSWAAQGDYPSGFKXGGKPFWIIGLGKXGSXCKEGF

SEQ ID NO: 110684 - protein, 128 aa, Triticum aestivum
  Clone ID: PAT_TA_5102.pep
AVVDNYIVCPLLPRRCLRAFPCRLTSHHQQQCIDLWRARPKHCSRPRGAQGQAYTSSGDDGGGGEGAPQGHRVAAGPGQARLGCRGRRRRRRRVEVWWTRTPWPPSPLPLYHFRISLYLHPCLSATSE

SEQ ID NO: 110685 - protein, 228 aa, Triticum aestivum
  unsure (1)..(228): unsure at all Xaa locations
  Clone ID: PAT_TA_5103.pep
PTHPPPWGAGICRAPEVEPKVTPKEDLPPPPPPPPAKKEXQRWSKKASLKKXXVLTKNELLARRAEQEQDEQPAFVQKVMDMRGPQARVLTDLKGLSAEQEMEANDVPMPEWQYDVRLLVDETEADIVRLDGQLRREQEKVASLVREKEKVAKQEALQKRQLQVMETIADVLEKVRVDDTAGLLTLGGLLKTFQELKVRYEEEFKICSVAWVACRFAHPLLIRVFQGW

SEQ ID NO: 110686 - protein, 183 aa, Triticum aestivum
  Clone ID: PAT_TA_5104.pep
MGAGGEIGLGLCPAGGRQKKRGRYPGGLLLAYDALSTKLGDQSFFFDDSPTDVDALLLGHVLFVLNALPASSMLRSYLQNYDNLVKYAEDIKVQLVEVGSSSAGSASSDMPSSSTPRKTSSSGQSYKPKPKAKKERTEEEKKSRRRTKYFLAAQLISVLAFLSIMGGVDSSELDDDYDMEYED

SEQ ID NO: 110687 - protein, 318 aa, Triticum aestivum
  Clone ID: PAT_TA_5105.pep
RLSPIPNPNRGSMDPNPDSKSRMDDGPSWSLSSQASSATSSRPVDGGPAAPARKRKPGTWRRLPRTLPLEVELRMKLGFITHEELRRQHLARAEELERMDDSGCDSEEAKVAFRDFKKEHVRWYRKLAEGWPENIVINYDPKPSDTEEEYLTAEDMEARFAHRDPTSLHLEQLKHFANLALAHYNARKTEHKFDISQALTSNCFSEACGTTYAHVNFTAKPQKSDDPTKRLFFAELMLIPKLQLQEDAEPMRVLHVSIIDDAPCFGGCHEIYRNINHRMRGAMDYERCHACHDILKHPKGDMFIGGHDSTRMPYISAT

SEQ ID NO: 110688 - protein, 215 aa, Triticum aestivum
  Clone ID: PAT_TA_5106.pep
EFGTRLGGHMRRHRPLHAPADRAIATTAVTAIAASTTKKEKDSTPAGINLELDLNLPAPSDEECVSHPPPPPPPSSAPPVVLGLGPFDSGKKRLMLTAASAALGGLPLLIHRHVACSWPGLTNSLLFLTPIDCPIILLLLLPLPPSYTKLHTYKFAPFGTYQRKLVTYIAFFRSFGRKVGLVPFSAPRVHMHVGLSLGLYGALEAISRSTVRTSE

SEQ ID NO: 110689 - protein, 189 aa, Triticum aestivum
  Clone ID: PAT_TA_5107.pep
MGKIKMPALFRRRSSSKSRSASPPPTPQEEEGTRPASGAGSPARSAEEEMERVFRKFDANGDGRISRPELAALFESLGHAATEDELTRMMAEADADGDGFISLEEFAALNATAAGDDEEDLRLAFKVFDADGSGDISAAELASVLHGLGEKATVQQCRRMIEGVDKNGDGLISFDEFKVMMASGLAKMA

SEQ ID NO: 110690 - protein, 191 aa, Triticum aestivum
  Clone ID: PAT_TA_5108.pep
MGKIKMPALFRRRSSSKSRSASPPPPQDEQQEGTRPASGAGSPARSAEEEMERVFRKFDANGDGRISRPELAALFDSLGHAATEDELTRMMAEADADGDGFISLEEFAALNATAPGDDEEDLRLAFKVFDADGSGDISAAELARVLHGLGEKATVQQCRRMIEGVDKNGDGLISFDEFKVMMASGLAAKMA

SEQ ID NO: 110691 - protein, 181 aa, Triticum aestivum
  Clone ID: PAT_TA_5109.pep
MGKMKMPALFRRRSSSKSRSASRRRAGRPSGSPARSAEEEMERVFRKFDANGDGRISRPELAALFESLGHAATEDELTRMMAEADADGDGFISLEEFAALNATAPGDDEEDLRLAFKVFDADGSGDISAAELARVLHGLGEKATVQQCRRMIEGVDKNGDGLISFDEFKVMMAAGFAAKMA

SEQ ID NO: 110692 - protein, 197 aa, Triticum aestivum
  Clone ID: PAT_TA_5110.pep
MARGYAGRIQAFSKAALLGLVLLSMVTWVPHACSCLRAFLFVSLPSAASAIATPKCLFIFSNIIVLFLATECRLSRNGARSTSTNEDDIDAVVRELVAFTHAIKETHAAQEIVKAEQEVSVRMTTQQLDQCEKEEESDVALVNNNVGDDLQEEVMKEEDCEEATELPTEELNRRVEDFIARFNMERQLEARMVVCCC

SEQ ID NO: 110693 - protein, 234 aa, Triticum aestivum
  Clone ID: PAT_TA_5111.pep
NSARAFFSYAFELGQVVSTGEYKALRCVSVNSWSHGSEPMISEVITLGGGGGDRHARWRERPCPPCPVTSASKKSVVVNGVVYFLLDFGSHRFTYSGDRVEPCSVACFDLETEEWMGTLRRPIQVRSFVESFNGMCSYSDLYCKLSLVNMNGFLVMVQDPLAYPLDLPLDLWFLIDIEKCLWDRKYSIAFQYENLFAQSLLILEDGRIAIGASNLLRIYDPVSESYTEFQMAGS

SEQ ID NO: 110694 - protein, 110 aa, Triticum aestivum
  Clone ID: PAT_TA_5112.pep
LPPFYSSLVLFDRVFLNEKGHCPMVGSDLSPLQHFGINRQHLVCMRSDCLLLFLQAKRCATCGCYFIPEADQHCEECMWHLYWLSEDPYSEYHKSRMPLSLSVTPLFPEK

SEQ ID NO: 110695 - protein, 50 aa, Triticum aestivum
  Clone ID: PAT_TA_5113.pep
KPQPVRPGMFLETVSKVLGGIYAKNTSGITAQHLEWVHQTTLKVLQEMAF

SEQ ID NO: 110696 - protein, 240 aa, Triticum aestivum
  unsure (1)..(240): unsure at all Xaa locations
  Clone ID: PAT_TA_5114.pep
CSAACLRLPGTKSLSCTRCTLPHLHPKLTLSPPMSILMLTLILTCRKSAPGAHTLFPLSWMGFLVGPRLXIEMLFDNKMRTVVRDGKDPCVAAIEQMGRNLDSALQGVKWNQQICFEKLDARAISQSLLLEDLHKASKQVNFVEAALSEAGRRMFHKKVIWAKRSLLTLVPYASRYYFYCLSAYSLLMCDVPLRPVDYALIVVGAQWMASDEMRGKFLESYNYFKNGGKKVDAGDAGKKI

SEQ ID NO: 110697 - protein, 336 aa, Triticum aestivum
  Clone ID: PAT_TA_5115.pep
MGAGAGAAEEPSQTRRALVDTLAGAISGGISRTVTSPLDVIKIRFQVQLEPTAKWGVLRRDVYGPSKYTGLMQATKDILREEGLPGFWRGNVPALFMYMPYTAIQFTVLHKLKTFASGSSRTEDHLHLSPYLSYVSGAIAGSAATVGSYPFDLLRTILASQGEPKVYPNMRSALVDIVQTRGVRGLYAGLTPTLVEIIPYAGLQFGSYDTFKRSMMSWNRYRYGIEEDDSASSFQLFLCGFAAGTFSKAACHPLDVVKKRFQIEGLKRHPRYGARIESSTYKGMYHALTEIVVKEGFGGLYKGLFPSVVKSAPAGAVTFVAYEYISDWIGAKAGVE

SEQ ID NO: 110698 - protein, 77 aa, Triticum aestivum
  unsure (1)..(77): unsure at all Xaa locations
  Clone ID: PAT_TA_5116.pep
CRVLLEGTVLGALSSSSFNFTSSCVLPGRASMAPQCLPQVVRGGGVVRPLAPMYPALGECVGVLCCWWFRXGCGMGP

SEQ ID NO: 110699 - protein, 285 aa, Triticum aestivum
  unsure (1)..(285): unsure at all Xaa locations
  Clone ID: PAT_TA_5117.pep
ARRPERGRHVRSGGVLSRRAAVHYGVHRSRPLLRPPAPPPXGPPSPGHDTGGRRKKPSPGAHGCPRPPPGAAPSPSPPLRPPARSRCAQARPDGHNVTDTPPAPARASPRSAPPWLARPPAPSSPRAARAPSPPSTMPPCRGPRSGASRPDALARVALPARERTPSRPSPPEAKVPTPPGPAPAPAPKAPAPARSWPLHLLTAPGAWALSALPPSPKNHTAPPPKPAKEPVPSPTPVVETPAEGPGADGDQPPADEHKSGASDSEPWSLGAVVAVAVPVVVFLLW

SEQ ID NO: 110700 - protein, 202 aa, Triticum aestivum
  Clone ID: PAT_TA_5118.pep
GEISAAIRSVSRRLATAGAVHGAQGGTLAVAAPVRRPVITLPARGYSASSAGITSIAKETGQRLYKAVLRSTPFMASVTTYATVVSAVGYWVIETVEGGVNKKLVEQNNTLAVKLEAEKVKREGFQSIATHAHHESARRIDESMFDVRLQLNKLFLRWLEGHEVNLKRMKDMEQRIDALTREVDALKKSPSAKDDDTPIKRS

SEQ ID NO: 110701 - protein, 199 aa, Triticum aestivum
  unsure (1)..(199): unsure at all Xaa locations
  Clone ID: PAT_TA_5119.pep
MPPFHDCRDGGLLVLDPAAAMFGGVRQRKRARVTAVPPCVFAAAAAEEEALRAAPAAKRQRLREAPTLDALPDGCLFEILRRVQGARARGASSCVSRRWLALLGGIRASEIKRVQAPAVPDLNQRTLEGEGATDVALTAEADADGLRGSLESVVVRGSHPTRGXTDSGHFRVRXGCPSIRSLCPVGMCRKVTERRGSLK

SEQ ID NO: 110702 - protein, 116 aa, Triticum aestivum
  Clone ID: PAT_TA_5120.pep
MAGKLIANLIVMGSGIIGRAMLQAYRKALENANKTGVAHEAVNNIRRASKTMTEQEARQILGVTEQSTWEEIAQRYDKLFERNATSGSFYLQSKVHRAKECLENVYQKNKQDGTPT

SEQ ID NO: 110703 - protein, 90 aa, Triticum aestivum
  Clone ID: PAT_TA_5121.pep
QGCRGHRREPCPHYNSSTCCRPCGDLFRSSSYPRSHQGQHHAQRYQPDGYVAAASHWHDFIRLDVLLLLNPPISCVLARLRTGNLHVITL

SEQ ID NO: 110704 - protein, 374 aa, Triticum aestivum
  unsure (1)..(374): unsure at all Xaa locations
  Clone ID: PAT_TA_5122.pep
MSSLCPFAKATTGGVCPMKSDKKPDKSGGAACPVTGKSHGSENKESGADRAAEEEGAEDPRVVPAQCPFRYDSSTFKLGPLSCMVCQALLHDASKCLPCSHKFCKACISRFKDCPLCGADIEGIEPDAELQALVDRFIDGHARIKRSLAGEADEAAGGKSKVIYEVYRMERGAFLVQQAMRAXFRAQNIESAKSRLSMCAEDIREELKSSEDNLDLCSQLGAVLGMLGDCCRTLGDAPSAITYYEESAELLSKLPKKDLELVHTLSVSLNKVGDLRYYGGDLQSARSYYARSLDVRRNSVKEHSAVASQVIDLATSLAKVADVDRNLGNEDAAVEGFEEAIKCLEKLKLDSEQASLEQRRRSVLDFLQKQLHDK

SEQ ID NO: 110705 - protein, 274 aa, Triticum aestivum
  unsure (1)..(274): unsure at all Xaa locations
  Clone ID: PAT_TA_5123.pep
MSPGASCSGVPVPLRPAGTHTFLLPAAPPFVSKCTINRRDPRTASSCFGKAITPKRCFVVAGGLTWVDGVEEELMELQKTQEQSSGKLKKRPPLRRGKVYPQLPVPEHIPRPSYVGANIPQELPAVRQIHNAEGIAGMRAACKLAARVLDFAGTLVKPSVTTDEIDRAVHHMILEAGAYPSXPLGYGGFPKSICTSVNECVCHGLPDSTQLQNGDIINIDVNVFLNGYHGGTSRTFVCGEADESIKHFLKAAEECSEKGISVCRDGVNYRKIGK

SEQ ID NO: 110706 - protein, 128 aa, Triticum aestivum
  Clone ID: PAT_TA_5124.pep
LKFGVTKNLQMVLLIKPGTNIGRQLEEIFRVVPRAVPPPLLPANQTTTYTHLGILLETTSMVNCRATTSPHNGITSNANLQCNSMSPHLSPGRLLHKGEASHMWIWLLGLLYEPPRSESRWLNNFLLQ

SEQ ID NO: 110707 - protein, 117 aa, Triticum aestivum
  Clone ID: PAT_TA_5125.pep
PALLRPARFEYAPSSSKRSNLVPFRKPLPPFGRSTLAYRQAGRQEGTVLYSPGAAPAAGLFHLVSAQGGGGAGAPRPHCALLSPPSLSLFRHIFRPRLSPRRKEERRDTLVTCRSPS

SEQ ID NO: 110708 - protein, 188 aa, Triticum aestivum
  Clone ID: PAT_TA_5126.pep
HANTTGLPYPYVLCRNSINAVWKDSDMAVGPDAEKPAEAGVRKRAVGGDREGRIPRATAGRTPTTPARPTQEEREPRITEERVGGWSEEQEGLPFGTAGGAGHMAGASQREEGPELVEHLPANESLPPTPHRGDEEGQERLLVARGREGCGGRRPREKPAGEEAETRSQRRSPTTQAEVDKQIPPKPI

SEQ ID NO: 110709 - protein, 256 aa, Triticum aestivum
  unsure (1)..(256): unsure at all Xaa locations
  Clone ID: PAT_TA_5127.pep
AGRSWFTLERXIAIWSTRNRKXTMLAKAVATECKTTFFNISASSIVSKWRGDSEKLVKVLFELARHHAPSTIFLDEIDAIISQRGEARSEHEASRRLKTELLIQMDGLTKTDELVFVLAATNLPWELDAAMLRRLEKRILVPLPEAEARHAMFEEFLPSTPDTMEIPYDVLVESTEGYSGSDIRLVCKEAAMQPLRRLMAVLEGRQEEMPEDELPEVGPIAAEDIELALRNTRPSAHLHAHRYEQFNQDYGSHVIG

SEQ ID NO: 110710 - protein, 228 aa, Triticum aestivum
  Clone ID: PAT_TA_5128.pep
PSLPVDGGRAARSVGLVGFRRREEMEAGNDGPSTPVLLNVYDLTPVNDYLYWLGFGAARAGIEVHGMEYGFGAHDFSSSGVFEVESKCCPGFVYRKTVSLGTTDMSREDFRSFIERLAGKYHGNTYNLIAKNCNHFTDDVCRSLTGKPIPGWVNRLARVGSVFDCLLPESVQVSPVGRVPTLRPVIDDDLDSVSSSDSDEGDDKHLLEAPSTDLQPVEVPLKLAKDLL

SEQ ID NO: 110711 - protein, 168 aa, Triticum aestivum
  Clone ID: PAT_TA_5129.pep
SARGRSRPSKGNPYVMFGDGKLCACKPISEEDLASFIADCIFDREKANKVLPIGGPGKALTPLEQGEMLFRLLGREPRFIRVPIQIMDGVIWVLDGLAKVFPGLEDAAEFGKIGRYYASESMLVLDPETGEYSDEKTPSYGKDTLEHFFEKVIREGMAGQELGEQTIF

SEQ ID NO: 110712 - protein, 133 aa, Triticum aestivum
  Clone ID: PAT_TA_5130.pep
TNPRSAALLTPPSFLVSHRCTIPLRSSLSARRATRRKPPQKRTGDARWRASGQEADGEHAINEPSGRSYWPILSRPPKTAGCAVMRGAAWEEMRICRRRRNPSSLAASSPNKCSRVGEEGVEQQLSLGECSVT

SEQ ID NO: 110713 - protein, 155 aa, Triticum aestivum
  unsure (1)..(155): unsure at all Xaa locations
  Clone ID: PAT_TA_5131.pep
VPVVNSTTLKXLNLSSNVLSGSLPATVGKCVSDAWGGNLLSGELAILRSWDGIVEVIDLSSNKLEGSYPNDAPQFQNLVTLKLRNNSLKGSVPSVLGTYQKLSFLDLSLNALGGPVLPVFILSPTLTVLNLSGNNFSGTIPFQSPYSTESIMLSS

SEQ ID NO: 110714 - protein, 270 aa, Triticum aestivum
  Clone ID: PAT_TA_5132.pep
HASGVGSYPTAQDYEDLPVHQIDDLLQEMDMAKSSIIDSCSRQSNLCCTESTSGSLGQTIYSRKTESEHGPQQLHPLDHVGSSDSFQRNDSERSLLKARQASRKILCAAETLCDMRRSTEGWSPQVYSNGTINLPKSPPDKVKARKPSSPFGTAESSSGSRNSDPARSGNHSTKKVVDRKNDSAACMSNPGKGLIRWPVPIEDAVSPVKPEKGLMLDMRQNHSNAARHPIHVSSQARLEKEYENQQKLRKATLASSLGSGDWNKERNRRL

SEQ ID NO: 110715 - protein, 114 aa, Triticum aestivum
  Clone ID: PAT_TA_5133.pep
KDCELDCKDLKLSTCKIKKAGIGGPLINFDGSFVGMNHFDGRMVTPFLPKSKIVQVLRQGVSVRRDDGPVHLRDASEGSRINRWPVPRPYWYHGLLDADRDDHLPAVSRGRVLQ

SEQ ID NO: 110716 - protein, 268 aa, Triticum aestivum
  unsure (1)..(268): unsure at all Xaa locations
  Clone ID: PAT_TA_5134.pep
LHWTLGGLSSPAXIWXILSTQYSGKGNVMLIAXIEDXIRLLRQDDGMSVXTYVAELQALWAEQDNCDPLELYDAACIESGRKWIARRRVLKLLEGLRGCFHGRRASLLHQPLLPSIEETIAAMSQEEVRLSLEHADMKAVPSSTFAVTERMEWSDPNKCHICGEAGHWKWACPTRGPGRGYDRGGAGRGRRGRGRGGYSAATWRGAATGGGGGSGGHGGERRAKTAVAGNRGTSEGKDADVAYGGFAPWASTDEGAADEPDGWDWHQA

SEQ ID NO: 110717 - protein, 187 aa, Triticum aestivum
  Clone ID: PAT_TA_5135.pep
MLLSSSSSSSPLPCRRRAPQTLPLLLAPRPAARRRVAMSRQPEVLWAQRSEKVYLTISVPDAEDVVIKTEPQGIFSFSAVAHGESFSLNLELFDSVLPEGSKTKTKVGSRNIICSIQKDKKCWWKRLLKSEAKHPYIKVDWNKWCDEDEESENSGSDDDFDGGEENDESDADDGMLYLPDLEKLRGK

SEQ ID NO: 110718 - protein, 99 aa, Triticum aestivum
  unsure (1)..(99): unsure at all Xaa locations
  Clone ID: PAT_TA_5136.pep
NSARAEAEKTVGEQKALEQELYDLNATAESVGLQCAYPRRRSSRVSATSKRSKXGRSSVSAANWNPKSPSFTIKRKKKMMPSLLKLIKEKRGGSDKSTN

SEQ ID NO: 110719 - protein, 339 aa, Triticum aestivum
  Clone ID: PAT_TA_5137.pep
MGDDLRLDLDKLPIKRLEAIDEAGNEHYPPDTSSEEQRLAAIRRVDFSWVVERDAKKAKKAAAEDAAQKAWPWQGLHESLQLAQQELTVVLDLISTVEVNDTVAVATISKPRPLPDEILVDMAVSAATKLQRLRHLGRYFKQSAKTMQQQFQKEARFYGSLIRLQQNWKVKRQRGNAPGINSFMFDVVDTSQLDTAAMPRMSSLSLVPIDQDSSGTLSVQVPQKSCRFLSLQFRRDSANGPESYACRTKGVSSTTSSAAEDDALEDDDDVNKSVKQAHSILRNIHKSIFEEQVLDMVIRETFVQTQGVNVTGMREDFLQTSNARRVGCAFRLVDPWTGW

SEQ ID NO: 110720 - protein, 115 aa, Triticum aestivum
  Clone ID: PAT_TA_5138.pep
TIQTLNFHTLPKNCKSRHLKLQCISGRQGRGWQVRSGTLTTPGRQCHAPFRRPRYRGARSLMLICSRCKDAFHVKTKPQASTNKFTSSHPNIHIQTSASVVHLCLIAPQIASVEG

SEQ ID NO: 110721 - protein, 222 aa, Triticum aestivum
  Clone ID: PAT_TA_5139.pep
MPFTTISSQIHCQGLLPLYPVTSSDASPSTSTPASIAFYKDKDSQHSASSYSSTDYICFKIPDGSLNLRNFVAVIKDFCNSRSTSNTPSLSGFLLHIPVEYECVDLSLYKDNQVVLLLSGKSSSESAGRSWMVMLQTENLSFSQLSRTFPANYYNLQELEALELQLDTDYGKVRSIPHPLSTPLAVSASRGVACVFSSRRHALVYILDEDEDEDEDEDSEME

SEQ ID NO: 110722 - protein, 121 aa, Triticum aestivum
  Clone ID: PAT_TA_5140.pep
ARGQSAQRSRVRKLQYISELERSVTGLQMEVSALSPRVAFLDHQRSAGAEGRRHLRQRIAALAQDKIFKDGPEGAPPAELERVRQLSHHQKIKATGGTDMATAASMQAKQELLMCEGAAMR

SEQ ID NO: 110723 - protein, 290 aa, Triticum aestivum
  Clone ID: PAT_TA_5141.pep
PKPAAAQRPPASKSNLHREEAMAGREEEEERWTMRPCTAVRSTMAGDHGPATRVVSKSKRGKAVARSSRKKGERRPECAAAGAGDRALPDPHGKAAMPTKKVVGAAAAAQAGGKGKRPLKKSEIRTIIALKPEPFPEDDYLDGMAKYYPPEWLEQKKREHAQDAAYFGKIDADYEDFRKKVIDGVKEKGYFEVDEGYMEKKPDQHPKPQLQKVDLSELMRFAATPEEELRRRGGNGYHEYSTDEEDDAVLAHVRDEDDDDDFLSDSSVSDEENAQTEGADVHKVAAIVAS

SEQ ID NO: 110724 - protein, 161 aa, Triticum aestivum
  Clone ID: PAT_TA_5142.pep
PQSQKGSAIVRGRVGAYHFQPPKNWINDPNGPMYYNGIYHEFYQYNPNGSVWGNIVWGHSVSTDLINWIPLETAIERDTPSDINGCWTGSATILPGNRLVIIYTGADPEKRQVQNIVVPKNLSDPYLREWTKAGNNPVIQPVGPGLNSGQFKDPTTGWIGP

SEQ ID NO: 110725 - protein, 170 aa, Triticum aestivum
  Clone ID: PAT_TA_5143.pep
MHPAGGLADLLTDNAGTGPGTEGIICGMPDFKMGGKRGDESAPTDAGDEDGEDDDGDEDGDFAEGEEEISEGEEYDNPKASDAKKKQIGEGEENGEDDEEEQEEQEGGGGDDDDDDDDDDDNEDDDDDDDDVAAEDDEDGVEEEDDDQDNDDDEEDDDEDSLQPPKKKKK

SEQ ID NO: 110726 - protein, 130 aa, Triticum aestivum
  Clone ID: PAT_TA_5144.pep
SSGRPGRYNAFSAYAHSKLANILHANELSRRFQEEGCDLTATSLHPGIIGTNIVRYITTNTATTCYVALHAVPQGAATTCYVALHPDTKRVSGKYFAGCNEATPTSVARDAELAKRLWAFSEELVENRSK

SEQ ID NO: 110727 - protein, 102 aa, Triticum aestivum
  Clone ID: PAT_TA_5145.pep
KRRMGTNDMQNWNWNCELMLVGVTNLLNVARLHYIWIYCFGRCDFVVCCMPHVAGDSCWMTLGYRFFGTGAAVQCSVLFFFFFLLSEPLICVLSNCLVVFVL

SEQ ID NO: 110728 - protein, 208 aa, Triticum aestivum
  Clone ID: PAT_TA_5146.pep
FGTSLNPSLFGLAGAAMEEPLPLRSPPSPPPSPPSPPPRRLPPSAALGPYVAEPVVVVEPIVDIKQEEEDMRDEDVCFQEADKYDVAELEDSNLPDNDTPMPPCFLPSPSDAIGTDGSSTSCGTVSSASNSIAPATTTSTFAGLFASATTSTTPQSRSLRDLIGVDPTFLCLQSVHHHLCSHRQMQATPAPLSTTSTAHICDWHSAEG

SEQ ID NO: 110729 - protein, 182 aa, Triticum aestivum
  unsure (1)..(182): unsure at all Xaa locations
  Clone ID: PAT_TA_5147.pep
MRVAADSADDAVATSTCAHCYRETPSPSITLHSAHCAPQPSCEMLQHCRNIWVPMEPHGLRTTTLTHAPANCPRWRTNWWEPQRCACFSKPLISPLRDAGRAKYCKFXELPAGDIFAHQDVTWEANXNIVNLATRTSDFANGLDTSSYSIQKQMPLQNPQAADPCWKKKRAVVTSKYARLLV

SEQ ID NO: 110730 - protein, 182 aa, Triticum aestivum
  unsure (1)..(182): unsure at all Xaa locations
  Clone ID: PAT_TA_5148.pep
MVVALGPGRFYGGGLPRPRVFPGDRVDPPAPVTDALLCWAREAHWSMGGLGAKRLRLQGRIEGNLVKLRRTARXRDARASAKSPAKASKAKVPAPGHGPAPATLDEALGSNDESSRDEXRGRGREVVDAARDSECGESLGVRVPLVTIAAAXKRMRVRKLSDEFDRIAAAQWRAARRRSRED

SEQ ID NO: 110731 - protein, 184 aa, Triticum aestivum
  Clone ID: PAT_TA_5149.pep
KCDRVITPTLKTIETLLSKQVFLNKEGHGDFYSELVNLLGPELKGSKDFTKLCAGLSILGYISSQLDGTGTRAFSQLLVFLGHRYPKIRKAAADQVYLVLLQNDSLISAEDMDKAQEVLAETCWEGDVEEARHKRSELNAMAGFGVATSQKSENRQGARAPDVRNAASTDENTSYSSLVEFSGY

SEQ ID NO: 110732 - protein, 80 aa, Triticum aestivum
  Clone ID: PAT_TA_5150.pep
LQVGRKHDIQMKPGCSGIWIGRCSLADYDDGLINITHQSTVIIVSSIWLQIIDTTSSKSHGTQCFTLPPKHSKQVSAYMV

SEQ ID NO: 110733 - protein, 241 aa, Triticum aestivum
  Clone ID: PAT_TA_5151.pep
FAPRAHPDLTHPPLAGPPPQVAALAYNPSRARLSPPAPAAPRPRKRGRSPSAPGAAVWRASAYVAPFDHRRRWQDPAGASGRVWQGYHAPHAPVPYRRWIFADEAATSGSDACTIMSYNILADNNARNHPDLYLDVPWDALRWDSRRRLIIHEIRHWDSDLVCLQEVDRFREIAAEMKNKGYECSFKGRTGDAKDGCATFWKSERLRLLEEDSIDFSEFNLRNNVAQVLVFELNGTQKFVL

SEQ ID NO: 110734 - protein, 124 aa, Triticum aestivum
  Clone ID: PAT_TA_5152.pep
RGLTVGAAEPGDGVHEACWIICARTHTRTHLQFQVLVSLNKTGRQRAAVHVRASVSFSLQFSVRLLAHLLLAAGIAMGWHGSRIPRRGHVGLCTSGRHGMARPVSSAGMTASFACFQELVDEFR

SEQ ID NO: 110735 - protein, 115 aa, Triticum aestivum
  Clone ID: PAT_TA_5153.pep
SYAMLKGNSSNRGHHGEPLATSYHKRFLGTVDSRGETGGRECSRVLDTLPVDALRRTRGLPTREMGSDHLPIVAEFIFSEQTRDASEQEDESDQDESAGEASTSKHIYFSSDSDS

SEQ ID NO: 110736 - protein, 339 aa, Triticum aestivum
  Clone ID: PAT_TA_5154.pep
MVVKSGGGGGAEEGAAGAAVRRWVEAGGGRLVLDGGLATELEAHGADLNDPLWSAKCILSSPHLIRKVHLDYIEAGANIIITASYQATIQGFESKGFSKEQGENLLTKSVEIAHEAREMFLKQHPDQSTALRPILVAASIGSYGAYLADGSEYSGDYGEAGTLEFLKDFHRRRLQVLAEARPDLIAFETIPNKLEAQAYVELLEECNINIPSWFSFNSKDGVNVVSGDSLIECAKIANECAKVGAVGINCTPPRFIHSLILSIRKVTDKPILIYPNSGERYDAEKKEWVESTGVSDGDFVSYVGEWCKDGAALIGGCCRTNPNPIRAIIRSLNQYYPAA

SEQ ID NO: 110737 - protein, 618 aa, Triticum aestivum
  Clone ID: PAT_TA_5155.pep
PAPLVGNIYTMVDVLLHHIQLELQRGHLVQDLLSKAITNLAFFVWTHELVPLDIVLLALIDRDDDPYALRLVISLLERPELQHRIKAFCSSRSPEHWLKNQPPKRAELQKALGNHLSWKDRYPPFFDDIAARLLPVIPLIIYRLIENDATDIADRVLAFYSTFLAFHPLRFTFVRDILAYFYGHLPSKLIVRILNVLGVSTKTPFSESFAQYLGSSNSSICPPPEYFANLLLGLVNNVIPPLSSKSKSNPADASGGRTNFSKPHASTQAGGNSNADAQRAFYQNQDPGSYTQLVLETAAIEILSLPVPASQIVSSLVQLIAHVQAMLIQSNTGQGMSGGLGQNSGLPTSPSGAGAESAGASRGNTSASGISANFVSRSGYSCQQLSVLMIQACGFLLAQLPPEFHMQLYSEAARIIKDCRWLSDSSRPVKELNSAVGYALLDPTWASQDSTSTAIGNIVALLHSFFSNLPQEWLESSHTVIKHLRPVTSVAMLRIAFRILGPLLPRLAFARPLFMKTLALLFNVLGDVFGKNSQASPHVPASEIGDIIDFVHHAVMYEGQGGPVQSTSKPKVEILTLCGKVVDMLRPDVQHLLSHLKTDPTSSIYAATHPKLAQQHPS

SEQ ID NO: 110738 - protein, 284 aa, Triticum aestivum
  unsure (1)..(284): unsure at all Xaa locations
  Clone ID: PAT_TA_5156.pep
MVHKELQQAWWFDSHNLARTSPWLGSTLSELDDKTKQMLKLIDQDADSFAQRAEMYYKKRPVLVDMLGDLYRTHRSLAEQYDLLKHGSGTCRSKFNPSPCTKSWSPGSMDGKATKSWSSGSMDGKTTRSSSSNSLCSDSYDSESEVDDPEEEHDEKVSDAEAEAEKHEADQEAELMRAEINRLSEQNAELQKVIEENKAAHEAELAAKDGEKRGVLRQLASSIDLVKPGDYPLREPLKGPKXPSPTPAAAAQPRGFGLRKLPLDLFXAKLFTGQRKHSGPMVAL

SEQ ID NO: 110739 - protein, 338 aa, Triticum aestivum
  unsure (1)..(338): unsure at all Xaa locations
  Clone ID: PAT_TA_5157.pep
NSARGAAEVIDLSSDDDEESLPFPSTSAVTIAPSSPRDVKPYELADVKPLLYPIQPPGCYALVPVKDEEPVPLPLAAEAPRVLPPPRLCRQFWKSGEYVVARRNPDADAPGGRNRLRINPKFLHSNATSHKWAFGAIAELLDNAIDEVNNGATFVRVNKFTNPRDGSPSLLVQDDGGGMDPDALRCCMSFGFSDKQSDAFIGQCXPSCRIGLLAASCRWDSGCADVLVPTVDYQYDLTTASYTQLLRHNQKLFSSNLAILSKWSPFASEAELLKQFDDIGEHGTKIIVFNLWFNDDGDMELDFNSDKKDILITGAQKKVKTNKHEKLMTQDYIANRLR

SEQ ID NO: 110740 - protein, 176 aa, Triticum aestivum
  Clone ID: PAT_TA_5158.pep
LDDGAYMVVKIIIEMVRMRLAGLEGGVGGLIRDLEEPAESVLLRMDIVGEPKSAKQRGIEAVEAFKTYIEEGKLSGWVLDDCGDCSVDEGCLVDNNDHPIDVDAYMYRAKFYDESQRPLGWVHIRQSVHNPNIALNLQSCVPGGCRSMAVDLFERFLLTSGVNEFVDTSEVQKFVK

SEQ ID NO: 110741 - protein, 236 aa, Triticum aestivum
  unsure (1)..(236): unsure at all Xaa locations
  Clone ID: PAT_TA_5159.pep
GVLAANXIFDWGSKACVDLYNQGTIIEIYGMSRKKMQRPWRIDDFDTFKSRMLKKDHXYKRALISVDNAGADVVLGMLPLAREFLRRGVEVVLVANSLPALNDITANELPEIVAEAAKHCGILRKAAEAGGLIVDAMAGIQGDTKDEPASVPLMVVENGCGSPCIDFRQVSSELAAAAKDADLLILEGMGRSLHTNLNARFKCDALKLAMVKNQRLAEKLFNGNIYDCICKFEPVS

SEQ ID NO: 110742 - protein, 233 aa, Triticum aestivum
  unsure (1)..(233): unsure at all Xaa locations
  Clone ID: PAT_TA_5160.pep
MIHLKQPLVLSAQSSNVASPPLFATAAAASGQQRRASGAGRSRSGRRLTARRISCASTEEAVGVSTSMTTKERSLTVTAVVTAQAPTSVYVARGLDDIQDLFGKTLLLELVSSELDPKTGREREKVKGFAHMTLKEGTYEAKMSVPASFGPVGAVLVENEHHREMFIKDIKLITGGDESTAITFDVAXWVHFKFDXPTRAXXYRKSYLPSKPRRNXALRKRLENCXGRHSVHN

SEQ ID NO: 110743 - protein, 80 aa, Triticum aestivum
  Clone ID: PAT_TA_5161.pep
SAARSCPWKRLNKCSCVPRGGNGGEIPSTFPSGAGAVHTGQHHVDRFRFSTALTPVLLGRRTRNTHPPSAREKEDTRDIY

SEQ ID NO: 110744 - protein, 200 aa, Triticum aestivum
  Clone ID: PAT_TA_5162.pep
EPDKPLIIYVGRLGVEKSLDFHKRVMDRLPGSRIAFIGDGPFRPELEEMFSGMPAVFTGTLQGEELSQAYASGDVFVMPSESETLGFVVLEAMSSGVPVVAAGGGGSPLYIPGDVDDCVGKVELLLSCEELRETMGKAARKEMEKFGWKAATRKIRNEQYSAAIWFWRKKRSQLLRPLQWVFRRLFRPAPAPAPAITNQS

SEQ ID NO: 110745 - protein, 171 aa, Triticum aestivum
  Clone ID: PAT_TA_5163.pep
NSARAHLPAFGLAWFLHQDSEKSTGWASMRGTIGYAAPEYGLGNEVSIHGDVYSYGILLLEMFTGKRPTDSGFGESFGLHKYVQMALPDRAAEVIDRDLLAETEDGEESTSNSGSTMDLRIACITSALHVGISCSQETPTNRIEIGEALKELQIIRGRFDKGLRAEIEPIN

SEQ ID NO: 110746 - protein, 405 aa, Triticum aestivum
  Clone ID: PAT_TA_5164.pep
NSARAELRAPCLLLLVFLLYSSLRLQLSQGLKQRRVYIVYLGERQHEDVSLVTSLHHDLLTSVLGSKEAALESIVHSYRYGFSGFSAMLTESQARKIQTLPGVVSVKENTMVRMHTTRSWDFLGLSMGVDIKQEQQPNELLAAANHGDGMIIGVIDSGVWPESQSFADDGYGPPPSKWKGTCQAGANFSAHDCNRKLIGARWYAGPDIDRRFLQGDFLSARDSHGHGTHTASTAGGNVVHNTSFFGLAAGTARGGAPRARIAVYKACWGSCSTASVLKGIDHAIHDGVDVLSLSLGSTDEMAALGTLGAVARGIPVIMAAGNDGPTEQTVQNSSPWLLTVAATTVDRSFLTVITLGNNRQFVAQSMYVADKGGDEFSQLLYYFNDRCDPDYINSTDIHGKVVFCY

SEQ ID NO: 110747 - protein, 305 aa, Triticum aestivum
  unsure (1)..(305): unsure at all Xaa locations
  Clone ID: PAT_TA_5165.pep
LPCVPLDFKTSYQIXVYCNRIGIPKIKISTTRTTSGSXVVAPRXAAFSSRGPSPIYHGVLKPDIAAPGVYILAAAAQTGAYKSLGVSYVFDSGTSMACPHISGIVALLKSVHPDWSPAALKSALMTTAHTMDSHGVPIEANGNRAKIADPFDYGAGSVNPTKAADPGLIYDISASDYLEFFNCPQGFGSNNNCTPPDLNLPSIAIPGLKTSVTVVRTVTNVGQPNAVYKAFLEPPRGVKMAVEPAVLVFSNARRVQSFNVTFRATRRIQGSYTFGSLAWHDGGAHLVRIPIAVRVVIEELYSDAS

SEQ ID NO: 110748 - protein, 112 aa, Triticum aestivum
  Clone ID: PAT_TA_5166.pep
ANNNNMFQTFLFFFGVVNFSEQMNVDMKDLSDRKHEINESREQGDWHGCILCGCIQPTNFLRIMVCYHSEELLFFLLMLGSLLYHTAACYLDTLLWHILARTRNKTVSFPDA

SEQ ID NO: 110749 - protein, 181 aa, Triticum aestivum
  Clone ID: PAT_TA_5167.pep
EHNFSNQGRGTVVTGRIEQGVIKTGDDVEVICLTESGPVKTTVTGVEMFIKMMDHGDAGDNVGLLLRGLKRGDVERGQVVCKPGTVKTYKKFEAEIYVLTKDEGGRHTAFFSNYSPQFYFRTADICGKIELPPDVKMVMPGDNVTAIFELMLPVPLEPGLRFALREGGRTVGAGVVAKVMS

SEQ ID NO: 110750 - protein, 164 aa, Triticum aestivum
  Clone ID: PAT_TA_5168.pep
WNIKLRLLYASKDIRKEMDSACSSCAPEGDSPPASLVPERLPMVAPSSDARDVAAGRPIVRQEPPARLAVTCVESGLPPRRGSSGTGSSGTLLQSRWLAKGPPWAPGPLAAAALRVGCRGAVRPRLCSGIVALRRSCCHRLHRRRPALPSRKLRKKQGNSNIYK

SEQ ID NO: 110751 - protein, 204 aa, Triticum aestivum
  Clone ID: PAT_TA_5169.pep
YKGLATKNKIIPKLDVINANQPKVQHQPCISSAGLTQGHQPVHRCALAWQGVDHRTAKRNPTAENHRSWQSGHTTNLNPATTVTFAPQPQAAPPHMSLSTTAGPGPDEPAIVVQSRRAHTSSLPRPGPFPTSSSRELTQPMVQCKVKAAITTYQRQEKEKCVSSCDSASCSTNGTKVASSPFLIFGTPTLLVALPSSKEPEHSS

SEQ ID NO: 110752 - protein, 155 aa, Triticum aestivum
  unsure (1)..(155): unsure at all Xaa locations
  Clone ID: PAT_TA_5170.pep
MATFLGSSPAFLARPAAKPHVSCAPPSRPPSAQPPSDQPPPPPQQQEPMQAQAAPARAPAPKRAATSADSTDWVASSLTRRFGIGAGLAWVGFLAFGVVSEQLKTRFEVAQQQANTKDVGEEKEVVLPXMGIRYTGVRVGGGDVPRPGDLVVIDL

SEQ ID NO: 110753 - protein, 166 aa, Triticum aestivum
  Clone ID: PAT_TA_5171.pep
LWAMRPDIVSSDDPDPLPEGFAAASAGRGLVVPWCCQVEVLAHAALAGFLTHCGWNSVLESVWAGVPMLCFPLLTDQFTNRRLVVREWRGGVPSGDRGKVFPDEVSARIQGVISGQEGQQLRQALRKVTAKLKAAAAPGGSSQRSFDDFVDELTHRCGGGGRILMT

SEQ ID NO: 110754 - protein, 280 aa, Triticum aestivum
  unsure (1)..(280): unsure at all Xaa locations
  Clone ID: PAT_TA_5172.pep
MELRTLGGTGLRVSPVGFGASPLGNVFGDVPRDVARATVRRALDLGINFFDTSPYYGGTVSESVLGDCLRFSGVPRDSFVVATKCGRYKEGFDFSAPRVTRSIDESLARLGLDYVDILHCHDIEFTILDQIVNETIPALQKIKESGKARFIGITGLPLSIFTYVLDRVPPGSVDLALSYCHYGINHPAPGDSQAGHTGTAADHCRKKGKHITKLARXYSLMNNDCSTGPLGWHAPEQVEENVAAAVELSTSGIDEELLHEVEAILEPVKNLTWPSGIQQA

SEQ ID NO: 110755 - protein, 131 aa, Triticum aestivum
  Clone ID: PAT_TA_5173.pep
MTSTLAACESGSRWEDPLSRRLRPPLPGSPWGGPRSPPRPPPLPGASTCCAPLPPSPSPAAPPGPGCPPPPPPRSPPPPRGRGLPPPSSPRGLPPRGGLCPPARLSLQGLGLFGFPAPGTLQWNQDIGLFW

SEQ ID NO: 110756 - protein, 232 aa, Triticum aestivum
  unsure (1)..(232): unsure at all Xaa locations
  Clone ID: PAT_TA_5174.pep
LGNEQRQYLSPRGYLPATGCRGNSTHTHAHTDTQAAAAAAAELGFGSGAAAAAAAAARTVSPRLHAPTSLTGRRGAGRPSTVSVRAAGGGGLMDFVGGDLVKPDLGRWLADVEEHKALAIYPPHEGGYEGRYLNRLRYQGYYFLDLSARGLGDPESTLTKIHPVCPPSLGRQPXVARWYFPPEVXDYRLSLLHPDAXKGLIVWGLRRPKVLSKAPLLASWSMPPTFRPQVKG

SEQ ID NO: 110757 - protein, 100 aa, Triticum aestivum
  Clone ID: PAT_TA_5175.pep
WSIQQASYVNTLRLVVLCFAMKEHRGGPKALLVTKACSDPLRSLTAAPGAEGAPAQSRGAARTRLLARSGVESRESFRTGSKYQMQIIPSIGLLPTFQNR

SEQ ID NO: 110758 - protein, 209 aa, Triticum aestivum
  unsure (1)..(209): unsure at all Xaa locations
  Clone ID: PAT_TA_5176.pep
HEGFLNIIVDYPXVECTSSVLQALIMFKELYPGYRKEEIGKCVKNASKFIEDKQRKDGSWFGTWGICFTYGTFFGVKGLIASGRTYENSSSIRKACNFLLSKQLSTGGWGESYLSSETEAYVEATSPHAVNTAWAMLALIYAGQVERDPTPLYHAAKELINMQLETGEFPQQEHVGCFNCSIYFNYGNYRNLYPIWALGEFRRRLLAKN

SEQ ID NO: 110759 - protein, 104 aa, Triticum aestivum
  Clone ID: PAT_TA_5177.pep
LHSIYDHRVQMISTSTDNHSASVPPADGCCKDLSGWWVDSGLPHMKERVVQTSCFFSSLQDGHFPWIIFACAGTPAFLGGTPRSLSTASSSRPPTASTCPGGRS

SEQ ID NO: 110760 - protein, 154 aa, Triticum aestivum
  Clone ID: PAT_TA_5178.pep
IFLAFTSASKIGDTLPYAVKVMSLYKSRVRKLRKALEDLLAVKGENAPAAEVGSEELSLDNEIDVLNNILAALENKLEDLAQATLTPASEASGTHNVVYAAPRAASPTLQIAGGSNSVSTAATVETQSSTGIELETAGQGMKQASAKLISAEPS

SEQ ID NO: 110761 - protein, 80 aa, Triticum aestivum
  Clone ID: PAT_TA_5179.pep
PTRPPTRPPTRPPTRPPTRPPTRPAPTPTATPRTTPPAPTPAPAAPTTRSSSAHDRAKTRQPLKRSRSSTQTRRSLSDLI

SEQ ID NO: 110762 - protein, 235 aa, Triticum aestivum
  Clone ID: PAT_TA_5180.pep
MASLAAASRVVLHILPLFLLAAGTHAATFTITNKCQFTVWAAAVPSGGGKQLDPGAQPWSIEVPAGTTGGRVWARTGCNFDGSGNGQCQTGDCGGVLQCTGYGQAPNTLAEFGLNKYMGQDFIDISVIDGFNVPMDFLPADGTAGCAKGGPRCDADITSQCPSELRAPGGCNNACTVFKKDEYCCTGTAADNCGPTDYSRFFKGQCPDAYSYPKDDATSIFTCPGGTNYQVVFCP

SEQ ID NO: 110763 - protein, 211 aa, Triticum aestivum
  Clone ID: PAT_TA_5181.pep
MASLPSSSVLLPVLILILVAAATDAATFTVINKCQYTVWAAGTTGGRVWARTGCSFDGAGNGRCQTGDCGGKLQCTQYGQAPNTLAEFGLNKYMNLDFFDISLIDGYNVPMSFLPAPGSPGCPKGGPQCPRVITPQCPNELRAAGGCNNACTVFKEDRYCCTGSAANNCGPTDYSRFFKGQCSDAYSYPKDDATSTYTCPGGTNYQVIFCP

SEQ ID NO: 110764 - protein, 233 aa, Triticum aestivum
  Clone ID: PAT_TA_5182.pep
MASLPSSSVLLPVLILILVAAATDAATFTVINKCQYTVWAAAVPAGGGRQLDAGQTWSINVPAGTTGGRVWARTGCSFDGAGNGRCQTGDCGGKLQCTQYGQAPNTLAEFGLNKYMNLDFFDISLIDGYNVPMSFLPAPGSPGCPKGGPQCPRVITPQCPNELRAAGGCNNACTVFKEDRYCCTGSAANNCGPTDYSRFFKGQCSDAYSYPKDDATSTYTCPGGTNYQVIFCP

SEQ ID NO: 110765 - protein, 62 aa, Triticum aestivum
  Clone ID: PAT_TA_5183.pep
RPGRDYPPLPTTRPPPPQEEEEKQQAREGDHASRRPTMRAKWKKKRMRRLKRKRRKMRQRSK

SEQ ID NO: 110766 - protein, 221 aa, Triticum aestivum
  unsure (1)..(221): unsure at all Xaa locations
  Clone ID: PAT_TA_5184.pep
APLQQGRGENTMATSSVLLPVLLLVAVAGAEAATFTVINKCQYTVWAAAVPAGGGRKLDAGQTWSIDVPAGTTSGRVWARTGCSFDGAGNGRCQTGDCGGKLQCTQYGQAPNTLAEFGLNKYMGQDFFDISLIDGFNVPMSFVPAPGTSGCPKGGPRCPRVITPQCPSELRAAGXGCNNACTVFKEDRNCCTRYAAQQTPRKQKTIRFGRAVMIAQLHGTP

SEQ ID NO: 110767 - protein, 262 aa, Triticum aestivum
  Clone ID: PAT_TA_5185.pep
GMAMVKPVFIPKAQRDTIAERERLEEEERQVEETIRKRLEARKIETRQIVVEEIRKDEHIQKALNEDASIEDVDTDDEQNEAEEYESWKNREMARIKRDREERYARLKEKEEIDKVRNMTEEERREWEKKNPKPSLQKSKQKWNFMQKYYHKGAFFQEGGDDVSQSAGRDAIYTRDFSAPTGEDKMDKSILPKVMQVKHFGRSGRTKWTHLVNEDTTDWDAPWATNGPLRTKYNAKMAGMNAPIAKPKGSKKMKDWDTKRDD

SEQ ID NO: 110768 - protein, 161 aa, Triticum aestivum
  unsure (1)..(161): unsure at all Xaa locations
  Clone ID: PAT_TA_5186.pep
FRMHFEPRTEREEMIQSTGNAAGTNGIHHHNNTQPPRHRRSEREAPSVXSSFKSSSRWTGRGGGVVPVWSPPCSIRPFRNLLERSEADVSCRXSYLDRHPXSSHRIMNWHQLSRSVDGGQGRGELRAVRVSSGREMAGHRAGESQPRGVQGGVFVGVIIAM

SEQ ID NO: 110769 - protein, 197 aa, Triticum aestivum
  Clone ID: PAT_TA_5187.pep
HPSYRSTPRIFTTSTKDEAHHALLHITKQQKLSQHRPNQSPILPQCANTGQPDCQLTTKCRIMRPPSNQVLNASSGPILPQCANTGQPHSQLTTKCRITRVPSNPQPCFSKVCLCALTPLIQGDFLPIQCSGQLSVLVVTDTKDGFSGRQAEDRIPIAPSIFGDFLGIQQAPSMPHRLPFEFSNNQSASLYPMSSID

SEQ ID NO: 110770 - protein, 799 aa, Triticum aestivum
  Clone ID: PAT_TA_5188.pep
MSSAVASAASFLALASASPGRSRRRARVSAQPPHAGAGRLHWPPWPPQRTARDGAVAALAAGKKDAGIDDAAASVRQPRALRGGAATKVAERRDPVKTLDRDAAEGGGPSPPAARQDAARPPSMNGMPVNGENKSTGGGGATKDSGLPTPARAPHPSTQNRAPVNGENKANVASPPTSIAEAAASDSAATISISDKAPESVVPAEETPPSSGSNFESSASAPGSDTVSDVEQELKKGAVVVEEAPKPKALSPPAAPAVQEDLWDFKKYIGFEEPVEAKDDGRAVADDAGSFEHHQNHDSGPLAGENVMNVVVVAAECSPWCKTGGLGDVAGALPKALAKRGHRVMVVVPRYGDYEEAYDVGVRKYYKAAGQDMEVNYFHAYIDGVDFVFIDAPLFRHRQEDIYGGSRQEIMKRMILFCKAAVEVPWHVPCGGVPYGDGNLVFIANDWHTALLPVYLKAYYRDHGLMQYTRSIMVIHNIAHQGRGPVDEFPFTELPEHYLEHFRLYDPVGGEHANYFAAGLKMADQVVVVSPGYLWELKTVEGGWGLHDIIRQNDWKTRGIVNGIDNMEWNPEVDAHLKSDGYTNFSLRTLDSGKRQCKEALQRELGLQVRADVPLLGFIGRLDGQKGVEIIADAMPWIVSQDVQLVMLGTGRHDLESMLQHFEREHHDKVRGWVGFSVRLAHRITAGADALLMPSRFEPCGLNQLYAMAYGTVPVVHAVGGLRDTVPPFDPFNHSGLGWTFDRAEAHKLIEALGHCLRTYRDFKESWRALQERGMSQDFSWEHAAKLYEDVLVKAKYQW

SEQ ID NO: 110771 - protein, 799 aa, Triticum aestivum
  Clone ID: PAT_TA_5189.pep
MSSAVASAASFLALASASPGRSRRRARVSAPPPHAGAGRLHWPPWPPQRTARDGGVAARAAGKKDARVDDDAASARQPRARRGGAATKVAERRDPVKTLDRDAAEGGAPAPPAPRQDAARPPSMNGTPVNGENKSTGGGGATKDSGLPAPARAPHPSTQNRVPVNGENKANVASPPTSIAEVVAPDSAATISISDKAPESVVPAEKPPPSSGSNFVVSASAPRLDIDSDVEPELKKGAVIVEEAPNPKALSPPAAPAVQEDLWDFKKYIGFEEPVEAKDDGWAVADDAGSFEHHQNHDSGPLAGENVMNVVVVAAECSPWCKTGGLGDVAGALPKALAKRGHRVMVVVPRYGDYEEAYDVGVRKYYKAAGQDMEVNYFHAYIDGVDFVFIDAPLFRHRQEDIYGGSRQEIMKRMILFCKAAVEVPWHVPCGGVPYGDGNLVFIANDWHTALLPVYLKAYYRDHGLMQYTRSIMVIHNIAHQGRGPVDEFPFTELPEHYLEHFRLYDPVGGEHANYFAAGLKMADQVVVVSPGYLWELKTVEGGWGLHDIIRQNDWKTRGIVNGIDNMEWNPEVDVHLKSDGYTNFSLSTLDSGKRQCKEALQRELGLQVRADVPLLGFIGRLDGQKGVEIIADAMPWIVSQDVQLVMLGTGRHDLESMLRHFEREHHDKVRGWVGFSVRLAHRITAGADALLMPSRFEPCGLNQLYAMAYGTVPVVHAVGGLRDTVPPFDPFNHSGLGWTFDRAEAHKLIEALGHCLRTYRDYKESWRGLQERGMSQDFSWEHAAKLYEDVLLKAKYQW

SEQ ID NO: 110772 - protein, 173 aa, Triticum aestivum
  Clone ID: PAT_TA_5190.pep
EHPPRAASLPPPTPPGEELLCPEPPPAGQPVTRSQTTTAATLPWSSPPPTTSPSDSFFSASNPSAATGSTPEQPDPPPPDPPAVGSRTTERFTRSFVAWATQLPRPSLPAKSSPSISSPSLLLSIFPFFVSFLAVRQLPSWAYHACRLFWIFLYFSWPKMTHISHPLLVDVLT

SEQ ID NO: 110773 - protein, 195 aa, Triticum aestivum
  unsure (1)..(195): unsure at all Xaa locations
  Clone ID: PAT_TA_5191.pep
NDRPWEASEPPTAPASGTAVPRWRGGTTPRPPRPSSASPRPTPPASRRPTNTFAGQPPPRHQERPPLSXPARSSPTICEKDGHRQAQLPPDGGDPGGPPGTVRPRCAVPGTTPSPXPSTPCRTCRNARPPRPSPSGASRRARSPTPPTATRPPPEPLPHPLRPGSPQPTPAAGRAPAPPPPSKPPPPRPPRLLRR

SEQ ID NO: 110774 - protein, 228 aa, Triticum aestivum
  unsure (1)..(228): unsure at all Xaa locations
  Clone ID: PAT_TA_5192.pep
YGGXRALGLXRELAENNRGARVLVACAEIXLVCFGGPDGGNLVXHAIFGDXAXAVIVGAGPFRXXEQSPIFEMVHATQTTVPKTEHALGMQVSGSGVDFHLAIQVPTLIGQNVERCLLDAFRGGEEAGHGARPPSPLSGNGKWNGLFWAVHPGGRPILDNIDKVLQLEPEKLGGSRXLLREYGNMSGATIVFVLDELRRRRSLLPEWGAMLAFGPGVTIETMVLRCPR

SEQ ID NO: 110775 - protein, 337 aa, Triticum aestivum
  Clone ID: PAT_TA_5193.pep
VSIASLLDVVSDDLLKLNNNLKSLIGAENPVLVSAAEQIFGAGGKRLRPALVFLVSRATAEVAGLSELTREHKRLAEIIEMIHTASLIHDDVIDDSGMRRGKETIHQLYGTRIAVLAGDFMFAQSSWFLANLENIEVIKLISQVIKDFASGEIKQQSTLFDCDVTLDDYLLKSYYKTASLLASSTRSAAIFSGVSTAVCEQMYEYGRNLGLSFQVVDDILDFTQSAEQLGKPAGSDLAKGNLTAPVIFALQESPELREIIDSEFCDTGSLSAAMELVHRSGGIRRARGRGPEKGDLALQNLQCLPRSQGGTARAALEKKEQERLERIDGRMDQLWSV

SEQ ID NO: 110776 - protein, 148 aa, Triticum aestivum
  Clone ID: PAT_TA_5194.pep
PHHSPRRNREIQRTFFLSWILALFSLVLLRYGRKGFFCNTLLVRPIYSFLPLVSLILLRNRAFFLSLSACTRKLLFFHFGFGSAFSTSPSSTSAQALMAAAIDMYKYNTSTHQIGSAASALDQELMKALEPFITIASSSSLTTPTLLL

SEQ ID NO: 110777 - protein, 185 aa, Triticum aestivum
  Clone ID: PAT_TA_5195.pep
MKQSGSPPRASAAALALAGVAPAQSKLYRGVRQRHWGKWVAEIRLPKNRTRLWLGTFDTAEDAALAYDKAAFRLRGDLARLNFPSLRRGGAHLAGPLHASVDAKLTAICESLAAPSSKNSEPESPKCSASTEGEDSASAGSPPPPTPPVPEMEKLDFTEAPWDESETFHLRKYPSVEIDWDSILS

SEQ ID NO: 110778 - protein, 168 aa, Triticum aestivum
  Clone ID: PAT_TA_5196.pep
GTRTIFFFGDFCFLRKMNKKEICLVSKPKPRTGRENQQGQQPRQKEMALVVDLDTTSKEVWKKNLAWPITTTKREEKRTDLEPRDLKRPGDLAACRVNKETNRGREEEGLRLGEPYLGDARTRSDLCLPRSNSRECLWFAGIGAFSAGGGWWNVCGRRSEWAGRGGPA

SEQ ID NO: 110779 - protein, 236 aa, Triticum aestivum
  Clone ID: PAT_TA_5197.pep
HAHDLATLAPSAPSHYPYHYFPARPNTQHSSSHTPQLGPRPQPMKPASVAAATPPRPQKLYRGVRQRHWGKWVAEIRLPRNPRPRLLGTFDTAEEAALAYDQAAYRLRGDAARLNFPDNAASRGPLHASVDAKLQTLCQNITASKNGKKSASVSASTAAATSSTPTSNCSSPSSDEASSSLESAESSPSPATTTAAEVPEMQQLDFSEAPWDEAACFALTKYPSYEIDWDSLLATN

SEQ ID NO: 110780 - protein, 208 aa, Triticum aestivum
  unsure (1)..(208): unsure at all Xaa locations
  Clone ID: PAT_TA_5198.pep
MEEAGGCARMGLRGVLLALALLLSVCVRASHGLTDSQDTSVLRALMDQWQNSPPTWGQSDDPCGVSPWDGVTCSNNRVISIKVSTMGIKGLLAADIGQLTELQSLDLSFNKDLGGVLTPTIGNLKQLATLILAGCXFHGNIPDELGXLPNLSYMALNSXNQFSGKIPASLGNLSSLYWFDVADNQLTSPLPISSNXGMGLDKLTKTKH

SEQ ID NO: 110781 - protein, 169 aa, Triticum aestivum
  Clone ID: PAT_TA_5199.pep
GRPTRPHRFPPDHGRSARDKAYIAVLSFAFLFLLHYILGKKSNGSKGAAHLPPSPPAVPFLGHLHLVEKPLHAALCRLGARYGSVFSLRLGARNAGGVSSPACARECFTDHDVAFANRPRGPSQMLVSYGGTSLVSSSYGPHWRNLRRVAAVRLLSAHRVAGMSGVIAA

SEQ ID NO: 110782 - protein, 141 aa, Triticum aestivum
  Clone ID: PAT_TA_5200.pep
MASMLCSYSVSMPAAARAPLLRSSASSYATSVGFATSQLAGLSLSLGLTSTAAVSLPAKNTIVARRICPFLEKKTNRANKVSFSNHKTKKQQFVNLQYKKLWWEAGKRYVKLRLSTKALKTIEKHGLDAVAKKAGIDLNKK

SEQ ID NO: 110783 - protein, 135 aa, Triticum aestivum
  unsure (1)..(135): unsure at all Xaa locations
  Clone ID: PAT_TA_5201.pep
MASMLCSYSVSMPAAARAPLLRSNSLGFATSQLAGLSLGLTSTAAVSLPTKNTIVARRICPFLEKKTNRANKVSFSNHKTKKQQFVNLQXKKLLDGTAGKRYVKLRLSTQGXSKTNEKHGLDAVANKDGVDLNKK

SEQ ID NO: 110784 - protein, 70 aa, Triticum aestivum
  Clone ID: PAT_TA_5202.pep
FFFFFFFGDTLVTILIKRITSVSLTKDARDYYDAVSKPISKFLEPKFHTTKIQPNFLRKAFYSVYQNCTE

SEQ ID NO: 110785 - protein, 139 aa, Triticum aestivum
  Clone ID: PAT_TA_5203.pep
SVGTRRTARAWCGRRRSRKRALSSGVPRTGGGDRPEGRRPCKGVARARPLLTVACGCGKPPANCLPAAHLAAAATLLHAAHHGFTGGGPIGCLLHHVTIDLGLLRMNNPWAAPDVVLPRYLHRLTFFNHASKIQNNAEP

SEQ ID NO: 110786 - protein, 87 aa, Triticum aestivum
  Clone ID: PAT_TA_5204.pep
MIPGDDELRALFQFSLIFVADAGSQLLTYGSRKPIDHFLQCMEELTLDDITAFAKMLLSSQPTMASYGDVDKVPPYEFVSKRFQRFR

SEQ ID NO: 110787 - protein, 274 aa, Triticum aestivum
  Clone ID: PAT_TA_5205.pep
MEAKAAAVSLSAPLPRCRVAGGNGPLACSASARRSRRCGYHHGAPLRSLARPSSSARSFPAGRVYAMAAAATTPVKEQDLVFVAGATGKVGSRTVRELIKLGFRVRAAVRSKERASPLVQSVERLELGEGSAADSRLELVECDLEKQGEAGIKAAIGDAALVVCSIGASEKEILDVTGPYRIDYVATANLVRAAAKAGVEHFVLVTSLGTTRFGFPAALLNLFWGVLCWKKIAEEALVASGVPYTIVRPGGMERPTDAYNETHNLVVSPRDTYV

SEQ ID NO: 110788 - protein, 80 aa, Triticum aestivum
  Clone ID: PAT_TA_5206.pep
QSYRTCSSLMCNGSVFEGGVGLTRCGWRFRRLDCVSLLCATSDLIVVGLKIVIPFVYSATNIVTDAKEIRLPKKKKKRPL

SEQ ID NO: 110789 - protein, 157 aa, Triticum aestivum
  Clone ID: PAT_TA_5207.pep
MGFVSFAGRVLFASVFLLSAYQEFTEFGTDGGPAAKNLAPKFNSFTKNISVHLGVVVPHVELKHVVAATIGLKGLGGLLFIVSSSFGAYLLALYLAFITPVVYDFYNYDMEKAEFVQIFMKFTQNLALFGALLFFLGMKNSVPKRQAKKKAPKSKTT

SEQ ID NO: 110790 - protein, 155 aa, Triticum aestivum
  unsure (1)..(155): unsure at all Xaa locations
  Clone ID: PAT_TA_5208.pep
MGFVSFAGRVLFASVFLLSAYQEFTEFGTDGGPAAKNLEPKFNSFTKNISVHLGVVVPHVELKHVIAATIGLKGLGGLLFILSSSFGAYLLALYLAFITPVXVYDFYNYDMEKAEFVQIFMKFTQNLALFGALLFFRGLKNSVPRIQTHKNAPKS

SEQ ID NO: 110791 - protein, 206 aa, Triticum aestivum
  unsure (1)..(206): unsure at all Xaa locations
  Clone ID: PAT_TA_5209.pep
EFGTSSAAAAAASATTSSKKTMLRVLIFPFFATSHIEPFTDLAVRLVAAGPAVEATVAVTPANVPVVQSLLRRRGQAXHVKIATYPVPGRGRTPGGRGEPQQGQREARTRXRIRRRCPEAXHLTRPAQEALARAPSPDAVVTDVHFAWNVRVAGELGVPCVAFSAIGAFPTLALHHLEREDVDNGDVDVATVPQFPGPSIRVPRAE

SEQ ID NO: 110792 - protein, 186 aa, Triticum aestivum
  unsure (1)..(186): unsure at all Xaa locations
  Clone ID: PAT_TA_5210.pep
DAWGNDYNYAFXKGKTLDDAKSYVPTVSSAIIDATERLIKGGAMHLVVPGNLPMGCSSAYLTLHPGRSRGDYDAVGCLKTYNDFAQRHNAMVQQKLQVLRLKYPEARIMYADYYGAAMAFAKNPKQFGFKQGPLKTCCGGGGPYNFNPKASCGVRGSSVCADPFAYANWDGVHLTEAGYHAIGDRI

SEQ ID NO: 110793 - protein, 335 aa, Triticum aestivum
  unsure (1)..(335): unsure at all Xaa locations
  Clone ID: PAT_TA_5211.pep
MAISRLSVLVAALACCCLVRLAQCGGGGQNYTSMFSFGDSLTDTGNLLVSSPLSFNIVGHFPYGMTYFHRPTGRCSDGRLVVDFLAQAFGLPLLQPYLSRGKDVRQGVNFAVGGATAMDPPFFEGIGASDKLWTNLSLSVQLDWFEKLKPSLCSSPKNCKKYFSRSLFLVGEMGGNDYNYAFFKGDKKHNQLSYVPGLSSAIIDAGETLIKDGAMHLVVRGNSVMACSSAYVNLDGVRLTEAADAAIADSTHNDFAPRPNAIFHPKLLVLRLKYPMARIMYADYLCTGXSCAKLHKQFGEVEGLLPLSLVGRGLLLLDPKASCGVPRSNVCADPS

SEQ ID NO: 110794 - protein, 71 aa, Triticum aestivum
  Clone ID: PAT_TA_5212.pep
SAALSAPTKLFGVHLRSAPVGAGSKRPPSPEEELPSTPPATKARLALENDDLSLSVAPPSQPCAASSPARS

SEQ ID NO: 110795 - protein, 198 aa, Triticum aestivum
  Clone ID: PAT_TA_5213.pep
VMLKKEAEYFGDIVILPFIDRYELVVLKTIAICEYGVQNLTAAHVMKCDDDTFVRVDVVLRHIKMNSLGKPLYMGNLNLLHRPLRTGKWAVTEEEWPEDIYPPYANGPGYVISGSIAKFVVSQHANQSLRLFKMEDVSMGLWVEKFNYTMPVRYSHSWKFCQYGCLENYYTAHYQSPRQMLCLWDKLVRGRPSCCNYR

SEQ ID NO: 110796 - protein, 369 aa, Triticum aestivum
  Clone ID: PAT_TA_5214.pep
MACAAPPSPLPVVSLPARRRSATAAAPASYHAPSTRLSRRSWLSSGNSPRSRLRAQASKAEPAEEGLPAAPGPSAPSEPLPQPRTSTWNWKGYNIRYQCAGTSGPALVLIHGFGANSDHWRKNIPVLAMANRVYAIDLIGYGYSDKPNPREFEESFYTFETWGEQLNTFCAEVVKSDAFFICNSIGGLVGLQAAVMEPQTCKGIVLLDISLRMLHINKQPWFGRPFIRSFQNLLRYPLAPSLFFNAVATPESVKNILCQCYHDTSAVTDELVQMILQPGLDPGAVDVFLEFICYSGGPLPEDLLPLVKCPVLVAWGEKDPWEPVELGRAYGSFDAVEDFVVLPNVGHCPQDEAPELVNPLVESFVKLHS

SEQ ID NO: 110797 - protein, 340 aa, Triticum aestivum
  Clone ID: PAT_TA_5215.pep
MEPGRLIFNTSGSGNGQMLFMDCGAGGIAGAAGMFHRGVRPVLGGMEEGRGVKRPFFTSPDDMLEEEYYDEQLPEKKRRLTPEQVHLLERSFEEENKLEPERKTELARKLGLQPRQVAVWFQNRRARWKTKTLERDFDRLKASFDALRADHDALLQDNHRLRSQVVTLTEKMQDKEAPEGSFGAAVDALEPEQAAAEAKASLANAEEHAAAAEAFEVVQQQLHVKDEERLSPGSGGSAVLDARDALLGSGCGLAGVVDSSVDSYCFPGGAGGDEYHECVMGPVAGGIQSEEDDGAGSDEGCSYYPDDAAVFFAAAQGHGHHHTDDDDQQDDGQISYWMWN

SEQ ID NO: 110798 - protein, 97 aa, Triticum aestivum
  Clone ID: PAT_TA_5216.pep
SCGDGCADLFADVRRALQPLAPRVVGSEVTTLGGRVRITVAMLREGAVTAASVRRALDSVLDRVASAAAAFEFSPRDSLLASKRRRVSTFDSSSSSS

SEQ ID NO: 110799 - protein, 167 aa, Triticum aestivum
  Clone ID: PAT_TA_5217.pep
MKSIGSRDKLQAAAAATGPRRVLLLVFASCFAFATLLTFLYTSSGFASAASSGSRLGSSSSSNAAAGSGAALPLPVFDALVHYASFSNATHRMTDTDIRAISAILRARAPCNLLVFALGAESPLWLALNHGGRTVYLDLNEFYVKYLEPRHPGLDDFDVSYPPPRHP

SEQ ID NO: 110800 - protein, 268 aa, Triticum aestivum
  unsure (1)..(268): unsure at all Xaa locations
  Clone ID: PAT_TA_5218.pep
PPIHRRHPSRRPPATLNSARAATASRPPRDVRRRRPDGEPWPQLVAGAPPLRAPGDPHGSAAPRAAHTVRDLAEEGKKRAVLLLVFAFGLAFLMSMTSSSVWINFPFAISLIVLFRYLSLDYDFRRKSTTTTDRDASRPLAKTXSIELSKPSLTQKNGNSSWRSKVNSPPVEAAFEQFTRHLVTEWVTNLWYSRITPDKDGPEELISIVNSVLGEISNWGRSINIITLLTRDLVXICNNLELYHSCEAKIGKEKFVRLPTERRDAELK

SEQ ID NO: 110801 - protein, 197 aa, Triticum aestivum
  unsure (1)..(197): unsure at all Xaa locations
  Clone ID: PAT_TA_5219.pep
MVATKSGELRALFASLDRDADGRISAAELWGCMQDTLGEDMPAEEAXALVASADADGDGLLCEAEFLELAQQAAWAGTDEENDELRIQALREAVGMYEMEGQGRITTVRLRRMLAQAGYLMCGHPVPRWHAMICRIDDVPGYLLFGTRPGQWTKCKQCSPDDSGLRCHQCAGHRALASLFCLPLSRSSLECISVLYV

SEQ ID NO: 110802 - protein, 152 aa, Triticum aestivum
  Clone ID: PAT_TA_5220.pep
MVARKSGELRALFLSLDRDADGRISAAELRECMRATLGEDVPAGEAEALVASADADGDGLLCEAEFLELAQQAAWAGDAAEEDDELRIRALREAFGMYEMEGQGCITPASLGRMLGRLGAERGAGECRAMICRFDLDGDGVLSFDEFKIMMS

SEQ ID NO: 110803 - protein, 151 aa, Triticum aestivum
  Clone ID: PAT_TA_5221.pep
MVASSGELRALFASLDRDADGRISAAELPGCMRATLGEDVPAEEADALVASADADGDGLLCEAEFLELAQQASWAGDALEEDDELRIRALREAFGMYEMEGQGCITPASLGQMLGRLGAERGAGECHAMTCRFDLDGDSVLSFDEFKIMMS

SEQ ID NO: 110804 - protein, 170 aa, Triticum aestivum
  Clone ID: PAT_TA_5222.pep
MAVTRTIFLAMAVMAILSTASAAIYNVGEPGGAWDLSTNYGTWASSRNFKADDQIVFKYSPQARDVLEVSKADYDSCNTASPITTLNSGNDVVSLTASSTRYFICGFPGHCAGGMKVKIDSMSGSSSSPAPASGPSASNAPPPTPVSTATNVEAIGYGLAVLLAIAGLMA

SEQ ID NO: 110805 - protein, 151 aa, Triticum aestivum
  Clone ID: PAT_TA_5223.pep
MVATKSGELRALFASLDQNGDGRVSAAELRGCMRATLGEDVPAEEAEALVASADADGDGLLCEAEFLELAQQAAWAGAEDEDNEQRTRALREAFRMYEMEGQGCITPASLGRMLGRLGTERGAGECHAMICRFDLDGDGVLSFDEFKIMMS

SEQ ID NO: 110806 - protein, 152 aa, Triticum aestivum
  Clone ID: PAT_TA_5224.pep
MVATKTGELRALFLSLDRDADGRISAAELRGCMRATLGEDVPVEEAEALVASADADGDGLLCEAEFLELAQQAAWAGDAGEEDDELRIRALREAFGMYEMEGQGCITPASLGRMLGRLGAERGAGECRAMICRFDLDGDGVLSFDEFKIMMS

SEQ ID NO: 110807 - protein, 151 aa, Triticum aestivum
  Clone ID: PAT_TA_5225.pep
MVVTKSGELRALFLSLDRDADGRISAAELRGCMRATLGEDVPVEEAEAMVASVDADGDGLLCEAEFLELAQQAAWAGADDENDELRIRALREAFGMYEMEGQGCITPASLGRMLGRLGAEQGAGECRAMICRFDLDGDGVLSFDEFKIMMS

SEQ ID NO: 110808 - protein, 151 aa, Triticum aestivum
  Clone ID: PAT_TA_5226.pep
MVASKSGELRALFASLDQDADGRISAAELRGCMRATLGEDVPAEEADALVASADADGDGLLCEAEFLELAQQASWAGVEEGDDELRTRAPREAFGMYEMEGQGCITPTSLGRMLGRLGAERGAGECRAMICRFDLDGDGVLSFDEFKIMMS

SEQ ID NO: 110809 - protein, 170 aa, Triticum aestivum
  Clone ID: PAT_TA_5227.pep
MTATRIILLAVAVMVVLSTASAAIYNVGEPGGAWDLGTNYGTWASSRNFQTDDQIIFKYSPQAHDVLEVSKADYDSCSTARAITTLNSGNDVVTLSASGTRYFICGFPGHCAGGMKVKIDVTSGSSSSAAPASGPSASNAPPPTPVSAATNVEATGFGLAVLLAVAGLLA

SEQ ID NO: 110810 - protein, 171 aa, Triticum aestivum
  Clone ID: PAT_TA_5228.pep
MAAKRTILLAMAAMAVLSTASAATYNVGEPGGAWDLSTNYGTWASSRNFQTNDQIVFKYSPQAHDVLEVNKADYDSCSTANPINTFNSGNDVVTFTATGTRYFICGFPGHCAGGMKVKIDVMPGSSSKSPVPANGPSASNAPPPRPVSAATNVEATGFGLAVLLAIAGLMA

SEQ ID NO: 110811 - protein, 168 aa, Triticum aestivum
  Clone ID: PAT_TA_5229.pep
MAVTRTILAVAVMAILSTASAAIYNVGEPGGAWDLSTNYGTWASSRNFKADDQIVFKYSPQAHDVLEVSKADYDSCSTASPITTLNSGNDVVTLTASGTRYFICGFPGHCAGGMKVKIDVMSGFSSPAPASGPSASNAPPPTPASAATNVEATGFGLAVLLAVAGLMA

SEQ ID NO: 110812 - protein, 171 aa, Triticum aestivum
  Clone ID: PAT_TA_5230.pep
MAARRTILLAVAAMAVLSTASAAIYNVGEPGGAWDLSTKYDTWASSRNFQTSDQIVFKYSPQAHDVLEVSKADYDSCSTANPVTTFNSGNDVVTLTATGTRYFICGFPGHCAGGMKVKIDVMSGSSSMSPAPASGPSASNAPPPTPVSAATNVEATGFGLAVLLAIAGLMA

SEQ ID NO: 110813 - protein, 171 aa, Triticum aestivum
  Clone ID: PAT_TA_5231.pep
MAAMRTILLVVAAMAVLSTASAAIYNVGEPGGAWDLSTNYGTWASSRNFQTSDQIVFKYSPQAHDVLEVSKADYDSCSTANPVTTFNSGNDVVTLTATGTRYFICGFPGHCAGGMKVKIDVIPGSSSSAPAPANGPSASNAPPPTPVSAATNVRATGFGLAILLAVVGLIA

SEQ ID NO: 110814 - protein, 170 aa, Triticum aestivum
  Clone ID: PAT_TA_5232.pep
MAVTRTIFLAMAVMAILSTASAAIYNVGEPGGAWDLSTNYGTWASFRNFKADDQIVFKYSPQAHDVLEVSKADYDSCSTASPITTLNSGNDVVTLTASGTRYFICGFPGHCAGGMKVKIDVMSGSSSSPAPASGPSASNAPPPTPVSTATNVEAIGYGLAVLLAVAGLMA

SEQ ID NO: 110815 - protein, 152 aa, Triticum aestivum
  Clone ID: PAT_TA_5233.pep
MVATNTGELRALFLSLDRDADGRISAAELRGCMRATLGEDMPVEEAEALVASADADGDGLLCEAEFLELAQQAAWAGDAGQEDDELRIRALREAFGMYEMEGQGCITPASLGRMLGRLGAERGAGECRAMICRFDLDGDGVLSFDEFKIMMS

SEQ ID NO: 110816 - protein, 171 aa, Triticum aestivum
  unsure (1)..(171): unsure at all Xaa locations
  Clone ID: PAT_TA_5234.pep
MAARRTILLAMAAMAILSTASAAIYNVGEPGGAWDLSTNYGTWASSRNFQTGDQIVFKYSPQAHDVLEVSKADYDSCSTASPVTTFNSGNDXVVTLTTTGTRYYICGFPGHCAGGMKVKIDVMPGSSSSPAPASGPSASNAPPPTPVSAATNVEATGFGLAVLLAVAGLMA

SEQ ID NO: 110817 - protein, 289 aa, Triticum aestivum
  Clone ID: PAT_TA_5235.pep
MAAATVRSTLPRCLLLLLLLSTALASAATSPRLVLLAPSGSHTPCLDNPPDLTAAADEAGELVRDLGSLPAYVTGSRSSTRAIVLASDYFGFQAPKLRKIADQVADDGYLVVVPDLLHGDPFRDEAKISFQDWLKTHSPVEAAEKTKVLIAALKKQGVSEAGVGGYCWGAKVAVELSKSEEIQVVVISHPSLVTVDDMKEVKHPIEILGGELDQASPPPIVHQFEQALDQNNKIDHFVKIFPGVAHGFACRYNASDAFAVKTAEKARADMLSWFNKYLKKHQELSLHES

SEQ ID NO: 110818 - protein, 137 aa, Triticum aestivum
  Clone ID: PAT_TA_5236.pep
DPRVRPDTRPPQPRWPPEMPPTRRRPRRRSLWWSRSAPSPRRPPTRRPSSSRATTGPSRPPFDPSTTTRRSTPMAPIRHPSPRHPSQPLSMARTPRTRTTWASATRMRTTRTTWAAATRTTTRMPPSPPRLRRQMSG

SEQ ID NO: 110819 - protein, 168 aa, Triticum aestivum
  unsure (1)..(168): unsure at all Xaa locations
  Clone ID: PAT_TA_5237.pep
EPARPSHTLLRSDRGCPSPSPQWRPXSSAPSPPPPPPPPPXPACSAPAAPPPAPPRPPLPPRPRYPXPPPAGRGRPPHAGRRAARAGGPPAAPPPPPPPPRPRPRRAPPPPPPPPPPPPPPPPXAPSPSPRRPPTPPPPRPRSPTPPGPPRAPQSRAATGARSRCRRS

SEQ ID NO: 110820 - protein, 352 aa, Triticum aestivum
  unsure (1)..(352): unsure at all Xaa locations
  Clone ID: PAT_TA_5238.pep
PRVRDSRCLSXMFAAEIFMHRFLLSSAIRTMNPEEADWFYTPVYTTCDLTPWGHPLPFKSPRIMRSAVQFISSHWPYWNRTAGADHFFVVPHDFGACFHYQEEKAIERGILPLLRRATLVQTFGQKDHVCLKEGSINIPPYAPPQKMKTHLVPPETPRSIFVYSRGLDYDTANDPEGGYYARGARASVWENFKNNPLFDIXTDHPATYYEDMQRAIFCLSPLGWARGSPRIAEAVVFGSIPVIIADDIVLPFADAIPWDEIGVFVAEDDVPKLDTILTSIPMEVILRKQRLLANPSMKQAMLFPQPAQPGDAFHQILNGLARKLPHSKSVYLTPGQKALNWTQGPKGDLKPW

SEQ ID NO: 110821 - protein, 525 aa, Triticum aestivum
  unsure (1)..(525): unsure at all Xaa locations
  Clone ID: PAT_TA_5239.pep
HASGSLSSVKTLYLQNNQLTGSINVLADLPLSDLNVANNRFTGWIPSQLKKINSLQTDGNSWTSGPAPPPPPFTAPPSNRRKSPAKKDSGSSSSDGKSGISGGAVAGIIISLLVVGAIVAFFVIREKRISKREEHFEQHQPFTSFPSNEVKDMKPFXESTTIDVDSLASPASVGLKPPAKIERNKSFDDDDDFSSKPVAXKSNTKPIKAVVYSVADLQIATDSFSMDNLVGEGTFGRVYRSQFNDGKVLAVKKLDCTVIPFQSSEDFVELVSNISILHHPNLNELVGYCMEHGQHLLVYDFHRNGSLHDLLHLSDEYSKPLSWNSRIKIALGSARALEYLHEVCSPSVVHKNFKSSNILLDSEYNPHVSDAGLASFIPDAEFQTAEQSAGCTAPEVDMTGQYTMKSDVYSFGVVMLELLTGRKPFDSSKPRSEQSLVRWASPQLHDIDALDRMVDPALKGLYPAKSLSRFADVLALCVQAEPEFRPPMSEVVQALVRLVQRANMTKKMLDGDASRRGDDQDQDFI

SEQ ID NO: 110822 - protein, 211 aa, Triticum aestivum
  Clone ID: PAT_TA_5240.pep
MSFTGTQDKCSACEKTVHFIDLLTADGVIYHKTCFKCSHCKGILSMCSYSSMDGVLYCKTHFEQLFKETGSFSKKFTQGNRSGDKNELSRAPSKLSAAFSGTQDKCAACTKTVYPLEKMTLEGDAYHKSCFKCSHGGCILTTSSYAALNGVLYCKIHFQQLFMEERKLQPHERRRAPRRRCCPIWWRQPKSNRRQRRQRRHRRKMKNREEN

SEQ ID NO: 110823 - protein, 278 aa, Triticum aestivum
  Clone ID: PAT_TA_5241.pep
MTLGRASIIRKRRRLKGGSFHCFAALHLSRHLGRRKKKKKKKTASRFSGVRKEGSGQLKGWQVNGGAERAGRERLQAAAAMENEFQDGKEEVIQAWYMDDSEEDQRLPHHREPKEFIPLAKLSELGVVSWNLNADDWEKDENLKKIREARGYSYVDICDVCPEKLPNYEAKLKNFFEEHLHTDEEIRYCLEGSGYFDVRDQNEQWIRIAVKKGGMIVLPAGMYHRFTLDSDNYIKAMRLFVGEPIWTPYNRPHDHLPARKEYVDKIINRGGNQTVEAR

SEQ ID NO: 110824 - protein, 113 aa, Triticum aestivum
  Clone ID: PAT_TA_5242.pep
MAFDIDSLPPLLGPDSDSDSDSDHLPPAPRRGRPLRPPPAPRVEPSPPAPRRCEATPAPEGTGGAAQQSWPGLPRGVEFNPSDSDLLWHLAAEMGNGLAHRHPFISEFIKSGD

SEQ ID NO: 110825 - protein, 178 aa, Triticum aestivum
  Clone ID: PAT_TA_5243.pep
MMSLYKACSAIDDVLQFLKDSLPDVPMAIAHGKKVSKNIQLAMEKFSCGEIKILVCTHIIESGIDIPNANTMIVQYAELFGLAQLYQLRGRVGRSGREGFTYLFYTDKSLLSRIAMDRLGAIEEHSDLGQGFHVAEKDMGIRGFGSMFGEQQSGDVANVGIDLFFDMLFDSLSKVSSF

SEQ ID NO: 110826 - protein, 63 aa, Triticum aestivum
  Clone ID: PAT_TA_5244.pep
LQNYTLPVMNPMHLLVTMLDFLHQKASEESWRSSLQQESEPEFFNAIDEQHFRISIVHHTSHC

SEQ ID NO: 110827 - protein, 455 aa, Triticum aestivum
  Clone ID: PAT_TA_5245.pep
MARDEPSAAAVDVADGDSPSSSPTLTRLREALAALSKAFESGDTASSDAAAALVAEILSPSDADASAALSEQMLREVHAFLSRPSSNQMAIDALSLELPKPVAKLGARMGNCRDIARTIIEFFVSNCSPRDMLCILCEALDTPVALNGSAYLVILLDGLASTLILIQRRHIEQVKVVLPAILRVMHANLSECDGEHGMSAVDLFSAALRIGNAIQEMCKTMVNHRKEELCSILGLYALQNIALVSSESKHQNIQSTCGSVVLQYSKLLMFCGFTYLGLLTGNDVTSATTKLSKEEDDNFLDCFSSAMDGASLVVVWTSMHDDMSKYAGAEFESALKEVQDNCIRKWEAINMFRYVLSSVNYSWAIKSHSLDLLLTLVDDKCSEETNDHVHFPYSTQIFATLNAIERVMIAAPDTLMRKKAFSALKRVISAVPSTQRFDILQALIENSMFPSLTAI

SEQ ID NO: 110828 - protein, 132 aa, Triticum aestivum
  Clone ID: PAT_TA_5246.pep
MDLIDHKDFGESPPWASQVLELVELILRPPEGGPPCLRDHSEEVLSALNLLRLILIIDSRGSRSAKMLRDEKIRAVYSEWLLPLRSVVTGNQSELEKDGGDDDENQMACLLNPVQLVLHRCIELVEEKMKGL

SEQ ID NO: 110829 - protein, 242 aa, Triticum aestivum
  Clone ID: PAT_TA_5247.pep
SARGSILLRERTLIFGGKSYYGALLCCSWSADGKYILSGGEDDLVQVWSMDDRKMVAWGEGHTSWVSSVAFDSYWSPPSSDDAGENAMYRFGSVGQDTQLLLWDLAMDEIAVPLRHPSSGSPTFSSGSPSAHWDSACPPPTGVLQARARMRDVPKLSPLVAHRVHADPLSGLEFTSESIVTICREGLIKIWARPQHSENSQRPNSSELAAGNAISKDKMITSPNKAGASSSSFKQPSSVIFS

SEQ ID NO: 110830 - protein, 103 aa, Triticum aestivum
  Clone ID: PAT_TA_5248.pep
FFSALSSLFFKPNAYAIIIHDMSDSSRGDTYPLPCIPLTGGSVTKIHGSLTSIKLDEIEGLTKYLNILDPDKCHRLGRSWNETYKPGWLTNIGFAQETPPNLN

SEQ ID NO: 110831 - protein, 205 aa, Triticum aestivum
  Clone ID: PAT_TA_5249.pep
SNVEKWRELWRSCSCYCAPVQASSQVAPAQGLRMKLTHVDDKAGYTTEERVRRAVSVSRERRASTQQQQQRRAFGDVSAPVHLATRQYIAEYLIGDPPQRSDALIDTGSNLIWTQCATTCLKACAKQDLPYYNLSSSASFAPVPCADSAKLCAANGVHLCGLDGSCTFIASYGAGSIIGSLGTEAFTFQFGAARLAFGCVSLTQI

SEQ ID NO: 110832 - protein, 147 aa, Triticum aestivum
  Clone ID: PAT_TA_5250.pep
GPKFEAKVPKSLYSLRDSLEASSIQGPGGRDPAHAGGAYGGRSEEVTRQLNHSVVQPPGDTGLDLCVARQDVNKVVPALVFHFSGGADMAVPPGSYWGPVDKSTACMLIEEGGYESVIGNFQQQDLHLLYDIGKGELSFQTADCSVL

SEQ ID NO: 110833 - protein, 137 aa, Triticum aestivum
  Clone ID: PAT_TA_5251.pep
VSVAMTTTGIAEKHTDDGRPRSTEQTVFDVEKSPPGCRQCVQLQHIAYRPCPNRFLSNRPAVLSLVAIAAVCVCVGLIMQSPPVIRGLPGPFLWESHPLGTHLKRPVGCRFCYSLCTPRVRMLVNCDRPKCKFLYII

SEQ ID NO: 110834 - protein, 84 aa, Triticum aestivum
  Clone ID: PAT_TA_5252.pep
VYYRCISAALSYRSATALVLADNKLFSISKSNNTRLRAVLLQVHVVALISPLIRLALPCMKLYTFNFTKLYQVRFQLYLATPAT

SEQ ID NO: 110835 - protein, 279 aa, Triticum aestivum
  Clone ID: PAT_TA_5253.pep
MDVNDVLLLASAVVLGLVWWRRCSKTGGVDGLPPGPPGWPVVGNLFQVILQRRPFMYVVRDLREKYGPIFTMRMGQRTLVIVTDADLIHDALVKQGPMFASRPADSPIRLLFSVGKCTVNSAPYGPLWRALRRNFVAEIVSPQRVKGFSWIREWAMGNHLRRIRAEHAKTGAVRMMASCRLTICSILICICFGAKIPDELIVEIEEVLKDVMMISLPKLPDFLPLLTPLFRRELAEAKNLRRRQLDCLLPLVRARREFLRTGGNACKAAGEGNRVIGGM

SEQ ID NO: 110836 - protein, 158 aa, Triticum aestivum
  unsure (1)..(158): unsure at all Xaa locations
  Clone ID: PAT_TA_5254.pep
SQVSRVKALIIWGLDRPLPRLRVPNSPHVRERSRVRGXPRXGVRXWRLGGRTSVVCLEXXIHYPRGGGQEARRRHASLRRRRXVISFAPKRLYFDVVKRVGELFPGPSKXTRAYLHSEKDIEEALRAAGWRVKNKGFISTQFYFAKLYEAVPVAAGSS

SEQ ID NO: 110837 - protein, 108 aa, Triticum aestivum
  Clone ID: PAT_TA_5255.pep
IPAPPPAPAGPRALLPPHTGMRRRHRLFLLLYVFDVLIKTWGFCCNGRVLLDNTGRPVSWGMDPIQRQALPPNLIQRDGGEALHSPLSPSMAGLTRWSLRVDVLPFCL

SEQ ID NO: 110838 - protein, 84 aa, Triticum aestivum
  Clone ID: PAT_TA_5256.pep
ITLTLYGKQFLCTTTIQTPNWSALVVLVPHVVPFCHLHEHRSFSCTMFLQQIYKPWKKHSISLKTICNITPASLNSSRHPVSHV

SEQ ID NO: 110839 - protein, 151 aa, Triticum aestivum
  Clone ID: PAT_TA_5257.pep
MRALEDDLFPSTPGKVKIERAGGTMNRQLHRCFASTSTMFLWALVRVAMTASYLSFQSFVDTSSKYFAASWGGLHWERQIRASAAPRRPPGSAAGAGMSVLVTGASGFVGAHCSLALRKRGDGVVGIDNFNAYYDPSLKKARKALLTSHGV

SEQ ID NO: 110840 - protein, 305 aa, Triticum aestivum
  unsure (1)..(305): unsure at all Xaa locations
  Clone ID: PAT_TA_5258.pep
IKKSTLSVISEIEEFINEVSILSQINHRNVVKLHGCCLESEVPLLVYEFISNGTLYDLLHRPSEQNSSNLLMPLSWEERLRIATEIAGALTYLHSSASVSVLHRDVKSMNVLLNDSYTAKVSDFGASRLIPIDQTHXVTAVQGTFGYLDPEYYYMGQLNDKSDVYSFGVILVELLMRRKPIIQNEHGKKQNLSNYFSYAMRERLLEETVGAQILGGGRDEGALCGAQVAEARVRLRGAARPTGKGVAPRLQLPGGDREGRRGRREGEAGPAGDDGHGGVDSVVGQHGSRQFSQEHEFVSSLRVPR

SEQ ID NO: 110841 - protein, 186 aa, Triticum aestivum
  unsure (1)..(186): unsure at all Xaa locations
  Clone ID: PAT_TA_5259.pep
GLFTXGIAAPPGLFLPIILMGAAYGRIVALVLQSTGAASIDHGLYAVLGAAALMSGSMRMTVSLCVIFLELTNNLLLLPMTMFVLLIAKTVGDAFNPSIYEIILDLKGLPFLEPKPEPWMKDLTVGELAAAKPRTISLQVVEKVSTVLEVLRNTGHNGFPVVDRPRPGLSELHGLVLRSHLVAVLR

SEQ ID NO: 110842 - protein, 98 aa, Triticum aestivum
  unsure (1)..(98): unsure at all Xaa locations
  Clone ID: PAT_TA_5260.pep
LQRTPEVMSTARELSLXESCIITQLXQGISXSPXDEPKSMRGRRGMWINPAAGRSSSVPTKNPGLLGGVPQLTSSYQSQKAVLYCYIDGLQTFKACMS

SEQ ID NO: 110843 - protein, 413 aa, Triticum aestivum
  unsure (1)..(413): unsure at all Xaa locations
  Clone ID: PAT_TA_5261.pep
MMRTAAVLFLCFFAFTGSGWGGARAAAXMGGGGQADGGGGGGXAWRFPSPRLRDAYVALQTWKQQAIFSDPKNLTGNWVGPAVCGYTGAFCAPLPSPRLPAVPGFVLSHGVGPRGLPSLLALLCDLALLYLYATRSCGLVPDTFRRLVLLHELDLSNXRFVGAFPTVVLDLPSLRFLDLRFNDFXEGGVPSELFDRPFDAIFLNHNRLRFQLPDNFGNSPVSVIVLANNXFGGCLPASLGNMSDTLNEILLINNGLTSCLPPEVGMLREVTVFDVSFNALAGPLPPEVARMQKVEQLDIAHNLLSGTVPEAVCDLPRLKNFTFSYNFFTGEPPSCARVLPADGDRRNCLPNRPAQRMPQQCAAFYARPPVDCAAFQCKPFVPPRPPPPPAYPGPLPPVYPMPYASPPPPPRYR

SEQ ID NO: 110844 - protein, 110 aa, Triticum aestivum
  unsure (1)..(110): unsure at all Xaa locations
  Clone ID: PAT_TA_5262.pep
MVLVHGCPLFVLNHKTRPSFRSRIVLMFYDLPSHHLLYLSIFPEDYKIKRDQLIWRWIAEGFVCHANEEXGPFELQESYFNELINRSMIQPVGIDGESIAKSYCAHNMMH

SEQ ID NO: 110845 - protein, 118 aa, Triticum aestivum
  Clone ID: PAT_TA_5263.pep
FAHLAFRIDRLHSMPHKCFSSAYEINHHIMYTIRFSHAFINIDVNWLNHASIHAPIDPVNQQGQPGPQGGFPLRRPAEKSPRPYTMFVHSTTELKLANPLFFMINKTSNYPPYISNEL

SEQ ID NO: 110846 - protein, 351 aa, Triticum aestivum
  Clone ID: PAT_TA_5264.pep
STPRPLRLLLEQKLRELTSGVRSTYSKPANGVRIYAPSPGLDDTASACDTSSIASTDYDRDSIQSSKDGKDKFPRTDLVLKDDQSSQSVKYDNGFIDQVELEHLHLSPHSTWEASLSTETCSSAESRTNANESRLFSSTEGAATSGSTHYGRVLEVEALSEYSDTASSITATLAETTHPSESSSSCRMEIKFLREILNAISVRDNACSYFERFDSSNILDPHLFEELNGNFRLPVGEEEGKSFGMIRRLLFDCVNEVLSVKCTYYFNAGYSSWFTGMAVLQKLSPEEIYQEMTSLKVAEEWMVDELVYKEMSGPLGSWVDFKTESHEAAKDITAELLESLIDEMVADLLYW

SEQ ID NO: 110847 - protein, 73 aa, Triticum aestivum
  unsure (1)..(73): unsure at all Xaa locations
  Clone ID: PAT_TA_5265.pep
MSAAVACAERATSDMLIGPDWAVNIELCDIINMDPGQAKDALKLLKKRLGNKNSKVQILXPYVLETLSKNCGD

SEQ ID NO: 110848 - protein, 327 aa, Triticum aestivum
  unsure (1)..(327): unsure at all Xaa locations
  Clone ID: PAT_TA_5266.pep
EGPVGVLIIELGIVFHAHEAIGKGVLRNIPVPVAGNINQGTAPPRPAGASFAPLLNVHHEDDEPEDEFSVLSRRSARDGAAAQGNMSSVPRNERPYPSPLLPPPPSTKRPVYTEASSVDYLSGDSYKSEKVPDDFVNPTAPANMSAPSHSKTETDQVPNYDSRSENVPDDFINPTAAPSFSMPSRPTSEPSVNKLESLPDDDFINPTALPGFSSSSTSEDLPKAPWEAQAPVSLPPPPARYGQRQQFFEXQQHGFPGENNEGGYDEMLTXTGSLSLNQRNTENGKSASVSTASRQPKPEDALFKDLVDFAKKNPSSPSKPANSRRTR

SEQ ID NO: 110849 - protein, 188 aa, Triticum aestivum
  Clone ID: PAT_TA_5267.pep
MATGAACYYHPAAGRGSPSSLSPGLGSSQSKVFFISSGGRSSSRWWMRRRRGEGKASRRGINSSSRARARPALFSPAMEWQECSTEIEVDVPCSVAFERPPGQVTIPEWMPFISTVKVLEDKPELSRWTLKYAILGRDVEFSWLARNMTPTKNQKIHWRSLEGLPNRGAVRFFPKSSSSCRVPRPRPR

SEQ ID NO: 110850 - protein, 178 aa, Triticum aestivum
  Clone ID: PAT_TA_5268.pep
MVGNDNWINSYLDAILDAGKSAVGGDRPSLLLRERGHFSPARYFVEEVITGYDETDLYKTWLRANAMRSPQERNTRLENMTWRIWNLARKKKELEKEEACRLLKRHPETEKTRIDATADMSEDLFEGEKGEDAGDPSVAYGDSTTGVSPKTSSVDKLYIVLISLHGLVRGENMELGRD

SEQ ID NO: 110851 - protein, 204 aa, Triticum aestivum
  Clone ID: PAT_TA_5269.pep
MRSSISTKRSRAAAIHNESERKRRDRINQKMQTLQKLVPNSSKTDKASMLDEVIDHLKQLQATVQMMNRMSSMMMPMAMPQLAQMSVMANMAQMAQMAQMGLGMMNMAGPLAQPAYPGLTQPMMHTSTPFVTMQPWNAGAGADRQKQPAAAAVPDAYSAFLACQAAQQNAQQQAQPNGMEAYSRMMAMCQKLSQQQTKPGSSKE

SEQ ID NO: 110852 - protein, 196 aa, Triticum aestivum
  Clone ID: PAT_TA_5270.pep
MATTVGAAPTALDEKARRTRDLLASFYNTDPAAAGAAAASPARPSPTAATASPLESIYSTSFNPEGYMDVLVQQSNLEALLQRHVKMAAEIKNLDTDLQMLLYENYNKFISATDTIKRMKTNIAGMETNMEQLLSKITSVQSRSDTVNTSLFNKRENIEKLHRTRNLLRKVQFIYDLPTRLNKCIKAEAYADAVRF

SEQ ID NO: 110853 - protein, 266 aa, Triticum aestivum
  unsure (1)..(266): unsure at all Xaa locations
  Clone ID: PAT_TA_5271.pep
MLLPCITDSIAKQLEHVILEERSDKKKKKSTRASSRACKSKPARKPAGSNGHEVGFTSTIIMGDPASVKMDQGALGQYDFASSILIDNQPSSSQYTVRDSMHTYTEQLHKEFSKAVDLEKNETSDEKVSAALKSSLKAVGSKNRSQSVTWADDNGSILEASKAYDIDSDAKNLSMEDIDSSLRRESAEACAAALIEAAGAISQAHQEVEDAIPKXRXIKSARPAPARTEKQGEGQGVYRTVSCNCTSNEFSRSGHTETSLKWQYWG

SEQ ID NO: 110854 - protein, 134 aa, Triticum aestivum
  unsure (1)..(134): unsure at all Xaa locations
  Clone ID: PAT_TA_5272.pep
AMKALGLAKVYTLGPLPLLAREEPPTPRSAINLSLWKEQEECLQWLEGREPGSVVYVNFGSITVMTSAQMVEFAWGLAQXIIRPDLVKGDTAVLPPEFSAETVERGLVASWRAQGVVLPAAARVVDPPRRGRLS

SEQ ID NO: 110855 - protein, 78 aa, Triticum aestivum
  Clone ID: PAT_TA_5273.pep
TPAREFFLGGPKKKLLLCKHGEVNFGPLKRPPPFFFFFFFFFFFFFFFFFFFFFFFFFFFFFFFFFFFFLPHKLRFEY

SEQ ID NO: 110856 - protein, 368 aa, Triticum aestivum
  unsure (1)..(368): unsure at all Xaa locations
  Clone ID: PAT_TA_5274.pep
MKLNVKTLKGTSFEIEATPESSVGEVKRIIESAQGQNVYPADQLMIIYQGKILKDDTTLEANKVAENSFLVIMLSKPKASSYSVXLLHSKAPASQSQPATPPGPWCPSCRITTLSAVSDTPGPAVTGSNIANFYGQSGSIRVCGAALENETPEIGAGGNVLGALAADVPQALQVXLKEEREAIQRLEAMGFNRELVLEVFFACNRDEELAANYLLDHGHDTYQYQYSNLGAGVGAGAGALDALRQLPQFQALLALVQANPQILQPMLQELGKQNPQILRLIQENQAEFLRLVNETPESGAGGNILGALAAQMPQAVQVTPEEREAIQRLEGMGFNRELVLEVFFACNRDEELAANYLLDHGHEFEEQQ

SEQ ID NO: 110857 - protein, 238 aa, Triticum aestivum
  Clone ID: PAT_TA_5275.pep
MKTVSLGAPRSSTVKFRMPTRDNLVPIRVDIEVDGQRYRDAFTWNPRDPDSEVITFAKRTAKELKLPATFVPQMLQSIQGQLAEFRSYEGQEMQVKEKIMPLKIDLRVNNTTIRDQFLWDIGNLESDPEEFARTLCDDLNITDPEVGPAIAVCIREQLYEIASQTVSAMREAKMSKKRRAPEFASNSKAMNNAVDMFKYFGSKGSVIRKRKEWYLYEPVVDVVPKEEAAVVDAKEQLK

SEQ ID NO: 110858 - protein, 249 aa, Triticum aestivum
  Clone ID: PAT_TA_5276.pep
MVMVDGSLDAEKIAGYFKGKTILITGATGFLGKILVEKILRVQPDVRRIYLLVRAMDAHSAKQRVEAEVTDTELFCLLKEKHGKGGFELFVEEKVVPLAGDVVFENMGLDAPRLEELANEVDIIVNGAATTNFYERYDVALDVNVMGVKYLCQFAKKCANLKMLLHVSTAFAAGDREGLIMERPFKKGETLREGTYLDIDAELRLGGDVKNELERQDGGDMTKRERKGMKELGLERSRHFGWSNTYVFT

SEQ ID NO: 110859 - protein, 74 aa, Triticum aestivum
  Clone ID: PAT_TA_5277.pep
LLASSTLNDSILTTSASIDFVLRQQLKTLHLVSLFTEFSVHSWKHAFSNQLTATTDSFGLSFKIIKCIVWNPVL

SEQ ID NO: 110860 - protein, 97 aa, Triticum aestivum
  Clone ID: PAT_TA_5278.pep
LHLLPSCSPVARASQPSSASHLRRRPPGPAPRRTPAPPSARPTPVPPPAARLDVRRRFHLRRPLRRQPAPAPASSCAASAVESRCNGRPPALPAVSH

SEQ ID NO: 110861 - protein, 213 aa, Triticum aestivum
  Clone ID: PAT_TA_5279.pep
MVAPATLSLRPCATLAPSRAALPRAHAHAGFAPASRPALSVSCPPTRFESLRRAATAVSDRQGSAEPSEKQEGKSRTYYFLVANAKFMLDDEEHFQEQLQEKLRLYEERSKEQDFWLVIEPKFLDRFPNVAKRLKRPAVALVSTDRNWIRFMKLRLDRVLAEQFDAETPEEALASNPAELKFDKPDKWTAPYPKYESGWWEAFLPPKSSNGTA

SEQ ID NO: 110862 - protein, 85 aa, Triticum aestivum
  Clone ID: PAT_TA_5280.pep
MGDAASNHPVLAQSSSDAGHAAGTGGFIALDVAALSSLAGDGPETTPAAPPASTPRTPRVVRSLSRKGSERKQADGDAATGTTGG

SEQ ID NO: 110863 - protein, 148 aa, Triticum aestivum
  unsure (1)..(148): unsure at all Xaa locations
  Clone ID: PAT_TA_5281.pep
MATHHRPLHALLGGGAVADLLLWRRRNASAAAVAGASVVWFLFERAGYSLASVLSNALLLLVVILFFWAKSASLLNRPLPPXVPNLEVSDVVVEKAVXGPLVWVNKVLAVAHDIAINERTILXFIQVIMALWVVSCIGMLFNFFTLVH

SEQ ID NO: 110864 - protein, 106 aa, Triticum aestivum
  Clone ID: PAT_TA_5282.pep
HFFRSQIWQFQVHQLHTFFWCICVSVNFVIAISPTPVSSSRYNSCTHFGISVLWFLYLPLDQFPVGRSRFNLHTTGICVPCIFYLASPISQLADQGSSCHRIFESS

SEQ ID NO: 110865 - protein, 154 aa, Triticum aestivum
  Clone ID: PAT_TA_5283.pep
SHLGSGRRVGVVYKGLSPSCYWSLRRDEALAHSSSSARLATPRLVTTRRAAGCGIEPSRAHSYALLFAGQERRVFDRWGHDLRRRIVGYRLGRGFSPRLSTRGRTYICGALPTLAVTKQNASPPPRPRRSSAAAAAGDSVPFTAYTVDGRAGLR

SEQ ID NO: 110866 - protein, 88 aa, Triticum aestivum
  Clone ID: PAT_TA_5284.pep
TKAYSLQRMFRFCPLLDGGFRMIVHDQLFTSPACAFRNAAPPFLYSFSLLRTSTIKVCIQLALFVAVLPLRVFDCSHTASFCSCWLIN

SEQ ID NO: 110867 - protein, 369 aa, Triticum aestivum
  unsure (1)..(369): unsure at all Xaa locations
  Clone ID: PAT_TA_5285.pep
NSARDEVLHLMAGEEPTTFAEAEQEDCWRHAMLDELASINDNTTWTLTTLPAGHRAIGLKWVFKVKKDEHGTIVKHKARLVAKGYVQHEGVDFEEVFASVARLESVRLILAVAAHCGWEVHHMDVKSAFLNGDLNEEVYISQPPGFVAKGHEHGVYRLHKALYGLRQAPRAWNAKLDASLASLGFSRSASEHGVYSRGTANTLLIVGIYVDDLVIARAEPEEVQRFKGEMHRLFSMSDLGLLRYYLGLEVNQEGGRITITQTAYATKMLERAGMKDCYAVHAPMEARLKLSKDSSXEGXVDATLYRSIIRSLKVXLCTTRPDITFAAGVPGCFMGAPAAVLPAAALPLLRYSPGSLSCGCLSRRGHRQR

SEQ ID NO: 110868 - protein, 232 aa, Triticum aestivum
  Clone ID: PAT_TA_5286.pep
GIRHEARTRRRASPSPALPAPLPHASSPPLHWPSRPHPFRTPFLLSDRWIRSAAARPATPAAAGFNLELHGVAQVWRPDGADSLLLRAPGAPRPHVQQQQQGQQRLEGGAGQLHPLLLLPNVEDGPGAAARPGGGRQPRRLRGHLLDPPQLQIQRGSRGRSPGALRMVSSILPKTFGVHLLVEVPRYWWNFIQGVKHFQYQDCSKFCGTSLLETMLMMMLVQYQDSVSVARV

SEQ ID NO: 110869 - protein, 313 aa, Triticum aestivum
  Clone ID: PAT_TA_5287.pep
MMTMDLIGGYGRADEQVAIQEAAAAGLRGMEHLILQLSRTGTSESSPVGSSEAPEQQVDCREITDMTVSKFKKVISILNHRTGHARFRRGPVVAQSQGPAVSEPAPVRASSSRSVTLDFTKASSGYGNDAGFSVSAASSSFMSSVTGDGSVSNGRGGGSSLMLPPLPSASCGKPPLASSAASTGAGAGQKRKCHDHAHSENVAGGKYGASGGRCHCSKRRKSRVRRMTRVPAISSKAAEIPADDFSWRKYGQKPIKGSPYPRGYYKCSTVRGCPARKHVERDPSDPSMLIVTYEGEHRHTPADQEPLAPLPEL

SEQ ID NO: 110870 - protein, 126 aa, Triticum aestivum
  Clone ID: PAT_TA_5288.pep
RPTRPSNSSSSPSNFKHRDNLEKQLTFTALHLLGFVSPKDDQSLKDFLIKKASFLEDWLKGLCSAFNSAEDQPLASETINDEDGFSPNVSQKVMLSSAVVSLLNVYTSGNQQVITQRFEQLARSTA

SEQ ID NO: 110871 - protein, 229 aa, Triticum aestivum
  Clone ID: PAT_TA_5289.pep
AASLAQQKSSVVVILLHCIEEEMHFSVRCGALQVLRSVVHNYPSCANIIWEKVRDIVLDLLHTESFEDQKCDANFGPPKEELSTKGRCLVAGIKVIDECLRVSSGFKGADDLKECRLLDIQQFSDCTVNKSIKSAPHFEIETPGPSQNCSLDITLGTNRWTEVLETHLPRGLSHASAMVRTASLTCFAGMTSDVFFSLPVNKRDYVTSSSVHAALSDAVATVRSAACRA

SEQ ID NO: 110872 - protein, 70 aa, Triticum aestivum
  unsure (1)..(70): unsure at all Xaa locations
  Clone ID: PAT_TA_5290.pep
MSSGRYMAYSPSPSTTPHSPRISGLRAXXAGVDDQEKYLAELLAERHKLNPFVPVLPHSIRPGESSELTM

SEQ ID NO: 110873 - protein, 286 aa, Triticum aestivum
  Clone ID: PAT_TA_5291.pep
MSSGRYMAYSPSPSTTPHSPRISGLRASSAAVADQEKYLAELLAERHKLNPFVPVLPHSIRLLNQEILRVSTLLENASLLNQSGFEHGSPLTLGGLYSNGAATDMNGWTSAFQSESSSAYSWLGGSQGSSSGLIVKKTMRVDIPVDKYPTYNFVGRILGPRGNSLKRVEATTDCRVLIRGRGSIKDPAREEMMRGKPGYEHLNEPLHILVEAELPVEIIDARLMQAREILEDLLRPMDESQDFFKKQQLRELAMLNGTLREEGMQRSGSASPFHNSLGMKRAKTRG

SEQ ID NO: 110874 - protein, 320 aa, Triticum aestivum
  Clone ID: PAT_TA_5292.pep
MAAACRFAAPLGLAPLPRGRNVAKGIAFSAGSAKAAPRGVATKAASGTSGGEETPEVVGPLYCTGIMKRAEEVLLSTQVEETSGPPSDKDLKRNMNLLQQLGILPCGATAWLSFAQSAQSSEGVKLNMVYEVGELFELGIQLSYLLILLGLLGTGTFFVIRQVLVRRELDLSAKDLQEQVRSGEGSATELFELGAVMLRRKFYPAAFKYLQQAIQKWDRDEQDLAQVYNALGVSYKRENKLDKAIKQFEKAVELQPGYVTAWNNLGDAYEQQKDLASALRAFEEVLLFDPNNKVARPRRDDLKSRVGMYKGVPVKTTDKR

SEQ ID NO: 110875 - protein, 189 aa, Triticum aestivum
  Clone ID: PAT_TA_5293.pep
MGGAEHAMDSVAVVAVPFPAQGHLNQLLHLSLQLASRGVDVHYAAAAQHIRQARTRVHGWGEEALRSIQFHDLGISSYVSPPPDPTADSPFPSHLMPLFEAYTASARAPLAALLEDLSGSCRRVVVVHDRINAFTAEEAARLPNGKAFGLNCVAVSMLVGRIDTNHRLLRENGVILSYVERYATYEFIE

SEQ ID NO: 110876 - protein, 178 aa, Triticum aestivum
  unsure (1)..(178): unsure at all Xaa locations
  Clone ID: PAT_TA_5294.pep
MERKQADYSNLDERYTIQGERYQGQQYSHIYYTRLHHMRTLLHALVPSRKPHLPVTTXVLGLEEGKXDCVLVGTLYKHMKLKPSILDEYSKXERSAIPLVKPHKFMHSDDNLILGDXSGRLTLPGAGPPTASGPXVCGALHGSGSSARTWLAHVVVDAGLPPRSVLLFGPDIHYVVFV

SEQ ID NO: 110877 - protein, 231 aa, Triticum aestivum
  Clone ID: PAT_TA_5295.pep
DEGRGGGRRPGGRGDGGGDGGNRIDALGRLLTRVLRHMAPELRLNMRSDGYVRVRDLLRLNLETFAKVPLNSHTVDEIREAVRRDNKQRFGLLEEGGELLIRANQGHTVTTVTSESLLKPILSADEVSVCVHGTYRKNVDSILKHGLKRMARLHVHFSSGLPSDGGVISGMRSGANILIYLNVRKALQDGMKLYISDNKVILTEGFDGVVPVKYFEKIETWPGRAPIPFQR

SEQ ID NO: 110878 - protein, 189 aa, Triticum aestivum
  unsure (1)..(189): unsure at all Xaa locations
  Clone ID: PAT_TA_5296.pep
NSLVISVVAAEVFVSMEIMKPPQSTDPSQKNTQLILKFLPFMNGYFSLSXVPSGLSIYLFTNQCPSVQPQPDMGLRKLGGSKXAMNEGASGIXITAWTSKTFRCSIRARVGERFKQLKEEENRRKAXKALGAGDSNGSTTSRRMKAVQMIDTXEEGGPVEETFATGNDKKLPTYSGKKGKRSKRKRIVH

SEQ ID NO: 110879 - protein, 116 aa, Triticum aestivum
  Clone ID: PAT_TA_5297.pep
QLLRFLEVIDHAALLDEIKHTHLFSNPTLKSQSSFPPPALLGKANLFRFALIHPSALLCSVPLPALAKPHYCPLPPSPTRQYSPRLGSTCWLARRQCPPRESLGSPSLGISHRGRA

SEQ ID NO: 110880 - protein, 253 aa, Triticum aestivum
  unsure (1)..(253): unsure at all Xaa locations
  Clone ID: PAT_TA_5298.pep
MSMQQQQQQPALANLLGAMPAASMISLAFTAAVATAALFVAVAVARYNRKYRGLRLPPGPPGWPIVGNLFQVAFSGKLFIHYIRDLRREYGPILTLRMGVRTLVVISSAELVHEALVEKGAEFASRPAENTTRNIFSSNKFTVNSAVYGPEWRSLRRNMVSGMLSTSRLREFRPARLRAMDRFVARMRAEAAASADGASVWVLRNARFAVFCILLDMTFGLLDLEEEHIVHIDAVLKRVLLAXXVRMDDYXXF

SEQ ID NO: 110881 - protein, 160 aa, Triticum aestivum
  Clone ID: PAT_TA_5299.pep
SLSISSSAVFPIWYGARLLYPFQSPDSLVLQDWPLLGCYLAGSVPCWLASPRSPLTPLLPRASLACCPAARTPVEGCACVSAASACPSPLLRNTPWLCPLLSAALVFRSSACYIKYFTIRRSKYFQSIAERPIIAMAKQSGSLSTSAFYFTWSCQLNNKQ

SEQ ID NO: 110882 - protein, 373 aa, Triticum aestivum
  Clone ID: PAT_TA_5300.pep
MESSPPTITVQVKFAGRTIPVELPTSASTAELKLLLQPLTNVLPRGQKLICKGKVLADAASLSSMQVGDGSKVMLIASQGLHQGEGPITKNSSGLAPSAKRTSNVKDNQTLKPEIISKSRAERWKITGVIALSGSSLKAVPEEVWDCGSSIRVLDVCNNSIEAIPQKIAAVKSLNKLLLTANDISDGGISWEGLSCVDTLTVLSLSQNRLVTLPPSLGTLTFLRELRIANNMLGSLPVEIGLLKQLEILIANNNRITSLPSSIGDCESLFEVDLSSNLLAELPKACGNLHNLKALHLRNNGLNSLPPTLFKKCWRLTTLDLHGTGITNDILRQMEGWEEFDERRRQKYQKQLDFRVGSSGVFDEGADDDNRHA

SEQ ID NO: 110883 - protein, 143 aa, Triticum aestivum
  Clone ID: PAT_TA_5301.pep
SMQDQVWSNDAVTFQEITEDPNIDPPDLVVDRIMMRQQVREFLGILSTREKEIIEHRFGIYDGEPKTLHVIGDMYGLSKERIRQLQNRALDKLKRSVSTQGFDVYLDLLTPNGWLGSASFSLGSIVHTQGNTHVCMYVCSLRS

SEQ ID NO: 110884 - protein, 153 aa, Triticum aestivum
  Clone ID: PAT_TA_5302.pep
SPNFLQKITLNALAQITLKLNSKTHACLNSKHHTNILGTKASYTAAYRSKHQDIIDQNTKIQGITHLQGGSHLHNPPNYNNPWTGDRKQPPHLQLHQRRGEVHKSRTSTSSRESTIKSCIYYASPTTEQVLGKTHKSRISNSGTKSTKSRAEF

SEQ ID NO: 110885 - protein, 170 aa, Triticum aestivum
  Clone ID: PAT_TA_5303.pep
LQFVTPVHGSGGSVDPDNMRTRQVPDRRAEYSFGVVLLELLTCKKPFNLDALGQEKSLSMMFMSAMKENRLEVMLDDGIKDEDNMEILEEIAELAKHCLEMSGENRPSMKEVAEKLDRLRKVMHHPWVQQNPEEMESLLEEPSAMVHSTIVSDQYFSIEKKAVTNLQSGR

SEQ ID NO: 110886 - protein, 79 aa, Triticum aestivum
  Clone ID: PAT_TA_5304.pep
MGKYVELLDMGVRIAARFHSHCPQTARMYYHPPASASAAPGAVDGGGMVPGEGAVAMAMMKRQRRAAIDATEIILYTVV

SEQ ID NO: 110887 - protein, 271 aa, Triticum aestivum
  Clone ID: PAT_TA_5305.pep
PVREKIFLLLDATQTSLGGAKGKFPQYYEAYYELVSAGVKFMNRPNVVITQVHNPVPEAIIEPNKDNLSSRSNGVQQEANVQPVSDTSIIRKASSVMEVLRDVLNSMDPRHPEGATDEFVLDLVEQCTFQKQRIMHLVMTSRDEAVVSQCIELNEELQKVLVRHDTLLSVHPTTTTVPSNLKEDEEEEDAESLYRRLRKGKALSQDHIDESVPSFRSIPEEKMRRALTIQPPLPDRKPTALNIRSPDHPEARPDPAVLIPPPPAKHAERER

SEQ ID NO: 110888 - protein, 194 aa, Triticum aestivum
  Clone ID: PAT_TA_5306.pep
APLPRSPPPLPWPPPAPGPPRSTKRELSAAEPSVLSTSRLLSPSVRSSIFVEQREGERRSSDSREIHGEVRGAAGHGGAHRRAVPLPLPADGPDVLPPPRLLLGRPRRRRRRPDGARRRRRGHGHDEEAAAGRHRRHGDYSLHRRLGRPVAAALIRIYRTIEGRERCYLILLLPLFYFRIEEREMKDGRECSID

SEQ ID NO: 110889 - protein, 477 aa, Triticum aestivum
  unsure (1)..(477): unsure at all Xaa locations
  Clone ID: PAT_TA_5307.pep
HASADAWGRSSRPVSSPPTRRKAASRTAPDQTPESEPRSKGKTPSAAAAAAMESVEALVAHIQGLSGSPWKLAQLHGLLKQADGDALRGHSAGLLPFLSHLHPGSHSLGYLYLLDSFVSSSANLRAHAGGDLLVTVADFLTSCPAAAGTLLPPWPINACRARQTRYAWPPDKFMNVCRVLKNEVMQLNAPIRGIAPLRAAVRKIQTSSEQLTPLHAEYLMLCLLAKQYKAGLSVLEDDIFEVDQPKDLFLYCYYGAMIYIGLKKFXITVGAYKKYVLVSLLQSGQVPSFPTYTSSTAQRNLKNHTQIYVDLSTCYGTGSYSDLETFIQSNAEAFQTDNNFGLVKQVLSSMYKRNIQRLTQTYLTLSLEDIASSVQLNTPKEAEMHVLRMIEDGEIHATINQKDGMVSFNEDPEQYKSSEMVEHIDSSIQRLMALSKKLTSIDQNISCDHAFLMKVQSGRERARFDYDDFDSVPHKYF

SEQ ID NO: 110890 - protein, 356 aa, Triticum aestivum
  unsure (1)..(356): unsure at all Xaa locations
  Clone ID: PAT_TA_5308.pep
LSMVSGQNDAELDFNAVQRGDAEMAQKLYRVIRACAEMGEKNPIISIHDQGAGGNCNVVKEIIYPKGAEIDIRSIVVGDLAPSAAQVWGAGYQEQDALLVKPESRNLLQSLCDRERVSMAVLGEIDGSGKIVLIDSAAVEHAMLSGLPPPPPAVDLELEKVLGDMPQKTFAFKRVPRSSEPLDIAPEITLMDVLKRVLKLPSVCSKRFLTTKVDRCVTGLVAQQQTVGPLQLPLADVAVVAQTYTDLTGGACAIGEQPIKGLLNPEAMARLAVGEALTNLVWAKVTSLADVKASGNWMYAAKIDGEGADMYDAAVAMADCMIQLGIAIDGGKDXPFYGNNDGRTYPKPRKPGYPLK

SEQ ID NO: 110891 - protein, 475 aa, Triticum aestivum
  unsure (1)..(475): unsure at all Xaa locations
  Clone ID: PAT_TA_5309.pep
MKILYSLRRFYHVETLFNGTVVFAGRVPVTAGLAGRPGNASLINLSGKLLGXAHVAHAGLIVFWAGAMNLFEVAHFVPEKXPMYEQGLILLPHLATLGWGVGPGGEVLDTFPYFVSGVLHLISSAVLGFGGIYHALLGPETLEESFPFFGYVWKDRNKMTTILGIHLILLGLGAFLLVLKALYFGGVYDTWAPGGGDVRKITNLTLSPSVIFGYLLKSPFGGEGWIVSVDDLEDIIGGHVWLGFICVFGGIWHILTKPFAWARRAFVWSGEAYLSYSLAALSVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAVNYVSPRSWLSTSHFVLGFFFFVGHLWHAGRARAAAAGFEKGIDRDLEPVLYMNPLN

SEQ ID NO: 110892 - protein, 188 aa, Triticum aestivum
  Clone ID: PAT_TA_5310.pep
GKKTAGNDYEAERRGTGRVSESGEAEIERAKANTRLNKQNNHWITVVMNSGKRETEDLDSSRTGQRDPATSEDGGELSRQLAGESPEAKASGKGTSPGAWKGPLPTEDMATHDDGSTRGRHPLRRVQYRDGDNRTEKISQTPMEAARGIMRAQPIGPDRHKPGEENKKGERIPRQKDGPGRGGDMQAP

SEQ ID NO: 110893 - protein, 298 aa, Triticum aestivum
  Clone ID: PAT_TA_5311.pep
MLMRRRRQRPVLPRLLLATLLIASAVAFLPRAAGDAAEAGDEGRVGEAVAAVERADAAAAALGAAEAGGEAAQGNATTKEHSLADMIDRALEKEFPDSEGDQGGGETDPGSFNNTVAEKQGVLETVARRVTKKNETKDNNSFPFKEVFLDRSEQEDVPTLIDRKDNVFIISNRKSKYPVLQLDLTLISDLVVVIVSATCGGITFACLGQPVITGYLLAGSIIGPGGFSFVNELVQVETVAQFGVIFLLFALGLEFSTAKLRAVRAVAVLGGLLQIIHFMFLCGISATLCGGKTKGGCF

SEQ ID NO: 110894 - protein, 48 aa, Triticum aestivum
  Clone ID: PAT_TA_5312.pep
SRDTLEDHVFRDYKTMLGRNCRVELHRRKWANDYPTPHCDKLRSLDVA

SEQ ID NO: 110895 - protein, 202 aa, Triticum aestivum
  unsure (1)..(202): unsure at all Xaa locations
  Clone ID: PAT_TA_5313.pep
LSPLPPAREPTPPRPARPADPGPPRGRGFSPPPPRPVQPPGFRPRPPPPPAPPAPPXPPPPRRPPAPRSPPPLAPPRAAVPRPLAAPXPAPPAARRASRRPPPAPAPPPPTPPPAPEPATPAAAPPRSPPSRPNRPPSPTLHMAPLRWTMRQRSLKILMMILRGTTTRLTLISGRSTTCCPMKMSFSLGSRMRWSHLRRRIL

SEQ ID NO: 110896 - protein, 128 aa, Triticum aestivum
  Clone ID: PAT_TA_5314.pep
LICIYILNIIYDNTDLQSSSGAIFFKYRVQSIFLGVCHIRMSSRQPHISIYFSRISDFPQASTLLCICHLTACLVCFSIQQKTTTILTVQPSNASGTSLLRRGMLEWKAMERRSHVMACNYVMLAMYL

SEQ ID NO: 110897 - protein, 201 aa, Triticum aestivum
  Clone ID: PAT_TA_5315.pep
IRHERFSILWSSSSVVFYVDGTPVREAQRRRSRRRFTDDGMGPDGDDSDMGADYPSKPMAVYVTIWDGSTWATENGKHTVDYGHGPFTAEFSGLVLRGCPADAGADIRQLHLGASTQRCATAEWELMTAEYAVMTARKRADMRRFRRRQMVYTVCYDTDRYPAALPECEVNAAERQMFERWGRVQGLRSAPGRLRRRRLCP

SEQ ID NO: 110898 - protein, 312 aa, Triticum aestivum
  Clone ID: PAT_TA_5316.pep
MRGPGAVKAGSRPPWLGLSAAVWVQVAGGASSTFALYSHALKLALGVDQRRLALLAVACDVGENLGLLPGVLCNRLHPALLLLIGAAACVLGYGTTWLTVSGAAPALPYWLVWLALCLAANSGAWLGTAVLVTNMRNFPLSRGAVAGILKGYAGLSAAVYTEIYTGILHDSAASLLLLLALGVPSVCFLTMYFVQPCQPSLVPNSSEQVHFLFTQIGSIVLGVYLVGATVLDHVVTLSDAVNYSLVVIMVLLLFAPVAIPLKMTLFPSNRRKGPSDSSGADSDHTEPFLPPSASGSNLNDLDDEDSFDIDIL

SEQ ID NO: 110899 - protein, 328 aa, Triticum aestivum
  Clone ID: PAT_TA_5317.pep
HRITEHNAGFLTLRQHTENTRRKSMLASKWSALVKKDSVDDLFLINSYGFYAYDTVWILAYALDAYFSRGGNISFSNDTKLHEVGAGGLQLKAMTVFDGGRLLLERIQQVNFTGATGPVKFDTDGNLIRPAYDIVNIVGSGPRTVGHWANYSGLSTSLPETLYMKPAKRIRGDQKLHTVIWPGETTVRPRGWVFPNNGIELKIGVPNRASYRQFVSVDNNSGTVRGFCIDVFVAAANLLQYPVPFKFVPFGDGSQNPSYPDLINNILTNEFDAVVGDIAIVTNRTRVVDFTQPYVESGLVVLTSVKKQSSSGWAFLQPFTIKMWCVTG

SEQ ID NO: 110900 - protein, 120 aa, Triticum aestivum
  Clone ID: PAT_TA_5318.pep
ALAYFAVYSGMFAWGIDPTPVSRRRERVMRSHLEFLASALDGKISLGCNMSLWRAYVSGFLGLVVDRAPCLLHEVDLKVLKKLSIGLRQWKEKELAVAILCRGGPEAMGVAAELILDSEW

SEQ ID NO: 110901 - protein, 149 aa, Triticum aestivum
  Clone ID: PAT_TA_5319.pep
VARPPGLLPQSSPMLFALLCVCPQIHASTPIYICPRGSSNTTTDYSTNPSLPSNNLVVDSRTTLQYTDLQITITKQFITDLFHLVAISPSHDKKLSMAEKYCHVRMFSSSFLLSFSPSARMQCCPRPVALCRGSMFSPASTRSSVSLPP

SEQ ID NO: 110902 - protein, 272 aa, Triticum aestivum
  Clone ID: PAT_TA_5320.pep
MEGMGQKRRPLVVMASSSTTAAQSASRGGANPLAELTDRFRSLEVGVREWMAKQPTHIEAAVTTAFGAVQGGALGGLMGTFAPEGGAGLPVPQPPPGLDPKAMATFKQAQALAGGPLVQARNFAVMTGANAGISCVMRRVRGVEDVQGSMAAAFGSGALFSIVSGMGTPNPVVNAITTGMAFAVFQGGFFIVGQKFSKTKTHNEDMNYSRARNMLNQLGLQNYEKNFKKGLLTDETLPLLNESALRDVNIPPGPRLVILEHIKREPGLTKSN

SEQ ID NO: 110903 - protein, 225 aa, Triticum aestivum
  Clone ID: PAT_TA_5321.pep
TVRRRKVPEWARSALSSSGNPPPESVHKYVRDECSKWNLVWVGKDKAAPLEPHEVEYLLGFPRDHTRGVGKTQRFKSLGNSFQVDTVAYHLSVLKGMFPNGVRVLSLFTRIGGGEVALHRLGIHMRTVVSVEIGEVNRRILRGWWDQTQTGTLIEIADVKSLTDDRIATFVRRFGGFDLVIGGSPCNNLAGSNRHHRDGLEGEQSALFYHYFRIVDAVKSAMGRM

SEQ ID NO: 110904 - protein, 254 aa, Triticum aestivum
  Clone ID: PAT_TA_5322.pep
SVGRLVMEASARSNLKPVSLEQGGAGRHRAGDAGDVDMAVGLAIGANFFNKGEACVAASRVYLQEGIYDGFVKKLAQRMESWVVGDPFDPRVNQGPQVDKAQYERVLGYIDHGKREGATVLTGGKPCGQSGYYIEPTVFTDVKDDMIIAKEEIFGPVMCLMKFTSVEEAIARANDTRYGLAAGVVTKDINVANRMARSIRAGVVWVNCYFAMDSDCPFGGRKMSGFGKDDGMHALDKFLAVKSVVTPVYDSPWV

SEQ ID NO: 110905 - protein, 142 aa, Triticum aestivum
  Clone ID: PAT_TA_5323.pep
CQRLVCTLFVLFGEAQRFAKARKWVIDAVASGHALTLSPPLAKLFRDWKGMSKTGMRLYVALYEERNLFIKSKERYGSQVDYFNPYEDVVKEAKEACIDKEREHHRANLCFRTRPTAEVDLSFLLGGELLLVKYTKNSPARH

SEQ ID NO: 110906 - protein, 115 aa, Triticum aestivum
  Clone ID: PAT_TA_5324.pep
GGRFFSSCPKIRLLFLLLFAPNSPLHNTSTPYELSKQITSGTSISEVKQRRPTYSLGSSNAPCPYNNQLMKYALLIFTHQWYYCNCIPQKLLSPPNVDGGWTAAYAGNSCGAAAH

SEQ ID NO: 110907 - protein, 92 aa, Triticum aestivum
  Clone ID: PAT_TA_5325.pep
CRRHALDLQMDLISTCEGVALSAPASEQSTGKDNPQAPGWAKRIRMGRAPDDERPPCAARMSALEMALPSYAEKKTETVIVPAMQKRKLKLS

SEQ ID NO: 110908 - protein, 223 aa, Triticum aestivum
  unsure (1)..(223): unsure at all Xaa locations
  Clone ID: PAT_TA_5326.pep
GQVQVLNDKMLKLDGADXAVLLLAAATSFEGPFVKPSESTLDPVTSAFTTLNMARSMSYAQLKAYHMDDYQSLFQRVSLQLSRGSNGVLGGSTLAHLPENISQDTAVSDCTVQMVDSSRLNELNNSEKPTVDRIISFRHDEDPSLVELLFQFGRYLLISCSRPGTQVSNLQGIWNNETKAPWGTAPHPNINLQMNYWPSLPCNLSECQDPLFDFIGSLSVNGA

SEQ ID NO: 110909 - protein, 184 aa, Triticum aestivum
  Clone ID: PAT_TA_5327.pep
MASTSSFLRSPASFQPATGACGHVCWAQPLAPPKPHRSPLPPTATPGVPRRLLLPAAAGIWDFLSGGAAGAAGAAAAPLAVRRGMELFKQGDVAGSVAEFDRAIELDPRQKAYLWQRGLSLYYLDRFEDAAEQFRLDVAANPNDTEESIWCFLCEAQLYGVEEARNRFLEVGLDRRPVMREAYA

SEQ ID NO: 110910 - protein, 151 aa, Triticum aestivum
  unsure (1)..(151): unsure at all Xaa locations
  Clone ID: PAT_TA_5328.pep
GVAARGDAVAAPSASRAPGPRPCPPRRRLPPPPPRRLRRPRPRPPAPGLPAPGPAPGPLPPAAPGPPLPRRLRPRRRPPRPRPXPPPRARRRSAPPGAPPAAARRWRPSPSRGRPSPXPGPRPRRRATSWPAGTPSATPTSLRPPWTISTR

SEQ ID NO: 110911 - protein, 274 aa, Triticum aestivum
  unsure (1)..(274): unsure at all Xaa locations
  Clone ID: PAT_TA_5329.pep
MAAAEPSGSSQPGAPGRWSLHGKTALVTGGTRXGIGRAVVEELAALGAAVHTCSRKEAELGERLKEWEARGFRVTTSVCDLSVREQRERLIGDVAERFGGKLNILVNNVGTNIRKPTTEFSAEDYSFLMATNLESAYHLCQLAHPLLKASGLGSIVFISSVCGLVAVFSGTLYAMTKGAINQLTKNLACXEWAKDXIRTNSVAPWYITTSLTEGLLANKEFEASVVSRTPLGRVGEPGEVSSLVAFLCMPGSTYITGQTISVDGGMTVNGLYPA

SEQ ID NO: 110912 - protein, 131 aa, Triticum aestivum
  Clone ID: PAT_TA_5330.pep
SDDQLVALSRDIDPSSPSPLDYYPLPKKGERFPVSDPDMEPRLEPRPDSDADYLHGILESMARIEASGYKLLKELGATPVEEVFTAGGGAQNEKWTAIRERVLGVPVRKAEQTEAAYGAALLALRGATTGS

SEQ ID NO: 110913 - protein, 69 aa, Triticum aestivum
  Clone ID: PAT_TA_5331.pep
GKAEAQVVRVWSRLKNPQKQSKYSSCFRLASVTLHLMDLEVSPWDALIHSDQSTASRWPVETCRWGRRP

SEQ ID NO: 110914 - protein, 134 aa, Triticum aestivum
  Clone ID: PAT_TA_5332.pep
KPKIVAQAWTAEEHLKSCGSPHEASAAGLVGVCPRATRQLPSEPRANTCGGIDRRRKRRRRGGGMTRGKQKIDAQRKSAEKNQKSKGSQLEARAVGLKVVCPICKAQLANEKQLIDHYGSKHPKEKPPGPSNAE

SEQ ID NO: 110915 - protein, 161 aa, Triticum aestivum
  Clone ID: PAT_TA_5333.pep
SAALHCGLHRPIELLQTHQHHPCSAKEWRAQWWQPQSASAASDAPPSPAPRGRFVAARVKASAEAMATEKLGVRVERNPAESRLSELGVRQWPKWGCEKSKFPWTYSAKETCYLLQGKVKVYPDGEEGFVEIAAGDLVVFPKGMSCTWDVAEAVDKHYKFE

SEQ ID NO: 110916 - protein, 199 aa, Triticum aestivum
  Clone ID: PAT_TA_5334.pep
PRVPGPTRGIRAPSPSGPSADTSPCKPISVTRALLQRNGEPNGGNPNPPQQPQIRPSFPSTQGTIRGGEGEGVGGGDADGDGEADGVRVERNPAESRLSERVGVPSGPSGGASKSKFPWTYSAKETCYLLQGKVKVYPRRRGGVLGDRGGGPRVVFPKGMSCTWDVAGALDKHHKCVWPASNVLHGRPLSCLLPVLCLY

SEQ ID NO: 110917 - protein, 98 aa, Triticum aestivum
  unsure (1)..(98): unsure at all Xaa locations
  Clone ID: PAT_TA_5335.pep
PYLVSGASGFALNAITRAMEKDLKAYIESMRSILASDSWNTKTTICWGLRDRWLTYDGVEDFCDGLKHNVVQLPMAGHHAQEDRGEXLGNIIKRILRG

SEQ ID NO: 110918 - protein, 73 aa, Triticum aestivum
  Clone ID: PAT_TA_5336.pep
MQQLAYQYTAKGACLALVARREWSLWQVADRAFELDAQDVIILPGDVADPDDYNRFVQATIDQYDQCKPWKAC

SEQ ID NO: 110919 - protein, 350 aa, Triticum aestivum
  unsure (1)..(350): unsure at all Xaa locations
  Clone ID: PAT_TA_5337.pep
MDLVNGALNWAAMPAMVAALLLFYPPYYLFKLCYSFLSYLFPDDLKRKVVLITGASSGIGEQLAYQYAAKGACLALVARKEWSLRQVADRAFDLGAPDVIILPGDVADPDDCNRFVQATVDHYGRLDHLVCNAGIASVGAFQEIPDVTNYSSQLDVNFWGAVQSTSAALPHLKRTXGRIVVTASATGWNPVPRMIFYNAANAALINFFETLRSELGSEVCITIVTPRGXMESEISKGKFLKEHRGVEVDQEYRDAQIGLFPVECAMNPARAMVQPARQGHGRLTVPSWVRRMXQGDVLAPHAAEFCYRLLYMHRHGAGDQTDAPSKTMAEGCGKPMLYPSSLRSADVKSD

SEQ ID NO: 110920 - protein, 193 aa, Triticum aestivum
  unsure (1)..(193): unsure at all Xaa locations
  Clone ID: PAT_TA_5338.pep
VVLHCDLKPSNVLFDMDLAAHVADFGIAKMLLGDGNSMIVGSMPGTVGYMAPEYGFMGKAXRKSDVFSYGIMLLEVFTRRRPMDSMFVGELTLREWVRQAFPANLVHVVDSHLLQGSLPSICDLNEDFLVPIFELGLLCSSHXPNERLTMSDVVAILNKIKVGIHQKDVSERECGLVNICTCVPSVPPENTTT

SEQ ID NO: 110921 - protein, 251 aa, Triticum aestivum
  Clone ID: PAT_TA_5339.pep
DPRVRPYASAPDKSLTVVPAAQNWIQHQGDVFHFPGGGTMFPNGASSYIDELASVIPLADGTIRTALDTGCGVASWGAYLMDRNILTMSFAPRDSHEAQVQFALERGVPAVIGADAWVKLPYPSRSFDMAHCSRCLIPWKSNDGMYMMEVDRVLRPGGYWILSGPPINWKKYYKTWQRSKQDSEEEQNRIENIAEMLCWNKIYEKEDTVIWQKKVNLNACHNKNGRTSKMCNVQDADDIWYKKMEACITPI

SEQ ID NO: 110922 - protein, 206 aa, Triticum aestivum
  unsure (1)..(206): unsure at all Xaa locations
  Clone ID: PAT_TA_5340.pep
MSKRLMERMLGMFRSRTQVGVDRAGNHYFSRVEEVDGAMKEKRWIEFKGDRDPTTVPVEWICWLNGQRKKAPTPEELAELEARRERVKQNVELLKXKEEEERRSGVRPVKTIGKTDSPNLRSFTQQFPGTSEDKKKEPEKVSKPNDVTDAEDAQNKIMTGLPEPTSTGXSFKPGTWLPPSLNANLYLQLTKCLCLTFFSWPTCCQS

SEQ ID NO: 110923 - protein, 214 aa, Triticum aestivum
  unsure (1)..(214): unsure at all Xaa locations
  Clone ID: PAT_TA_5341.pep
EGPKQFGSLAEYTAVEEKLVALKPKSIDFAXQAAGLPLAIETAHEGLERAGFSAGXSILVLGGAGGVGTLVIQLAKQVYGASKVAATASTPKLELLKSLGADVAIDYTKENFEDMPEKYDVVFDAVGQGEKAVKVVKEGGSVVVLTGAVAPPGFRFVVTSDGSVLAKLNPYLESGKVKPVVDPKGPFPFSQVVEAFSYLETGRATGKVVISPVP

SEQ ID NO: 110924 - protein, 127 aa, Triticum aestivum
  Clone ID: PAT_TA_5342.pep
GTEGRCNNLGEWVWSLHGEARVLDAVDPRLGGEYDEGEMRRVLLVGLACSSPEPERRPGMRAVVQMLSGEADPPFVPAARPSMSFSANHQLLLSLQDSVSDYNALGLNPSDDSSSDSLSSSSRKSTL

SEQ ID NO: 110925 - protein, 108 aa, Triticum aestivum
  unsure (1)..(108): unsure at all Xaa locations
  Clone ID: PAT_TA_5343.pep
GLLLFQHNHTKLDNYKMIRIDSILQRTKVHEYGKHNLKYSQYGNPQKLAYTIPNGRAEACAKTEWSDYVLKLLSPSVSQPGELCTLSPSXFRIDHPCVHMXGPRELVA

SEQ ID NO: 110926 - protein, 243 aa, Triticum aestivum
  Clone ID: PAT_TA_5344.pep
MGSARGDPPARAGSRGLAAASHASSSSPVLLHVNGGGGRQAHLLSRKATGNAAGLLSGRTRRRGLSAVASAATANVRPASPRGVSASDVLWPSAGAFLAMAVLGRMDQMMAFKGVSLTIAPLGAVCAVLFTAPDSPPAKSKYNMFIAQIGCAAIGVLALSLFGPGWLARGAALSASIAFMTITGSSHPPAASLPLLFIDGPKFHHLQLWYPLCPGAAGCAILCAIHDCGARSSLGLPAAPSFA

SEQ ID NO: 110927 - protein, 242 aa, Triticum aestivum
  Clone ID: PAT_TA_5345.pep
EFGTRRTLALCLAAASHRCSRSRSASLSARCRSAPSPPLPLPYLCRPSSPPRIHRSNTSGAPWGGTTDFSHHRSPWNGNKGLGCRRALFLQVVAAGAGCTLLPLAEDDEGEDAEADKGGGGGGVRPVAIRCGRPPTTTSRAGRARWHSPGSPAAAAGRRPPSSPSRRGATRRCSTWPSSSTRASRSSSPAASKARPDAPSPRSGHPMPGRLWMPRTSRLAVLLQLLLPRSCSTLLLVSCRRI

SEQ ID NO: 110928 - protein, 110 aa, Triticum aestivum
  Clone ID: PAT_TA_5346.pep
MGAPKQRWTSEEEAALKAGVAKHGPGKWRTILRDTDFSAVLRLRSNVDLKDKWRNLSVTAGGYGSREKARMALKQGKRVPKVNTEPMDVDADNLDNVHVTVIPANPLTNI

SEQ ID NO: 110929 - protein, 183 aa, Triticum aestivum
  Clone ID: PAT_TA_5347.pep
HASALHHNQRSLVRPPPPLRHHRRRSLVRLPSPSSPASPLPSRPPLPFESDHISGRGGPRARHARASARRRWMRTRRLGTCTPYSTLFLPIRPRSARGGARGRHAHRRRWVPPSSWFPRHRQHEPLHPLPRDRPGPGNLSLPDPAVCSSPSIRLVARCIASLRYHHEYSFSRLSIFCSVKGLC

SEQ ID NO: 110930 - protein, 394 aa, Triticum aestivum
  unsure (1)..(394): unsure at all Xaa locations
  Clone ID: PAT_TA_5348.pep
LDKSNTRVSLKKHRSGSFLGLRSTGEESSDSMASKLVVLGIPWDVDTEGLKEYMSKFGPLDDCIVMKDRSSGRSRGFGYVTFASVEDAKNVVNSEHILGDRTLEVKIATPKEEMRAPGNKKATRLVAAPLPPSLHLSDMXHEDAMTXENMIXMPGCLGSRILCGIGFVTFRSAECVDNVMQENHEIDGSTVVVDRATPKDEEVRHPPRRGGGAQGEGGYGSYNAYITAATRYAALGVPTLYDHPGPAYGRGYLNEPPVSSKKIFIGRLPQEANTDDLWDYFGRFGRIVDAYIPKDPKKSGHRGFGFVTFAEDGVADRVARRSHEILGQEVAVDSAAPVEGGPSRGGYMEPPAPHGAYSPMMSYGQFSGSLGYDYGYGPSGSSSRSRVQPRYKPY

SEQ ID NO: 110931 - protein, 127 aa, Triticum aestivum
  Clone ID: PAT_TA_5349.pep
MISCLGHAHHCMPPHAQSFSPWKDLNIRKAPTGPGRAGQPGRGLSHGGGPGPLGPANPGGDPAQAGARRAAAAAPQVRDRRRTGGSAGSAARGRRSRRGRPAGEAAAAGNRSQRPATPWAPGPRGRI

SEQ ID NO: 110932 - protein, 175 aa, Triticum aestivum
  Clone ID: PAT_TA_5350.pep
AQNTCPQAAAFLACRAKQTPQGTKTGKHQSPYTRVSHTYSYSYLRTTTHPLFSIFSSAVAPRLLRSYKQSLYNLSFCSRNHVLALRPSSHSLGFCSPAQTSSMENPWIGDRRTVPSLRGHRSNLLMMSAISPPSRRRDLIEQILSLILFSVSVGAAADDIRAISATSALKARTRA

SEQ ID NO: 110933 - protein, 98 aa, Triticum aestivum
  Clone ID: PAT_TA_5351.pep
FSISSEAWIICTVALGLRLIAASELASYSSESFAYVDERGPSSKVMCDAIHRLPFEPGGLHLHHVKGAWKFLYTDDPMAPATDLPGGRSKSLSEFVAV

SEQ ID NO: 110934 - protein, 266 aa, Triticum aestivum
  unsure (1)..(266): unsure at all Xaa locations
  Clone ID: PAT_TA_5352.pep
TRKHYVRWRQYILSREDMQVYQSIANAINDITRHQPFRDICFRNTHQLYDLLAADVGDSEFAAMLETHCSDKNVRQLFMPLRGRLCLRPLVDCKTPAVIQVDGSEPGEAKENELKLLSERLVQSLDTLQPAKFHWQWVELRLLLDEQALAEKLDKAEKSKIPMPILMTLADGLRKLSPNSESFTLSESEKGFTEIILSRLVARPDAAPLYSEVVHLLGKLQESLVVDVKWILQGHDAVLGRKSTXQQLLTIATRRGVPIKAHVWKP

SEQ ID NO: 110935 - protein, 230 aa, Triticum aestivum
  Clone ID: PAT_TA_5353.pep
VRGRVGDTTSSREEKQTVLRALSSSPFKDYRVWWSLSDSKYAGTAVFMKKKFEPKKVSFNLDRTSTKHDADGRVIIVEFESFLLLNTYAPNNGWKEEENSFQRRRKWDKRMSEFVQQVDKPLIWCGDLNVSHDEIDVSHPDFFSDAKLNGYIPPNKEDCGQPGFTLAERQRFGNILSQGKLVDAYRYLHKEKDMECGFSWSGNPVGKYRGKRMRIDYFVISEGLKDRIVS

SEQ ID NO: 110936 - protein, 231 aa, Triticum aestivum
  unsure (1)..(231): unsure at all Xaa locations
  Clone ID: PAT_TA_5354.pep
ATSDCADGPAPTAADAGGDGPPGEEPRRFVTWNANSLLLRMKSDWSAFCQFVARVDPDVICVQEVRMPAAGSKGAPKNPSELKDDTTSSREEKQTVLRALSSSPFKDYRVWWSLSDSKYAGTAVFMKKFEPKKVSFNLDRTSSKHDADGRVIIVEFESFLLLNTYAPNNGWKEEENSFQRRRKWDKRXLEFVQQVDKPLIWCGDLNVSHDEIDVSHPNFLSDAKLNGYIPP

SEQ ID NO: 110937 - protein, 332 aa, Triticum aestivum
  Clone ID: PAT_TA_5355.pep
MKRFFQPVLKDGSPAKKRPAGVATSDCADGPAPTAADAGGDGPPGEEPRRFVTWNANSLLLRMKSDWSAFCQFVARVDPDVICVQETVLRALSSSPFKDYRVWWSLSDSKYAGTAVFMKKFEPKKVSFNLDRTYGRVIIVEFESFLLLNTYAPNNGWKEEENSFQRRRKWDKRMLEFVQQVDKPLIWCGDLNVSHDEIDVSHPNFFSDAKLNGYIPPNKEDSGQPGFTLAERQRFGNILSQGKLVDAYRYLHKEKDMECGFSWSGNPIGKYRGKRMRIDYFVVSEGLKDRIVSCEMHGHGIELEGFYGSDHCPVSLELSKEAAEAPESKSSG

SEQ ID NO: 110938 - protein, 187 aa, Triticum aestivum
  unsure (1)..(187): unsure at all Xaa locations
  Clone ID: PAT_TA_5356.pep
MVLDPLCSYSISWIWTPNGEYTASSAYSAQFIGSYGTAXFETNTIWRTHAEQKCGLFSWLVLHNRILSTDCLVLRGWLTTPSASLAXSSLDTATHLCKDYPFTAAVRFTVLSWQGVHLSPSLVTTIPSIDAWWEGLLRSSSKDTKRFHSSHIIYIMWNVWKERNWRIFNGISMTYIEVAHLTIEDIA

SEQ ID NO: 110939 - protein, 137 aa, Triticum aestivum
  Clone ID: PAT_TA_5357.pep
CDLCLPEFTPVLEQLLVTSSRGHGEVFKYLAVKPWSPLLLGIASLGWRPPLRAFTERRNTAFRERSGQLGVGFLQQHPQGHRGSRRGAVQKSAMPPRTICSASGGRSVFGFSYYRSAAAPAASGIQSREERRSRAEF

SEQ ID NO: 110940 - protein, 128 aa, Triticum aestivum
  Clone ID: PAT_TA_5358.pep
SMSIDQMETVAQGRVWSGQDAASRGLVDSLGGFSQALAIAKQRAKIPQDKKVRLVEISKASPTLPEILSGIGGSILGVDRVVKGVLQDVTSLNGVQARMDGILFERLENMPGENQLFLLVKEITNYFG

SEQ ID NO: 110941 - protein, 242 aa, Triticum aestivum
  unsure (1)..(242): unsure at all Xaa locations
  Clone ID: PAT_TA_5359.pep
CLCVRTVRQSVTLRSQEGASGGGNGGVASPYRIGEKSWGGSTSFPARKKKKSTLVTPNKKSQPGNTFLPHNLRRRLHAFFCHSSSTGCPTCCETSSRSSSSLAGRTWTTVGFAHKFRSDDRXSKGKKNQAETKKKDEQEKAIKQQRESLVIKAKHTPNIYQKGPPPKAELKKVPPTRAKSPKFTRRKSTGDGTPXTLEAVNTSAASHRAHRHSMGNPKDAKKAQCSPKSGVGAKARAVKPVS

SEQ ID NO: 110942 - protein, 121 aa, Triticum aestivum
  Clone ID: PAT_TA_5360.pep
QAEKIWKEMMRRKVQPDRVSYTAIVGAFNRSGELDRCMDYYQEFRETGGTVDKTLAGLMVGVFCKTSRFNDLIQLLRDMKLQGTKLDRRLYMIVLNSLREAGLEVHVRWLQDYFNSVEEKT

SEQ ID NO: 110943 - protein, 134 aa, Triticum aestivum
  Clone ID: PAT_TA_5361.pep
SNSCREDSEVAIGVGGCSETIKSLFNDEKDDMAKEDSDKLAPTIGQLESLHELDPWTSSECSFSCSILFSDLMFLKACSQHSSRQGKPMTPYSSFCRRTLGKIWSTNILFQQRTKGKSSRSTTQFLFRRIPFFK

SEQ ID NO: 110944 - protein, 188 aa, Triticum aestivum
  Clone ID: PAT_TA_5362.pep
IRHEHWPAMAPTPCFHLLLVLSVGGALCTSALVDYVHQPPIRCSADNYTDGSQYHKNLYRLLQTITMAAPRKGGFYSGTFGVGADKIFALFMCYAEVEYSPEVCQYCRSSPEGDMEEMPAEPGRLTSTLGSSRLIRYPDNSLFGGVVPPLQARPLPVEHRLPPATRAVPAGPAARWCAGPQRGPAKTQ

SEQ ID NO: 110945 - protein, 168 aa, Triticum aestivum
  Clone ID: PAT_TA_5363.pep
RGSCTTGAAGTLGYMDPKCVFTATASVESDVYSFGVVLLEIACGRRPAVVQEDDDDSVVHLLQWVWESYGKGTILEAADERLDGEFDGQEMEHVMVVGLWCGHPDRSLRPSIRQAVSVLRFEMPLPSLPAKMPVATYMPQPSAEDSFGTSDASSSTGSIEATTSSAQT

SEQ ID NO: 110946 - protein, 326 aa, Triticum aestivum
  Clone ID: PAT_TA_5364.pep
GWLRRACGRNCICILIGGCVCSPKDRKGRNVTFQCLFRISEVHCWRTSNSKIVCCNFSSDGKILASAGHEKKAVLWNMETFQTQYLPEEHSLIITDVRFRPNSTQLATSSFDRTVKLWNIADPAFSQHTFTGHNYSVTSLDFHPKKTELLCSCDGNGEIRYWNVTQHSCIRVIKGGTAQIRFQPSTGQFLAAASESVVSIFDVETHTKKYTLQGHNTDVQSVCWDNTGEYLASVSQDLVKVWSVSSGECIHEVSSNGNKFHSCVFHPSYTNLLVIGGYQSLELWNMVKNQSMTVPAHDGLIASLAQSPVTGMVASASHDNSVKLWK

SEQ ID NO: 110947 - protein, 197 aa, Triticum aestivum
  Clone ID: PAT_TA_5365.pep
MEGLDSARPCCLAIIVGGYREVTRAVLKFTQGPLETKNEKQSSPPSPPLAASPPAPPPLLRLAPLAAPLPPPRPPRRPAPPPAPPAGPAPGSAPPPGRARWILERERGGHRRAPVQRQAAARRRDEAAARPRDEAAVRLCSPPAGPPCSCVEGTRPPRARARHLRVSHARAPKGRGPCAPALATRGSAMLAARAAGG

SEQ ID NO: 110948 - protein, 146 aa, Triticum aestivum
  Clone ID: PAT_TA_5366.pep
MTYALKQSDQTYPLIGAITCCGEDKHRVLQVTVHLLDCSNLNCRAHQQAEHAKIVPAFPQNESPCLPVPPSAQLSVHCKESKIFWHASIFFLVFVKSQHEPVCLPKSSLLHWSPCSKVFLYTGGCRIQSMLGALQAQRKQSCSSEM

SEQ ID NO: 110949 - protein, 165 aa, Triticum aestivum
  Clone ID: PAT_TA_5367.pep
LNSSKDGQAMGTTMPFSTVSTAEPSGTEETEEEGEDEDESIVHHTASVGDGEGLKKALDGGADKDEEDSEGRRALHFACGYGEFKCAEILLEAGAAVDAMDKNKNTPLRPPTSAAAWGRKECVDLLLKHGAAVTLQNMDGKTPIDVAKLNNQDEVLKLLEKDVFL

SEQ ID NO: 110950 - protein, 184 aa, Triticum aestivum
  unsure (1)..(184): unsure at all Xaa locations
  Clone ID: PAT_TA_5368.pep
MASLTVSQTTPAAGNANKQREGAEIITGAEACYEHSKELLKGLGFPGGVMPLRGLEECGLVRETGYVWMRQGKPYEHHFRATGTRVRYDAEVTAYVEEGRMKRMTGVRSKQMMLWVPIVEMSLDGADKVYFKSNVGIGRSFPAAAFADEDAAAXTRRRRPAPPRPTTSIDRSTSQRSYGLCWCL

SEQ ID NO: 110951 - protein, 339 aa, Triticum aestivum
  unsure (1)..(339): unsure at all Xaa locations
  Clone ID: PAT_TA_5369.pep
MASGGDLPSGVADESKGKKTEGSSNERQGVPPAAGAGLSGPLGFSSMQRLLNGPSMKEMADKTARHPAFTPVAEEVQKGAQTAGEQGMPPLDPHQYMEKVQXVIENPQLMTMAEGLGTALMQDPTMSQYAGXLTSPTHKEELEEPMSRTNDDPASKPILDELXYCVPAAMIKFWHDPETLQRIGQAMGNMMPFSTVSTGVPSXTEETEEEGEDEDESIVHHTASVGDGEGLKKALDGGADKDEEDSEGRRALHFACGYGEFKCAEILLEAGAAVDAMDKNKNTPLHYAAGYGRKECVDLLLKHGAAVTLQNMDGKTPIDVAKLNNQDEVLKLLEKDVFL

SEQ ID NO: 110952 - protein, 212 aa, Triticum aestivum
  Clone ID: PAT_TA_5370.pep
SGNVPLNAVQLLWVNLIMDTLGALALATEPPTDQLMKRTPVGRREPLVTNIMWRNLFIQAVYQVAGRPPPILSGPDLLHLTQDTLEHSSKVKNSFIFNTSADAWVFNEFNARKPEELNIFEGVSRNHLFLAVVSVTVVLQVIIIEFLGKFTSTVRLSWQLWLVSLAIAFISWPLALVGKFIPVPQTPLKNLILKCWPKKKKQGDEGAAPPPV

SEQ ID NO: 110953 - protein, 221 aa, Triticum aestivum
  Clone ID: PAT_TA_5371.pep
QPLGLIFPRAEFGTSFMPKRKHLRTHGRVDIEKAITRMGGFRKIATLMNLSLSYKNRKPRGYWDNLENLEEEIRRFQKNWGMDPSYMPSRKSFERAGRYDIARALEKWGGAPEASRPRRGGAGRPRQGRGRGGEAPGEPPSGAGGGAPGRGGEAAEARGPGDAQGWVLKRRAGDTGWAGPRAGGPAASEPKPPRRTERETGRWRARGWGWPASKERRTRKQ

SEQ ID NO: 110954 - protein, 80 aa, Triticum aestivum
  Clone ID: PAT_TA_5372.pep
VLVHGECGCPGVRPAVWSAAAAAVVVGALLYVRRRDRRERDLLVMLSQEKDKRIAQLLHQIALLSDIRGGSDSSGRPGRF

SEQ ID NO: 110955 - protein, 86 aa, Triticum aestivum
  Clone ID: PAT_TA_5373.pep
DCQYLVLRLGERKNTHETPCVVRLVCEDVIGLYWGRACFVSLVERVLQKHCKGNDVPVSYLFFRCARHARHTWARVAERETVDYCR

SEQ ID NO: 110956 - protein, 199 aa, Triticum aestivum
  Clone ID: PAT_TA_5374.pep
METSLRLRGADSTSGQQLGLRIHAKQKLPLAYNALLQAHAEIDTATRKPSLLAILARHFFPQLSANVGAGVQLERGNIFRYTLRAKKAVSFTDDGLLGLNIKGRLLADKNFKPRRKSGAVELAWTILDFRRGQDVRIKAGYELYRKMPYFQLRENNWTLNGYMDGNWDVRFGICSASNPILEERILWHAVSALVVELLR

SEQ ID NO: 110957 - protein, 166 aa, Triticum aestivum
  unsure (1)..(166): unsure at all Xaa locations
  Clone ID: PAT_TA_5375.pep
QTPWVPKRVIEPWFKVRGKKIGKPESGXYLKEDRDELDTXQNFEKFEESSDHSQAXSKTGPWRKMLSSKDLNFVGYTXYKNFELVNDDEVLEMAGLKKKEKAKRPSVKSLFDEPDGEEEQQASGEDDDDGEGSVRNRKTEPEPELTRSLSLPSPSADKPSLALPTD

SEQ ID NO: 110958 - protein, 287 aa, Triticum aestivum
  Clone ID: PAT_TA_5376.pep
TSLTPRPATVRGPELIKFISRCKNLQQLWVMDLIEDHGLAVVAGSCSKLQELRVFPSDPFGAGQVLLTERGLVDVSASCPMLESVLYFCGQMTNEALITIAKNRPNFTCFRLCILGPRTPDYVTRESLDAGFSAIVESCKGLRRLSVSGLLTDLVFKSIGANGNCLEMLSIAFAGNSDLGLHYILSGCKSLKKLEIRDCPFGNKPLLANAAKLETMRSLWMSSCSLTLGACRQLAEKMPRLTVEIMNDPGRTCPVESLPDDSPVETLYVYRTIAGPRSDTPDYVQIV

SEQ ID NO: 110959 - protein, 155 aa, Triticum aestivum
  Clone ID: PAT_TA_5377.pep
LLPLHCSRFSLGCLQMMFSLCSCISKTSSYPAVSETSKVSISILTKRCEVILGQFLADENDLGDRPLPSVRIEETVCVLQELARLILDIETANALNIPRYLKDALRENQSHGRAHLLSLLPTFSELVVSREARVRELVQVLLRLISSELGLQRLT

SEQ ID NO: 110960 - protein, 188 aa, Triticum aestivum
  Clone ID: PAT_TA_5378.pep
PSCFLTGVWPRAGVWRHADGDLAAGAPEPRAVVFGGAPDGVVIGSLLLVGIKPESSEIKLVGVPDLELKLLLPHFFSSCHGGGLEEEGGRGFSCSILSACPWSLGFAANGGGSRCKEHQEVLAAAPLHLLVERRPLGVPATASSSSISSWPSSHMGGSLLGSSSGISTVYLRSCAGGVVAIPPRQVVS

SEQ ID NO: 110961 - protein, 326 aa, Triticum aestivum
  Clone ID: PAT_TA_5379.pep
ASAHASVLLKGMAAAQWVKTIRFQVGHATVPGPASSPSAPTAWVARGEGRRLSFSTRPFESRSRHPGPISSLVRRRCRSTMAWERHPGDACIYWFSSGSVLWFGAMPLGFSTAGALRGNCRWLPFLSSSSSPWWRKGGGALDLAKSLSISSRVSQIWSSSSFFLTSPRAAMEVDWKEEEERGFGCSILSACPWSPSSCSKWLGILVQRAPGVSCHCAAVSAGRKATTRSSGDDVRLLYFLLAAEPYGRQVYLVLCPGISMVYLRLFAGGVVAIPSPQVVSSPVVVGSGQDRRRRRGLDCFSFLLSGVLSAKCPAWVVIFSFCWAFL

SEQ ID NO: 110962 - protein, 105 aa, Triticum aestivum
  Clone ID: PAT_TA_5380.pep
MCGGAILAELIPGAPARRATSGHGHVWPGKGAKQTKAAAADDFEAAFREFNEDSDVEDDSLMVMERREEVAPKQPFRVRPLPPKENNQGMGGPSRKESRITGVSG

SEQ ID NO: 110963 - protein, 97 aa, Triticum aestivum
  Clone ID: PAT_TA_5381.pep
FFSTILFFCKICSSCSLLIFVVAQVHLLEMGGKLHKHHTCQVAKVVHHRFPRRQEIPPHHHRSSLNQSDRPAVRMVQGGLKPPVTSRRMSVLQVPPA

SEQ ID NO: 110964 - protein, 202 aa, Triticum aestivum
  Clone ID: PAT_TA_5382.pep
YRAPPRAEDSEEDYETLEDEYRTREDEYEYETLEESKYGILEDEYEYETLEDEYGSPENEYGNPENEYRTLEKDSEEEYGSPESKYRTQEDEYGTIEEDSEDEYGSPGESAEEKYGTLEEDSEEDSEDEYESPEEDSILKKEGLIEHRGTKEFSLKYQKEVDRFFFTSAATTLITSEFVCIYMGIPNQNHGHKNGSSGFGVN

SEQ ID NO: 110965 - protein, 438 aa, Triticum aestivum
  Clone ID: PAT_TA_5383.pep
MAAPRVLLLLAAAALLAVASLGDASGEGPRGRKLLVLVDDLAVRSSHSAFFGSLQARGLDLEFRLADDPKLSLHRYGQYLYDGLVLFAPSTPRFGGSVDQNAVLEFIDAGHDMILAADHSASDLIRGIATECGVDFDEDPEAMVIDHINYASSEVEGDHTLIAGDDLIQSDVILGSKKIEAPVLFRGIGHAANPSNSLVLKVLSASPSAYSANPEAKLASVPSLTGSAISLVSVMQARNNARVLISGSLDLFSNRFLKSGVQKAGSKMSHDKAGNEQFVTETSKWVFHERGHLKAVNVKHHKVGETNEPSMYRINDDLEYSVEIYEWSGTSWKPYVADDVQIQFFMMSPYVLKNMSTDKTAVYSASFKVPDVYGVFQFKVEYQRLGYTGLSLAKQIPVRPYRHDEYERFITSAFPYYAASFSTMGAFFIFSVAYLYHK

SEQ ID NO: 110966 - protein, 159 aa, Triticum aestivum
  unsure (1)..(159): unsure at all Xaa locations
  Clone ID: PAT_TA_5384.pep
HKLDIPIIHMDPTPGNEXVAEDPVAGTAGFALSRVFGEAQPRLCTQTVVGPAGHRALGNLYRGEISAQSDIYSLGLLIIEITTGEKNCPETNQPSARNFIDNVQKXWTEDYITFKYSSLTPDCLNQVKRCIKIGLECVTIDRKGRPTIEKIIDTLNGIN

SEQ ID NO: 110967 - protein, 170 aa, Triticum aestivum
  Clone ID: PAT_TA_5385.pep
AGGSLDDTGKVGKGAGMPCFLCPHPTCKQSMITQGVCACPECSGTLILDPVSAPKWRLLCNTCNCVVLLPHAAHRITTTDKKCPTCESTIIEVDFNKKATPLEDGATLHEGCILCDELLHSLVEMKHGKSFFMRRGRGRGRGRGRGRGGRGRGRRGNSRHDDPKMSFRDF

SEQ ID NO: 110968 - protein, 139 aa, Triticum aestivum
  Clone ID: PAT_TA_5386.pep
AKPEMPSTDELIRVLEVVRLGYILPRFNGMDSVHDWASVLSLGEQQRLAFARLLLAKPTLVLLDESTSALDDTNEVHLYSQIEAAGITYISVGHRKTLHRFHNKVLYISKSDSTTGSLRNWELKPTDQKSIEESSPFAS

SEQ ID NO: 110969 - protein, 541 aa, Triticum aestivum
  unsure (1)..(541): unsure at all Xaa locations
  Clone ID: PAT_TA_5387.pep
MALYLLFESASGYALFHAHGIDEIGQSVDAVRSTVLDLKRFSKAVKLAGFTPFLSAVDALNQCNATSEGIMTDELRNFLELNLPKVKEGKKAKFTVGVMEPKVGSHITEATGIPCQSNDYFQELLRAVRLHFDQFIEQLKPSDLEKAQLGLGHSYSRAKVKFNVNRVDNMVIQAIFLLDTLDKDVNSFSMRVREWYGWHFPELVKIVSDKYLYAKLAKFVVNKSDLSEKDIPALADLIGDKAKPKEMVEAPKPSRDQNLSPVDLINVQQVGPRVMKLTEYRKNLYECLVTKMYVIAQNLTSLIVEKVVARLISHAVSLLNLLKCAASTLQILGVVKALFXRSLKTXGNTPKYGLIFHSSFIGRASTKNKGRMARYLANKCSIASRIDCYSDMSSSIFGEKLREQVEERLDFYDKGVAPRKNLDVMKAAIDGLTNTEDNDGKENGDASVKKSKKKKSKAEANGDAMDVENATAEAETGTEKKKKKKHKLEEPKDEEMQANGDDETPKKKKKKNREAESVDPKTGTEGKSKKKKKKSKTDDDE

SEQ ID NO: 110970 - protein, 202 aa, Triticum aestivum
  unsure (1)..(202): unsure at all Xaa locations
  Clone ID: PAT_TA_5388.pep
MSSSSSPAPAPGSDPAAPAASSASSAIDFLTLCYRLKTTKRAGWVRRGVXGPESVADHMYRMGVMALVAADLPGGVNRDRCVKMAIVHDIAEAIVGDITPADGVPKEEKSRREKEALDHMCALLGGGSRADEIRELWMEYENNATLEAKVVKDFDKVEMILQALEYEKEQGRDVEGFFQSTAGKFQTDVGQKWAGESACSRE

SEQ ID NO: 110971 - protein, 218 aa, Triticum aestivum
  Clone ID: PAT_TA_5389.pep
NSARDDDDTSHLGVHTNDDDDDDDDEWHDGISWGQPSSSDSEPSPSPSPREDRHTGMLKAMDKQLKMLTTRFLTSAGISLPHEDDGGESWLDIVTALSWEAALLIKPDGKAGNEMDPGSYIKVKRVASGTRRQCEVINGLVFRKYAAHKHMPTKCHNPKLLLLGGTLGDSDVGLSSFDSMGQEKDHLEKAISQVMEKCAPDVILVEKTVSRDIQELLL

SEQ ID NO: 110972 - protein, 213 aa, Triticum aestivum
  Clone ID: PAT_TA_5390.pep
HASGPTPAPARTQTLDPFPLDPHSLFRLLHPFFVPRHGLRPRASPPPAIPHRPCELGGGMNGQGRWATRATPPTRFAPPLPKSSPRALHPIPSSLVSSDGQVPILLRFPSLCSFSSLTTCRLSPSRILLPQQPLQEARPPCCKVAGPDLEEEEEIRGSRRWLGTVPFRYALHGADGFHGAEESMRAFCWKGLGGWESSAMNDECWRSFYCDTT

SEQ ID NO: 110973 - protein, 147 aa, Triticum aestivum
  Clone ID: PAT_TA_5391.pep
SDSFLYRELENGVRREVGGPRVVQGAGEEAVGASPCDEGGERGGGGEEGAGGEGVTGVPGFGRREESGYAQREVQKHRAQLEDEEQGCFKDHIESATKFLLSKLADFQFFVGESMHDDGSLVFAYYKDGAADPTFLYFAHGLKKINC

SEQ ID NO: 110974 - protein, 138 aa, Triticum aestivum
  Clone ID: PAT_TA_5392.pep
LLKEARSLSLRSIVYTRRWKGRQKRMLDYNIPLIQADGDGRHCGWIWRRRNQNLFGRCRYRHDGLLCLVGVSTSFPVERSELAALQIHGAASRYKRGERGCQSKTAMRCLIEGTRLHASYLHRGVVQICWLSVVQWNA

SEQ ID NO: 110975 - protein, 294 aa, Triticum aestivum
  Clone ID: PAT_TA_5393.pep
MAPGEKKGRRWLPAACLPRPGCFTVSATEEGPSGSGSGSGADEGGSGRPPAPPILSAAGIVGSAENWGYAAKRFIRKHPEDVVVHCSGCNSATRTFDGVDVMGRRLAEEVISVVKCRPELQKISFVAHSLGGLIARYAIALLYEPTTQTDCHEEYEKDVNDARSNQPMGQGKIAGLEPMNFITFATPHLGTRSHKQMPLLRGSYRLEKMAFGMSWLAGRSGKHLFLKDVEDEKPPLLLQMVTDYGDLHFISALRSFRRCVAYSNVCGDFRCWAGKTLQIRPSNMSFPKKEDLVG

SEQ ID NO: 110976 - protein, 178 aa, Triticum aestivum
  Clone ID: PAT_TA_5394.pep
MLSQQFHHISKLILILFYLPVRGNERFLMEEMTKLPNITILGLVVLACGHSFGASSFHVLKMSSGIRELTLQLVTRRDSKALCQPGCICAEPSNWETEDLVLPCLKEVAINGLRGTEHELALVKRLFKWATMLERVTVIFHDSISESNGEEFRQLLLSFSRPAICMEFSHCGGSLSFD

SEQ ID NO: 110977 - protein, 340 aa, Triticum aestivum
  Clone ID: PAT_TA_5395.pep
QVVKGGFPRWVRPGDRRLLQAPASGITANAVVAKDGSGGFTTVSAAVAAAPTNSKSRYVIYIKAGAYMENVEVGKSHKNLMFIGDGMGKTVIKASLNVVDGSTTFRSATVAVVGNNFLARDLTIENAAGPSKHQAVALRVGADLSAFYRCSFVGYQDTLYVHSLRQFFRECDIYGTIDFVFGNSAAVLQSCNLYARRPLPNQSNIYTAQGRTDPNQNTGISVQKCKVAAASDLAAVQSSFRTYLGRPWKQYSRTVFIQSELDSVVDPAGWLAWDGTFALDTLYYAEYQNTGPGAGTSGRVSWMGYRGVISASEAGRVTVGSFIDGDVWLAGTSIPFSGGL

SEQ ID NO: 110978 - protein, 174 aa, Triticum aestivum
  Clone ID: PAT_TA_5396.pep
SDPAPCFSLPGIILHPVALIHRRVDASRGWDLRFLFDPVPSHPTTTTKGGSGCSGHPLQIPTSDDPFYSSVPWRSPTVQSLAAQYTEDSLEALPLILCPQPCLQGSCGGRREARSSGCGAVPHCRVPSRSSSTWARQNLCHGGVGRKKRSGRRERGVGPPCKPHRAWPRQCHVV

SEQ ID NO: 110979 - protein, 168 aa, Triticum aestivum
  Clone ID: PAT_TA_5397.pep
MQPPCLGACGGSPAVLGASAHCQRPSTSTRVTVRCAARGGRASSRGKENVWSVDNERAAEQKSRSQKSHRGRRRPAGRSRPPPPPTRTKENDAGSRVLVSGAMLVEVETVLQTQESVLRPSWDTFASSLSGVWKGVGAVFSPITAEMEPVGLGSKQEYLYDCYTLSLI

SEQ ID NO: 110980 - protein, 130 aa, Triticum aestivum
  Clone ID: PAT_TA_5398.pep
KPSELTGPWKVYEVSATPIFSEKVKEIEGGAAFVYLCMETMKKRSLPESSVFFGEEEMLDMQDVTILWLPGGVPAYVDVDKDGILCIGVSWYSEEGINLVMERDYGTDGKLREVRTKTEIKRRWNQPLPP

SEQ ID NO: 110981 - protein, 71 aa, Triticum aestivum
  unsure (1)..(71): unsure at all Xaa locations
  Clone ID: PAT_TA_5399.pep
XEIXGYYALLTDLLLLIAVHQGTRQDVTRSRPAGGISFNIRTDEWVMSNFPCFGLFLHQLQVVFSFAVSYS

SEQ ID NO: 110982 - protein, 126 aa, Triticum aestivum
  unsure (1)..(126): unsure at all Xaa locations
  Clone ID: PAT_TA_5400.pep
XPVVPPTSATVGPNLEGAVVEELVLEPLVRAQEPLPRLLRPVAGPLLRPRLGATAVQPEQLPQLRPPAAPPSAPARRGSAARPALPAPRSAYPTARATRSTPPTPPCSMDMALALAKLPPCFRLDA

SEQ ID NO: 110983 - protein, 136 aa, Triticum aestivum
  Clone ID: PAT_TA_5401.pep
MEGPTRPPTRPRTRGVKSEPEEGEVLMMMQDGGEGGGASVAAESMAPAQIDVRMDLTLLHCQGCLLPLKPPVFKCEAAGHVVCYHCRAVHSTICSRASTHCGELDAVVGAAKVPCAYRAFGCERHVVYHEAADHQR

SEQ ID NO: 110984 - protein, 229 aa, Triticum aestivum
  Clone ID: PAT_TA_5402.pep
IRHEREPARPPHRPSRPPAPRSSRASPARARLGRAAPSGAAVRPVPPAVAAERGAALADAWDCKGRPAARASTGGWGCAAMILGAELFERMTTLGIAVNLVPYMTGTMHLGSAAAANTVTNFIGTSFMLCLLGGFVADTYLGRYLTIAVFSAVQATGVMVLTISTVAPGLRPAACGDATGQSPDCVPANGTQLGVLYLGLYMTALGTGGLKSSVSGFGSDQFDESDDGE

SEQ ID NO: 110985 - protein, 76 aa, Triticum aestivum
  Clone ID: PAT_TA_5403.pep
QFLLCRIGFTVCCCWSDIVFNLFLLGIIHHPRGSRFVEYCCLFKGYNKKCFSFYYYQKKKKKKKKKKKKKKKKKGP

SEQ ID NO: 110986 - protein, 290 aa, Triticum aestivum
  Clone ID: PAT_TA_5404.pep
MAGKEIYHKMKDKVKDAFSSSGPETGKGKTKLSGRRVKHGYHLVKGKSNHPMEDYLVAEYRQVGEHDLGLFAIFDGHLGHTVPDFLRAHLFDNILSEPEFLSDTKNAIRKAYLLTDEKILEKAAELGRGGSTAVTAILISSNDSVKLVVANIGDSRAVISKNGKAEQLSVDHEPSMEREIIEEKGGFVSNLPGDVPRVDGQLAVARAFGDRSLKKHLSSEPHVAEEVIDESSDFLILASDGLWKVMTNQEAVDEIKDIRDAQAAAKHLTEQAVNRKSKDDISCVVVNFHC

SEQ ID NO: 110987 - protein, 233 aa, Triticum aestivum
  unsure (1)..(233): unsure at all Xaa locations
  Clone ID: PAT_TA_5405.pep
MHTAPGIHFPPSSRTHSALCSRCSSPTPALLHLQHLVADSSKGDIGSMVWKSWGRRLLLSAAVLLCSAAAGGAAAGDVSLSLTSAPPRVSTSPSAVFAFRAVQSSGWTCGDCAITCKLDGERRSDCGGNGNGTEVVTFAGLKDGNHTFAACATPRSGSGKQAPARTCATLRXGMVDTVPPPAAVAAAAAFTAPPRAAAPVALRGPCPGPGGFTPDPPACGRGVFAPAKGPTLM

SEQ ID NO: 110988 - protein, 165 aa, Triticum aestivum
  unsure (1)..(165): unsure at all Xaa locations
  Clone ID: PAT_TA_5406.pep
MAWRRVLSQAARNQSAYAIYNELAASSPLRSLRSDISAGGALRNLHERYHSSYFGGLSRSMRDLGSQSEASMLKEIYRSDPERVIKIFESQPLLHSXNPSALSEYVKALVKVDRLDDSTLLKTLQRGLAASERSEGSLGSVPALQSAGQVTKDGIIGTANAPIHM

SEQ ID NO: 110989 - protein, 101 aa, Triticum aestivum
  Clone ID: PAT_TA_5407.pep
VYFYNQASPTIHPSTCVAVGSHLSAIAHITWVLCYIQIITRPSHLPSMCPRIETKLMGGQTFLHPQITITGSNYNKKMFIGRMKFNKMKLCWSALILTSTK

SEQ ID NO: 110990 - protein, 245 aa, Triticum aestivum
  Clone ID: PAT_TA_5408.pep
MRGAAIQGHGLARAPPAAVPLLHPRPRRAVGVAPRHRLRSDLLPLLLPAAAPFRARSPPSSSSSNVNPGTGEGADELLEELLQKHGEVVYSSGGAGSAALASEADEDAECLSLAVSLAKVASEVKAADIRVLFVKPIVYWTEFFIILTAFSNAQIEAISSKMRDIGEQQFSRVASGDTKPNSWTLLDFGDVVVHIFLPPQREFYNLEEFYGNATPIELPFETHCSNYRSNLGLEPNEDVHSTPCK

SEQ ID NO: 110991 - protein, 120 aa, Triticum aestivum
  Clone ID: PAT_TA_5409.pep
LKHFSVCSVHFGLFSIQKMRLTVETVHITIITRSDYYDGSLPAVLLLYQVRLPMAPGGEILGVVFGWGTKCNRMVMVPRRWNRLVPIVCFVSVWFERWIWLSTPLCVEMVRLPPMHVYAI

SEQ ID NO: 110992 - protein, 120 aa, Triticum aestivum
  Clone ID: PAT_TA_5410.pep
AAQVHPVFHISRLKPFSADYSPVFSELPPPDLVLCDKLPSAILQRRMVRDGNRATTQVLIEWGDLPDDSATWENYEVVKHRFPSSSLWDEAQSQAAASVTTPALADNESPGSEDPGERAL

SEQ ID NO: 110993 - protein, 114 aa, Triticum aestivum
  Clone ID: PAT_TA_5411.pep
FWVREEIEYLEGKGVLPPKIEEPTPPKKLVVIDFPASWCGPSPIRAPIFAVLPKKFPAAVFLKVHFNELKSIVDQFRVEAIPPFLFIKEGDFKDRVVGAIKEELPTKVGLHPAQ

SEQ ID NO: 110994 - protein, 126 aa, Triticum aestivum
  Clone ID: PAT_TA_5412.pep
MAASAATATAAAVGAGEVISVHTLEQWTMQIEEANAAKKLVVVDFTASWCGPCRIMAPVFADLAKKFPNAVFLKVDVDELKPIAEQFSVEAMPTFLFIKEGDVKDRVVGAIKEELTNKVGLHAAAQ

SEQ ID NO: 110995 - protein, 129 aa, Triticum aestivum
  Clone ID: PAT_TA_5413.pep
MAASAATATATATAAAVGAGEVISVHSLEQWTMQIEEANAAKKLVVIDFTASWCGPCRIMAPIFADLAKKFPAAVFLKVDVDELKPIAEQFSVEAMPTFLFMKEGDVKDRVVGAIKEELTTKVGLHAAQ

SEQ ID NO: 110996 - protein, 112 aa, Triticum aestivum
  unsure (1)..(112): unsure at all Xaa locations
  Clone ID: PAT_TA_5414.pep
MAASAATATATGXTAVGAGEVISVHSLEQWTMQTEEAKAAKXKLVVIDFTALWCGPCRIMAPNFADLAKKFPAXAVFPKVDVDQLKPIAEQVIVEAMLTXLFMKEGDVKYRG

SEQ ID NO: 110997 - protein, 116 aa, Triticum aestivum
  Clone ID: PAT_TA_5415.pep
MDALVAGQQARRRIRPPEPLVMAASPTTPAAFKCPISLEVMRSPVSLPTGATYDRASIQRWLDSGHRTCPATRLPLASTDLVPNLLLSPPHPPARRHAAPLALARGGALAARRLAR

SEQ ID NO: 110998 - protein, 169 aa, Triticum aestivum
  Clone ID: PAT_TA_5416.pep
GSTAAAGVLEGLLPHRDLHELRITRYPGATSPSWLGLQMEKLTSLYIRNCRKLNALPALGELPCLELLDVKELPCVKRIDGGFCGAGAFPKLKKVVLDDMPGLLAWGDMPKLAFPLLTEVSIADCPLLSSLSGLERTGPLGLRVMGCPRITPETLPAIFSTGVSTYRFR

SEQ ID NO: 110999 - protein, 185 aa, Triticum aestivum
  Clone ID: PAT_TA_5417.pep
MTTATAIVAGHGIAFRRSLHLPNPPGKPSFSVARPHAHYRLLVPATPSPRPCRSISSQSPTAAAADTAEDEEEPAEESEGSEEELDPLAEVRYLDPDADAEGIRQWEVDFCSRPILDARGKKVWELVVCDATLSLQFTRFFPNTSINSVTLRDALASVASSLGVPLPDRARFFRSQMQTIISRAC

SEQ ID NO: 111000 - protein, 169 aa, Triticum aestivum
  Clone ID: PAT_TA_5418.pep
AARALLVLAKRRGVVPVVAQQDSISLPLFFCVRIRFVGSQFYMHLSIFLLYAGYTPGGGRGGARARAGPGQVRARARKVQRAAQVGPRPERRANACVRGRWVGQDLHSATSSSPWTQARTDSWVLVAVPSIGGSKWSRSRLIHQDETCILELAQRGEEAGSSALASQMN

SEQ ID NO: 111001 - protein, 197 aa, Triticum aestivum
  Clone ID: PAT_TA_5419.pep
TRPPTRPLESEGTQTHLTFVYSFAQAAAAAQAGASVVQIFVGRIRDWAKNHSGDPEIDEALKKGEDAGLALVKKAYVYIHKNGYKTKLMAAAVRNKQDVFSLLGIDYIIAPLKILQSLDESVTDSDEKYGYVQRLTPSLDKMYNFSQEELVKWDHLSLAAAMGPAAEELLASGLEGYANQARRVEELFVKIWPPPNV

SEQ ID NO: 111002 - protein, 410 aa, Triticum aestivum
  Clone ID: PAT_TA_5420.pep
IYALTPLPPNLRPHLALSISAPTSSPFLPAPRQVGRWSSSPSSAKPAVFSLRRPVVVARAAAGNAPSSPAGAVVTEFDVVSSFSEIVPDTVVFDDFEKFAPTAATVSSSLLLGIAGLPDTKFKSAIDTALVDGECNTMEKPGDRMSCYLTKALGNVGAELAHQVPGRVSTEIDARLAYNTRGIVQRVHELLQIYNEHDIPSERLLFKIPATWQGIEASRLLESEGTQTHLTFVYSFAQAAAAAQAGASVVQIFVGRIRDWAKNHSGDPEIDEALKKGEDAGLALVKKAYVYIHKNGYKTKLMAAAVRNKQDVFSLLGIDYIIAPLKILQSLDESVTDSDEKYGYVQRLTLSLDKMYNFSQEELVKWDQLSLAAAMGPAAEELLASGLEGYANQARRVEELFAKIWPPPNV

SEQ ID NO: 111003 - protein, 283 aa, Triticum aestivum
  unsure (1)..(283): unsure at all Xaa locations
  Clone ID: PAT_TA_5421.pep
HCCIFFCIPKCFGELRKLCILKIAIRSLSRSDIEILERMPALAALALYNQTTPTEKMIMTDGGFYGLTYRKHECGGGCQGXEQGAMPKLQNLNLGFNSDQWRSDTFETLGLSHVXGLTDVRVRLGTGAADNFNVKVAKSALEGVVRNHPKSPRIRIKFVDLIFDGKEDDSTATHQYQEGKESRSARGQDGKQDATRGERQQQGPPMSKQDARRSKAVGASSKALPPMSKAVNASKSRAAVPPPTSSSPSKPMPSSSLTSPPKPRRRGSRTSPPRPTSPPQPKR

SEQ ID NO: 111004 - protein, 355 aa, Triticum aestivum
  unsure (1)..(355): unsure at all Xaa locations
  Clone ID: PAT_TA_5422.pep
HEVPCATTSQKCIRTNDIENVGRTSRHQTFFEMLGNFSFGDYFKKDAIKWAWELTTKEYGLPPERLWISVFEDDDEAFSIWLNEVGVPKERIKRMGEDDNFWTSGATGPCGPCSEMYYDFHPERGSLNAARXDLNDDSRFIEFYNLVFMQYNKNDDGSLEPLKQKNIDTGMGLERMARILQDVPNNYETDLIFPIMEKAASMALVSYSKADDAMRTNLKVIGDHMRAVVYLISDGVIPSNIGRGYVVRRLIRRVVRTGRLIGMRGDGHENSEGAFLPSLAETVISLSREIDPDVESRRKSILGELLREELRFVQTLGRGEKLLDELLDEALGSAGDIGDKPCLSGKDVFLLYDTY

SEQ ID NO: 111005 - protein, 143 aa, Triticum aestivum
  Clone ID: PAT_TA_5423.pep
RNEASSLRSKIAVLKAASLASKAVLVEPHNVRILVEHMGDVDADGLKSAAEHLVGTLQDPAAVILGSSPGDGKVSLVAAFSPGVVKLGVQAGKFVGGIAKLCGGGGGGKPNFAQAGGRKPENLPDALEKARAEIVAALSSKAS

SEQ ID NO: 111006 - protein, 141 aa, Triticum aestivum
  unsure (1)..(141): unsure at all Xaa locations
  Clone ID: PAT_TA_5424.pep
MSQFVPDWGNMGDISRPLGEDDDLMELLWCNGNVVMQSQGHRKLPPRPEKVPAPPVVQEDEAGLWFPFALADSLDKDIFPDLFCEEPPGAAAGRPGRDGAPRXGGADWRTSPAAAVSAPPGPRPPPKSTHVSCSSRQQSMS

SEQ ID NO: 111007 - protein, 126 aa, Triticum aestivum
  Clone ID: PAT_TA_5425.pep
VDPRVRGSGMAPPAVMFPGMQMHQYLPQMGPSMARMPFMAPPQQGHGVSLPEQYAHFLGVNPHHHLQPPAHHHQHFAQGLGYYPLGAKALQQSPALHHVSNGNAGGGTPAATANATPGNAIHPNKR

SEQ ID NO: 111008 - protein, 157 aa, Triticum aestivum
  Clone ID: PAT_TA_5426.pep
FFFSLFSLFLLLCLSLPWSSESNLYIGRHSCQVRRINLEEKFTLPCNVVYDGYHVIPHISFSSGRHSCQVRRINLEEKFTLPCNVVYDGHHVTTSRKRFDGLQNPVTESAQGGGQNFRTEGCQTVPSASKLHLILLSERRQNKCVTALRAPGSSFTS

SEQ ID NO: 111009 - protein, 85 aa, Triticum aestivum
  Clone ID: PAT_TA_5427.pep
MQNSNPSNKKKKADVSIVLSTAPEDAPTHWQQTLLYLFEPIELKKNQIMEGSVTISQSQQHARFLNICLKSSGGAGRYVKESVMR

SEQ ID NO: 111010 - protein, 138 aa, Triticum aestivum
  Clone ID: PAT_TA_5428.pep
MATARRGGVGWRAVLAAVLQLLVAAEAGKYNAVFNFGDSLVDAGNLVTEGIPDYLATARPPYGQSYFGYPTGRCSDGRLVIDFIAQEFGLPLLPPSKAKNASFAQGANFAITGATALDTEFFEKRGLGKSVWNSGLLF

SEQ ID NO: 111011 - protein, 175 aa, Triticum aestivum
  Clone ID: PAT_TA_5429.pep
VQGISDGVEQLIAEGAKDLIVPGVMPSGCFPVYLSMYVDPKEGYGPRTGCLKRFNTFSWVHNAMLKRALEKLRAKHPGVRIIYGDYFTPVIQFLLQPEKFGFHKQPPRACCGAPGKGPYNFNLTAKCGEPGATPCPDPKTHWSWDGIHLTEAAYEHIAKGWLHGEFADQPIIQSS

SEQ ID NO: 111012 - protein, 141 aa, Triticum aestivum
  Clone ID: PAT_TA_5430.pep
TSLTNKSNVINMVLYHSLQEAKSQTIAYIKLKSFRVRDGMQEIDHRWLLAPAGPTVKRPQPSTPPGALELLLLQPLLMTPSASVALPTPAASADRHQIRPASLPPLQLHPTIKTLTLMLSTMTACTRSGTTEGGNRGAREE

SEQ ID NO: 111013 - protein, 124 aa, Triticum aestivum
  Clone ID: PAT_TA_5431.pep
LLVTTFSSQDEEYQIHLEASKYILKNSKALGSTQMDSKQKSQYSMLSTSYKHYKCDYSSYKKRAPPGPATTTPPQVPEARHHESNAEEGASAAARGPACCSGVSADPLKCVFEDLECIPHRMTA

SEQ ID NO: 111014 - protein, 166 aa, Triticum aestivum
  Clone ID: PAT_TA_5432.pep
MSRPSRSDAHLSPVDEAVRVDEVRGYYDGAGPKRHSKPSRSDHSAVYTDALAGPGADGSHPELDKFQDLEAHSEKLVCEGGKAGEEFVETEYYKDLGCVGKQHHTTGTGFIKVDRPGRRHRFELSEDPDATERHASSKGNPATNEWIASADTVYQEESDKPNRSDS

SEQ ID NO: 111015 - protein, 125 aa, Triticum aestivum
  unsure (1)..(125): unsure at all Xaa locations
  Clone ID: PAT_TA_5433.pep
MSRELNSERELQDMCSTNVCIKEDHLDFIVIGEHNLSNVKLAFCSDNPLAYKVGDKXEWSYYKVAIPLAQLRSVNPSTSRTHAAEKYIQVVSVDNHEFWFMGFVYYDSAVKHLQEALQEARILQA

SEQ ID NO: 111016 - protein, 271 aa, Triticum aestivum
  Clone ID: PAT_TA_5434.pep
RPRTRGRTRGSESYNPHVRYGAALAVGISCAGTGLSDAISLLEPLTSDVVDFVRQGALIAMAMVMIQTNESFDSRVGTFRRQLEKIILDKHEDTMSKMGAILASGILDAGGRNVTIKLLSRNKHDKLTAVIGLAVFTQFWYWYPLLYFISLAFSPTAIIGLNSNLEVPKFEFLSHAKPSLFEYPKPTTQQTTTSAVKLPTAILSTYAKAKSRAKKDAESKAANQEKTAEAESKANQEKSTAESKPSQEKSTDAESKAKTTEDASGSTSGEA

SEQ ID NO: 111017 - protein, 53 aa, Triticum aestivum
  Clone ID: PAT_TA_5435.pep
AEHLAARAHEVGRSGAGISPFSDSAVATGYLGFSGGKLADTAVVVSIVRRSEA

SEQ ID NO: 111018 - protein, 70 aa, Triticum aestivum
  Clone ID: PAT_TA_5436.pep
AKTRRQIEKDAQKAMRMTTRQTLVDILRSEGPKGLFTGVGPRVARAGPSVGIVISFYEVVKYALHQRNMS

SEQ ID NO: 111019 - protein, 158 aa, Triticum aestivum
  Clone ID: PAT_TA_5437.pep
MVFPSHVSRSPTYYGFEGTFEEPMGREALQELWQKYKVDLAFYGHVHNYERTCPVYQSQCVVNASNHYSGPFQATTHVVVGGAGASLSDFITSKIQWSHFRDFDHGFGKLTAFNHSSLLFEYKKSRDGNVYDHFTISRDYRDVLACSVDNCPRTSLAS

SEQ ID NO: 111020 - protein, 228 aa, Triticum aestivum
  Clone ID: PAT_TA_5438.pep
GTRPIDVDDLAHASARSLVGSLSKPERSQQHKSSSSDSSTTGNFTNAEQNSLNTDGQMDSQDFFGGCDTVDITGTSVLEVENARLKAELASAIAVLCTFGAEYAHESIDEGQNDDVLRNAREKTSQALSAKDEYANQLQSVLKAKQEQCLSFEKRIQELEEQLANQYIHGQMVSGSKSASDSLLSTFKGNDCNLDGGRQTHLRDESSVAMGETSSTSEQPSKQTEGGD

SEQ ID NO: 111021 - protein, 118 aa, Triticum aestivum
  Clone ID: PAT_TA_5439.pep
MLAKLGLHCTALRCRDRPDLEQEVLPELENVLSSVTSSRKFESPKAVVPSHFICPISQEVMDDPCVAADGHTYERRVIEAWLEEHKISPITKHVLPSLTIIPSHSLHEAIQQWKRSSR

SEQ ID NO: 111022 - protein, 188 aa, Triticum aestivum
  Clone ID: PAT_TA_5440.pep
DSMFLESQSIIDYSMLLGIHFRAPNHLKAATSHQNTLESSGITSAMDCSVPLHCEDANSSKGFLLVAHEPGTTAGGSHIRGSMVRASEGGYEEVDLVLPGTGRFRVQLGVNMPARARKLLESTDAVEEYDVVLYLGIIDILQEYNTPKRVEHAVKSLKFDPPSISSVDPNLYSKRFVSFLERVFPGQD

SEQ ID NO: 111023 - protein, 325 aa, Triticum aestivum
  unsure (1)..(325): unsure at all Xaa locations
  Clone ID: PAT_TA_5441.pep
MGAACDDAVQQVARLLDQVEEPLKKTFQNVHQGYPTETLVRFLKAREWHVTNAHKMIVDCLNWRIQNEIDSILEKPIIPVDLYRSIRESQLVGLSGYSKEGVPVFAFGVGQSTYDKASVHYYVQSHIQINEYRDRIILPMATKKFRRPITTCIKVLDMTGLKLSALSLLKILTAISAVDELNYPEKAETYYIVNAPYIXMSVXRVGKPLLQERTRKKVHVLSGRGKDELLKIMDHLSIPHFCRREGSSKASLSSVDDCFSLDHPFHQELYHYIEQQALNQELIKQGSLHVDIPDQDPDDAMIVEVIQAEFHKLGEQNGSADGDHK

SEQ ID NO: 111024 - protein, 156 aa, Triticum aestivum
  unsure (1)..(156): unsure at all Xaa locations
  Clone ID: PAT_TA_5442.pep
GXVADLLALPMPTVAAVTGHAAAAGCALALAHDSVVMRASRGFLYMSEVDAGIKIVDYFGELLRQKVPDAATRRDMLLRGDKXMTAAEAVRRGVVDAAADGGVEDVVAAAVAAAEGLAARGWDGEVVAEIRKAMWPAVWGKVKDYGADAVAARPRL

SEQ ID NO: 111025 - protein, 153 aa, Triticum aestivum
  Clone ID: PAT_TA_5443.pep
MKGFTEKNGSKNSGDVEATSFYSSSEETLVVMHMPQGMGEGNKLKFSDILKATNNFDKENIIGCGGYGLVYKAELHDGSKLAIKKLNGEMCLMEREFSAEVDALSMAQHENLVPLWGYCVQGNSRLLMYSYMENGSLDDWLHNRDDGTSSFLD

SEQ ID NO: 111026 - protein, 289 aa, Triticum aestivum
  Clone ID: PAT_TA_5444.pep
HEEEGCDLFGAPYDFRYGLAAPGHPSQVGTAYLERLRLLVESACAANGGMPAVLMAHSLGGLYALQFLARAPPAWRAAHVKRLVTLSAPWGGGAREMLTFASGNTLGVPFVDPTLIRDEQRSSESNLWLLPTPKVFGNTTLVVSQRHNRTYSAKNVTQFLNDIGFADGVEPYRARIRPLGEVLPEPGVPVTCLVGTGVDTVESLVFGDEGFDAGPVEVVYGDGDGTVNLASLMGPIKAWSDSPSQVLEVVELPKVSHMGILKDKSALDQILRILDSINLNATSTTTYQS

SEQ ID NO: 111027 - protein, 272 aa, Triticum aestivum
  unsure (1)..(272): unsure at all Xaa locations
  Clone ID: PAT_TA_5445.pep
MDISQRNLLKGLTSDESVVAKDSSTLGVVIVKHCGYTATVKVSGRTKNSSDGKQTSDISDHLDEIPNIDVDDHPDGGSNALNPHSLRIPLAENYQPXIAASNQHLASKPHVDNYARKLACTVLETSLRKLENTPNKNPRRIRWELGSSWLQHFQKKDASVSEDSEKNAKKSEKDSSVKGLGKHFEQLRKINKKESTIEDAKTVKEESDSNCLLTNGTEKSENVVFTEIRNLITEDAFCRLKSLEAGLHQKSLEELTKMAHKFYDDTALPKLV

SEQ ID NO: 111028 - protein, 350 aa, Triticum aestivum
  unsure (1)..(350): unsure at all Xaa locations
  Clone ID: PAT_TA_5446.pep
MATAVAAFRSFIHPTAIAAAIPLPPSHFNLNNFQRHCVGLRLFSSSHRRHPILLPASTSAASGQEFSSDGEYYSEEGPKEYVEEEGEEAEPEVQAVRGYYPPRNRPALGQEPGRIYVGNLPYTFTGAELTAAFSEPGSVDDVQIIYDKITDRSRGFAFVTMATAEEAAKAVQMFNGALLGGRTVRVNFPEVPRGGEKAVASAAVARTSLRFVDDGTYKGYAGNLGWGVPADALKTAFEGQPGLVGARVIFERXTGRSRGFGFVSFQTIEDAKAALQAMDGVELDGRPLRLSLAAQNPPAGSTPSTVQSQQEQTASGGSEPEVDKNSTSPAPARGRMPAAALPPTPAISNY

SEQ ID NO: 111029 - protein, 117 aa, Triticum aestivum
  Clone ID: PAT_TA_5447.pep
IRHETYPGAGRTRQPATTTGGRGRSRSSARCRRRRHRMGLRTASTGACPAACRCAPSGRPRLRPSRPRRRGRRGTTSSGQRRRGSSPGRRCSPTTSPSRRSPRPTRSSSPLSRSTAG

SEQ ID NO: 111030 - protein, 180 aa, Triticum aestivum
  Clone ID: PAT_TA_5448.pep
MLEVECRGLDHADALGLIAIGNRLRCISNWLVVAMQKLRHPHPEHGGGKQLVRVYGPRVKFERGPSLAFNVYDWKGEKVAPALVQKLADRQAISLTCGFLRNIWFADKYEADRSAVLEQARASDGGGEAGIHVVNASLGFLSNFEDAYKLWAFVAKFLDADFVEKERWRYTALNQKTVEV

SEQ ID NO: 111031 - protein, 123 aa, Triticum aestivum
  Clone ID: PAT_TA_5449.pep
MSCNGCRVLRKGCSDACVLRPSIEWIDGAQPQANATVFVAKFFGRAGLVASLAAVPLHHRPALFRSLLYEACGRTINPVSGALGLMWTSNWDLCQAAADAVLRGDSLRSLSDGPAVFTERDMA

SEQ ID NO: 111032 - protein, 151 aa, Triticum aestivum
  unsure (1)..(151): unsure at all Xaa locations
  Clone ID: PAT_TA_5450.pep
KXWEAWEHELSENERMWSDTHRDEHKETARAQRYRMMINNLLPHILDDTIRQEISMNINQISPNFPDQQPRPIRRLNWVAQKQDLQNLNARMKKYNTIMKATDEVTSSIISMMGGAIEDQKRASSSNAGISSHNLSEADDDVKTLIPESLP

SEQ ID NO: 111033 - protein, 707 aa, Triticum aestivum
  Clone ID: PAT_TA_5451.pep
RPRVRVLVTPYSGPPGQHKSKYVSNRIGWQGGLSYQFLSLSEVQKDAQNGNGLGDSQTNSNNTHLLRCHQCNDDENIDLTSLSSFKRTVECPLNFVPQASARDLFRPREAIEFADSYVGGSHLTPGKLALFACLREGPASKQQKAVKDHDDAKTIGWSISDILNKENLDKFIPATTAGLNGTVDTSDYMRRYKSSLTDGRLKDCVDLLESMEQKGLLDTKKIHHASFLSACKKQRAVMEAVRFCRRGENPKMSTFNMLLSVCANSKDFEGALQVMVLLKEAGLKPDCKLYTTLISTCAKCGKVDAMFEVFHEMVSAGIEPNVNTYGALIDGCAKAGQVAKAFGAYGIMSSKKVKPDRVVFNALISACGESGAVARAFDVLSEMTAESSESKGCKPILPDHVTVGALMKTCIQAGQADRAREVYKMLRGYSIKGTPEVYTIALRSCSLTGDLGFALKIYEDMNKIGVQPDEMFLSALVDVAGHARRADAAFEIIKDVRAKGFHVGIMAYSSCMGACCNAKDWKKALQLFEEIKAIKLIPTVPMMNALITSLCDGDQVLKAAEVLNEIKELRVRPNEITYSVLCVACERNGEAQLALDLFEKLKVDGIGLNPTIVGCLTGLCLQMFSYDLSLGNIIVRFNQGKPQIDNKWTSSAIMVFRQAITAGLLPSSDVLSQVLGCLRFPHDSSLKTTFIDNMGISCDMPHHPNTN

SEQ ID NO: 111034 - protein, 97 aa, Triticum aestivum
  Clone ID: PAT_TA_5452.pep
VNRVRPDLVRGEDMMSALDVQKMLGLPLLGVVPEDSEVIRSTNRGVPLVLTDPPTPAGLALEQATWRLVERDAMTAVMVEEQERPKKKGGFFSFFGG

SEQ ID NO: 111035 - protein, 168 aa, Triticum aestivum
  Clone ID: PAT_TA_5453.pep
GFGEYGVGAAAVLEEGGLLGAVASTSTKYSQIVIDARKSNIYTAEVSLLSTLKSLKHRLAAGARLPNVTILLPTEKKQVDLDEREKTLKLAGRVGQAVGSLLRRLGIKYQGEESHGRMRINGLTLRRWFNPKFTSAPPTGAPVELLPLPSRLAKGIADQQRDIRSLSL

SEQ ID NO: 111036 - protein, 75 aa, Triticum aestivum
  Clone ID: PAT_TA_5454.pep
KRESHSSSSKISTMMEYYAYRIQQRLNQSVVLQTSGKLFLQFIIDAATCVEQWRLNWYCELPILATTNCTASHNS

SEQ ID NO: 111037 - protein, 392 aa, Triticum aestivum
  unsure (1)..(392): unsure at all Xaa locations
  Clone ID: PAT_TA_5455.pep
MGSEQKPHVVFVPFPAHGHVAPHTQLARLLHARGFRVTLVHTELHHRRLLLAKGADAAAAAAPWLGVEVIPDGLSLEAPPRSLEAHHDALELNCPEPLKELLRAMARRPGAPPVSCVVVDAPMSFASMAARDVGVPDVTFFTASAAGLMGYMQFEELVKRGLVPLKGAGYKTDGSLDAPLDWVPGMKGMRLRDMPTFCHTTDADSALMRIHLHQMRVVAGSKAVVINTFHDMEKDVVDALAAFLPPVYTVGPLSSIVSSLPAGGGDPSSSTDTPSLFQEDXECMAWLDGKEARSVVYVSYGSHAAAGADKIKEFAFGLAKCGSPSCGSAADLAAALKAGERLLCLGAPRGVLPPTGRFLSPVVDSSGTESRVRPVVHVQRHPAVYTVKRRMP

SEQ ID NO: 111038 - protein, 119 aa, Triticum aestivum
  Clone ID: PAT_TA_5456.pep
RASCWKHLVCVLGLQLSVQARRPFTRLGFSLAGRVPNFQSVATNALNLGVSPPQYFTPPHTSHTNSALPPPVLAALAKGPAHAQGNLLAVAAASWPLLPQLASGDYTFMAYFLPVCRVE

SEQ ID NO: 111039 - protein, 86 aa, Triticum aestivum
  Clone ID: PAT_TA_5457.pep
RVFEETGRVMFKAPWTYFNSLRKALRNKHTGAISLMSPVNDFGGAMPRVSPVDLFQLPSTQLMVSIRCLLGQRHIAVSGQDLRSCN

SEQ ID NO: 111040 - protein, 174 aa, Triticum aestivum
  Clone ID: PAT_TA_5458.pep
REALHRKGEAYKLFWPDQPEFVRMAARFGVTVVPFGCVGEDDFVEIVLDYNDQKNIPYLKDAIKSFNEDFKGLIRDTVKGDDGNQVLHLPAVLPKVPGRLYFLFGKPIEMKGMDNVLTDRKKANEVYLQIESEVENVVSYLKRKRKEDPYRSITRRALYHATQDPSTQVPTFEP

SEQ ID NO: 111041 - protein, 224 aa, Triticum aestivum
  unsure (1)..(224): unsure at all Xaa locations
  Clone ID: PAT_TA_5459.pep
EFGTRPAPPPPRPPLPPPPFAPPPPSPPEAAAPPAAPPAAAPPPAPPRPPRPPPPLRACPRRCPVPRRVRVRRSGAASLRPSASHRPGASVRGAARGSCAAETASGVDTPSTADAPTPPHAPVHRHFPVKGVSIAFCLLHCALVRPMQFTAXPFPCLAHYLSARPLPCFSVPWRTPVPLVLDVTPPPRPLLRGSLARSFFLFYSPLARDTAWASFSVLASCLAF

SEQ ID NO: 111042 - protein, 515 aa, Triticum aestivum
  Clone ID: PAT_TA_5460.pep
AQIRSSGARSARRVAPGARSDPRPATSPADALVGPTPRSGKEKENIGNTSCHPREVNLSDNVPARRKAEPKSQQNARSGKAKETREKATCDFREDSPSGKAEERRHKAACSVREVSPSDDHLVKKQDGPGEEKAARKANFTVKKQARPREEKEANLSGNHPLKKQAEATSQQISRPGKQNSRDGSKSSDDRSRKRIPDEADSLPPEKQVEVAYEETRAIPSKRGMHHGQSNGTNARVKESKGSSDMSMSSSLENSTARHRSRSNSPFIPTEQPSGYTTAHRDSNMKYHVKEPRVSTFNSATTYQGSYLANSDGRKDAIGERNDPTVYTGADDRSSAYNSSIEEMTKRYAPGRAGDVYSPQGQGNGGSFSRRQDDHLQTSLYSLGSSGARYDQIGSSGARYDQIVSSGARYDPRSLTSPSYGLLSTTPRSSVIDKYSPGFSGSSGSGPSVMDSYAPGYLGANAPGRSLVMDRYALPLDETNYAMRGVHDVPGYGRDMPPQYPYRGPDPSGRGPPHI

SEQ ID NO: 111043 - protein, 127 aa, Triticum aestivum
  unsure (1)..(127): unsure at all Xaa locations
  Clone ID: PAT_TA_5461.pep
MSGDEKIAPAVKGKGNKRRTATLSQRGEGRLLYSTGHEWVREYTVDGYTVDAVLVDEKLAXFEIDGTTHFSXRNLGTPXLGHTAFKRRYIPAAGWELVSLSXQEWEGLQGETEQMAYPRRILSIGAE

SEQ ID NO: 111044 - protein, 436 aa, Triticum aestivum
  Clone ID: PAT_TA_5462.pep
PNSSKGGVGFQAILEAMGMAAVKAIAAITAIIAGGRLFLRPIYRQIAAHPSALPCPPPTPLLLLGARLLTARAGLSMALGAFLAGLLLAETEFSLQVESDIAPYRGLLLGLFFMTVGMSIDPKLFLSNFPAVSLILGLLIIGKTLLVTFIGRVFGVSTIAAVRVGLLLAPGGEFAFVAFGEAVNQGLLSPQLSSLLFLVVGLSMAMTPYLAAGGQFLASKFEQHDVRSLLPVESETDDLQGHIIILGFGRVGQIIAQLLSERLIPFVALDVRSDRVAVGRALDLPVYFGDAGSREVLHKVGAERACAAAITLDTPGANYRAVWALSKYFPNVKTFVRAHDVDHGVNLEKAGASAVVPETLEPSLQLAAAVLAQAKLPMSEIATTINEFRNRHLSELTELCSTSGSSLGYGFSRVMSKTKPVVSDDESDTIDGALAI

SEQ ID NO: 111045 - protein, 69 aa, Triticum aestivum
  Clone ID: PAT_TA_5463.pep
HRYIEREMEKGVVYIMGENEVVARPHSSLLKKVIVNYVYAFLRKNCRQGDKMLAIPRSQLLKVGMSYEI

SEQ ID NO: 111046 - protein, 97 aa, Triticum aestivum
  unsure (1)..(97): unsure at all Xaa locations
  Clone ID: PAT_TA_5464.pep
GTRAEQRLNKIHLVEEMKXGVAVEGYEESSVKAEEVQAKVRLVMESEEGQKLRERAAMAKGMAADAVKEGGSSDVAIYAFLKHVEDERSSRSAKSGH

SEQ ID NO: 111047 - protein, 239 aa, Triticum aestivum
  unsure (1)..(239): unsure at all Xaa locations
  Clone ID: PAT_TA_5465.pep
ARGCDNPFVIPEMDPTLRKQIQECNWQVVNVTTPANYFHVLRRQIHRDFRKPLIVTAPKNLLRHKECKSNLSEFDDVEGHPGFDKQGTRFKRLIKDRNEQKKVEAAMSGHVLSSVKLLFAVFGERQNSHMSYARESXVELQMPISYGPMQRQLTWSPNAEIVPCHEQPMKKPAYGHISPRLNTGPKAPSGRGSFGDIKDVGRAPAAATATGILTVHDAGPVGAGAIGIATGADQVPLMG

SEQ ID NO: 111048 - protein, 131 aa, Triticum aestivum
  unsure (1)..(131): unsure at all Xaa locations
  Clone ID: PAT_TA_5466.pep
ESTLTKIHPVCPPSLGRQPVARWYFPPEVDYRLSLLHPDAKGLIVWVYEAKVLSKAELQFLAMLPDLRPKVRVRAGCGTWRQMIWXKPLKQISGLEPDADARGMRSPRAAAASSHLSRLHPVVKFCTKAGQ

SEQ ID NO: 111049 - protein, 206 aa, Triticum aestivum
  Clone ID: PAT_TA_5467.pep
EFGTRPSPSTASQRRAKSHLVPGQRAAMSSNGKPNPQPPAAAAATNGAGAGGPPKMYQRPIYRPQGPAKGRRGGRSSCRFSCCCCFFWAVLVVLLLALVAAVAGGGFYLLYRPHRPAFTLSVARVNKLSLSSSATAPALTDSIDFTLTAKNPNKKLVYLYDDFTVTAATAANAVPLGEATVPGFWRGANNITVIKATVTAAALGVD

SEQ ID NO: 111050 - protein, 211 aa, Triticum aestivum
  Clone ID: PAT_TA_5468.pep
CGLSRNLPFALPLSANMQIYPTTSLFHSFTASNSNSQSSFTRPHLNPMLFMSHKRKPRKNNTSRPKRINRRGQSGYRQAYPTSPLFTISQHPTANHRLPAPILKSYAFYVTQEEETYGTTPASQPKRINRRGQSGYRQAIPGGEPPTPRASTSESAMASIICSSKLSGTLPELMLDTSEAAAARLAAPASTVTSAQLVLASAASDHPSLLE

SEQ ID NO: 111051 - protein, 348 aa, Triticum aestivum
  unsure (1)..(348): unsure at all Xaa locations
  Clone ID: PAT_TA_5469.pep
MAVGNEWINGYLEAILDAGSKLRVQGVSLPPLEPAPALASEESSAAYNPTRYFVEEVVRSFDDQALHKTWTKVVAXRNSQERNNRLENLCWRIWNVARHKKQVERDYSQEVARRKQEQELGSLEAAEDLXAELSEGEKETVPKPDGAAPHLSADEQRPQQRTRLAWINSEVRLVSDDEDEQSKDRNLYIVLVSIHGLVRGENMELGRDSDTGGQVKYVVELARALAATAGVHRVDLLTRQISCPDVDWTYGEPVEMLERLSSGDDDGDESGGGGAYIPSAAPARPRLRIRPPGGCSWPLCPSSRWTGALSRGSLTRPPPPPLLSSKPPPSQPRHAAPDAPGFCTLWYP

SEQ ID NO: 111052 - protein, 267 aa, Triticum aestivum
  unsure (1)..(267): unsure at all Xaa locations
  Clone ID: PAT_TA_5470.pep
MAMAAYSNQAQAMMRDYLLADPLVPYTSVLIGVFLCKMAYDLTRILSSFYFKGYSSLTKIQRVEWNNRGMSSAHAIFIAAVSVYLVASTDLFSDRLNGPITFRSSIISTSALGVSEGFIITVLVLNFCVYHSLSGMDYVLHHTLSLVAIAYTMLSGEGQFYTYMILISETTTPEINMRWFLDTAGLKKSSAYXVINGILIFVVWLAARGFSVLXVLSYAYAWADAWVKMHAFGYYLTLTVPSVLFVMNAMWFTKILKGVMKTLSKWS

SEQ ID NO: 111053 - protein, 111 aa, Triticum aestivum
  Clone ID: PAT_TA_5471.pep
EPPDALTYKIVFRGLCRGGGPIKEAFDFLVEMADKGFIPEFSSFRMLADGLLNLGMDDYLISAIELIAEKANFRESDVSAIRGYLRIRKFYDALATFGRLLDINNPRWTYR

SEQ ID NO: 111054 - protein, 286 aa, Triticum aestivum
  unsure (1)..(286): unsure at all Xaa locations
  Clone ID: PAT_TA_5472.pep
MQTPTMPTPMATRPTSTMAAKLPAPSTPRQCYLLPGRRAGLARGAPSASSKKRNPWLDPFDDGPDEEFDYTGVYSGGKQEEDPRPPEDAENPYGFLRFPMGYMPELDSLASKVRGDVRRVCCVVSGGVYENVLFFPVVQMLKDRYPGVLVDVVASARGKQVYEMCKNVRYANVYDPDDEWPEPAEYTHQLGVMKNRYYDMVLSTKLAGTGHALFLFMSSAREKXRYVYPTVNGAGAGLFLTEISSRRHQLADGGYNMYQGHAGXLGRPAKGVPXQPTPPLKVSSPR

SEQ ID NO: 111055 - protein, 121 aa, Triticum aestivum
  Clone ID: PAT_TA_5473.pep
GPHGHGHRRACTPWPERRCLSLRRGKKMQPLLDFVPCSSPSPSKRAPAAAGEMPVNASASVVASPELRSTEERAGPSPCARCSGERSYRVAMSGVPRAAVSSCVCAPHRRRRSWTTPRAEF

SEQ ID NO: 111056 - protein, 214 aa, Triticum aestivum
  unsure (1)..(214): unsure at all Xaa locations
  Clone ID: PAT_TA_5474.pep
QPEAGRGNGRRXMPRSRGSELPQRASPRAPLHLXTTASSEANGAHHRLVVDRSSPKIADRHSPRSPLPEKKRAGTRVAELETKLGKVQDXLKKLREQLVSAEAAKKDAQVALEEAKKHVGTKGSPKPAASPPSPALLAVEDEKKTEEVKVVEEPAADEEQESSINSPATDVFEVVRTESGDKENQSALVADESEEVSCGDNAALAEEDVEVEET

SEQ ID NO: 111057 - protein, 264 aa, Triticum aestivum
  Clone ID: PAT_TA_5475.pep
TSGNGGTSLVAETVKSSAEDSLQKDEINADVLKEARMLHFNSEVLLTPSMHDTLFRAIALSKKFGSKIFFDLNLPLPLWRSRDETKEFINRAWKEADIIEVSRDELEFLLDHKYYEYKRATPPQYYLDGFHLTRNWPQYYHYTPEEIAPIWHDGIKLLLVTYGTLRIHYYTPKFHGCVVGTEDALITPTTTDRTGSGDAIVAAAIRKLTTCPEMYEDQDTLERELRFAVAAGIISQWTIGAVRGFPTESATQNLKEQVYVPSMW

SEQ ID NO: 111058 - protein, 328 aa, Triticum aestivum
  Clone ID: PAT_TA_5476.pep
SYGVVAPSGLFVPIILTGATYGRLVAMLLGRHSGLDHGLVAILGSASFLGGTLRMTVSVCVIIVELTNNLLLLPLVMLVLLISKTVADSFNASIYDLIVRLKGLPYLDGHAEPYMRQLSVGDVVVGPLRSFNGVEKVGHIMHVLRTTGHHAFPVIDEPPFATAPVLYGLVLRAHLLVLLRKREFLPAQERYPKEYSIAARFEAQDFDKRGSGKQDTVDGVELSPEEMGMYVDLHPFTNASPYTVVETMSLAKALILFREVGLRHLLVVPKACDRSPVVGILTRHDFMPEHILGLHPVLLGGKWKRLRWHKAAVAKYFRDLIVRLANCG

SEQ ID NO: 111059 - protein, 201 aa, Triticum aestivum
  Clone ID: PAT_TA_5477.pep
KCLLSLFDMYHTIHKINSESNKEAEYYSLFVLLHLGCKIPKMANSLSFWYSQLPASIVRSKEMIFARTILRCYHLGNFKRFFCMIADEAAELQLCLVEPFLNEVRARALMYLNHSGYKLQHHPLTHLSDILMIEELELEDLCRICGLEISRSGDTKAFAPKQTTFSLPTPSSKSSGIYISRGDQKMIRALLGTPSVPKFVS

SEQ ID NO: 111060 - protein, 322 aa, Triticum aestivum
  unsure (1)..(322): unsure at all Xaa locations
  Clone ID: PAT_TA_5478.pep
APLLRRFFCCAAKSASATSAAPRAKKKNIGFLGSPQVAASVLDTLLAASSSPDSAFQVAAVVTQPPAAKNRGRKLLPSAVAQLALERGFPGDLIFTPERAGEESFLSDLKGVRPELCVTAAYGNILPQRFLDIPPCGTINIHPSLLPLYRGAAPVQRALQDGVAETGVSLAYTVRALDAGPVIACERFSVDEFIKAPELLAILFNIXNSDESWLTFDEEAVLLRNRLRPLAAPPRPRPQLQLLNQNGEPDVXDIKVISTNVSTSCDKVGDENEILFSGNSLLVPCSGSTWLEVLELQLPGKKVTXARDFWNGLRGQKLLKST

SEQ ID NO: 111061 - protein, 268 aa, Triticum aestivum
  Clone ID: PAT_TA_5479.pep
MPPPLSVSLPSPQPLSLLPRHARAAHSHPLALAQPLSTRAPPSSACSVVPARHSDYFDPRAPPSQRDAYGQPPLERDPPVPGGQAGRVFASYSIYKGKAALAFDPRPPQFVPLESGAYKVAKEGFVLLQFAPAVGPRQYDWTRKQVFSLSVWEMGTLLTLGLTDSCEFFHDPFKGRSDEGKVRKVLKVEPTPDGNGRFFNLSVQNRLLNVDENIYIPITKGEYAVIVSTFNYIIPHIMGWSTFTNSIKPEESQPYNRPQSSPELEWRR

SEQ ID NO: 111062 - protein, 222 aa, Triticum aestivum
  Clone ID: PAT_TA_5480.pep
ASNLGNSVYPKFSSGSLIPEHVLSPYKNVGSDSRRNDFHQKNPSSRNRSGPLFFRQMKDTRPHLSVAPDEASEGNVVQRRGRFQVTSDNPGQKVASSASSNSRPNLPSGVTRPASNSSTILPTLQFLMQQNSMQKEVLSRLISSIEETSDASDASTVGSSQSSGSLAREKGLESYVVQLQRSVTELAEEVQRLKLRNNQLEQQINGLSKKDERLRREGSTKQ

SEQ ID NO: 111063 - protein, 117 aa, Triticum aestivum
  unsure (1)..(117): unsure at all Xaa locations
  Clone ID: PAT_TA_5481.pep
GDPLPRFPASDXPAHFLHFGLCLHFDVSYNLKVFTEIPGETASPSSSAAGFVASRVNAARELARSAYLGYRRGGYFREGWELLLMRVLAVALPGLPFHRAHEYVNGVALAARIPKDE

SEQ ID NO: 111064 - protein, 169 aa, Triticum aestivum
  Clone ID: PAT_TA_5482.pep
MPATDSSASPAHHHHHHTSFGRHILSLRHRDHGQIHSAPPTPDHPNAANANPHPSPADREVDAFQRHAAELLLDLLPCSPDAAPADAKNAPPEILSIAWTQHLLDSFLICLEEFRSALLGGGPGALARPPLDRLVADFFDRAVKALDLCNALRDGLDLLRQWRKHLAIA

SEQ ID NO: 111065 - protein, 326 aa, Triticum aestivum
  unsure (1)..(326): unsure at all Xaa locations
  Clone ID: PAT_TA_5483.pep
MSGHDSKYFSTTKKGEIPELKEELNSQYKDKRKDAVKKVIAAMTVGKDVSSLFTDVVNCMQTENLELKKLVYLYLINYAKSQPDLAILAVNTFVKDSQDPNPLIRALAVRTMGCIRVDKITEYLCDPLPRGLKDHDPYVRNTAAICVAKLYDINAELVEDRGFLEALKDLISDNNPMVVANAVAALAEIQDSSARPIFEITSHTLTKLLTALNECTEWGQVFILDSLSRYKATDCKGDAEXIISGTKLPPRPLHAACPVLLAAVSGCLRLRPLLPSSVVLRTLRPDWAPPLAPPLAAVPAPPSGAFCDPGLGVQARPTFLAHGMAV

SEQ ID NO: 111066 - protein, 214 aa, Triticum aestivum
  unsure (1)..(214): unsure at all Xaa locations
  Clone ID: PAT_TA_5484.pep
IARTGDDLPPAAPQRTEPLPPLHSATSGPAFATSSAATPPPQASSPPPSHPHCGPPTPPHLPTSPASMTSPPPVPAPKNRPHDQGQXTPPPPPAPGAHLSHTMPGCPRRRCDRTRWSSDQAWPSRPPCPRGLPRRRLLSPPPRAASRRRGCCRPPPAPAAPPPPYPPGEAPPTHRALPARRAAPRPHTVGESVEGPAKSVCGGVHPQIWPMVRP

SEQ ID NO: 111067 - protein, 59 aa, Triticum aestivum
  Clone ID: PAT_TA_5485.pep
FLVDLVTKVRFNCLSMCLKLKDRRALEKINFESQIHGHICLLRAIRIFHVYHFGSNGWT

SEQ ID NO: 111068 - protein, 71 aa, Triticum aestivum
  Clone ID: PAT_TA_5486.pep
PPRHHGEQADILLCFLMRFGMMAAQIKAFFDSNGGLWQYQSISGNPTGIFFAMGTQGRQAKTQTIATCRLH

SEQ ID NO: 111069 - protein, 214 aa, Triticum aestivum
  Clone ID: PAT_TA_5487.pep
SMLRSVVPKISKMDRTSILGDTIDYMKELLERIRRLQEEMEEPHAGPAAAPLLSVFRELNPNEMLARNTPKFEVERKEEDTRVEIYCAAKPGLLLSTVSTLDTLGLDIQQCVVSCFNDFAMHASCSEMQREMISADAIKQELFKNAGYGGGCLWGGTSSCTARGPGPPAPAAAAAGGGGSSSRGVAAAPAAGKRAKIWEAFCNQSPHHNHFDSM

SEQ ID NO: 111070 - protein, 158 aa, Triticum aestivum
  unsure (1)..(158): unsure at all Xaa locations
  Clone ID: PAT_TA_5488.pep
MSTKLIALYITVCSVLFIISKMLISFLCYKKXARKKRIIETSLTGGKLVIFRSAAMQSLSPKAFMRMIMGLSSKDIIGSGGYGTVYLLRLDEKSAFAIKKLSRGSAEMDRGFERELDTMGDIKHRNIVPLCGYYAAPHFNLLIYELMPNGSLDTILHG

SEQ ID NO: 111071 - protein, 201 aa, Triticum aestivum
  Clone ID: PAT_TA_5489.pep
HEIQDTGLDYTIIRLCGFMQGLIGQYAVPILEEKSVWGTDAPTRIAYMDTQDVARLTFVALRNEKASKKLLTAAGPGAGSTQEVTTAGARAGGPDADVTTGAGAAGRDARETTGPVAGTSDAGDRPGFSEGPTGEADSPAPMNETYQLLGVEAPENETYQLLGVDAKDILTLEKYLQDYLSNILWKLQGLRGQSKQSDLIF

SEQ ID NO: 111072 - protein, 130 aa, Triticum aestivum
  Clone ID: PAT_TA_5490.pep
ECNTNTSSDSAAASTKAAVTTGNAGGNKNKNGYVPISESGNDDALQKLEEGLMSMTSSSSIGSSNGDTNAVDGDSESSSSSFSGSGAVCTAEEGKEQCVSERAPLIRVGDVEEEAHEHDGDGDGRGGGQV

SEQ ID NO: 111073 - protein, 440 aa, Triticum aestivum
  Clone ID: PAT_TA_5491.pep
MAIGTDDLEEAPPLLLLDDDEAAYPRPRRVALFVEPSPFAYISGYKNRFQNFIKHLREMGDEVIVVTNHEGAPRGFHGAKVIGSWSFPCPLYGKVPLSLALSPRIISEVAKFKPDIIHASSPGIMVFGALAIAKLLSVPLVMSYHTHVPVYIPRYTFSWLVEPMWQVIRFLHRAADLTLVPSVAIIKDFETAHVISANRIRLWNKGVDSASFHPRFRSHEMRVRLSDSEPDKPLIIHVGRFGREKNLDFLKMVMDRLPGVRIAFVGDGPYRTELEKMFEGMPAVFTGMMQGEELSQAYASGDVFVMPSESETLGQVVLESMSSGVPVVAVRAGGIPDIIPGDAEGRTSFLFAPGDLDDCVGKIRLLLTDDEFRGEMGRTARAEMEKCDWRAASKTIRNEFYSSAIDYWRKKQAEMVQPLQWLAQMFMPAPNRVIGGGIKQ

SEQ ID NO: 111074 - protein, 152 aa, Triticum aestivum
  Clone ID: PAT_TA_5492.pep
MLLFSSSPLSILSGMQNAARIINVEAMDNAKSWIVWLQGSSWFWTIIFQFLPNVLIFVSMYIIIPSVLSYFSKFEFHLTVSGEQRAALLKMVCFFLVNLILLRALVESPLESWILSMGRGYLDSADCKQIEHYLSPSFLARSSLSSLAFLIT

SEQ ID NO: 111075 - protein, 252 aa, Triticum aestivum
  unsure (1)..(252): unsure at all Xaa locations
  Clone ID: PAT_TA_5493.pep
KISWLEAKMDXXSLFDEFVQGGXMAVGSXXLVRRCKXLWAMAAQRFGFTDDERLRKLQTRKLVIGSRLSDYKEXAXHLGAGIXSSGRPGRYTANKAVRDFRMERKKTPIGRFFPVMELQLERSRWRVERAPPASDIYWNHLGMNKTSLALRRIAVNTCLIVMLLFFSSPLSILSGMQNAARIINVEAMDNAKSWIVWLQGSSWFWTIIFQFLPNVLIFVSMYIIIPSVPRPRPRYAIPNFPARQWGGGNKRG

SEQ ID NO: 111076 - protein, 122 aa, Triticum aestivum
  unsure (1)..(122): unsure at all Xaa locations
  Clone ID: PAT_TA_5494.pep
MADDEVVAASAEESLTTPLLEPAASPGDPSVEVSLYRRGAGPPKVFRSGLRGPRRDRLDVRGIQAEHGLRALFAFKPGVSRRGLRIRPDPATGXSAVPFRDGAAIALDGDAQGAGVVDQRLR

SEQ ID NO: 111077 - protein, 199 aa, Triticum aestivum
  Clone ID: PAT_TA_5495.pep
ALLLVPPPAASGPRPPARAAPSPLVPVPVCLLLGPQASGALCWAPAPPAFPLPRGSGLGSATGLLPLRGGAWGRPLLGCPGRRRSGLASSCSGVPLLLAGRGSLVGVVLDGPAVYFWGLRFVRAGVGAPLAGGPAGPAQVRSTGCSAGGRASVPLCGDLRARGPPQASLVRFADAGFFLDVKDISGERSFWSFYNRVVQ

SEQ ID NO: 111078 - protein, 127 aa, Triticum aestivum
  Clone ID: PAT_TA_5496.pep
GAARRQRRLLPRPGAAAGGAAGVRRPPPVLPHENCKIDDLELTPEELEMYIDLHPFTNTTPYTVVETMSVAKAVVLFRSVALRHMLIMPKYQGPQISPLVGILTRQDLRAHNILGAFPHLAKKSKTH

SEQ ID NO: 111079 - protein, 213 aa, Triticum aestivum
  Clone ID: PAT_TA_5497.pep
MAAMKPVLYSAAISSCSYRVRIALSLKGVEYEYRAVEWNDTDYEKINPIKYVPALQDGDILVSDSLAIILYLEDKYPQHPLLPQDLKRKALNLQIANIVCSSIQPLQCYAVIGLIKGKLGPDESLQIVHHYIDKGFRAIEKLLEGCDSKFATGDEVQLADVFLAPQIHAGVTRFDIDMSKYPHLERFYKAYMEIPAFQAARPENQPDAPSLRQ

SEQ ID NO: 111080 - protein, 165 aa, Triticum aestivum
  Clone ID: PAT_TA_5498.pep
VRSWRRLRNEPEWKIAPTVLTLCEHLFVSFAVRLLHQEATKAIAEATSKVKGQLTGGEDEGESSSGGGALVKQGRLWTVGRFAASGAAGGGAGGQRRGRRRPAGRRLEGGSPPRTVGRRAADPAEAGGATRAGAARGSPPGGATKGPGRAGDARGAFDAGAGGEV

SEQ ID NO: 111081 - protein, 191 aa, Triticum aestivum
  Clone ID: PAT_TA_5499.pep
LWLGVGAGGLMLLRLLLLLYLRLRYRGGTGKYGALVLPRFEIMLAILAMPCVSQASAALIRGGTTGGLAVGIVLIGILTAFLVALLLFLSLGITTGRLLQYKEVHQEGQEHRWYQEIVRRSLGPGKRGQWTWKDPARAARLVKLGPLFEDLRGPPKYMLTQIVVGGGGKRAAADQRIMASEDENEDAEAPV

SEQ ID NO: 111082 - protein, 97 aa, Triticum aestivum
  Clone ID: PAT_TA_5500.pep
IEAPGQTEAVLDEDERDRVYEMKASAWYQVTYHPKWVQRSREALEPDREEEDAPARLSFAWIPVEHLARIKLRCRGGVKVGRRGPVERLAAYMSWSL

SEQ ID NO: 111083 - protein, 97 aa, Triticum aestivum
  Clone ID: PAT_TA_5501.pep
MELKPGMSALVTGGASGIGKALCIAFAQKGLFVTVVDFSEQNGREVTSLVQKENKKVHGDVGVPSAIFVKCDGSIGGDLAAAFAKHVDTYGGLDICI

SEQ ID NO: 111084 - protein, 716 aa, Triticum aestivum
  unsure (1)..(716): unsure at all Xaa locations
  Clone ID: PAT_TA_5502.pep
SAPPSAHTRATPIGSPTPPKLRRRTEQDRTSSSPPAASSPLGSSPGPPTCPSPPRLAPVSPRALLARSLARSWSVSPRRAGETELKPGISARVSGVHRRIGKALCIAFARNVLFVTVVDFSEYNRRELTCLAQXRTENVIEXLGVPFTVYVCCYDSIETGLAXAEAKHVYAYAGLAIRIDCIAXSNKTLVYDDISEGTRXWRHAINVNFVAVIDGTRIASQIMRSQKKPGVIINIGSAAGLYPMFADPIYTGTKGGVVMFTRSLAPLKRHGVRVNVLCPEFVQTNMAEQINQKIVHATGGFLKMEEVVNGAFELIKDESKAGACLWITKRRGMEYWPSAEEQRKYLLNYTKSKRTVTKNVFPSIQTPEFYEKIVVHTLSHNFRNATRLDRVRLRLPIEPQSALVKIIYAGVNASDVNFSSGRYFSGSAKETAARLPFDAGFEAVGIVASVGDAVSHVKVGSPVALMTFGSYAEFTMVPAKHLLPVPRPDPEVVAMLTSGLTASISLEKAGQMTSGQVVLVTAAAGGTGQFAVQLAKLAGNKVVATCGGESKAAFLASLGVDRVINYQHEKIKDVLKKEFPKGVDIIYESVGGDMFDLCLNALAVHGRLIVIGMISQYQGEEGWKPKNYTGLCEKILAKSQTVAGFFLVQHAHMWQDHLDKLFELYASGKLKVSLDPKKFLGVASAVDAVEYLHSGKSVGKVVVCIDPAYSQTLAKL

SEQ ID NO: 111085 - protein, 97 aa, Triticum aestivum
  Clone ID: PAT_TA_5503.pep
LFLISGVACFIALVIFFTRILCQYGKYNQGDDEGGTPPEDCPVRRPERLRSIRDLITFVDMKEEEAKRAIKRKSSDDRRDRSIASSGGASSSSASTV

SEQ ID NO: 111086 - protein, 292 aa, Triticum aestivum
  Clone ID: PAT_TA_5504.pep
AEASGPAARAATVISPEEAVEWVKKDRRRLLHVVYRVGDLDKTIKFYTECLGMKLLRRRDIPEERYTNAFLGYGPEDSHFVVELTYNYGVESYDIGSGFGHFGIAVEDVEKTVELIKAKGGTVTREPGPVKGGKSVIAFIEDPDGYKFELIERGPTPEPLCQVMLRVGDLDRAISFYEKAFGMELLRRKDNPQYKYTIAMMGYGPEDKHAVLELTYNYGVKEYDKGNAYAQIAIGTDDVYKTAEVVRQNGGQITREPGPLPGISTKITACTDPDGWKSVFVDNLDFLKELEE

SEQ ID NO: 111087 - protein, 190 aa, Triticum aestivum
  Clone ID: PAT_TA_5505.pep
MGKYMRKPKVSGEVAVMEVAAAPLGVRTRARALAMQRQPRGAAVAKDQGEYLELRSRKLEKLPPPPPPARRRAAAAERVEAEAEADEVSFGENVLESEAMGRGTRETTPCSLIRDSGTISTPGSTTRPSHSNSHRRVQAPARHIIPCSAEMNEFFSAAEQPQQQAFIDKYNFDPVNDCPLPGRYEWVKLD

SEQ ID NO: 111088 - protein, 178 aa, Triticum aestivum
  unsure (1)..(178): unsure at all Xaa locations
  Clone ID: PAT_TA_5506.pep
MGARSTATAGEAVARRGSRKKGAMAPSVGGVEAASAAAMAGGRRSRAPPRLVGYEELPEYLKDNEYIRGHYRVEWPIRDALLSAFSWLNETLNVWTHLGGFLLFLALAVAGGGPEAAHEVAPGIMRFVVGSANSSWKSDQSGLPSHDAAAAVLGGHXVPRWPRMVFLVGAMACLAISA

SEQ ID NO: 111089 - protein, 249 aa, Triticum aestivum
  unsure (1)..(249): unsure at all Xaa locations
  Clone ID: PAT_TA_5507.pep
MASRSAALCFSAAVTSSTATGGGGRGRSRRRFLVVCCDGGRRSDLLSSSLAAKVLGAPTTFDAAKLTVQHAAGPAAFPRAYTLSHCDFTANLTLAVSETITSEQLRQWGWRRDDVFAEWKEMTCTGGPGGGEMTLHLHCHVSGPNPLQELAAGFRYYVFSKELPLVLKAVVHXGDAALFAARPELMDAXVWVHFHSSSRKYNRIECWGALREATKRSLLDGGLVDELQSEITERRSTWNIFNALVSFLL

SEQ ID NO: 111090 - protein, 485 aa, Triticum aestivum
  Clone ID: PAT_TA_5508.pep
CSRSAVGLNTRVGVASFITLLVQKVMINIKPYTAMLLKLLYTAVLEERSSAAKRAFASSCAAVLKYASQSQAQKLIEDTASLHLGEKSSQSSGAVLIKSYLSNAADVISGYNAVVIPVIFSSRFDDDKETSALYGELWEDIPSSERVTLQLYLPEIVSLLCDCMSSSSWAGKRKSAKATKSLCDALGEPVSAHHHNILKSLLKELPGRFWEGKDAVLDALASLCLCCHAAITADEPTMPSVILNAVCAACSRKPKLYREAAFSCLQQVITAFKDPGFFNSVFPMLYEVSNQSVIFKTTRSSSSLSTSAAAEQDESASVSVSLHKVLNCAASSITIALPQDIIHQKKNMLEVLLNSLSPEEGWQVKLSSFLCIKELCYKFSDSGGSTAWPEGTDDFVQEMFHSVASKVVDSIRLVKIAQVHVAASECLLELIKLYRDFPLEERREAKFEGELIQLCESEKSEQAKALLKQCLAALKELTGVTMTIG

SEQ ID NO: 111091 - protein, 151 aa, Triticum aestivum
  Clone ID: PAT_TA_5509.pep
MAADGTGGRTKPKPHAVVIPYPLQGHVIPAAHLALRLAARGFTVTFVNTESVHQQAARALGVDRRGCDIFAGARGSEDVRYELVSDGFPLGFDRSLNHDQFMEGVLHVLPAHVEELLRRVVLDPASASPPTLLLWQLAARVPSLDDRASIQ

SEQ ID NO: 111092 - protein, 153 aa, Triticum aestivum
  Clone ID: PAT_TA_5510.pep
PDIVSSDDLDPLPEGFASAGRGLVVPWCCQVEVLSHAALGGFLTHCGWNSVLESVWAGVPMLCFPLLTDQFTNRRLVVREWRVGVPIGDRGAVFADEVRARIEGVMSGKEGEELREAVKKMRATLEAATLHGGSSQRSFDEFVDELTRRCGGC

SEQ ID NO: 111093 - protein, 228 aa, Triticum aestivum
  unsure (1)..(228): unsure at all Xaa locations
  Clone ID: PAT_TA_5511.pep
MISLHTSPFTLLIKLEPGRRRLALPQYAVLRRPAPRSGVRAAAVAESVDAQLRQFARGGATEDDDRLQNYEALLVTRFLDIIQDLHGSNFRRVVEECLRVSAEYQRDAGDRAAKLGELGALFTSLDVGDAIMVSSSLSHMLNLANLAEEIQMVYQKKMETSRRGGFADEAXAPTESDIDETFQRMVXGWGKTPQEVFRRAQGRKTIDSVFTAHPTNPSGRGGARVPIK

SEQ ID NO: 111094 - protein, 168 aa, Triticum aestivum
  Clone ID: PAT_TA_5512.pep
MHSWGTRLLAASTTAALLLIATCAAASALDAFHVPSVEAQAHVTKINRFHKQINGNDKVTLTFSLSANLESLFTWNTKQVFAFVTAEYETAKNSLNQVSLWDKIIPDKDQANVQVEVKSKYPLTDQGTSLRGKKVQLVLHWHIMPNAGAMIRGKMPLSDFTLPDTYTS

SEQ ID NO: 111095 - protein, 315 aa, Triticum aestivum
  Clone ID: PAT_TA_5513.pep
HASAESSDSESSDEDDSGRISVCGEDSCDPDPKFARSSSFKADIFRSSRTSEDFATWQRIIRLDATRANAEWISFSRNQAEVPKEKALQSAASVGLKDYDHLEPHMIYHAARLVGLLEAYAIYDPEIGYCQGMSDLLSPIIAVMEEDDAAFWCFVGFMRKARHNFRLDEVGIKRQLKIVSQIIKRKDSHLYRHLQKLQAEDCFFVYRMVVVLFRRELTFEQTVCLWEVMWADQAAIRAGIGRTTWGKIRLHAPPTDDLLLYAIAACVLQRRKLIIEKYSSMDEILRECNSMAGQLDVWRLLDDAHDLVVNLHDKI

SEQ ID NO: 111096 - protein, 165 aa, Triticum aestivum
  unsure (1)..(165): unsure at all Xaa locations
  Clone ID: PAT_TA_5514.pep
STPTATWRTSPRARTGRPSPSRAPRAPRPHRAGTCSCSSXAPACKPGPRAVPAGGRAAAGHRLLPAPALHLPGRVLRGGPRLPHEPPNRARAQGRRAGRPAPSTRSSPATPSTAAAAPEPRARPRSRPAPPPRAAPPPHRRGRGGRGSTGSTSPWAAPPCGARPP

SEQ ID NO: 111097 - protein, 76 aa, Triticum aestivum
  Clone ID: PAT_TA_5515.pep
MAKCLAVALLLLVVLASCEGRELSQKDGALGATRGAGVAESKASSGSGLPDLPVVGTGTSTINGPLVVIPGVPSHP

SEQ ID NO: 111098 - protein, 182 aa, Triticum aestivum
  Clone ID: PAT_TA_5516.pep
MEQNQRSDVPISQDASNATAGVELALVPRFVGSMPPTAPRVMETGKETGGRSFNTKPSDNIFQNGSSKPEREPGNSSNKRSGKFEDAGHKDGCPEATYEYCVRVVRWLETEGYIETNFRVKFLTWYSLRATPHDRKIVSVYVDTLINDPASLCGQLTDTFSEAIYSKKPPSVPSGFCMNLWH

SEQ ID NO: 111099 - protein, 211 aa, Triticum aestivum
  Clone ID: PAT_TA_5517.pep
QERRDEPLEPHGPTARLKKAGVPDDRAGVAPVVPCPRAPASGRGRVRAGVAGQELRVDPAQPRPLCSVSPICRGFHEEDLAHAGDGGADRGGVGGAGDAGGGGDGQQVHAGGEARGGGAVAAAAEAAVRHMQRDGKGGVPVLPVVRRGRLRLPDLRGHPEDALPELRRVRDRTPGARADCHRLRHATPGTGEHAVIGPARDPRPRGSILFS

SEQ ID NO: 111100 - protein, 244 aa, Triticum aestivum
  unsure (1)..(244): unsure at all Xaa locations
  Clone ID: PAT_TA_5518.pep
IRHEEEHSNSARKKLLYNTDNKVADEEGNNPSWNQTITAVKSKEVFEEANHPIPSKMLSGEAXNTMSPSNRPTYRANKNAPHKSLCTSSVQATGTSGKTPGMKLSAYVDQAVEQSTSAANMEVIKEHQELEEKMKETVYLDNLSHKATEVKSNPSRTLSTTAIKSDVFENANHTIPTKKLSDVARNKAPSKRSTDPAKKITPRKKPRSSAVQATGTSQNTSVMKLSTSDGQAANQSKSTAELEA

SEQ ID NO: 111101 - protein, 117 aa, Triticum aestivum
  Clone ID: PAT_TA_5519.pep
IPRPVRAKHATAEMFNDRPRRPGSKLKFRWVGHRDPDYEILKKSKILSRRHEVENFALIEHELDEEKSLAEQQQENLNCNRRMGGPREGAIRPGMTNYISKIYSVNWNDVFLKMAEY

SEQ ID NO: 111102 - protein, 154 aa, Triticum aestivum
  Clone ID: PAT_TA_5520.pep
GTLHLTTRDSSVITVDTEGKTWHKIRMPLSVEDTSDIGFIGHSQERLYALHMNYSDDECQLTVWVLEDYATGQWTLKHTADMSETAGDDEVCTFVAVDSEGNLIFQINGRDEQLVSYDMEKRKFHVIFSFESYFTLRCDPYIPTYKEWLPKAAP

SEQ ID NO: 111103 - protein, 252 aa, Triticum aestivum
  unsure (1)..(252): unsure at all Xaa locations
  Clone ID: PAT_TA_5521.pep
VAARAPPPRARRSSTFNRNSIRFRLLQGYAALPPEWPPPPPRRGGCAPRLGSALPGVFAFGVPPPGPLGVPGGMPPPARVWGAWGVSGLAXPGARAVVPGAPARWAPALPPATPGRRGSSPATGRPRPPPPPPPPPTRGRAPPPRALPGHPPPPPPAPRPPPGAPPWHPPPRPPRTRPPAPSPPSALPPTTGPPSSSRRPAPPPAASMPPQPPPLTSTSPSPXDPSPPPPAMQTTNLHESNVDMLDVGLGCP

SEQ ID NO: 111104 - protein, 152 aa, Triticum aestivum
  unsure (1)..(152): unsure at all Xaa locations
  Clone ID: PAT_TA_5522.pep
RPPPSLPRQVVSQPRRLLSPLSAIDPPSPPRSPRPPAAYICTWCAERGPAPREKLSRGVRRWSHRLHQAVWLPNRGSVSAPPGRARVSPPRTAHLAAVAVSLRLMLWRGCRCRHLHRLSPPSRKSPTXTPPPXXXALRAHRPARSAAGTTFR

SEQ ID NO: 111105 - protein, 155 aa, Triticum aestivum
  Clone ID: PAT_TA_5523.pep
RCRFALEVVEAVAREIGGHRLGLRLDQFTAGPEEHALALHVVSRLNDLGVLYCHMIEPKVDGRRRVSRRLLPYREAFGGTFIASGGYGREEGDAAVGEGYADLVAYGRLFLANPDLPRRFELGAPLNDCVSATFYGAGAGAAHPAVGYTDYPFLE

SEQ ID NO: 111106 - protein, 395 aa, Triticum aestivum
  unsure (1)..(395): unsure at all Xaa locations
  Clone ID: PAT_TA_5524.pep
MEPVFFSLEEAMPEPDSKTWRTSSPPLEAHMLVARLGGVGAGEVVXVDEPWLLNVPTAPVANPEASTLYPNPTAEGSRKRPYDVHDMVGAVEVIPTPPAASPEVDPVAYNAMLRLKRKLDAHLAAVAMLRTTRGICPQSSHDNGASQNSDSIQGSENHTGDVSLHQLSSSSLEPSPSDGDMEGEAQTIGTMHISAEKANKRKESNRDSARRSRSRKAAHAKELEEQVSLLRVANNSLMRHLADVSHRYVNISIDNRVLKANVETLEAKVKMAEETMKRVTCTNNFPQAMSSISSLGIPFSGSPLNGICDNPLPTQNTSLNYLPPTTTNFDVNNNYIPEPALAFQIQDQIPSLHMQPMSCLDHHPQRMHIGIPTSAPTPQRESTTLDSTEIVNMVM

SEQ ID NO: 111107 - protein, 158 aa, Triticum aestivum
  Clone ID: PAT_TA_5525.pep
KLPRYDKSAFGGRGDRADPSTWPEVEGPTEVVLFEGWMLGFKPLPNEVVTAVDPQLEVVNKNLEAYYDAWDRFIESWIVIKIKEPNCVFQWRLQAEVAMRADGKAGMSDEEVMDFVSRYLPAYHAYLPTLYKEGPNGAKKDHLLVIDIDEERTPISGS

SEQ ID NO: 111108 - protein, 226 aa, Triticum aestivum
  Clone ID: PAT_TA_5526.pep
MALSLFWGSLPGLLLPPCSCVPFGTADPVSVRRWRSVTEYNFVGVKFKARAMGEKGLIRCILDVKLDGGGGTLEVPCLDIDSETWRLLRNLIELEQRNRETVGSHVTAYCVFISQVACTTKDVELLSKRGVIVHGHGNNEEVAKCFADLCKGIQFDPDDPNCNYLRETCKKLEKRFQSYPRRWIAWLKQRYLRNPWLAVGLLAAVIGLVLAVIQTVYSVLCYYKQE

SEQ ID NO: 111109 - protein, 303 aa, Triticum aestivum
  unsure (1)..(303): unsure at all Xaa locations
  Clone ID: PAT_TA_5527.pep
GXKYIYLADMMRFMRQEEAIKAMHLFEGAQEHCRVSKTSLFIWPGRAFSERSARARSLVASTAAGSMRTLVRWVAAGLLVSPPCLRCPGGAAARSSACTWAQLLVAVFVFGNTMKTIFEAIIFLFVMHPFDVGDRCEIEEVQVVVEEMNIMTTVFLRYDNLKIYYPNSVLATKPIFNFYRSPDMGEGIDFSIHVATPVEKLALMKERILRYIDGKKEHWYPGAMVVLRDVDDTNKLKVSIWLRHTLNFQDMGMRFVRRELVLQEMIRVLKDLDIEYRMLPLDVNVRNVPPLQSTRMPTTWNYA

SEQ ID NO: 111110 - protein, 152 aa, Triticum aestivum
  Clone ID: PAT_TA_5528.pep
INPTGAADPGLVYDIDPRDYNKFFGCTIVRRTNVSCDATTLPAYHLNLPTIAVSELRRPITVWRTVTNVGEADSVYHVEVQSPAGVMMEVEPTVLVFNATNRVHSFKVKLSPMWRLQGDYTFGSITWRKDQKTVRIPVAARMTIQDFYADVA

SEQ ID NO: 111111 - protein, 130 aa, Triticum aestivum
  unsure (1)..(130): unsure at all Xaa locations
  Clone ID: PAT_TA_5529.pep
YFLPPEISVATNTHFELNIIFQLHPYTIQKLAIRSSLSLVIHSFLSSSPPDLAAGSRPLLLPAAPDLFCPQLQASAPPCRSPQALPQGALRRPLXLAXLKAWGSPGPATYMGEEQQDSCRIRHEASYIPT

SEQ ID NO: 111112 - protein, 110 aa, Triticum aestivum
  Clone ID: PAT_TA_5530.pep
IIEFHQDEVWELPAHAEVLARSDKTGVEMFRLGDRAMGVQGHPEYSKDILMSIADRLLRQNLLLDCQVDVAKASFDVRQPDKEFWKKVCRGFLKGRLQPQQQKQQHKLQL

SEQ ID NO: 111113 - protein, 169 aa, Triticum aestivum
  unsure (1)..(169): unsure at all Xaa locations
  Clone ID: PAT_TA_5531.pep
MGNPEKLMAQIFDLKFTSKSLQRQARKCEKEEKEQKLKVKKAIEKGNVDGARIYAENAIRKRTEHMNYLRLASRLDAVVARLDTQAKMQAIGKSMGNIVKSLDSSLATGNLQKMSETMDSFERQFVNMEVQAEFMEGAMXXSTSLSTPETEVNSLMQQVADDYGLEVSV

SEQ ID NO: 111114 - protein, 232 aa, Triticum aestivum
  unsure (1)..(232): unsure at all Xaa locations
  Clone ID: PAT_TA_5532.pep
MGNPEKLMXRIFDLKFTSKSLQRQARKCEKEEKEQKLKVKKAIEKGNVDGARIYAENAIRKRTEHMNYLRLASRLDAVVARLDTQAKMQAIGKSMGSIGKSLGSSPATGNLQKLYQTVDXFERQFVNIEVQTEVVEGXLAGSTSLATPATAPPSPTPPVAGRRSRTATAAGIPQCLSRSDTDRDSSVAKRKLGQPYDATSRLARPAACTTALALHFTSGTATCNSLPAPAVG

SEQ ID NO: 111115 - protein, 286 aa, Triticum aestivum
  unsure (1)..(286): unsure at all Xaa locations
  Clone ID: PAT_TA_5533.pep
MLAGGEDGNGHLPRPRRPRRVGGMGSPSGQAASALPHPAPPPCTDYDMAYFKAYSHIGVHEEMLKDHVRTNTYRNAIMHHKDLISGKVVLDVGCGTGVLSIFCAFAGATRVYAVDASDIALQAMEIVRDNELSDKVIVLHGRIEDVEIEEKVDVIISEWMGYMLLYESMLGSVIFARDKWLKPGGLILPSHASLYLAPITNSHRYQDSIYFWRDVYGIKMSCMMPLAKQCTFMEPSVETISGENVLTWPTVVAQVDCYTIQAPDLETITAAYKFTSMLQAPLHGXA

SEQ ID NO: 111116 - protein, 231 aa, Triticum aestivum
  unsure (1)..(231): unsure at all Xaa locations
  Clone ID: PAT_TA_5534.pep
HEGPARADAELEGLQQALKILSDAEKQIRLSSERSTWFTAALLPLGSGHDSEITHSRSSSKQSAKAASETMLEAVRESSASRSVSHPLFTIRGSRKTLDHRTASGHSSPHDLASLSSRMRPSDNLIYGECRSVDRVLLDSAQASNSTGAKXIINGSSRXLSKFGRKCIDNCHSKDVAAATPLINGKLTSIXEFEGYLVAFISFEDSKIMSRAQRFVSSIRNSMGTALINVE

SEQ ID NO: 111117 - protein, 84 aa, Triticum aestivum
  unsure (1)..(84): unsure at all Xaa locations
  Clone ID: PAT_TA_5535.pep
XPTTNFVGITEIDVIAGVHXRRRRXXHGSRPRRLPRQRISAWPPRRACSWRPSCRPSTLHLWSSNPHRSVLSIEISFAALPCTC

SEQ ID NO: 111118 - protein, 335 aa, Triticum aestivum
  Clone ID: PAT_TA_5536.pep
RHEEHCYPTPTSTPDRRLTTKEPAPKHANIATPQRPSTAERRPTRREMAPKLAGIASPCWPSSAERRPVARGIAEKNADVVTLRRPSTAERRPIKREPAPKHADVVPLRRPSTAERRPVARDTGLKHANVGNPCCPSTPEPCLSRGSAAKHADVVITSCRPSTGERRAVAKENALKLDPKTPIRLRAMPGDSNGAMATAATPQKAITRNLVKTSKPEMKSYAKERLELQVGGKLKSSSVNLPPRKVLTSNVGANRVVENIRKPNKQGIQETVGSRVFASKNATPLQTGSAKTRVPNPPPPPPPRRASQSPSKPSPSPNKLSVGGRKPKASTPHWH

SEQ ID NO: 111119 - protein, 342 aa, Triticum aestivum
  unsure (1)..(342): unsure at all Xaa locations
  Clone ID: PAT_TA_5537.pep
IRHEPALRSLAAVYGVKPTTRLVRHHSRLGGGLRASSVAVNGEVGLRNRSGKKEDAVKEEKDRGLEPLYDDGFGGVTVKDYFAAARALCKDDGGPPRWFSPVESGQPAVEDAPLLLFLPGTDGVGMRLPLPPPALGKAFEVRCLHIPXXDRTPFDGLLQIVEKSIQYEHDLSPNRPIYLVGDSFGGCLALAAAARNPHIDLVLVLVNPATSFAKTPLQPILPLLEAMPSDLHVTVPYLLSFGMADPLKMAMVSIENNLSPPETLQKLSESLTSLLPLLSQLADIIPRDALLWKLKLLKSGAAYANSRLHAVQAEVLFLASGKDNLLPSGEEADRLFKALKNC

SEQ ID NO: 111120 - protein, 261 aa, Triticum aestivum
  Clone ID: PAT_TA_5538.pep
NCATEKLFKSFLGRGDSINEIRTQPLKPSLFISASKDESVRLWNVHTGICILIFAGGGGHASAHASVDFHPSDIYRIASCGMDNTVKIWSMKEFWPYVEKSFTWTDLPSKFPTKFVQFPLMTSVVHSNYVDCTRWLGDFILSKSVDNEIVLWEPKIKEQGPGEGSIDVLQKYPVPDCDIWFIKFSCDFHFNQLAIGNREGKIYVWEVQASPPVLITRLSSPQCKMPIRQTAVSFDGSTILACGEDGSIYRWDEVEHQAAKN

SEQ ID NO: 111121 - protein, 215 aa, Triticum aestivum
  Clone ID: PAT_TA_5539.pep
NSARGSSCFFEEITNVSAFQNVMDLNFWGAVYPTYFALPYLKASRGNIVVTASVAGRVPVARMSFYNASKAAVIRFYETLRAELGPHVRVTILMPGYVVSNLTMGKGVQKDGNVGFDEDARDINVGPLPVGRTETLAEVVVASVRRGDSYVTWPGWYWPFHMVMCAAPELVDCFSRAFYVSKSSDKDGDALSKKILMAVGGDKFYPKNIRSSQPQ

SEQ ID NO: 111122 - protein, 253 aa, Triticum aestivum
  unsure (1)..(253): unsure at all Xaa locations
  Clone ID: PAT_TA_5540.pep
VVRKFPAFAYYNVDRKIKPLVELLLELGVPRSGIPGIIRKRPQLCGISLTDNLKPMMAYMENIGVNKTQWSKVICRFPAFLTYSRQKVEITVSYLTELGVSKENIGKILTRCPHLMSYSVNDNLRPTADYFRSIGADAASLIQKCPQAFGLNIESKLKPITEFFLEREFSIEEIGXIMVNRFGIIHTLSLQENLIPKYEYFLTMGYPRYELXEISTVLWVQFRAEDKTSVCSDDWLWGEVDSEPDVVSLRNQI

SEQ ID NO: 111123 - protein, 175 aa, Triticum aestivum
  Clone ID: PAT_TA_5541.pep
MLRAGGSRLVAPGLRRLLGPGAGERAAPGLAAAGARAYHERVVDHYNNPRNVGSFDKDDPNVGTGLVGAPACGDVMKLQIRVDEGTGKIVDACFKTFGCGSAIASSSVATEWVKGKQMEEVVSIKNTEIAKHLSLPPVKLHCSMLAEDAIKAAVKDYESKKAKLGDSPAEKAAEA

SEQ ID NO: 111124 - protein, 151 aa, Triticum aestivum
  unsure (1)..(151): unsure at all Xaa locations
  Clone ID: PAT_TA_5542.pep
AAARAGTLRRQHRAAPQLLLFGEMDYALKFPFYTTLERLDRKWNIIHSDARGSHILKTQYLPYGINQELFALADEDFTFSQSIHXDELLHLDRWVKENKLNQLQFAQKMTYCYLSAAATIXPELSDACISWAKNGVLRTIVDEFFDVGGSK

SEQ ID NO: 111125 - protein, 221 aa, Triticum aestivum
  Clone ID: PAT_TA_5543.pep
MTPSAVANLAGASPLPAFAPRARSRPNSASPGPFGPAPRRLAVAAPPRAFFSSAPYQPPEEGYSSRREYGLVPMVIEHTSRGERAYDIFSRLLKERIVCIHGPIADDTASLVVAQLLFLESENPLKPIRLYINSPGGVVTAGLAIYDTMQYIRSPVTTICIGQAASMGSLLLAAGARGERRALPNARVMIHQPSGGAQARPPTSPSRPKEILKLRDRLNKI

SEQ ID NO: 111126 - protein, 59 aa, Triticum aestivum
  Clone ID: PAT_TA_5544.pep
EEQRRRGKQGNGGAVSSLMGGCKVQSFLRSCSCLVGFQHSMLNSYIRLQLVILRQTVYH

SEQ ID NO: 111127 - protein, 292 aa, Triticum aestivum
  unsure (1)..(292): unsure at all Xaa locations
  Clone ID: PAT_TA_5545.pep
PAPPRCPPSQPGPVRARPPPARPRPRAAAPRLLGPPPAAGALLLLRPPRRAGPGGHLPPPGVRPRRQRAESISPGERAHRIFSRPRSRRGASAFLGVADERASPLVAPQLFLDXAKTPLTPSSFFINSGGGVTAGLAIYDTMQYIRCPVNTICIGQAASMGSLLLAAGARGERRALPNARVMIHQPSGGAQGQATDIAIQAKEILKLRDRLNKIYAKHTGQNIDKIEQCMERDLFMDPEEAREWGLIDEVIENRPASLMPEGLSAVDPPHHGGGAGANGRGRDRDMEEPSAV

SEQ ID NO: 111128 - protein, 431 aa, Triticum aestivum
  unsure (1)..(431): unsure at all Xaa locations
  Clone ID: PAT_TA_5546.pep
MGSKAVWLPVALLLAAVALSSVLTPPAAAAATESGEADHAVQQHSERISGSAGDVLEDNPVGKLKVFIYDLPRKYNKKMVTKDPRCLNHMFAAEIFMHRFLLSSAVRTLKPKEADWFYTPVYTTCDLTPAGLPLPFKSPRVMRSSIQYISNKWPFWNRTDGADHFFVVPHDFGACFHYQEEKAIERGILPLLRRATLXVQTFGQENHVCLKEGSITIPPFAPPQKMQAHLIPPDTPRSIFVYFRGLFYDTGNDPEGGYYARGVRASLWENFKNNPLFDISTDHPATYYEDMQRAVFCLCPLGWAPWSPRLVEAVVFGCIPVIIADDIVLPFADAIPWEEIGIFVEEKDVPKLDTILTSMPIEDILRKQRLLANPSMKQAMLFPQPAQPRDAFHQILNGLARKLPHPEGVYLPPGEKHLNWTAGPVGDLKPW

SEQ ID NO: 111129 - protein, 177 aa, Triticum aestivum
  unsure (1)..(177): unsure at all Xaa locations
  Clone ID: PAT_TA_5547.pep
DNSNIYISLPNNKANWVSGRPSSTFTENTLTLLIINPQSYYPVNLNRSGQQKRKKTPEPHDLASHPACAPPGRPPPPAPPPPPPPAPXPPPAPAAGPPRRSWPPRGCPTAAARSGLVPPGVQAXSAPGPPPGRRARHGTGGGARGSGRAPRPRAGPAGLPGLAPVGGLEHAGARRTT

SEQ ID NO: 111130 - protein, 147 aa, Triticum aestivum
  Clone ID: PAT_TA_5548.pep
KRVFPVRLGKFKNVGTQGAVEGGHGDSAVLRREEGESSSSSLDARKCFSMGTYQYVLGTSELQVALQPGRRRNGAMRTRPPGISCVNADIMEGKKICARNKGESFSMSKIWQWSNLKGKLPAGSDDCSEAGSLPWMKRGGTGDKLNM

SEQ ID NO: 111131 - protein, 177 aa, Triticum aestivum
  unsure (1)..(177): unsure at all Xaa locations
  Clone ID: PAT_TA_5549.pep
MRKLKFHEKXKLLKKSNFLLWKREGGHREAAVTQRYSLVDRDDYKKYNGICLMAQKLVNIIKQMDPRDPFRIEMTDMLIDKLYNMGVIPTKKSLVKCEKLSVSAFARRRLATIMVKLKFAEHLKEAVTYIEQGHVRVGPETVTDPAFLVTRNMEDFITWVDSSRSEKKIMEYNGALE

SEQ ID NO: 111132 - protein, 66 aa, Triticum aestivum
  Clone ID: PAT_TA_5550.pep
FRHHPNIQQGDMCTFLFKHKQGRCLSLSCAPSLDTPPSAASIVYTYDPLNYVSLLEIAHLWEDGRV

SEQ ID NO: 111133 - protein, 115 aa, Triticum aestivum
  unsure (1)..(115): unsure at all Xaa locations
  Clone ID: PAT_TA_5551.pep
AAAXPGRAEETANFPTNVLFFGXSQDDVSTGRAQPQQAPATTTPQSAPTPSQXKRRPPGACGLRRLLGCGGAXSPPPAPQEEDAARDIEMGLAGVGESSASSRQTKPPQQPAGSC

SEQ ID NO: 111134 - protein, 203 aa, Triticum aestivum
  unsure (1)..(203): unsure at all Xaa locations
  Clone ID: PAT_TA_5552.pep
AVQGDQASIIGGAIEFIRELEQLIQCLESQKRRRLYGDTPRPVADASAPVVPAASIHEPPPPPQGHEAPPFYVSPSLSFPGAGNGDGAAGAKVMIDLDACGGGLREEVGENKSSLADIEVRVLGEDAVIKVLSRRRPGAXWIKTIAVLEEMHMSILHTNITTIEQTVLYSFNVKITSEPRFTAEEIVGAVHQILSFIDVNYTL

SEQ ID NO: 111135 - protein, 135 aa, Triticum aestivum
  Clone ID: PAT_TA_5553.pep
DSARAHPRQAATMRQSRHRPSIRRAVPPSSLSLIWQPSATTLRALAGLTSSARHPHSIGAGRRSSGPRRSSSWALSPFTSYAMYRPLPEAPPHPCAPLMSPSGPRPHPPPPACTRPHQILKAALKGREMMLVKTN

SEQ ID NO: 111136 - protein, 171 aa, Triticum aestivum
  Clone ID: PAT_TA_5554.pep
MACQQSRAYAAILQRSAAAAAADPRRVASLHAAILMPGLLACDQFLANHLLIAYFRSPLRPRRHGLRLLDEMPRRNAVSWAAAVSGLAQGGRPREALALFRAMRREGAPPSGFALVSALNASSLVAPAGGAHARQLYALAVRLGFESHAFVLNAFLAAMVRHERLADAVRL

SEQ ID NO: 111137 - protein, 208 aa, Triticum aestivum
  Clone ID: PAT_TA_5555.pep
SSALNPDDTLLSERAPGQGTTIIENNQPGGCAEPSRLGESGSSALNPDDTLLSQKDSAMGATIIENNQPLGSLESQDSSHYSGETEVAKQDSCTAAADANDLTVSRQAEIDGMKTEAPISLELETKSDLGNRQGETEVNKVHSNNGKKFQDPTEPTVSDQTEHDIVIKGNVPRSQQTRGAEVQGSSETGAVGSLKSLASGIRNFWRNL

SEQ ID NO: 111138 - protein, 166 aa, Triticum aestivum
  unsure (1)..(166): unsure at all Xaa locations
  Clone ID: PAT_TA_5556.pep
MASPEPSAGGDAASQSAAVQPHQLQTPEEIKGQEMMNNCAVRSVLSGVLGXGGLGVLMGLFFGALENPIMSEEMTARQQIVYQAKSDGXKSMSHAKTFAVMGLIFSAAECVVEKARAKHDITNSAVAGCVTGGALAAKGGPQATCIGCVGFGAFSVAIEKFMERHT

SEQ ID NO: 111139 - protein, 439 aa, Triticum aestivum
  unsure (1)..(439): unsure at all Xaa locations
  Clone ID: PAT_TA_5557.pep
MPPRGLGPRFACANTTAASSSSTPSRRRLRLRIPPYQGHAKPIGFSATAMCAAGSLPGPVAQDDDAVSGYRLPPKEIQEIVDVPPNPSYHLSPRRDRIMFLKRRAMPPLSELAKPDKILAGIRIDSSSNMRSRMSFYTGISIHLLMDDGSLGPEKVVHGYPDGAKINFVTWSPDGQNVAFTVRYEDEVIXLMLWIXMGAPFEGISESGEARPLFRQTDIRLNAIFELFVWVDHSTLLVCTIPSSRGDSLKKPLVPFGPRIRSNEQNNVIQMRATKEMLKDLHEEELFDYYATSQLVLVSLDGIVKPVASPAIYTFLNPSPDEKYLMLTCVHKPYSSIVSYKRFPKKVELWTVHGRFVRELCDLPLAENIPIAANSVRRGKRLIRWRPDMPSTLYXRISWCYGLHALVYEYWHKTRRTRTWVISPDCNDLSPRLLFDRSS

SEQ ID NO: 111140 - protein, 265 aa, Triticum aestivum
  Clone ID: PAT_TA_5558.pep
NAARPTLYGCCVLVEEIVQRPSKLVSMLTNEKPVFPRRSRYVVTTPRCYCILSRLPFFELHFGVLQSILMEERLEWLTDGVSMLTSLSPEEDCEDGDICEGSEIVGQELYFGCTTVEKSFEPSVEVSPKQLSDTDNNSEYRENQLDFISQEVQQESGSPVKEEQNVLVTGTATQCYTAEESDNSVSEDTATGVSGVKLDEPDSLPIIPNESDTKENSHVLSHEDVNDGELDIFVNDTILPLIRSRLSEGSESSPSSKTSFKHFEK

SEQ ID NO: 111141 - protein, 182 aa, Triticum aestivum
  Clone ID: PAT_TA_5559.pep
MDARVASLETELALSVTKTGGLEAEVMAKKRELDLLKGKSDKLQSEVAEAEKKHSMSAEEVERLRVELGVLAKAKEVASKAFDAEKTEIVKELESLKRKVEEIQADKEAAEGVTREKDAQTVKLRAELEELHVSMSQLQTSCDELDTEQSRLQSEKNSVQKALDAEKAEAGKLMSKIKALEN

SEQ ID NO: 111142 - protein, 301 aa, Triticum aestivum
  unsure (1)..(301): unsure at all Xaa locations
  Clone ID: PAT_TA_5560.pep
MSGGGQAAVSFLTKVAKVAAGLGLTASVVSTSLYTVDGGERAVVFDRFQGVLPAVVAEGTHFLVPWLQXKPFLFDIRTRPHSFSSTSGTKDLQMVSLTLRVLARPDVERLPEIFTNLGLDYDDKVLPSIGNEVLKAVVAQFNADQLLTDRPHVSALVREALVRRAGEFNIVLDDVAITHLAXGHDFAQAVEKKQVAQQEAERSKVPRLRGAGSSRCRAGXILRAGGRRASSARRISDAPAVVGNGPTQLMEEARLSRGIAGVSAQSADVSPHPPIVDNGPAAAWAQHCPGECIATYRPLGH

SEQ ID NO: 111143 - protein, 218 aa, Triticum aestivum
  Clone ID: PAT_TA_5561.pep
MAPAIEAAEKVKVASAPVKAPVLNERTLSSMTRRPGSAHSWHDLEIGPDAPTIFNCVIEIPRGSKVKYELDKKTGLIMVDRVLYSSVVYPHNYGFIPRTLCDDSDPMDVLVIMQEPVVPGCFLRAKAIGLMPMIDQGEADDKIIAVCADDPEYKHFNDIKELPPHRLAEIRRFFEDYKKNENKEVAVNDFLPATAAYEAIQHSMDLYATYVGGRGLRR

SEQ ID NO: 111144 - protein, 123 aa, Triticum aestivum
  Clone ID: PAT_TA_5562.pep
MSVQVASPATAGERTMATTAWPYLEYMAQWERQVERRQLFLRSYHFSRDAEVSPRARTRRVVWAGARRLRRAAAKGLRRLRARIRLCFGWAAPALRRRSSPRRGGVHGFRYGRIPRGKAPPAA

SEQ ID NO: 111145 - protein, 176 aa, Triticum aestivum
  unsure (1)..(176): unsure at all Xaa locations
  Clone ID: PAT_TA_5563.pep
MLHVRLAPGPAPRNLSRRWDSSAYLHSWCSVPCPSRLSLSRAYSIKSSSIGSATGLCLGQCCRIKPLSCKCKLGRSSQPPPDSRQHFSASSSASEAVLTAQSDIRKLFVANEKIGVLLLNLGGPETLDDVQPFLFNLFADPDIIRLPXAFRFLQKPLAQFISVARAPKSXXXXASI

SEQ ID NO: 111146 - protein, 474 aa, Triticum aestivum
  Clone ID: PAT_TA_5564.pep
MPTVCIKWQKQVFPGIEIDTSQPPMVFKTQLYTLTGVPPERQKIMVKGGILKDDTDWSTLGLKDGQKLMMIGTADEIVKAPEKGPVFVEDLPEEEQAAALGHSAGLYNLGNTCYMNSTLQCLHSVPELKSALLSYSDNVRGNGVDQASHSLTVATRNTFGELDQSVRPVAPLHFLQMLRKKYPQFAQQQNNVYMQQDAEECWTQLIYTLSQTLTSEASEPTAAQMKELFGIDLVSRVHCAESGEESSEAESVYSLKCHISHDVNHLHEGLKHGLKTELEKVSPSLGRTAIYTRESRINELPRYLTVQFVRFFWKRESNQKAKILRKVDYPLELDVYDFCSDELKLKLQTPRQVLRDAESARFGLKVEVKTSSSQNIEGSSTSAGESSSMDIDKADSSVPKKQLTGIYDLIAVLTHKGRSADSGHYVGWVKQDDGKWIEFDDDNPSIRKEEEILKLSGGGDWHMAYICLYKARVI

SEQ ID NO: 111147 - protein, 214 aa, Triticum aestivum
  Clone ID: PAT_TA_5565.pep
MASAEIPNADTADPNPSPNPAARSPSPPLPPRKRRLSLSPSRSTSPRRSVSRSRSPRDRRSRSRSRSRSRSRSRSRSRSRSRSPRQPEGKRRRQNDLTVEACRDYLRDRCTRSDLECKYAHPHQSVSVDRDSKVTACADSLRNNCFRGRTCRYYHPPPHIQESLLRSIGLDVPQVKTVCRDFARGRCSRSANECRFLHHSSVQECAIVCQDLRE

SEQ ID NO: 111148 - protein, 293 aa, Triticum aestivum
  unsure (1)..(293): unsure at all Xaa locations
  Clone ID: PAT_TA_5566.pep
LKGQLFLDKFQEKVQHTFLDYISSGFELNFMVAVDFTASRRDPRVPQSLHYIDPSGRPNSYQQAILGVSEVLQFYDNDRRFPAWGFGAKIPRGSVSHCFNLNASTNDCEVVGVEGIMSAYSSTLYSVSLAGPTLFGPVISKAAEIASHSVQYGNNKYFVLLIITDGVITDQQETKDSIVRASDLPLSILIRGSPGMPISLQMRFLDADFGKRLESSTGXVATRDIVQFVPMXEXNKWAVTVVQXLLEXLPGQFWSNAHRDISRTPSPAAATLSPVRRRPTSWPTLNPRAPRNH

SEQ ID NO: 111149 - protein, 176 aa, Triticum aestivum
  unsure (1)..(176): unsure at all Xaa locations
  Clone ID: PAT_TA_5567.pep
MSMSMATTALLRLAPLPPHPRLLAPTSKKPALLAPLGSGRRALRLARAAGDGLADQTVYNGVYGPWSVDDADVREVLLYRAGLVTAAASFLVAASGAFLPEGNAVGDAVRRGADLFFAAGAGGLGLSLVLIHIYVTPIKRFLQALWASXVLGSVGTYALAARPXXEGLVRYVLDTP

SEQ ID NO: 111150 - protein, 174 aa, Triticum aestivum
  Clone ID: PAT_TA_5568.pep
APARPGRCVSPDLVRWLATKRFLSRASSPPAAAASSSPAAAASAGPPAPPTAGPPESAAGATGARPGLPSALPTVPPLLPLESLTALSAPVPPLRTRASGAVGTGFAPVAPDGPVMTLAGLAPIAPVARVTLVAHEVLALLPLHHENVVKLVGYCHEAQKKVVNNGKIYWCRHC

SEQ ID NO: 111151 - protein, 152 aa, Triticum aestivum
  unsure (1)..(152): unsure at all Xaa locations
  Clone ID: PAT_TA_5569.pep
MSQEEVHDAGLALGLSLGGGGGGGGDGSSSAHRGSNSGRLTLWEAEPSLTLSMPDDTTMTGTASGGVSSMSVGGAVKRERAEEAELGEMVSSTAVGAEEDDDGSTRKKLXLTKEQSALLXXRFKEHSTLNPVRTFVRAYPRVLVTFESIHRC

SEQ ID NO: 111152 - protein, 169 aa, Triticum aestivum
  unsure (1)..(169): unsure at all Xaa locations
  Clone ID: PAT_TA_5570.pep
MSDSDQSTVVFGLHLWELVGIGVGAAFVLLLVLLSLLCLLANRRRRRRRAPAGPVLHLATVAPSAHPKNPTKPPKDIQEVPSRGAQAPVGGTAPKVPLAQILXAXPQESIQIETGREHRITFPEQXAXHHQRTGGPSSPGPSXQSXXGAPSPACPSLKPGWGHWSLSRT

SEQ ID NO: 111153 - protein, 167 aa, Triticum aestivum
  Clone ID: PAT_TA_5571.pep
MECGRRQWQAQLAGLALAFLLFAPALVQCAGAEADGEKDGLPSPGKTVPPVPPGWTGDSGSAQGSSPDGSTWKYEWGWAAGPVGKGSGFGYGYGYRGSGDAGGGGQGGGSGVGSGRTFGPRDRGYGGYPGGYGGNGAGGYNGEGAFGGEDGGAGWNKRGGFRGGGWR

SEQ ID NO: 111154 - protein, 87 aa, Triticum aestivum
  Clone ID: PAT_TA_5572.pep
MRAALPAARRRWIYRGWTSPSPSSRCSWPPAWRTTTTASSPPPSPAASPSRSSSSTASRAGTATPWAPAPSCSRRRRSSTTRGPRPS

SEQ ID NO: 111155 - protein, 180 aa, Triticum aestivum
  unsure (1)..(180): unsure at all Xaa locations
  Clone ID: PAT_TA_5573.pep
PAGGLARAAAGVTREAEPAARRASSRGAQTPSELLESIFLKGPYVEPSLAYPDDPIEELSIDDIEIDDEVPLSPPPASSSACHMNKKATIRHEXRAKLFEGSSDADKPRMRSTQEILTKYKFGGDATAAAAHAKDKLMQRQEKLERISQRTAELQDGAENFASLAQELAKTMENKKWWKL

SEQ ID NO: 111156 - protein, 213 aa, Triticum aestivum
  Clone ID: PAT_TA_5574.pep
EGAFSTSPPPIGGRQEVMAENGGAAREAAMLGFHIKPVFSYYAYHGPIFRAMVQLCHGKEDGISNYGFICHCKSCGQSQTFGFDELGQISCGCANRTVGPLWTGPLHDRSSITEMLNLAVEWGWAHTSENGVTLEKLLGTMIEESDPRLPPGYIRLDEIASRAKVNSPPLGTLIHSLQKEGYAACRSHIGANAVKTNSPISSCIVVAREIRNL

SEQ ID NO: 111157 - protein, 276 aa, Triticum aestivum
  Clone ID: PAT_TA_5575.pep
MAAITTTTASSSFLHRRISSSPATTTTPRSHLVFFHARNRCHYRLTCRATDVSGAEPSAPPETGGGSSWLPVVPLAALPRGERRVIVQDGEEILLLWYKDEVFAIENRSPAEGAYTEGLLNAKLTQDGCIVCPSTDSTFDLRTGEIKEWYPKNPVLRALTPVLRKLFVYPAKTDGENIYISIRGAASSGGSAEILFSGKAQPGSTASDVNIEEVRMVVDEGVGGFGFTAYNELVNGKAAIIGFLLLIDFELLTGKGLLKGTGLLDFIYAISRAFSS

SEQ ID NO: 111158 - protein, 213 aa, Triticum aestivum
  Clone ID: PAT_TA_5576.pep
NSARAAMAVQPLHFVLVPLLAPGHVIPMLDLARLIAGRGGARVTVVLTPVSAARNRAVLEHALRAGLAVDVAELQFPRPALGLPEGCESHDMVTEPSHIMLFYEAVWLLAGPLETYLRALPRRPDCLVADTCNPWTADVARRLDIPRFVFHGPSAFFLLAHHSLAKHGVHDNDSVAAGEFEQFEVPDFPGRVVTSKATSRGFFQFPGMEKEKA

SEQ ID NO: 111159 - protein, 136 aa, Triticum aestivum
  Clone ID: PAT_TA_5577.pep
SPSHPGRPRGSTGSWSPHRTRTPRASSSSPGSPRRRYLSPPTPTPMPPCIRERSDGAATARKRRRSAAASWPLSPGERLSYAGSGRGKASSAARSRRKRRRPPPSGEIPLPRQRRWVSGGRSEISEKAKVRLGCRI

SEQ ID NO: 111160 - protein, 88 aa, Triticum aestivum
  unsure (1)..(88): unsure at all Xaa locations
  Clone ID: PAT_TA_5578.pep
MAAAAGGKETMRAPHILIKHKGSRCKASWKDPXGRVISATTPLPCASASSTTRSSPAHASFVDLAAQDSVXSSARRNGGDLGCYCYTI

SEQ ID NO: 111161 - protein, 189 aa, Triticum aestivum
  unsure (1)..(189): unsure at all Xaa locations
  Clone ID: PAT_TA_5579.pep
MPSFPPPGGVTVCEINRDLVVADSLSEDRAKEAYGDVLGMVFSPIPFQPDDLLAKHEAPAPDEAELPESVPRTSLVSTIAESFKQMLFPSCNPKLLEEFDTQKVSWNPHKHCLAFVSGKDQVTVHDFEDSDGKESCILTSEHQKEVKAIEWRPNSGKMIXVGCXGXXCLWSAXYSGXXCSLSLFFFGAP

SEQ ID NO: 111162 - protein, 145 aa, Triticum aestivum
  Clone ID: PAT_TA_5580.pep
MAFMRTSSNASSGMGVAPDIRETFLELQMKKAFRYVIFKIEEKQKQVVVEKTGATTESYDDFLACLPEKDCRYALYDFDFVTGENVQKSKIFFIAWSPDTSRIRAKMLYSTSKDRIKQELDGFHYEIQATDPTEVELDVLRDRAH

SEQ ID NO: 111163 - protein, 127 aa, Triticum aestivum
  unsure (1)..(127): unsure at all Xaa locations
  Clone ID: PAT_TA_5581.pep
MAFMRTSSNASSGMGVAPDIRXTFLELQMKKAFRYVIFKIEEKQKQVVVEKDGGYNXNEXYDDFLACLPXNDCRYALYDFDFVTGGECYRKARFSSFAWIPLTHPRISPPTMLYTNLPKGPASSNEL

SEQ ID NO: 111164 - protein, 230 aa, Triticum aestivum
  Clone ID: PAT_TA_5582.pep
ESRPRIDVEGEDAPARGRHRAWRRRGEGDLVVNGSVGGGGNRETHSIKLDRWRPTPHRGVGAAACALSRRCPSPWVPVAPPPRRPPPPAAPLSAPPAPSSPASSPRAALHPHPPPAPPTLPGSSTPVNQAKWIVVVVGRRMKVAGREVARFIGRCCRLVGESDPWPAGAGCRRGGGLDLVFTTASPSGGGGGGCPRGARQGEGREGGSGATVVGSDSGGKWGGRWLVPNS

SEQ ID NO: 111165 - protein, 177 aa, Triticum aestivum
  Clone ID: PAT_TA_5583.pep
DAPPVGGGAAVQRACCCTATSEFQCNTHVVGGGAAVQQPCAGGGAVQRPWCCAPSAELQCNTVVSDVAPVQRGVVFCASGGAAMQHADVAMECRRGPPVLLWSFARPPVLYWSITDVAMDRHRGRRCCYGALSGVAGVAMERLRVRRCCYGAPSVCCIAASPGNRCCIEASLGPRCV

SEQ ID NO: 111166 - protein, 77 aa, Triticum aestivum
  Clone ID: PAT_TA_5584.pep
HWTNPNKNIAITSIQSSDPEYKAKVDNVTFGNEFLVFRVDAARLIITLPSTFLCCSSFQPFLPTSPLLVSLGDCNIR

SEQ ID NO: 111167 - protein, 276 aa, Triticum aestivum
  Clone ID: PAT_TA_5585.pep
EFGTRISTSGGGCLVRRFSAVGAPRPCDAGRRLCRFYGSKGGVGSAEARGAGAAEAAAGSSGRCSEQEHARLGERDQQEWLSGERFLSDCKKRESPFLTRRERFRIEFLRRVVPWEKGNLTWQNFPYYVNENARQLLRECTASHLRHKGITSEYGSRLPSSGGRIVLQSLPGTELYRERLVRALAHELRVPLLVLDSSVLAPYDFGEDYSESEEEDEHGESEDEGSESEMEDEGDEDWTSNNKAKSAESDDEDALKSVKELKKSVDDLKKLVPCTI

SEQ ID NO: 111168 - protein, 323 aa, Triticum aestivum
  unsure (1)..(323): unsure at all Xaa locations
  Clone ID: PAT_TA_5586.pep
QGPIVKAELADLXAATQDFSTSHIVVAGSSRAGTAYRAVLRDGSALTVKRLHSCPLSEKAFRSEMGRIGQLRHPNIVPLLGFCVVEEERLLVYKHMESGALSKVMKEPGETLLDWATRLRIAVGAARGLAWLHHGFQMPQIHQNLSSSAVLLDEDYEARITDVGLTRLVRMAPGEGGDTSPFLNGDFGEFGYVAPEYASNPVGTMKGDTYAFGVILLELVSGQEAASVSSDVGEGFKGTLVDWVFQLKSTGRIADAVDKSLKGSDAEISEFLKVAFQCIVARPKERISMYRVYHSLKSIGTGRDVSEQFDEFPLAYNKDDSDT

SEQ ID NO: 111169 - protein, 126 aa, Triticum aestivum
  Clone ID: PAT_TA_5587.pep
MSLNSEEGLMCKDISHSSQSSAPSLAHPLSPCRYQCVSTLRGHSSYVSGLAVDGISLYVSSSDGHIRLWPLDMSSTTVQHEGSVVAATNSSIKCLMATSDGLVSAHQDGKIRVWQQAGRRKGGSSH

SEQ ID NO: 111170 - protein, 144 aa, Triticum aestivum
  Clone ID: PAT_TA_5588.pep
PLVRHPEVDHGEVPVRGAGRGRRAGAAARGAGHLPVPLHRRAPAPERRAAAAPRAAERPPRAPEQRRAGRARRAAQGGARPRAPRRRRPALERVPHRAAGPQDGGRRQGHRALAGAPRPRARARRRAPPPRRGRGPHRPPRAPR

SEQ ID NO: 111171 - protein, 241 aa, Triticum aestivum
  Clone ID: PAT_TA_5589.pep
MASLFKDPSKLSVYRDRRFPGTQEEFEAALLASLTVYVGNMSFYTTEEQAYELFSRAGEIKKIIMGLDKNTKTPCGFCFVLYYSREDAEDAVKYISGTMLDDRPIRVDFDWGFEEGRQWGRGRSGGQVRDEYRTDYDPGRGGYGKMVQKELEAQRELVDYGVGFQTNAPPQFDRADRKRGYGDRNDRGDYQRRRSAPDMARRATDSDSKRDANQEPEKNPRFREKGDSDDEDDDYDKKRRR

SEQ ID NO: 111172 - protein, 133 aa, Triticum aestivum
  Clone ID: PAT_TA_5590.pep
GGVQEVGDDRGKRKPPLPFVIPSPDDSSLHLPWIFVVCLALEWRPTRPGPCADHLVGLLLRLSWQQFGLPTDRRNCGRIWVADTPSSLTTGLPPSRCSFSSSSAKCNPPGPHCSQEVACSTDCMNCHMRKAMG

SEQ ID NO: 111173 - protein, 199 aa, Triticum aestivum
  Clone ID: PAT_TA_5591.pep
KPARGAAPPAASRFLLRRPPPPPPPPPPPSSPPPPPPPPRLRPLPPPRGCGRPPAPPPPPRRRPLLRRVSAPDQRPPAAGPASPPPPLLAAPSAVPPLLPAASRRPPSAPPPPSPSCPSCSSPPRPPTPVPSSLAPPPPSPSSPTCSSPTRAPTPAPTSLPHTTPSRPGKMSPYSAHKSTRIWQRGSPAPSHSHRPTTS

SEQ ID NO: 111174 - protein, 267 aa, Triticum aestivum
  Clone ID: PAT_TA_5592.pep
PEPRVGPQNPEGVTAEFPTTKPRKPRRGRRSEAAAVEDFVRDRLEQVFASIQERDPEVLQGKGDILKPKEEEERASDAEPGEENGEQKTVVEEEDPSWPLDADVGWGVRASEYFDKHSIKNVTVDGVEIDWEGEVDRGWVKEINCLEWESFAFHPSPLIVLVFERYNRAADNWRFLQELEKARKVYWDTKDRLPRRRVKIDLNIERDLAYALQAKECPQLLFLRGNKILYREKEIRTADELVQMIAYFYYNAKRPSCVNPEALAPSF

SEQ ID NO: 111175 - protein, 142 aa, Triticum aestivum
  Clone ID: PAT_TA_5593.pep
IRHEHSSGASTSTAAASQLRHCRLRRPLHHSSGASTSTAAASQLQHCRLRRPLHRSSGGVVATASQLWRHQRPLHRSSGGVDSDDGVAATTVVLVGVLGARVGVAWVFSLLERREWVEGKYVRGTASNRLRCTRSDGYQGGL

SEQ ID NO: 111176 - protein, 119 aa, Triticum aestivum
  unsure (1)..(119): unsure at all Xaa locations
  Clone ID: PAT_TA_5594.pep
SIWNXTSLRGKSIKHYTLTSRFACVKGSLLERRPENAAATIKLLHKHLPDQKKPFVKDELQKLVAEWPTEVIKRQKKDDRKAMEEALIEDIPKMISSMAKSGLDISVDLDKLTRQPEAA

SEQ ID NO: 111177 - protein, 110 aa, Triticum aestivum
  Clone ID: PAT_TA_5595.pep
IGHSRAPLPRPRKPYPPPPRAADSSPSHLPIQVHVQPPSTRGCRSPAPPRQPSPAPPRSPTLSRSATTPTLSGSPSPCVASSVPRWGGRSGAPRSMSRAAPCSSSWARWS

SEQ ID NO: 111178 - protein, 169 aa, Triticum aestivum
  Clone ID: PAT_TA_5596.pep
LAPSAADRIFPNLAFAFSRRGGALLCIAPGCAWSSPVWCWPALCRGGSPPSPFFISVLIFRAQVPPHVSLLWRCLCDYTGGTQVLWRRLGSCNLSIAPHDTGGVAALGSLGCAAPFDYVDGAVSWFGLLGDALWPCRWHTGAVVSSRLVCPFDCTPRHRWCRGVVYSWM

SEQ ID NO: 111179 - protein, 261 aa, Triticum aestivum
  Clone ID: PAT_TA_5597.pep
NSARGINTSAWSLRGPALQKLANPRKPCASGSRPRPLHPRRSDKHAVSAASTGQGEQQPAPAVASPRARPDADTFSVEFLTRDGCRLGISRYPDFAYNAHGGRGVGAGRGASGTAEADGTVLVDFDVSSLYIPAMSGATTRFLGLPLPPFLKIDILPEALRGSIDRTTGQVDLKFRSRFCFSVGSIYQAPPLFVDTTLTSEESSGAIRRGTGERLDGGGRCKLVGVAVLNPIDDVFMNTFLNLPTECIAYLNATISIASAT

SEQ ID NO: 111180 - protein, 65 aa, Triticum aestivum
  Clone ID: PAT_TA_5598.pep
KAGNLYHHPYDLGVYHNIVSVLGPNMLCWFCPVSRNIGNGVRFRTSYDIPLSTPPSKAEKHLAMS

SEQ ID NO: 111181 - protein, 122 aa, Triticum aestivum
  Clone ID: PAT_TA_5599.pep
MGSMDGHPLQGNHAYAHVPAGSNNDEDDASPPPSAGGGSSGSGRRPRGRPPGSKNKPKPPVVVTRESPNAMRSHVLEIASGADIVEAIAAFSRRRQRGVSVLSGTGHNSARNPPGRRPLSFG

SEQ ID NO: 111182 - protein, 126 aa, Triticum aestivum
  Clone ID: PAT_TA_5600.pep
SLIHPVFHVSQLKPFTANYSPVFADLHEPPELSAVTLQPEAILERRMVKKGNSAIPQIKVQWHGIATNHATWEDYYVLRARFPEASIWEELASQGGESVTSPPLLVSTDDRQVDPGSTGQASTMQV

SEQ ID NO: 111183 - protein, 85 aa, Triticum aestivum
  Clone ID: PAT_TA_5601.pep
DCTYNSMCMGIYIAIGGIHIQTCFLESCGEHGHTHMLILRSNKKDKWKRKTQSIVRVDKTAMALYMWPVVSELFRPCRTPRRPVA

SEQ ID NO: 111184 - protein, 42 aa, Triticum aestivum
  Clone ID: PAT_TA_5602.pep
NCCSKNHFHTVGVYRPEVYIQHGVARLMITTKGNLDWKIPRL

SEQ ID NO: 111185 - protein, 333 aa, Triticum aestivum
  Clone ID: PAT_TA_5603.pep
PGDIISIKLGDIIPADARLLYGDPLKIDQSALTGESLPATKGPGDGVYSGSTVKQGEIKAVVIATGVHTSFGKAALLVDSTNQVGHFQQVLTAIGNFCICSILVGICIEIIVMYPIQHRAYRPGIDNLLVLLIGGIPIAMPTVLSVTMAIGSHRLSQRGAIIKRVTAIEDMAGMDVLCSAKTGTLTLNKLSVDKNLIEVFENGRVEDQVILMAARASRIENQDAIDTAIVGMLGHPKEARAGVQEAHFLPFNPTDKRTALTYIDGDGKMYRVSKGAPEQILNLAHNKSEIAQKVHAVIDKFAGRGLRSLGVAYQDVPDGRKESQGSPWHFVAL

SEQ ID NO: 111186 - protein, 301 aa, Triticum aestivum
  unsure (1)..(301): unsure at all Xaa locations
  Clone ID: PAT_TA_5604.pep
MSKPQPPKPPSPPPPPPPPSKILGRAPAPPPPPPQRGTTGTVNKATALVEMYNSLNKRDTKKAVTVSAAHHNSIVGELQNRSTHLLAIKTDVETKGDFINGLINKVQMTTYTDVEQVLTFVDWLDQQLSTLSDETGVLKHFSWPERKADALREAAFEYRDLKCVVTEISSLNADDGSPTSCEATLRKISSLLDKLEKSMKRLVNLRSSVMPCYKQFGIPTXWMLDSGIASKMRVASVTLAKVYMKRALKEITAYTGGGNEAVLVAQSVRFTYRVHQFAGGLDSEAMRAFEELTQRSRLTAV

SEQ ID NO: 111187 - protein, 307 aa, Triticum aestivum
  unsure (1)..(307): unsure at all Xaa locations
  Clone ID: PAT_TA_5605.pep
MRPRPTTIMIPVLAHPGDNILLPRPRFSVYETKTTFSVPEVRYFDLVPERGWEADLESVKAIADENTVAMLIINPSNPCGSVYSHDHLXKLQETAGELGIXIIADEVYDHLAFGIKPFIPMGVFGKTVPVITLGAISKRWLVPGWRLGWIATCDPNGILKETKIDQSIQNYINITSDXPATFIQGAVPXIIANTKEEYFKKILDLLRNSADLCYGKIKDIRGITCPHKPEGSMFVMAKLDLSCLDGFSDDVDFCCRLAKEESVIVLPGTALGMKDWVRITFAIDLPSLEDGLERLKSFCERHARVEA

SEQ ID NO: 111188 - protein, 162 aa, Triticum aestivum
  unsure (1)..(162): unsure at all Xaa locations
  Clone ID: PAT_TA_5606.pep
AIAPFGVPVVDLPHPSVGGAGPVPLEAFHLIILSQGLTLSPLFDRXGQDFGKLQNRFLSRNPANVILSSMEVVAQSMGFKTHIRNYKMRVEGPNANKTSHLTIMLQIFEVAPSIFMVELERSAGDTSEYNKFVNNYCSKLDDIIWKVSAEKGKSRTSRLSKR

SEQ ID NO: 111189 - protein, 150 aa, Triticum aestivum
  Clone ID: PAT_TA_5607.pep
MADIAYSSCCVNEVGASRVVNCAHTRLNPEASMFESNCADHSKLSTMDCPPAANVGIHRVSMETSSSDRFTALSSIGEEYICKDKLPLLLKKKLAPICYVWFEPSHMMDIEQQGIMKTIYVNKIVQAGCTVKILMADWFLQRHFKIGTDL

SEQ ID NO: 111190 - protein, 96 aa, Triticum aestivum
  Clone ID: PAT_TA_5608.pep
GAFFFFFFLFFFFFFFFFFFFNTPINSDDVLIDGSVHPNQGNKDSDTRTTTNRNMSIRKVQTCTAHRLRTSNTPNHHRKHLHDESPYSEQNCTSQS

SEQ ID NO: 111191 - protein, 140 aa, Triticum aestivum
  Clone ID: PAT_TA_5609.pep
DKTNWKTNMLTGLLVPYIFFTMPGLLFGFIRGEIGSWVAFVFVVLRLFFPRHFPDWLELPGSLILLTVVAPAIFADTFRGSWLIIGVGVCLVIGCYLLHEHIKASGGLKEAFKKPNGWSNTIGILLLFIYPVWAVVMWFL

SEQ ID NO: 111192 - protein, 209 aa, Triticum aestivum
  Clone ID: PAT_TA_5610.pep
MAPSSFLAMKTGAAAGASEAAQALLESDLRELGLAARKLANHAIVLGGGLGFGRHFLKWLAFIAAVYLLVLDRTNWKTNMLTGLLVPYIFFTLPGVLFSLVRGEVGAWIAFVVVILRLFFPRHFPDWLELPGSLILLTVVAPSLFADHFRNDLVGVFICLAIGCYLLQEHIRVSGGFREAFRKANGVSNTIGIVLLFVYPVWVLVLWLL

SEQ ID NO: 111193 - protein, 222 aa, Triticum aestivum
  unsure (1)..(222): unsure at all Xaa locations
  Clone ID: PAT_TA_5611.pep
MATPLLPRKTGPAAGGSEGSEAPLAAAPRAVTAAXARKHATHAAVLXAGVGFIGTFLPWCAFDAAVYLLVLDETHWKTNMLLGLLXPYIFFTMPGLLFGLLKGVDFGCLALTLLLLSVPAGCSFHRHFPRACLELPGXLLLRPTGGVAPAHLRGTFLAGAPGLIIGXVGVCQVIGXYLLHEQISGVGQPHRRPSRQPNGGSKTIGALVLLILPVWPLVMLCL

SEQ ID NO: 111194 - protein, 176 aa, Triticum aestivum
  Clone ID: PAT_TA_5612.pep
KVLDYKLPCPMQGYFRTRWATKQQSRPTPVFSPLLPRHHVPQLDVGFLTLSANFSMTDESKGTKQLNTKSSDKANFECHGRPTSQHPLGEKEEDDLWPSSSPDVSESLRQRRDPGRGRMMPPVAVAVAPAGGAGRGGVGRWCVLPGGALEAERGGASFVILAAAVVRWADGVSEGW

SEQ ID NO: 111195 - protein, 161 aa, Triticum aestivum
  Clone ID: PAT_TA_5613.pep
MKKGSAKKSSGSSSSMEKVEYAQLRTSDADSEVSVAASGSTGGRLFSNSDSGIMDAFMGVGEYSGMIHPNSKFGLGFRRYGRSGAPPTGFGHSGMGGSNGFCDPEHGFAIAVTVNKMALGSVTRRVVRFVCEELGVPVPDEFSAAGEKGPDMVLNLAPPAE

SEQ ID NO: 111196 - protein, 112 aa, Triticum aestivum
  Clone ID: PAT_TA_5614.pep
ENQRPKHSRDREISSRPNGHGDGAQRPPPRRHARRPRRRRPHPVPRCRAVRPRLPAPRGAVPPPRLRDDDAPVALRPTCGHRPGRLRVPEAAPPAARHHPGPARAPPPYRLL

SEQ ID NO: 111197 - protein, 285 aa, Triticum aestivum
  Clone ID: PAT_TA_5615.pep
MEAVAALDARALFSPPTALPSSPSSRLRLAARPRALAASPAFVAATPKQRFLTPHPDPAGGRGTRDVVAMVIPFLRGTAFEQPPPDLASFLYKNRIVYLGMCLVPSVTELMLAEFLYLQYEDAEKPIYMYINSTGTTKNGEKLGYETEAFAVYDAMRYVKIPIFTLCIGNAWGEAALLLAAGAKGNRAALPSSTIMMKQPIGRFQGQATDVDIARKEIRNVKIEMVKLLSRHIGKPMEEIARDIRRPKYFSPSEAVDYGIIDKVLHNVKSQTDAGLVSEVKKELI

SEQ ID NO: 111198 - protein, 310 aa, Triticum aestivum
  unsure (1)..(310): unsure at all Xaa locations
  Clone ID: PAT_TA_5616.pep
DNSTQSFHITEINKNISDITKSKELLSCLYESTIMKMGVRHLQEEKSRLAKQNADKAHQNFLAMAEHFNHLIENSKESNDKQAQVVCEENCSLVALTQDLQSKLTKLAAQRNEALTAVQEIKFQXDARLATSLEEEATAVEQIIQEDKLALLVRKEDQATLGSIMDASRKLQKEAEEIILLREQLLDRGHIIDIMQGEISSILARVSKLKSALVTTSSSANSSHKDDCKSASVDTDRPLGNDDWEGRPPPPPPNAPATSSVARVFVGVVLLATYPACPSGRCPPISWALSGQQLRGSPAGCAPSGGGSSP

SEQ ID NO: 111199 - protein, 213 aa, Triticum aestivum
  Clone ID: PAT_TA_5617.pep
MAVAKSKAGKHAAPLLGKYELGRLLGRGTFAKVYHARSLVGGEAVAIKVLDKPELAATAGMDARVLGEVSAMRRLRHPNVLRLHEVLATRSKVYLVMELAPGGDLLSRLASLPKRRLPEHAARRVFLQLVSALIYCHARGVSHRDVKPQNVLIDADGNLKVCDFGLAALPESHRDDGRLHTACGTPAFAAPEVLRRKAYDGVKADAWSCGVIL

SEQ ID NO: 111200 - protein, 268 aa, Triticum aestivum
  Clone ID: PAT_TA_5618.pep
MNACALNSMEVKAKPARGGKRSRASGGTAVVLLEKKESEKERRKRMKALCEKLASLIPREHCCSSTDTMTQLGSLDVGASYIKKLKERVDELQRRRNSVQALDTLRGDTSIPTPTTTTTTSSGARSPEEEKAWEASEPVLQVRQHDDSSMEVRLICCMERPIKLHEVITIHEEEGAEIINANRSVAGHKMLYPGRARAFSSRIGIDVSRVSERLGALSRLFSHEKQAPSCMRSIEVPKYTDGTNLTPPKELISNNDIGGTNKVPNPRV

SEQ ID NO: 111201 - protein, 104 aa, Triticum aestivum
  Clone ID: PAT_TA_5619.pep
LCQVCALALLLGTHESMIQILATPFTTTISGFTEKCTAYIVDIFNSYGRPLDDHWSSVHMVTGWKLAVMFASYGGRLEARGLNDLIVYGRQYTLFITTSQVFSE

SEQ ID NO: 111202 - protein, 267 aa, Triticum aestivum
  Clone ID: PAT_TA_5620.pep
MVTVAAAAASYDDEVHSRAALREAFGDSSDSDSDAPRGAASTPPVHGAGRERWRWAAVAGVRGLWLCAAFLSPDEQSRLLAAIQREEWFTDAHNQAMRFGDLPPWAVELSALVREAICVGGVDASVGAGWMNEDEDACPLPSDLLWREPLFDQLIANRYKPGEGICAHVDLMRFDDGIVIVSLESACVMRFSQEGAACDTQKHGESECTNVPVYLNPGSLVVMSGDARYHWKHEINRKPGAQLWNGSELEQHRRTSVTLRKLRASPN

SEQ ID NO: 111203 - protein, 114 aa, Triticum aestivum
  Clone ID: PAT_TA_5621.pep
NVSQYLSIFIIRHLLDSFQISKFPMHRLDRAWGRLSSSHMHLFPCCEKRKRLWPRVCCAQRVWHPPVAGSNVQRPGSAVHGVLLDATVPAVQRALNAGGRSHPGAPPTRPPTRP

SEQ ID NO: 111204 - protein, 653 aa, Triticum aestivum
  Clone ID: PAT_TA_5622.pep
ASGTTSAYITVIVLLLGAVCSGLAGYVGMWVSVRANVRVSSAARRSAREALRMAGRAGGFSAIVVVGMAVFGVALLYATFYVWLGVDSPDSMKVTDLPLLLVGYGFGASFVALFAQLGGGIYTKAADVGADLVGKVEQGIPEDDPRNPAVIADLVGDNVGDCAARGADLFESIAAEIISAMILGATMAQRCKIEDPSGFILFPLVVHSFDLVVSSVGILSIRGTRDSGLISPIEDPMAIMQKGYSITILLAVLTFGGSTRWLLYTEQAPTAWFNFALCGLVGIITAYAFVWISKYYTDYKHEPVRLLALSSSTGHGTNIIAGVSLGMEATALPVLVISVAIISAFWLGRTCGLVDELGNPTGGLFGTAVATMGMLSTAAYVLTMDMFGPIADNAGGIVEMSQQPESVREITDILDAVGNTTKATTKGFAIGSAALASFLLFSAYMDEVAAFAQLPFKEVDIAIPEVFVGGLLGSMLIFLFSGWACSAVGRTAQEVVTEVRRQFIERPGIMDYKEKPDYGRCVAIVASASLREMIKPGALAILSPMAVGIIFRILGHATGQPLLGAKVVASMLMFATVTGILMALFLNTSGGAWDNAKKYIESGALGGKGSEAHKAAITGDTVGDPFKDTAGPSIHVLIKMLATITLVMAPIFL

SEQ ID NO: 111205 - protein, 61 aa, Triticum aestivum
  Clone ID: PAT_TA_5623.pep
HGFDILHTDTNQQLVDSGGIGALNRGETITSQYDVVQAFSRVNAHLMVSAYVIGDVINLIK

SEQ ID NO: 111206 - protein, 283 aa, Triticum aestivum
  Clone ID: PAT_TA_5624.pep
GLRNSDEVPLRPADGYGERRIGTDCHGVPVYANKKGGVEDAVVVEVPPPAIGNVQWHDAGEVPAIGNGQWHDHAEVPSTGNVQWHDHGEVRGNVQWHDHGEVHGNVQWHDAGQAHDQSNWLSSYHNAKEDTYAYAHSTYGSYDTSYEQSYSVDVVPDEPTWFPNQSYQDVYREEEPQCQEVLPSYGIESTFSSQPIYCYNQHTGEQPLHVQVEPPETFYSHKLEYHENFSTYTNHIDNPEISTQSCEIQPYAYVPDSPVEAYQPSWSMNLGYYQDSAEEVTPQ

SEQ ID NO: 111207 - protein, 206 aa, Triticum aestivum
  Clone ID: PAT_TA_5625.pep
EELTDELISDNMIDFMIPAEDSVPVLITLAVKFLSECPLALQQLEEENMELKMRKTDLGETLQWTDYMSLSFTQHVITETLRIGNIISGIMRKAVRDVEVKGHLIPKGWRVFMYFRSVHLDDMLYEDPCKFNPWRWKEKDMSTSSFTPFGGGQRLCPGLDLARLEASIFLHHLVTSFRWVAEEDHIVNFPTVRLKGGMPIRVTAKD

SEQ ID NO: 111208 - protein, 166 aa, Triticum aestivum
  Clone ID: PAT_TA_5626.pep
LSRIGNQDNVTLMTTAVGTEGYIDPECRKAGKVKFNLSSDVFSFGIVLLDITCTGKSREQVWDLYVRGRVMEATDDRLHGCGDSDMRQMERVAILGLWCSLPDSRKRPTSKEAMEVLERGVSLPDLNHLLNTTSVPSSMQQDTYTTSSSGPQAPPSDESPFGERHA

SEQ ID NO: 111209 - protein, 82 aa, Triticum aestivum
  Clone ID: PAT_TA_5627.pep
TLTDLASVVPIGILMLLPVTAVGHAAILAFIQRYVPSMIPSTYGPERLDLLRQLEEVKEMKLPEGSSEDISDAIGLRGDQVK

SEQ ID NO: 111210 - protein, 167 aa, Triticum aestivum
  Clone ID: PAT_TA_5628.pep
MLRPPPAPLLPPASRASLLPPHKAANPNAEPTPATSTTARATPMGVAASWPRALGQRFNPGGVAAVVAVAASEPRLALPHVSVQDIRWLDWAELRRAGFRGVVFDKDNTLTAPYAPELWPLLTTSFDQCRAAFPGAIAVYSNSAGLKQYDPDGSDASTIEATIDGFM

SEQ ID NO: 111211 - protein, 132 aa, Triticum aestivum
  Clone ID: PAT_TA_5629.pep
AGSAWDELKHIRQAIGFLVIHQKPKKTLDEISHDLCPVLSIQQLYRISTMYWDDKYGTHSVSPEVISNMRVLMTEDSNNPVSNSFLLDDDSSIPFSVDDISKSMQQIDISDIEPPPLIRENSGFVFLLPPPE

SEQ ID NO: 111212 - protein, 76 aa, Triticum aestivum
  Clone ID: PAT_TA_5630.pep
CSGSADRTVRVWPRGAEGEYSCSAVLDGHGAAVKSLALVLTGGDHGSEREESPRGGCSALICSGSLDCNVKIWRVT

SEQ ID NO: 111213 - protein, 471 aa, Triticum aestivum
  Clone ID: PAT_TA_5631.pep
ILNDPYKWHITSNVQRGDCNVIENSDGDGKLKKKKRRHSESSKDGPTTQGVTKPSGSIANAQVETVNEPSKVNQGDSTVTENPTGDGKRKKKRKLRLESSKDDPLTKSSGPTTGGSSTQHTSDDPLNAEHTTQGTIGEATGSDCRKLDGTADVAATNVIHEVLADLGCTDNLSGDPVKEHTEGVVSAALPLKYPADNQSDDLNDVLTENTAVPADGRTKSSKRQRKKTSLKHVSTDSSKDIQSLGVQVRQVPTEDLEGGNDTKEELLLEGSSVDAPASTGQVLRQKSRKSLKTQTPTIQEINHPTHGQDNQFIKDDQEKYVTGGAPRNDKNIVGAPTESSVLHKDGTIIMHDKPNARKGRKKSSKTELQSQDTALEQGSVADLMNSRAQEGAAIPKGSAGAVEPNDSAAIRSENGKINFLDHFSPSVMNGPSVSAENNDETTIREVKGKKKSKRKPDMQSQHAGIIEPNDL

SEQ ID NO: 111214 - protein, 160 aa, Triticum aestivum
  unsure (1)..(160): unsure at all Xaa locations
  Clone ID: PAT_TA_5632.pep
PRVRGRVGLDTPGAGVPMSVFWLVPXYAIHGVAEGFSSVGHMEFLYDQAPESMRSTAAALFWLSASLGSYMGTVLVTAVQSATRGGGEWLQDNINRGRLDAYYWLVTCLMVLNLGYYLVCFHFYTMKPLEVAEDDGDHEKECELSSVHKNGDGGAAGGLV

SEQ ID NO: 111215 - protein, 282 aa, Triticum aestivum
  Clone ID: PAT_TA_5633.pep
MELAGAAHPQPPESDVAPPRTPPQAPVEDSCKDTGDTRITEENSCTPPDLNLSQPNNSGLNSSSACENQTSNGDEMTEPESTLEAAKTEGDGSNKEKVLKKPDKILPCPRCNSMDTKFCYYNNYNIHQPRHFCRGCQRYWTAGGSMRNLPVGAGRRKSKSSSTNCNGILIPGDSLSAPGGDASVIPLPIKENQPAVKFGSDSTLPNSMASLLRVEEQNKNSNPASTAHPRNGENQTCPPSATTSDNPRIESVKAAVGVHQNGLPGDSWASSHASYTCFPAPL

SEQ ID NO: 111216 - protein, 246 aa, Triticum aestivum
  Clone ID: PAT_TA_5634.pep
FEFGTSLADLYADYFFKATLDENFRVADIEVEVEIDSHKQDREHIPTLSIEATLFDNSESSDDLNSDMSAANVVNLKTKPEPKGGPCHGFHGYVLGGKVENPKLWSSEKPNLYTLVVLLKDANGKLIDCESCQVGIRNVVLAHKQMLVNGSPVVIRGVNRHEHHPRVGKTNLEACMIKDLVLMRQNNINAVRNSHYPQHSRWYELCDIFGLYVIDEANIETHGFDETSHFKHPTLEPIWANSMLDR

SEQ ID NO: 111217 - protein, 181 aa, Triticum aestivum
  Clone ID: PAT_TA_5635.pep
YYAEYTYGSQPVPAVFTESELWWLPKWNAHGPATIYAREHNECKHDAIWWTAGKSSFWSGISISFWGKATLVSFHTWLATKRHLLDFPTPKDLGASHHNMRMEISLLEMQTCKDMGASLHRTEMEASLLCSSIPYHHPAEMEVSSLLCSSIRYHHPTEIEVSLLCSSIRYLRPVQIEVSLL

SEQ ID NO: 111218 - protein, 426 aa, Triticum aestivum
  unsure (1)..(426): unsure at all Xaa locations
  Clone ID: PAT_TA_5636.pep
HASDPSLQSTSVSSKKFENHAMLSTVQLHSTDPWKQNLAAGSGTMVPAKLRRALQASRHSLHGGVPPVKSSPQTNPSYNYNASHVGSDLRKMAIAEKFQPSSKPRSYVNGLTGKLSSVCRPNLSKEKQPRGSTSSEIVATSYTSRLHIGNPEGKIIIKTDQYNRDDFXXVYPRAKFRVIKRWGEANVHKSIKYGVWSSGLQGNKKLDSAFRDAQMIAASSSTLCPVFLFFSVNESNHFCGVAEMVGPVDFQKDMDFWSMDRWVGSFPVRWHIIKNIPNVALKCILLRNNEDKPVTSSKNTQEIHYVPGTSMLRIFKGSKTNGCLLDCFTVYEAEEARGRKCRMSKLRRDAPRFIPVPKLSLHHAYVPRQPKADRILMDRIIRETHDLASNGMQQSSWEEPGNLARYSAKASAQKENRSSGKQARED

SEQ ID NO: 111219 - protein, 177 aa, Triticum aestivum
  Clone ID: PAT_TA_5637.pep
MVTTASARAHQQHGGKQQQYQPLRRIEGLSLRSALRSDPRVPALAAAALLVPLGAALLALSGLFLLATLAGVALSAPLILLFSPVLVPAALGAALAVAGLAAAGALAVSGLSALVWVVGYVKRGLAQGDSGRVGGMVVQPLDSGKPRRQEGAPPPSGSRPEPWPLASALAGHTPDQD

SEQ ID NO: 111220 - protein, 154 aa, Triticum aestivum
  Clone ID: PAT_TA_5638.pep
IQIKLFQWQRATTVHGEADDAAAVEHDLPIRAGGGEHLARVPHGGARYGAQVRRPRGAPCDQLFRRVQERQGRGGGHRGVYQPVQERHEELAQPVGISSSSNLAATLARARRINLMPTRSSAPRRRQRDDALQLPAAPPQCELHEDDCSAVASP

SEQ ID NO: 111221 - protein, 245 aa, Triticum aestivum
  Clone ID: PAT_TA_5639.pep
ANLTGLPADACGKRLQALIVSSGVVKTYQPAVDEGPNLFAPTDDAFQPNAVPDLRKVIRADLGCQLEYRVLAQYAAKAPRQAMNGGSPTLASTRKGKYALSVVAQGDDVSMDTGMDESRVASAVLDDTPVTAHTVDNVRLPPELFGGAPSQAPAASADGHASAPAPEASSAPAPSPDHDENKPKHKSPAHSPPAPPADTPDTAPAESPEGDEEADKAADKNGATAVGMSIAAMVASVALVGASLF

SEQ ID NO: 111222 - protein, 273 aa, Triticum aestivum
  unsure (1)..(273): unsure at all Xaa locations
  Clone ID: PAT_TA_5640.pep
QLRHLPKYWEAGGNCNLAFAAARLGLRCSTLGHVXEEIYGKFLLDVLEAXSISVVGMLENADVTACRQAYETLLCWTLLCWVLVDPFQRHGFCSRADFSKEPAFSWIRKLPAETKIAIHHSKILFSNGYAFDEFSPDVIASAIDCAIDAGTSVFFDPGPRGRSLLHGNRDEQXRALEHALRLSDVLLLTADEAESLTNIGNQFKAXQELLRKREPEQNGVGIKMGSRGGHVTKARLCFLSLVNVDRILMRLRQADTPSQSHGCRGFHKDLNVR

SEQ ID NO: 111223 - protein, 292 aa, Triticum aestivum
  Clone ID: PAT_TA_5641.pep
MLRSLAAAARSPAAAAWRRLLHHGRDIGGGEEVESMAYRMSMLRAPPVARKKDIVSSNSCSLIGRLNAPVRLHRNSSEEDPKAYTFLCVTPSSSSSSTSANFQVTLQLKGDLANVCLKHLKYNDLVHVSGFLNSYHKVSGTGEKYVCYKIHVKELNYVHDPKNPRNDKDSVDPASTPSADTQTLEEIKYRERLRLWQVFFASPYEWWDNRQYKPYASCADFKHKDTREQLWLHPDDPPWVRKQLELIDQQTAESGRRDGRGRLTNPRWNAQDFNYSDECDDDEQDTQRQANG

SEQ ID NO: 111224 - protein, 116 aa, Triticum aestivum
  Clone ID: PAT_TA_5642.pep
FTGAGGQLQHGREEHKTGGILHRSGSSSSSSSSEDDGMGGRRKKGVKEKLPGGHKDNQQHMAAGTGAGGAYGQHTAAGTGAGGDYGQHGHAGMAGAGAGEKKGLVDKIKEKLPGQH

SEQ ID NO: 111225 - protein, 124 aa, Triticum aestivum
  Clone ID: PAT_TA_5643.pep
MSDFNAIAQQFVQFYYKTFDENRAGLGALYKETSMLTFEAQGTQGSAAIVEKLQNLPFQQIQHRTDTVDAQPSADDGILVLVTGALLLAGEDKPMSFTQAFQLKNADGNWFVLNDVFRLVYPAA

SEQ ID NO: 111226 - protein, 378 aa, Triticum aestivum
  unsure (1)..(378): unsure at all Xaa locations
  Clone ID: PAT_TA_5644.pep
MKGGGGGGGGKESATGSFLRFLLLLLLPLTALYFFYTLHLLLASAASSSAASCPPDPTAVSSRVSTNRTAAAVAGSKAAPAAAAASTATTLQHVVFGIAASSRFWDKRKEYIKXWWRPRGAMRGYVWLDREVRESNMSTARTGLPAIKISSDTSAFPYTHRRGHRSAIRISRIVSETFRLGLPGVRWFVMGDDDTVFFPDNLLTVLNKFDHRQPYYIGSLSESHLQNIYFSYGMAYGGGGFXISKPLAEALARIQDGCISRYPALYGSDDRIQACMAELGVPLTKHPGFHQYDVYGDLLGLLAAHPVAPIVTLHHLDVVQPLFPNAPARPAAVRRLFSGPVKLDPAGIMQQSICYDGANRWTVSVAWGFAVLVSRGVT

SEQ ID NO: 111227 - protein, 258 aa, Triticum aestivum
  unsure (1)..(258): unsure at all Xaa locations
  Clone ID: PAT_TA_5645.pep
PASARTRDGVHARTSSAASPPTAVDPDQPRPPPPPLALRCSCSPXQLGRASTVSPRAFFGRADLDGLLQRAWRGANAGAERLSFEARQAAQRLDGRYSISRRVAEAARAARERAAEIDAELGVGRRWRSFSVDFSRSWPRYRRELSDFLATPIGRALSTLTFVWLALSGWLFRIFIFSTFVLPFAAPLLLGTFANRVAIEGSCPACKRRFVGYRNQVIRCMNCQNIVWQPNSRSSGGGGGGGSRSSGPDYIDVEFEEK

SEQ ID NO: 111228 - protein, 139 aa, Triticum aestivum
  Clone ID: PAT_TA_5646.pep
TGREVVCCTPPRGTPGYLDPDYHRSFQLTEKSDVYSFGVVVLELVTGLRPVDVGRERRDVTLADWVVSKIQIGELREVMDPAVLGELPGVMPSVEAVAELAFRCVAPDKDDRPDAREALAELRRIQGMLPELSSHKDSS

SEQ ID NO: 111229 - protein, 235 aa, Triticum aestivum
  Clone ID: PAT_TA_5647.pep
MAMALLKVYADRLSQPSRAIIILCKVNRIDFQELTVDLAKGQHRAPEFTKINPMAQVPTIVDGRFKLFESHAILRYLATVFPGVPDHWYPADLFTRAKLESVLDWHHSNLRRGAATYVLHTALGPALGLTPNPETAKEAEKLLSRSLGTIETVWLKGDAKFLNGNPQPSIADLSLVCEIMQLEVVGDERRDRILGPHDKVRAWMENVKKATSPHFDEVHELIFKLKARLNPVSKL

SEQ ID NO: 111230 - protein, 289 aa, Triticum aestivum
  unsure (1)..(289): unsure at all Xaa locations
  Clone ID: PAT_TA_5648.pep
MAAVLKVYADRLSQPSRAIIILYKVDRIDVQDHGVDLAKGQHRVPEFTKITPMGQVPTIADXRFKLFESPGILRYLATVFPGVPDHWYPADLFTRAKLESVLDWHHSNLRRGAATYVLHTASGLALDLTPNPRXAKESEQLLWGSIENLFATVGLKGDANFFHGNPNPTIADLMLVXELMQLVXVLGDERRDRXILGNHHTLIALVXNVKKVTSPHFDGLHALIIKVKAPHEPRCTHSLKRWPLRWVSNIFFLLVLGLKQVLASMYLYDEKKEILVLFHYDISTLSKQY

SEQ ID NO: 111231 - protein, 239 aa, Triticum aestivum
  Clone ID: PAT_TA_5649.pep
MAIVCSVKQMEASQQQGFGVEQKSGPEQTDEMLASQVNQKFTEMCLDDTAVEAGIVQEKQDDPEARLEVHQKFAEMCLDTAVGTDINQENRSDQEARSEADQKPAETIRQCTVVESNVKPEEQQAAANPGVIYRCKKCRRMVATQEYVVTHEVGLGEAGFLKRRNDADEKKPECSACIFVEPMKWMQAVEEGYVSNKLWCMGCKTRLGSFDWAGMQCCCGAWVIPAFQLLKSRIDESHM

SEQ ID NO: 111232 - protein, 407 aa, Triticum aestivum
  unsure (1)..(407): unsure at all Xaa locations
  Clone ID: PAT_TA_5650.pep
MAPPLPGRTDNEIKNYWNTRIKKCQRTSTPIYPAEICLQASNEEQHESTDFSFSENLANDLLHGNGLYDPSSTWGDFIDDQEALSSAPLLPDLLWATFPVGAASLITMPPSIMGTKRARWAARLPRLPGCEMPFFGNTRIKKRQRTATPIFPAELCLQASNEDQHESADFSFSEKLANDLLHGNGLYDPSSTWGDFIDDQEALSYAPQLPDVSFSNLPGLYFESTNHGFVDQVNQAEVLKESEISFPWLNAAINGTFDGSHAFSNGNFSTSRPMTGPWKMELPSLQFAGSDPNNWSAYSRTCAAQGANFADPCMRSSAAMASAKFEHMCMIPGNSGQLEEPLPEAHAVSSAENQQLSVGXXSASTGSPCDAMVETLHFLERDPNLYALVNSCSPASPLCADLPCSDF

SEQ ID NO: 111233 - protein, 99 aa, Triticum aestivum
  unsure (1)..(99): unsure at all Xaa locations
  Clone ID: PAT_TA_5651.pep
FFFFFFFFFTIIIASRNTCISGRSXRTNHIGKETAKDLLALIEEKYNHAATNHTQQEEKEMQPHPPYLRTQEKSKNTEITRTKPSFLPELNNSNRESQV

SEQ ID NO: 111234 - protein, 173 aa, Triticum aestivum
  unsure (1)..(173): unsure at all Xaa locations
  Clone ID: PAT_TA_5652.pep
VNGFFAVDILLTFFVPXVDNKSYLVVDDPKKIALRYLSTWFIFDVCSTVPFRSITRLFTRHEHSLGLKFLNVLRLWRLRRVSSLFARLEKDIRLNYAVIRCTKLISVTLFAVHCAGCINYLIADRYPDPARTWIGAAHPDFREDGLWVRYVTCLYWSITTMTTTGYGDLHAQN

SEQ ID NO: 111235 - protein, 180 aa, Triticum aestivum
  Clone ID: PAT_TA_5653.pep
MGFIGDQVEAIRSMQVRQVLAQIISLGMIVTSALIIWKGLMVATGSESPVVVVLSGSMEPGFKRGDILFLRMSKEPIRTGEIVVFNVDGREIPIVHRVIKVHERQESAEVDILTKGDNNFGDDRLLYAHGQLWLQQHHIMGRAVGYLPYVGWVTIVMTEKPIIKYLLIGALGLLVITSKD

SEQ ID NO: 111236 - protein, 109 aa, Triticum aestivum
  unsure (1)..(109): unsure at all Xaa locations
  Clone ID: PAT_TA_5654.pep
VVFNIDGREIPIVHRVIKXVHERQESXEVDILSKRAINNFGGTXDLLVCTRDSFGFQKHHIMGRAVGYLPYVGWVTIVMTEKPIIKVPSGLAALGLLVITSERREAVNL

SEQ ID NO: 111237 - protein, 437 aa, Triticum aestivum
  Clone ID: PAT_TA_5655.pep
MSVDAPVPTLRPEERAGLLALLASAARPLADVVADFLARFPRERRLRVGATLCFLLEDKKMLHATGRLIAFAILHQSYSSQPVNPYVPLLLNAACDESSDKSEQAFVQLLLTSASGDNNNEVLQKSAVDYVNGPVSASQALLPREHLEKQFCRSIVQPQPQVSSFRSATVRCAIPDPDIPQSRANSSEISAPGSKQKSTSDDRDSALVALLQEKSWGRLGPQWIRPNPPRLHILDGELQWLNPDNNHELLWDYSMCAETSRGAAIRDLIARALKGPLVPAQQEQVVIELVKDSKLVYHCGMTPQKLPDLVEHNPLIAVELLSKLMNSPDIAGYFDVLVHMEMSLHSMEVVNRLTTAVELPTGFVHEYISNCIQSCQNIKDKYMQNRLGRLVCVFLQSLIRNQIINVQDLFIEVQAFCIEFSRIREAAGLFRLLKSLE

SEQ ID NO: 111238 - protein, 385 aa, Triticum aestivum
  unsure (1)..(385): unsure at all Xaa locations
  Clone ID: PAT_TA_5656.pep
MDAAEASARWCVVTGGRGFAARHLVLMLLRSGEWRVRVADLAQVISLDLDEEQGILGAAIREGQAVYASADLRDKAQLAKDFEGAEVVFHMAAPDSSINNFHLHYSVNVEGTKNVIDACIHCKVKRLIYTSSPSVVFDGVHGIFNADESMPYPDKFNDSYSETKADAEKLVMRANGRDGLLTCCIRPSSIFGPGDKLLVPSLVAAARAGKSKYIIGDGNNYYDFTYVENVAYGHVCADKTLSSEDGAKRAAGKAYFVTNVEPIKFWEFMSLLLDGLGYQRPSIKIPVSVMMPXAHVVEWTYKSFCKYGMKVPXWTPSRIRLLSCNPNIQLLKEPKISLGYEPIVSPKDGXKRTIESYSHMQAQNQGYKDFDLLGKGIFKNLLGKN

SEQ ID NO: 111239 - protein, 238 aa, Triticum aestivum
  unsure (1)..(238): unsure at all Xaa locations
  Clone ID: PAT_TA_5657.pep
YFEFLDTDIMPVTSKRPRISLWTSEIVAEYERRDCTSSDKLLYGRLPTKRVSETPFGQINRQPKVTLGASYDELLQFTLSIVPEENHQMVLDELPKIMHSMQSELFDSMQNVLAKNFMNLLKLMSSMHSSSPSKKQNSTDKDSRCVPISEAPTVPCGSHSSLQMTSTTLAERKQDKPEAKTGVECGSGXETEHVFTAEETKPLSEVQRKNNKAPVPVLLSFEDTSDEVLAEWDKQACA

SEQ ID NO: 111240 - protein, 266 aa, Triticum aestivum
  Clone ID: PAT_TA_5658.pep
MGSPAVTPVRRETKGITGLLRSVGKIISKAARISGWKHNLEHKTDKEIANDAESAAPALELEGPNEVNSLTNMPAMSEPSVLLSETMRSTLYSSLPILAQGRSWVLLYSTWRHGISLSTLYRRSLLCPGYSLLVVGDRKGAIFGGLVEAPLQPTSTKKYQGTNNCFVFTNLHSDPAIYRPTGANKYYTVCSADYLALGGGGHFALYLDSDLLSGSSSNSETFNNQCLSHSPDFAVKDVELWGFVYPSRYEEMLKLCRTEKPGVCRF

SEQ ID NO: 111241 - protein, 162 aa, Triticum aestivum
  unsure (1)..(162): unsure at all Xaa locations
  Clone ID: PAT_TA_5659.pep
SAFESSPSSRPTPSPPSPSPPPTMSAPAAPPPVAQPHPIPSPRAPATLSPPPHPPQXPLELPGXPPPRPHGTLGPTTPAASSTSTAPLPPTPPPSPPPPPPLPPPPAPPPRRSPATLCSRHGAARASWCSPSQPASRQTTSSASAAPTSSTPLRSVSSATMG

SEQ ID NO: 111242 - protein, 315 aa, Triticum aestivum
  unsure (1)..(315): unsure at all Xaa locations
  Clone ID: PAT_TA_5660.pep
LAAPWYLVVCLFSLGGQDGSVYLAGAVPWLLPAALDATLPGWLPSPLPKPAVPPEMLSAEEKDQAVAAATQTLELAFLLLXREERPWGKWLSKTRXFESSELVFLELHATAILCLPSGECMIPHATSCTALTSALYSTVSDQDVLHRQLKVEVKVSSKDPCCIEVALRCLATEGDXFGLHEANDGGLLAAIMAAGFKGELNRFQPGVSMEISRLDTWYSDCNGSVESTAAYIIRGLCRRCCLPETILRSMQASISLSEAGDSLDRCDKLIELVASSDSGMMHLFSQQQLQEFLIFERECFICKMELEEEQRPADG

SEQ ID NO: 111243 - protein, 133 aa, Triticum aestivum
  Clone ID: PAT_TA_5661.pep
MSKYGTIPISSSSSDAPPPGSSPLDFISRAKARGASALATRQPWRELADPKALAVPRGLGDAYLRARANLAHFSMNYAIVVLGVVFLSLLWHPFSLIVFLACMVAWVFLYFLRDVPLALFGHTIGDGVVLALP

SEQ ID NO: 111244 - protein, 171 aa, Triticum aestivum
  unsure (1)..(171): unsure at all Xaa locations
  Clone ID: PAT_TA_5662.pep
WIATPSWRRVGVVGGLRRWRNGEGGGRRLGCAERGEYLSDIKQGGETVFPRSEDTQAKEGTPSDCAGYAVKPVKGNAILLFNSRPDGIADKDSQYEACSVLEGEKWLAIKHMHASKIDKSKRSPASEDDGCTXEDGNCVSWAAAGECNKNPVFMIGSPDYYGTGRKSCHAC

SEQ ID NO: 111245 - protein, 92 aa, Triticum aestivum
  Clone ID: PAT_TA_5663.pep
NEVINSLGVESRLSMESACCSKSNKQICLAPEEWEHEPNSAYPVAILGGELTEVQTETPFNHSVAKQAYYLASTVVHDHPSCTHASCRHDQI

SEQ ID NO: 111246 - protein, 155 aa, Triticum aestivum
  Clone ID: PAT_TA_5664.pep
MEVPPPPPPPRPHDGEGEQSMALATQPPQLRVGIGAAPAAHRPPSPSIRARGGGRRRTRSVSVAAAAAEGRAAVKGAAAEVVREFYEGVNRRDLAAVAPLIAEGCVYEDLVFPRPMVGRDRVVGFFGEFMGSVSPDLRFVIDDISGEDPSAVGVT

SEQ ID NO: 111247 - protein, 116 aa, Triticum aestivum
  unsure (1)..(116): unsure at all Xaa locations
  Clone ID: PAT_TA_5665.pep
NPPPPATLATPPAPAAPNPXAPPPPPPPSPXPPPPPPPPPSPXPPPPPHHDGARASSPPTTTASTPASAPRLPPVCSSAPRPSPSTSTSRPSQGDSPTSSPWRCPATPPSKPSGHP

SEQ ID NO: 111248 - protein, 183 aa, Triticum aestivum
  Clone ID: PAT_TA_5666.pep
RRRGRWRAAPQARRLEVAGGEREERAVAGCGREVGRVSSRGRRDAAGISMRIDPDLLDCSICFEPLCPPLYQCQNGHVACLSCWSMLSNKCHVCSHDAIFARNIALEKIVESIKSSCAYAKWGCCELVSYTQRNTHEESCLFAPSTCPIPGCGYRGFTGRWSGHFLVDHHKCRFLALRLRPAI

SEQ ID NO: 111249 - protein, 144 aa, Triticum aestivum
  unsure (1)..(144): unsure at all Xaa locations
  Clone ID: PAT_TA_5667.pep
EIFSSGTGEFDXEEVYVKMPADLIISAEKARSIVQDIAKVRLENALVQAVALLRQKKRDGVISSLNDLLACDAAVPASKPLSWPTPRELDDLYCVYMKSIPKQDKLSRLQYLLDISAEKAEDLRDAATAGTLPQTGQEEEELAF

SEQ ID NO: 111250 - protein, 316 aa, Triticum aestivum
  Clone ID: PAT_TA_5668.pep
VDEAEALSLIRKVFIKYFMNGGIEEGETGIGKGEFMPVGSDGNVVLSFSLLNADPFDWVYDWESKDIGERILTPVVEALRPVADINIESHVLYHTPKSSYSYSDDKLGGNVLSMGDIPFFVNSNEWHLDTSISATGRSKVLQFVVYIPSARECPLYLQLPDGELSKTNAFISPMWGGVVIWNPPGCSLGSKKAHGTRRQMSSQELMETLEIFIGQLRQLFGLKPNYHAHGMDVATKFLVSEKGFAQWELDLLYRHHACSNLLSCVATLESLSSLVQSLPRMIVMDEIGRQVELSLEAASLAQRNATLGISDSSAVS

SEQ ID NO: 111251 - protein, 189 aa, Triticum aestivum
  unsure (1)..(189): unsure at all Xaa locations
  Clone ID: PAT_TA_5669.pep
MDPVPSLVKEEEEEEGAHGRGDSPAAGAAPRPMEGLHDAGPPPFLTKTYDMVDDPNTDSIMSWSAGNNSFVVWDPHAFATVLLPRHFKHSNFSSFVRQLNTYGFRKVDPDRWEFANEGFLRGQRHLLKNIRRRXLPLXTASNQQSLGXFTLKVGHFXYDAKIXPLKKDNXCFYGKFXKPKXGQQXXKPF

SEQ ID NO: 111252 - protein, 125 aa, Triticum aestivum
  unsure (1)..(125): unsure at all Xaa locations
  Clone ID: PAT_TA_5670.pep
PGPKGVENFMNFITIEYGGPKSDVLCPCSSCMNSVTXPQSIVQSHLHLYGMSVTYTRWVHHGEAVNVNVTNYVEAADHHLDQPDAQVEEEEDEEVLAAEPVSLTNIETIRRNACTFREVSLAEKQ

SEQ ID NO: 111253 - protein, 616 aa, Triticum aestivum
  unsure (1)..(616): unsure at all Xaa locations
  Clone ID: PAT_TA_5671.pep
MSGSGGPSGRGSAGGTRSFDFGTDDVLCSYDDFAAPSEPKRPDPVDKDFHESRFGRPSVKVYEQESYAKEDVLSAVEKCMKKYADNLLRSLGRYRLQALRSLRFIATKLXRGLIGELRAAGAGSITRDSKXSKSSLIDSLHEXVEQGLSQICLKTTQXVKPDTKKGAKPKFQLTHDESKKKDGVLTPFFPAPKQLDDKRDAASQQLALALPHQVNSSALVPRASVQIQKYNEKPVRPTAPSSLVPQQDRYAVSQAIVYYPQHQAPGNQDTQGQQVQQEVQYLPLRPQAQDVHASSQPQSANQSQPQSYTPYQQQWQQQQQPSRSSPAPVAQQQQPFSQPFPPPVQQPQLSNAHQFPTQPAQQSQLPNVQQFPAQPAQQSQLSNAQQFPPPQLQPQQSNPHLPQTAQPQHPHVQTQMRPSTPPPNYSGGYPPHQPLNPSPETLPGSAAMQGPYNTVAPSGGSHSEVQYSYGGPGIPPSQPPPQHSMQRQQLPPPGQGSFGPPPSKGAYPPQYAPQGHPQGGYNTSYGGYPPNGPSAAQAPQMPPGGAGVSHPGSSHHHMMRGHPYGDMIEKANTMGYPRDQVLNVIQRMTESGQQIDFNALLDRLNESGSGAPPRPW

SEQ ID NO: 111254 - protein, 121 aa, Triticum aestivum
  Clone ID: PAT_TA_5672.pep
HPFPRSPLSLPRQNPACSKIPTLYPSLPPSPLARSSARPPSPRSRSTGPPPTLPAIPNPATEMAAPAPAFFLAPDAAARLLSGEAGGAAAVEVAVGWSPASSPLRSVEVRRVQPPRRRPEP

SEQ ID NO: 111255 - protein, 85 aa, Triticum aestivum
  Clone ID: PAT_TA_5673.pep
RFLICSWLHRWVSRGFVSFEFYWSKLNLLMLTVWTGPFDTSALVMRNIFQHSVGSEVGKTIGLQGSGYFLVLVLPCDYLKLQPAG

SEQ ID NO: 111256 - protein, 520 aa, Triticum aestivum
  Clone ID: PAT_TA_5674.pep
MASAKSSRSRPAGHSGVFPVGAAATGVGGGGGGGGGGDGGVQLADKLKIFKTDNFDPDAYVQSKCQTMNEKEIRHLCSYLQDLKKASAEEMRRSVYANYAAFIRTSKEISDLEGELLSIRNLLNTQAALIHGLSEGVQIDSLTSGTEGSTEEDISNVEGQEPSEIQKWSADFPDMLDVLLAERRVDEALDALDEAERVAADRTQTLTTAEISALRSAVSDNRQKLADQLAEAACQSSTRGIELRAAASALKRLGDGPRAHSLLLSAHNQRLQCNLQTIHPSSTSYGGAYTAALAQQVFSVVAQALSDSVEVFGDESCYASELVTWATQQVLSFALLVKRHVLSSCAAAGGLRAAAECVQISIGHCSLLEARGLSVSAVLLKQFKPSLEQALDANLRRIEESTAALAAADNWTLTYPPNGIRPLARSSVANLALQPKLSSSAHRFNSMVQDYFEDVTPLLSLQLGGSTMDGIAKNFSLYVNLLISALPGSMDDEANIDGLGNKIIRMAETEEQQLALLANA

SEQ ID NO: 111257 - protein, 112 aa, Triticum aestivum
  Clone ID: PAT_TA_5675.pep
PCLRPIAATLNCREGWIQLKSGSILSCLLTHNIVHSVKVISGKKWFVAGTSDGVIHVYNYDNRIQKLRSFRAASDCFITSMAVNPTRSYVLSSAYHDIKLWDWSKGWECTKS

SEQ ID NO: 111258 - protein, 733 aa, Triticum aestivum
  Clone ID: PAT_TA_5676.pep
AAHPGHCLAPPVVLWLWAIVQGFSKEFEGSAERPSGPENAIQDAREGASVAGSSGVKPNADDSGKSSADNISDLQAVLHSLPQAELRLLCSLLAHDGLSDNAYLLVAEVLKKIVALAPFICCHFINELSRSMQNLTVCAMNELHLYEDSEKAILSTSSANGMAVLRVVQALSSLVTSLQERKDPELLAEKDHSDALSQISDINTALDALWLELSNCISKIESSSEYTSNLSPTSANATRVSTGVAPPLPAGTQNILPYIESFFVTCEKLRPGQPDAVQEPSTSDMEDASTSSSGQKSSASHTSLDEKHTAFVKFSEKHRRLLNAFIRQNSGLLEKSFSLMLKVPRLIDFDNKRAYFRSKIKHQHDHHHSPVRISVRRAYILEDSYNQLRMRSPQDLKGRLTVHFQGEEGIDAGGLTREWYQLLSRVIFDKGALLFTTVGNDLTFQPNPNSVYQTEHLSYFKFVGRVVGKALFDAQLLDAHFTRSFYKHILGAKVTYHDIEAIDPAYYRNLKWMLENDISDVLDLTFSMDADEEKLILYEKAEVTDCELIPGGRNIRVTEENKHEYVDRVAEHRLTTAIRPQINAFMEGFNELIPRELISIFNDKEFELLISGLPDIDLDDLKANTEYSGYSIASPVIQWFWEIVQGFSKEDKARFLQFVTGTSKVPLEGFSALQGISGPQRFQIHKAYGSTNHLPSAHTCFNQLDLPEYTSKDQLQERLLLAIHEANEGFGFG

SEQ ID NO: 111259 - protein, 145 aa, Triticum aestivum
  Clone ID: PAT_TA_5677.pep
HEDVGSSHGFSSSVYQDPEAHSVAQFSESSDVYSFGVFLLELITGREAASLQPAESRESLAHWLEAHFSSNELIDPRLGGGFTTEGMKEFVGLAFQCLNPSSRRRPKMRLVAAELDRILETEMSLTTIMGDGTAIITLGSQLFTS

SEQ ID NO: 111260 - protein, 349 aa, Triticum aestivum
  Clone ID: PAT_TA_5678.pep
MEEVEEANRMAVESCHRVLGLLAQTQDPAQLRSIALGTDEACAKFRKVVSLLGNGNGNGNEGGGTHHPRAKLVSRRQTPGFLSQKSFLDNNTPVVVLNSAHPSTSSAQVYPSSRNSILDSSQAAHPIGGPPKLVQPLSAHFQFGDSSRYNQFQQQHQHQQQKMRAEMFKRSNSGINLKFDSPSGTGTMSSARSFMSSLSMDGSVASLDAKSSSFHLIGGPAMSDPVNAQQAPRRRCSGRGEDGNGKCAATGRCHCSKRSRKLRVKRTIKVPAISNKIADIPPDEYSWRKYGQKPIKGSPHPRGYYKCSSVRGCPARKHVERCVDDPSMLIVTYEGEHNHTRMPTQSAQA

SEQ ID NO: 111261 - protein, 245 aa, Triticum aestivum
  Clone ID: PAT_TA_5679.pep
MASSVRQPWQLLLIVLLPSLAAATVFDDNYVPSWGADGYHLVDQGTETRLTMDRTSGAGFRSRSTYGSGFFHMRIKVPGGYTAGVVTAFYLASEAPYDGGDRDEVDFEFLGNVDGETITLQTNVFVNGDGDREQRLNLWFDPAADFHEYKILWNPYQLVILVDDVPIRVLRNLTGQVPEYEFPAKQMGVRASLWDGSDWATDGGRIKIDWGRAPFTAGFRGFDVDACANTSSTPCDSTDLWWNAR

SEQ ID NO: 111262 - protein, 107 aa, Triticum aestivum
  Clone ID: PAT_TA_5680.pep
MRQISSMLQGLARSMSLGKERKQAEEAQGTVLRSSGTLWGEGSETLAAACSRRGEKGTNQDTSIVWEGYGCQDDTIFCGVFDGHGQWGHYVAKAVRESLPQRLLCRW

SEQ ID NO: 111263 - protein, 253 aa, Triticum aestivum
  Clone ID: PAT_TA_5681.pep
MFDSFMRNFENSFSSTLRTLHRINEIPVYERSPTPEYSSTHGGSGAVENSSAADLRNHTKEIEQDLMNSVESQVVPTRPDNRQLADRAHSRSSREADQCILSAFERSVKEQARSNELKEREISLSMRKLQLKQTELALSSSSHMLEKIKLSLGFQKASFQGEKFKTQMQDTRHAEILRTLIDFLVSAVVIMSVCFAYGTYVHSYQRITDVTAACSAASRGSKSWWVPNSVSNFNSGLQFVRCHVIAATRMCFG

SEQ ID NO: 111264 - protein, 123 aa, Triticum aestivum
  unsure (1)..(123): unsure at all Xaa locations
  Clone ID: PAT_TA_5682.pep
TKDWDITSGERLNXILKDFTRFGLEHWGSDTKGVETTRHFLLEWLGYTCRYIPVGLLDVVPQQLNWRPPSYCGRDDLXETLMASDSSXDWVRISXECCSGKVPEGFTSAPKHKSNSYDRAENG

SEQ ID NO: 111265 - protein, 479 aa, Triticum aestivum
  Clone ID: PAT_TA_5683.pep
MGESPPPTPPPPAAPAKVYYEGCPGCAMERRKESSTGTPYKELFFVGITTFASSLPITSLFPFLYFMIQDLHVAQREEDIGFYAGFLGASYMVGRGFASIFWGMVADRIGRKPVIVFSLFTVIVFNTLFGLSVKYWMAITTRLLLGALNGFLAPIKAYSIEVCRDDEQALGISIVNTAWGLGLIIGPAIGGYLAQPAKQYPHIFHDKSTFGRFPYLLPCLCISIFATFALISCIWLPETLHKHAKFEMRAETAEAGTTQESTESPKKSLWKNWPLMSSIITYCVLSLHDTAYSEIFSLWTVSGRKYGGLSFSSKDVGQVLTVAGVSLLVYQIFVYRWLNNTLGPVNSTRIASALSIPIIAAYPFMTRLSGIRLGLALYIAAMIKSVLAITRVSGTSLLQNNAVPQGQRGAANGIATTLMSLFKSVAPAGAGILFSWAQKRQHAAFFPGDQMVFLLLNVTEVLGLLLTFKPFLAVPQHYK

SEQ ID NO: 111266 - protein, 198 aa, Triticum aestivum
  Clone ID: PAT_TA_5684.pep
TTNISSFLAGILAREDPQVLIPALQIAEIMMEKLPETFSKLFVREGVVHAVEALICPESSNMVPPQVPPQDKEGDPVMSSRPRRQRRRGGAAPTENSLLDVSNVSNSGIASASPCSTEVPVTSLRFEVSDRAKSFKDKYFPSDHGSSDAGVTDDLLKLRALCAKLNTATENVVTKAKGKSKALSPSHFDISHDVEEQL

SEQ ID NO: 111267 - protein, 191 aa, Triticum aestivum
  Clone ID: PAT_TA_5685.pep
VIFGITNTFRPFSDDIFRYDFKEPFKLQNGWLLWAGIGLFFALVSISLTGAVMTFLNGETTQRETDSLLLLLPLIGSSNISTACLLGITGVLAPILEETVGGALLRASLTLWCAPPVSGRVTAVACAVALLTPGVSPRRLGPGVALGFSYSQTRNLLTPITIHAAWNSGVILLLTFLQLQGYDIKELLQAS

SEQ ID NO: 111268 - protein, 266 aa, Triticum aestivum
  Clone ID: PAT_TA_5686.pep
KVQPTFVQERRAMKREYEEFKVRINAPHASAQKVPDEGWIMKDGTPWPGNNTRDHPGMIQVFLGHSGGLDTEGNELPRLVYVSREKRPGFQHHKKAGAMNALIRVSAVLTNAPFMLNLDCDHYINNSKAIRESMCFLMDPQVGRKVCYVQFPQRFDGIDAHDRYANRNTVFFDINMKGLDGIQGPVYVGTGCVFRRQALYGYNPPSGPKRPKMVTCDCCPCFGRKKRKGGKDGLPEGVADGGMDGDKEQMMSQMNFEKRFGQSRAF

SEQ ID NO: 111269 - protein, 342 aa, Triticum aestivum
  unsure (1)..(342): unsure at all Xaa locations
  Clone ID: PAT_TA_5687.pep
MFGSLGNNMMKGMVCLVAVALVVAGSASIAAAQAAGLKKGFYKKSCPQAEDIAQKVVWKHVAGNRELAAKFLRMFFHDCFVRGCDASVLLDSPTNTAEKDAPPNLSLAGFEVIDEVKAALERACPGVVSCADIVALAARDSVSFQYGKKLWEVETGRRDGTVSSDTQALNEIPAPSSTFDILLTNFSGKGLGLQDLVVLSGGHTIGIGTATXFSSRLFNFTGKNNPTDTDPSLNPXYAKFLQGQCRRNLQAPNDNTTVVPMDPGSSTSFDSHYFVNLKARQGMFTSDATLLTNSRAAALVDKLQDNGVFFDHFKNSIKRMGQIGVLTGASGQIRNKCNVVNS

SEQ ID NO: 111270 - protein, 140 aa, Triticum aestivum
  Clone ID: PAT_TA_5688.pep
NTIGIGNCNLFSSRLFNFTGKNNPTDTDPSLNPPYAKFLQGQCRRNQQDPNDNTAVVPMDPGSSTSFDSHYFVNLKARQGMFTSDATLLTNARAAALVDKLQDNGVFFDHFKNSIKRMGQIGVLTGASGQIRNKCNVVNS

SEQ ID NO: 111271 - protein, 117 aa, Triticum aestivum
  unsure (1)..(117): unsure at all Xaa locations
  Clone ID: PAT_TA_5689.pep
MASQEKPITPSPSPPAPPQPPTPEGAPRIRGFGGGAAGGGYPNPPDAALPDAATLRDQWRFXAVRQYSRWYSQAWGTAILAGGAFFALGWLVKGSNPLPSRADPRPPNDANADEDKK

SEQ ID NO: 111272 - protein, 158 aa, Triticum aestivum
  Clone ID: PAT_TA_5690.pep
MSTDVAADVPAPEVEVAADHVVETTAEAAAGDAKPVKETKAKAAKAKKPSAPRKPRATPAHPTYAEMVSEAITALKERTGSSQYAIAKFVEDKHKAHLPGNFRKILSVQLKKLVASGKLTKVKASYKLSAAAAKPKPAAKKKPAAKKKAPAKKTATKT

SEQ ID NO: 111273 - protein, 219 aa, Triticum aestivum
  unsure (1)..(219): unsure at all Xaa locations
  Clone ID: PAT_TA_5691.pep
MASSAVLLLILMVVAATVHGHTHTPGGTPAALFWEAALPDSPMPESIAHLVQKGTDHSPLQQHHSAAMILPNACLGYSYRIICNSPAQQASSVEGLFFRESDMRVGRTMTVALPAFDPAPFLPRKAAERIPFGNLADALYRFGITPGSQEAARVGETLSACREAPLAGSRKACATSLXEGVVLSATRMLATSRPLVAAASALPNSGLPRRTYTVQAISH

SEQ ID NO: 111274 - protein, 299 aa, Triticum aestivum
  Clone ID: PAT_TA_5692.pep
CSCDGPLDVLNEQSRGPRATRPKKQPEDDSKDEKPSVGLDQEPYNRADFVTEYKNARFFIIKSYSEDNVHKSIKYGVWASTTNGNKKLDAAYREVKDKEEHCPIFLLFSVNASAQFCGVAEMTGPVNFEKSVDYWQQDKWTGQFPVKWHIVKDVPNNLFRHIILENNENKPVTNSRDTQEVKLEQGLEMLKIFKDHEDDVSILDDFDFYEEREKALLENKARLHQQQQISSSSVSEPKKPSTVPPDLVGHITNSPSVEPKSPRPYPMTWWVISPRPSNMPCGLARPKEPLSRLKPRWRI

SEQ ID NO: 111275 - protein, 136 aa, Triticum aestivum
  Clone ID: PAT_TA_5693.pep
MAAATAPATARKLTEEVYTAELAGVPLGAPAGAPSGVAETADGVIAEGASVGASVGGAGGEAIGDGDAAVGGVATGAGAVAGDLAGGAGRGAAPGACAAAVTARSATMAATTAKRAIRLAQAVIGGRLWLGLQSRR

SEQ ID NO: 111276 - protein, 337 aa, Triticum aestivum
  unsure (1)..(337): unsure at all Xaa locations
  Clone ID: PAT_TA_5694.pep
MASSFLSLRLPTPSPPTATSSPFFPNPLVRSGRCSPPSSTLVARVAGSAAGAPSPLFNPRGDPFLSTLAAASPEQLAAAAGGERRGEDHLPFLEIFQNAKLMSSPAQVERSSSSYSQHSPRRPPPDLPSLLLHGRIVYIGMPLVPAVTELIVAQLMYLDWMNSSEPAYIYINSTGTARDDGEPVGMETEGFAIYDAMMRMKTEVHTXCIGAAAGHACLVLAAGKKGKRYMFPHAKALIQQPRIPSYGMMQASDVVIRAKEVVHNRNTLVKLLARHTGNPPEKIDKVMRGPFYMDSLKAKEFGVIDKILWRGQEKYMSDMLSPEDWDKVAGVRGPGGM

SEQ ID NO: 111277 - protein, 159 aa, Triticum aestivum
  Clone ID: PAT_TA_5695.pep
MAAVPPNVEVSIVPAPTTYRKTILRNLWLGRTGDDTQKSLLEVGKFGHYVVVNWTVFEGEGNGAKLVARGQGSTICAGSWISTYVIVFVDGRFKGSTLQVMGNALGVNGQLAVTGGTGEFALASGIIKVDFDKLTGVDHLTVEVYTPVFLGPCYAAAEN

SEQ ID NO: 111278 - protein, 260 aa, Triticum aestivum
  Clone ID: PAT_TA_5696.pep
PSCNTHGRVLPNGAQAAVLVSALLCLALSRGALSQKARAPIVETPAPAPAPRHVELAELLSLAGPYGKFLGYLTKTDVIKTFQSQANDTKQGITVFAPQDSAFAALNETVLSNLTTDQLRSLMLHHAMPSYYQLSAFSALAAASQVSMFAYKVNVTYAAGTIGVVSGWATAKLASSVYSTSPVAVYALNRVLLPKEIFPAAPEMAPVPAPAPAPGRGGKAMADAPGASERAASDNADAKSSSCRVVGAGSLALGYVVLLV

SEQ ID NO: 111279 - protein, 217 aa, Triticum aestivum
  Clone ID: PAT_TA_5697.pep
MSFRGRGGRGGGRGGRGGRGGRGFGGASYDHPAKHAPHEDFPEITLPEMTCAKATNEEKTLILSTLKLDDFMRNSCYYLEPDAPKKKNDDKEIERYSDRKRKTQSKREALASYLKLIPANFPAELLHGSKRAQPVQKKLRWDKDADNQAFDIFEKLEAKQKDGEEKTEKEGDEEEEDEEEEAEAEESSDDDYNQNIEFDDDDDDWNQEEEAHEDCYD

SEQ ID NO: 111280 - protein, 321 aa, Triticum aestivum
  unsure (1)..(321): unsure at all Xaa locations
  Clone ID: PAT_TA_5698.pep
MAATAVRCLLMAAAVLAPLFAGSEGAFLSSKFYDRRCPSLQTIVRSAMPQAVAAEPRMGASILRLFFHDCFVNGCEAVQLAGTTTANFTGDKNAGPNANSVGGXTSSITIKAQVQAVCKGNVSCAHNVALPARXGAAATSAPSHVSTPTWFDTTYFENLANKQGLFHSDQELYNGGSQDVLVRVYMRNPDIFALDFAKAMGKMGSLMPSADTPTEDQAGLQEDQLRSTGSEDESVVSSPVRTREAIYAHSSYSDHPVHKQGLFHSDQELYNGGSQDIMVKVYMRNPDTFAMDFGKAMVKMGSLMPSADTPTEIRLDCKKIN

SEQ ID NO: 111281 - protein, 91 aa, Triticum aestivum
  Clone ID: PAT_TA_5699.pep
IAGWGRAPCCDKARVKAGAVVPRRRTKQLRAYVRANGSGGNWIALPHKAGLHRAALGCPPPGLIPLSPLTRHAGAPEPDHRGISAPAASIT

SEQ ID NO: 111282 - protein, 199 aa, Triticum aestivum
  unsure (1)..(199): unsure at all Xaa locations
  Clone ID: PAT_TA_5700.pep
RLLPPLRLAALAVLRRLGLGALAVSRRSMLGVLCLAPGSFAGAGPPAPVRPTSAGPSAASSPPSGAVCPGAHVPCRSVRPWVLVSCLRFVSFEVAHLRLERLELHWARPVQFTGVVLGIPARAAPGRSGRIVDRFSSEPSRPCRSWHLLLDNGYSGAKXLKQKELPVAFVSFKSRLEAAQAAETQQHVNPLSLVTRYAP

SEQ ID NO: 111283 - protein, 415 aa, Triticum aestivum
  Clone ID: PAT_TA_5701.pep
WADLRLVGKKAEWTVRRLVTATGFTGAEAHFLFVLFARGKAQQVGGGSREKLAREEMGKGGELWDDSALVDAFDHAVATYKAMHGKNNQAAPSEKQESEDVAAAAASAAAYAAAAVAEEPVSTEVADEQTEKNDSCTNLPIGPVETPQQPCEERKTDKQAPLRGTDLGKETNISESKTCFSDVTNTEGKDSSNQQTEDYNELLRKYYELEVQSQKVLEQLHQTNYWNYQTPEQSSAYQQQQVPAYIATAPDPNSSTTQTSCCSLNVPMVSISCCSTGQQSGESTGMPPNGGCSISFTCDHCPGASTTYPTGSAFTQLPTKVSTGDDQVAKAAMMTAEGAMNFMRNTISGDAASFPNMRNEGGIGKENNTTVGMNLNLDTTGANSDLAVVLNAWYTAGFYTGRYLMQQSMKNPREN

SEQ ID NO: 111284 - protein, 338 aa, Triticum aestivum
  Clone ID: PAT_TA_5702.pep
SARGDERVGLESKSHRCHLYLVIHDEDDRYAIRKFDLSLHSSSDHTALQRLPPPLISLESPMSGLFASIGSKIMVMDTDRPERIVPVFDVCTKYLTLGPRNGSRPFRPIYLPVGDSLAALDEDSSELLRQQEWGWSSWRSLPNPPFNLEDITSHAVHPDSRTIFVSTKTTTFSLDTRLNDTKWMCHGQWKLPFVGRAHFDPRLDAWVGLSGGQDTLGYLCSSDVVSTDPDDPSGNTQSPSWKLSKKRLFGDNQAEKHIGTNLVYLGVRLFCLVHYFSVRDDASGSNCKTRYMLRLTTFSLEYDKNGDLRTGKPSRVQCYSLPTPSNILAFRDPVAFWL

SEQ ID NO: 111285 - protein, 325 aa, Triticum aestivum
  unsure (1)..(325): unsure at all Xaa locations
  Clone ID: PAT_TA_5703.pep
RLAVGPAPLASGGGDDAGEKRVTDRYLKREVLGEGTYGVVFKAIDTKTGETVAIKRIRLGKYKEGVNFTALREIKLLKERKDPNIIELIDAFPYKGNLHLVFEFMETDLEAVIRDRNIVLSPADIKSYIQMMLKGLAFCHKKWVLHRDMKPNNLLIGAEGQLKLGDFGLARIFGSPERNFTHQVFARWYRAPELLFGTKQYGSAVDVWAAXCIFAELLLRRPFLQGSSDIDQLGKIFAAFGTPKSSQWPDMVCLPDYVEYQFVSAPPLRSLFPMASDDALXIFLSRMFTYDPKXARTLLKQALRTQVLSXNYQAPTKPNLLPKPN

SEQ ID NO: 111286 - protein, 225 aa, Triticum aestivum
  Clone ID: PAT_TA_5704.pep
TPPTPPPPPPRPALTRASTKRAAAVTAVAVAAKRKRVALSEIPTLPNGAPQPHAKPRESSSQVAKPKKRSVSSLSLPAPKPAPGAADETGDPQLCAPYASDIYSYLRSMEVQARRRPAADYIERVQVDVTPNMRGILVDWLVEVAEEYKLVSDTLYLTVSYIDRFLSANSLNRQKLQLLGVSAMLIASKYEEISPPNVEDFCYITDNTYMKQELVKMERDILNNL

SEQ ID NO: 111287 - protein, 91 aa, Triticum aestivum
  Clone ID: PAT_TA_5705.pep
MTKGEVPLIGIDLGTTYSYVSVWQYVEIMANDHGNRIAHHALLRRLNQLAMNPTNTVSGTCFHLEALRLRAGAVLFPCTRYDLVGIGIMVI

SEQ ID NO: 111288 - protein, 97 aa, Triticum aestivum
  Clone ID: PAT_TA_5706.pep
TVRDTALEIRRAFPAKCILSVNPHGKERNLDFVDQVAALHSKQDRLLVGCRSGVRSRLATADLVAAGFTKVKNLEGGYLSLLKSVSYQQPAALANLH

SEQ ID NO: 111289 - protein, 131 aa, Triticum aestivum
  Clone ID: PAT_TA_5707.pep
MASIRRDLLVALCVAALLAVGSESHGLEDFGSEGKTEATPEMASFFGAKPEAAVLPEALDNNKAAKPEAASAMPTTTTSNPRSSPPRRSVAVAAGVACGVAALAVVGVAVAVAFVVRARRGERREAEVHFG

SEQ ID NO: 111290 - protein, 211 aa, Triticum aestivum
  Clone ID: PAT_TA_5708.pep
FGTRDTAPLLALCSPLLSSSLLSHTRPKASKLGRHEQGLRQPRRGRHPAHVPALPGLPLLPGPGGGRHRPHRLPRPPPHAPALLSPGRLAPAAGRAHRQRLRRGGRALHRAPGEDRRPRPVEGGQLDLRPLPHLRDLPRLPHRHRRQRRARGQRAQVPDRHLLPRRGLAVRPYVLCFLFFFVIFLCSVGGGEVGFLRVARARARSQEDHQG

SEQ ID NO: 111291 - protein, 135 aa, Triticum aestivum
  unsure (1)..(135): unsure at all Xaa locations
  Clone ID: PAT_TA_5709.pep
MGSLRSSGSGAAVPVESVDPEAACALLASGQYGYVDVRMWEDFDKGHVAGARNVPYYLSVTPHGKEHNPHFVDQVAALHAKEDRFLXVGCRSGIRSXSPTADLVAAGFTNVKNLEGGYLSLLKSASYPQPAASHH

SEQ ID NO: 111292 - protein, 205 aa, Triticum aestivum
  Clone ID: PAT_TA_5710.pep
GDHLTQKQRPLLPSCSILHRWVPCGAAQARRWRAWTQRRRAGCWPWSSTGTWTCGCGKDFEKGHVAGARNVPYYHSIHAPWARSATRTSSTRLLRSTQRRTGSLLAAALGSGPGSPPADLVVAGFMNVKNLEGGYLSLLKSTSYPQPPSSPAHPMIHQLILVRVSKKFVSDLFVYCVSITLRLLLLKKKKKKKKQVLQLRRTSGI

SEQ ID NO: 111293 - protein, 125 aa, Triticum aestivum
  unsure (1)..(125): unsure at all Xaa locations
  Clone ID: PAT_TA_5711.pep
KSPPFFEGGALFRGITPYGLLVEGQDKLDYVLALTVKNFXLARRLQTFVFKAGMAKSIPHARVLIRQPPIRVGRQIVNVPSFMVRVEFEKHIDFSLTSPFGGGPAGRVKRKNQKKASGGGDPGGF

SEQ ID NO: 111294 - protein, 127 aa, Triticum aestivum
  unsure (1)..(127): unsure at all Xaa locations
  Clone ID: PAT_TA_5712.pep
MATMMTMSSFAGAAVLPRGSAGHFGAQSLPALGRRALIVRAQTEGPSAPPPNTPKASTSIWDALAFAGPXAPERINGRLAMVGFVTALAVEAGRGDGLLSQLGSGTGQAWFAYSVAVLSWVLVQRSR

SEQ ID NO: 111295 - protein, 126 aa, Triticum aestivum
  Clone ID: PAT_TA_5713.pep
MGSLRSSTSAAVESVHAEAACGLLASEQYAYVDVRMWEDFEKGHIAGARNVPYYLSVTPHGKERNPDFVDQVAALHSKEDRFLVGCRSGVRSRLATADLAAAGFANVKNLQGGYLSLLKSTSYGQP

SEQ ID NO: 111296 - protein, 250 aa, Triticum aestivum
  Clone ID: PAT_TA_5714.pep
MEDERSTQSYQGGEAAEQVEVTDRGLLGNLLGKKKAEEDKEKKEEELVTGMEKKETLFSKLHRSSSSSSSSSDEEEEEVIDDNGEVIKRKKKKGLKEKLQEKLPGHKDTEGEHVTGLPAPAAPASVQTHHDTDVVVEKIDGDVKTEATPAVPEEEKKGFLEKIKEKLPGGHKKPEDAAAVPVTHAAPAPVTHAAPAPVHAPAPAAEEVSSPDAKEKKGLLGKIMDKLPGYHKTGEEDKAAAATGEHKPSA

SEQ ID NO: 111297 - protein, 136 aa, Triticum aestivum
  Clone ID: PAT_TA_5715.pep
MGSLGSSDGEKRLPVESVNTEAACALLASEQYGYVDVRMWEDFDRGHVAGARNVPYYLSVNPHGKERNLDFVDQVAALHSTHDRLIVGCRSGVRSRLATADLVAAGFTKVKNLEGGYLSLLKSVSYKQQAALANLH

SEQ ID NO: 111298 - protein, 172 aa, Triticum aestivum
  unsure (1)..(172): unsure at all Xaa locations
  Clone ID: PAT_TA_5716.pep
LDAELKLVGEYGLRCKRELWRVQYALSRIRNAARHLLTLDEKNPXRRIFEGAALLRRMNRYGLLAEGQDKLDYVLALTAGELLARRLQDSCLPRLAWQNPSHHARVLIRQRHIRVGRQIVNVPSFMVRVESEKHIDFSLTSPFGGGXPGRVKRKNQKKASGGGDAGGDEEEE

SEQ ID NO: 111299 - protein, 132 aa, Triticum aestivum
  Clone ID: PAT_TA_5717.pep
MASIRRDLLVALCVAALLAVGSESHGLEDFGSEGKTEATPEMASFFGAKPEAAVLPEALDNNKAAKPEAASAMPTTTTSTNPRSSPPRRSVAVAAGVACGVAALAVVGVAVAVAFVVRARRGERREAEVHLG

SEQ ID NO: 111300 - protein, 137 aa, Triticum aestivum
  Clone ID: PAT_TA_5718.pep
MGSLGSSDVEKRLAVESVNTEAACALLASSEQYGYVDVRMWEDFDRGHVAGARNVPYYLSVNPHGKERNLDFVDQVAALHSKQDRLLVGCRSGVRSRLATADLVAAGFTKVKNLEGGYLSLLKSVSYPQLAAAASLH

SEQ ID NO: 111301 - protein, 212 aa, Triticum aestivum
  unsure (1)..(212): unsure at all Xaa locations
  Clone ID: PAT_TA_5719.pep
VKDCGNHGEDDIRRTCRRFLAFLFFLALVVAVIALIVYLVLRPTHPRFYLQDASLRQLDVLSANASAAAGVLSTVLQVTVASRNPNDRVGVYYDRLDVYASYKYQQITLASALPPVYQGHGDVEVWSPVLSGPNVPFAPYLADALAKDVQAGYXILQVKIDGRVRWKVGSWISGHYHIFATCPAFLVGAGGNGAPGASGLRFQTATYCHVEV

SEQ ID NO: 111302 - protein, 208 aa, Triticum aestivum
  Clone ID: PAT_TA_5720.pep
MGKDCGNHGDDHLRNGCRRLLAVLLVLAFIVAIITLIVYLVLRPTHPRFFLQDASLRQLNLSNSSGLLSTSLQVTVASRNPNDRVGVYYDRLDVYASYKYQQITVAASLPAVYQGHGDVDVWSPVLDGPNVPFAPYLASAISQDCQAGYLILQVKIYGRVRWKVGSWISGHYHLFVTCPAFLVTSGGNGAPGASGFKFQTTTYCHVEV

SEQ ID NO: 111303 - protein, 131 aa, Triticum aestivum
  Clone ID: PAT_TA_5721.pep
MASSRRDLLVALCVAALLAVGSESHGLEDFGSEGKTEATPEMASFFGAKPEAAVLPEALDNSMAAKPEAASAMPTTTSTNPRASPPRRSVAVAAGVACGVAALAVVGVAVAVAFVVRARRGERREAEVHLG

SEQ ID NO: 111304 - protein, 213 aa, Triticum aestivum
  Clone ID: PAT_TA_5722.pep
MGKDCGNHGEDDIRRTCRRFLAFLFFLALIVAVIALIVYLVLRPTHPRFYLQDASLRQLDVLTANASAAAGVLSTVLQVTVASRNPNDRVGVYYDRLDVYASYKYQQITLASALPPVYQGHGDVEVWSPVLSGPNVPFAPYLADALAKDVQAGYLILQVKIDGRVRWKVGSWISGHYHIFATCPAFLVGAGGNGAPGASGLRFQTATYCHVEV

SEQ ID NO: 111305 - protein, 268 aa, Triticum aestivum
  Clone ID: PAT_TA_5723.pep
MEDERSTQSYQGGEAAEQVEVTDRGLLGNLLGKKKAEEDKEKKEEELVTGMEKVSVEEPEVKKEEHVDGEKKETLFSKLHRSSSSSSSSSDEEEEEVIDDNGEVIKRKKKKGLKEKLQEKLPGHKDTEGEHVTGLPAPAAPASVQTHHDTDVVVEKIDGDVKTEATPAVPEEEKKGFLEKIKEKLPGGHKKPEDAAAVPVTHAAPAPVTHAAPAPVHAPAPAAEEVSSPDAKEKKGLLGKIMDKLPGYHKTGEEDKAAAATGEHKPSA

SEQ ID NO: 111306 - protein, 195 aa, Triticum aestivum
  Clone ID: PAT_TA_5724.pep
MVHVNFYRNYGKTFKKPRRPYEKERLDAELKLVGEYGLRCKRELWRVQYALSRIRNAARHLLTLDEKNPRRIFEGAALLRRMNRYGLLAEGQDKLDYVLALTAENFLARRLQTLVFKAGMAKSIHHARVLIRQRHIRVGRQIVNVPSFMVRVESEKHIDFSLTSPFGGGPAGRVKRKNQKKASGGGDAGGDEEEE

SEQ ID NO: 111307 - protein, 259 aa, Triticum aestivum
  Clone ID: PAT_TA_5725.pep
MEDERSTQSYQGGEAAEQVEVTDRGLLGNLLGKKKAEEDKEKQEELVTGMEKVSVEEPEVKKEEHEDGEKKETLFSKLHRSSSSSSSSSDEEEEEVIDDNGEVIKRKKKKGLKEKLKEKLPGHKDTEGEHVTGLPAPAAPASVQTHHDTDVVVEKIDGDVKTEAAPAVPEEEKKGFLEKIKEKLPGGHKKPEDAAPVPVTHAAPAPVHAPAPAAEEVSSPDAKEKKGLLGKIMDKLPGYHKTGEEDKAAAAAGEHKPSA

SEQ ID NO: 111308 - protein, 262 aa, Triticum aestivum
  Clone ID: PAT_TA_5726.pep
MEDERSTQSYQGGEAAEQVEVTDRGLLGNLLGKKKAEEDKEKEEELVTGMEKVSVEEPEVKKEEHEDGEKKETLFSKLHRSSSSSSSSSDEEEEEVIDDNGEVIKRKKKKGLKEKLQGKLPGHKDTEGEHVTGLPAPAAPASVQTHGGHHDTDVVVEKIDGDVKTEAAPAVPEEEKKGFLEKIKEKLPGGHKKPEDAAAVPVTHAAPAPVHAPAPAPEEVSSPDAKEKKGLLGKIMDKLPGYHKTGEEDKAAAATGEHKPSA

SEQ ID NO: 111309 - protein, 249 aa, Triticum aestivum
  Clone ID: PAT_TA_5727.pep
MVSSSGSLRRSTPGLVQGGHMRPSRRAVTLDMVSVGVRRRRRRRQRGREERAPAMVHVNFYRNYGKTFKKPRRPYEKERLDAELKLVGEYGLRCKRELWRVQYALSRIRNAARHLLTLDEKNPRRIFEGAALLRRMNRYGLLAEGQDKLDYVLALTAENFLARRLQTLVFKAGMAKSIHHARVLIRQRHIRVGRQIVNVPSFMVRVESEKHIDFSLTSPFGGGPAGRVKRKNQKKASGGGDAGGDEEEE

SEQ ID NO: 111310 - protein, 274 aa, Triticum aestivum
  Clone ID: PAT_TA_5728.pep
TWGQAAEKCRPAPWPSSSGGAAVVSEHGEGSQVSPPSSRCKIRFRTESRFVSVAFDVMSSWSFVQASSSSAWRLVLSRGELPWWKLTAGGRSGDSFPNKLESFPDLEDLRRLVPFVRRCRGDGDRKWKRWSASLFRLGLCIFSSVLGVELRRPLELPVSAAFPVTFLAEGRPGEAMLASFLPPGLMPFERQLFNFNMESSSSIFVRRWSSGGPVISSGHVPGDGRTGSTLELSIGPDCNLNHQDGVLLVSFKDYDVISFSFQSWYELCTAAADS

SEQ ID NO: 111311 - protein, 179 aa, Triticum aestivum
  Clone ID: PAT_TA_5729.pep
TFSIDNCNFLMQVLKGLMYLHHEKRVIHRDLKPSNILINHRGEVKISDFGVSAIISSSSAQRDTFTGTFNYMAPERISGQKHGYMSDIWSLGLVMLECATGNFPYPPRESFYELLEAVVDQPSPSAPSDQFSPEFCSFISAWYLCFFIDPPLLINITWAIFVICLVLKFKTMSLATIPS

SEQ ID NO: 111312 - protein, 349 aa, Triticum aestivum
  Clone ID: PAT_TA_5730.pep
MKKPGKLALPSQDSTIGKFLTQSGTFKDGDLLVNKDGLRIVPQSEEGEAPPIKPLDNNHQLSIDDLDSIKVIGKGNSGTVQLVRHKWTGQFFALKVIQLNIQESIRKQMAQELKISLFTQCQYVVTCYQCFYVNGVISIALEYMDGGSLADFLKAVRTVPEAYLAAICKQVLKGLMYLHHEKRVIHRDLKPSNILINHRGEVKISDFGVSAIISSSSAQRDTFTGTFNYMAPERISGQKHGHLSDIWSLGLVMLECATGNFPYPPRESFYELLEAVVDQPSPSAPSDQFSPEFCSFISACIQKNAADRSSAQTLSVHPFLSMYDDLNIDLSDYFRTAGSPLATFKQIAL

SEQ ID NO: 111313 - protein, 136 aa, Triticum aestivum
  Clone ID: PAT_TA_5731.pep
ARGRDCHGDLELPLAARSSWLVVTCPCSPSLCLAPSASPLFLPPKACSISCPPHPPRPHYFATRRFCSSDLVYSLSFVCFSNLHVSACGLWFFRSDLLLVLISCSLWCRCVRLRLFLRLILISHVNLISVSGYLLV

SEQ ID NO: 111314 - protein, 170 aa, Triticum aestivum
  unsure (1)..(170): unsure at all Xaa locations
  Clone ID: PAT_TA_5732.pep
MLRLRECFVSRLLSSPSTPTYAIFSPPPRPTFPQIPVASPSRTTSSPPAASPDPKPSRPPPSSPTSSPPPTPTPXSPSSPASASPAPMPPPPSPKTRSSYAPKWTKPWPRWSMGSPASACRVPTSPASSRSPPTTSAVEPCSPGCSTTCPSSAPSTTSSGCSRTHPACCI

SEQ ID NO: 111315 - protein, 259 aa, Triticum aestivum
  Clone ID: PAT_TA_5733.pep
HPQAALPSRKPPSTPPAPPGPWPPPPPSAPPPVRPPPAPTQTPQPQRAPPPPAPSPTPPSPPAPPPPPCPGSVAAPSPRPARLSPPPRYPLSTASSPPRRPPSPQTLASPWRSTSSPPAAPPDHSPASPAPSSPTSSPPPIPTPCSPSSPASGAPTPMAPPSSPRTRRSSAPAWKRSPGAPSSPGLSGPRLIAFRHRAPRLALPVARFRLRSIVSLAAVLHASTFGSFVESSCEPCKKTFDPSPRLTLDDVGNAQPRGR

SEQ ID NO: 111316 - protein, 151 aa, Triticum aestivum
  Clone ID: PAT_TA_5734.pep
TEPTSSVMHPRDGGLKLLPYHSHRRRAVERNQIEYLRSAGTARPAPLFGNKTGGTGSGCSRLSANSSRNGNLSMASSRNSTPPSSISPCSAIAERAPPQGPTQNGDRGGGGGHSAGRTSSGRGGGAEFPCASAVPPICFGPHEIAPLFAYR

SEQ ID NO: 111317 - protein, 82 aa, Triticum aestivum
  Clone ID: PAT_TA_5735.pep
MASATPAVPDPALGLRHPGALARRIAMARGAAVAPALRPWLLFDAVPLVVVVLIAAHVLALGYWIYRLATDGSKHPARSKKH

SEQ ID NO: 111318 - protein, 106 aa, Triticum aestivum
  Clone ID: PAT_TA_5736.pep
MSAGGAFGGNRGVRPVPPEKGVFPLDHLHECDLEKEDYLACLKSTGAQSEKCRMFSKKYLECRMERNLMAKQDMSELGFSDADVVVTPSEEKHKLQSPASDSKERK

SEQ ID NO: 111319 - protein, 296 aa, Triticum aestivum
  unsure (1)..(296): unsure at all Xaa locations
  Clone ID: PAT_TA_5737.pep
PEEKRRFTLRIRRGDREKLLPAYLDHILATAQEIRRRSQDRLXPYTNARGGAMDSRGLPWDPVPFKHPSTFDTLAMDPDRKASIMADLRDFAAGGSFYERTGRAWKRGYLLYGPPGTGKSSMIAAMANFLGYDVYDLELTEVSSNAELRKLLMKTTSKSIIVIEDIDCSVDLTNRAALPPAPKPRPTLDGAIDQDAGAASGRSITLSGLLNFTDGLWSCCGSERIFVFTTNHIEKLDPALLRSGRMDMHVFMSYCTFPALKILLKNYLCLQDDGAEVMRGLEEWIEAAEITPADVS

SEQ ID NO: 111320 - protein, 210 aa, Triticum aestivum
  unsure (1)..(210): unsure at all Xaa locations
  Clone ID: PAT_TA_5738.pep
MMTRSLEPAAEQKASSSFGNLLSIFLRVSSSEPKPPRRSFDAEGVVGLGIVAAMSRACLTAQPIAIGAAARRRAREEDELSESYTCVITHMATGAGEGGSMRKRVYFGFGDGGDGWFVEAAEEAPARADDFLSRCCLCNKRLDGLDIYMYXGEKAFCSSECRCHQMLMDDRAENCGSEALRANSYSGLAVLLRRMSFSPKRRGGLADRAA

SEQ ID NO: 111321 - protein, 466 aa, Triticum aestivum
  Clone ID: PAT_TA_5739.pep
AAASTSADCVELQPELKRLKLRKNNWESDTFEFDEVLTEFSSQKRVYEVVAKPVVESVLEGYNGTVMAYGQTGTGKTFTLGRLGDEDTAARGIMVRAMEDILADITPETDTVSLSYLQLYMEMIQDLLDPVNDNIAIVEDPRTGDVSLPGATVVEVRDQKSFMDLLRIGEAHRVAANTKLNTESSRSHAILMVNVRRAVKGRSEMNVSMSAENGHSSSMMDSLPPPIVRKSKLVVVDLAGSERIDKSGSEGHTLEEAKSINLSLSSLGKCINALAESSAHVPVRDSKLTRLLKDSFGGTARTSLVVTIGPSPRHRGETTSTIMFGQRAMKVQNMVKLKEEFDYKSLCRRLDIELDKLIAENERQRKYFDDEIERITAEAQYRVAEAEKECKVSLENEKMKYHQEYLDSIKILEEKWKVHQQSPKKQIKEESTSNGDVQDLLQNEKMLRQSAEDESNDLKNQLSHWK

SEQ ID NO: 111322 - protein, 140 aa, Triticum aestivum
  unsure (1)..(140): unsure at all Xaa locations
  Clone ID: PAT_TA_5740.pep
MLAARRHAASTSGPLLLRRLSAQPKPKAPAPSPPPPPPSDEGAAAWARRAAALSLLGLTGAVAASAFSDLSVFLSCSSQAMEKATKNKQVASAIGEPITRGPWYSASIAVNRARRSVSCTFPVSGPQGDGLLKFKAXRLX

SEQ ID NO: 111323 - protein, 100 aa, Triticum aestivum
  unsure (1)..(100): unsure at all Xaa locations
  Clone ID: PAT_TA_5741.pep
RAGLRRSEPGTPXAECAGGRSSAEHIGVSLEGENRALEMSSTVPKSSNIFWHDCPVGKTDRQNLLEQKGCVCLDYRLSGQSKSTXACTLXREXHTRXNYF

SEQ ID NO: 111324 - protein, 184 aa, Triticum aestivum
  Clone ID: PAT_TA_5742.pep
MEAAGPQTQPPPPPPRGLQEMEAAGPPTQPPAPHPSSAPPSFLLGKWRGEGEGTFPSIAPFRYGEEILFSHHPSKPVISYTQRTWKAASGDPMHAESGYWRPRPDGSVEVVIAQSTGLTEVQTGSYDSEKKTVTLQSELIGNAAKVKQITRAFQVVDGELSYVVQMATITNSLQPHLKALLKRI

SEQ ID NO: 111325 - protein, 162 aa, Triticum aestivum
  unsure (1)..(162): unsure at all Xaa locations
  Clone ID: PAT_TA_5743.pep
MALVPHGGGAGGSATMAMPMLTADNYTVWAIKAQAILDVHTVWEAVAPGDAAVNARKDKMARALLLXRLPEDVLLQVSTKXTAREVWDSLKVRFVGPPRLLPAGRAPPRGASGRMGGPDGAVLGGGPGRLAAMAARYANLGETLGDAALVKKLLDXXPDXXX

SEQ ID NO: 111326 - protein, 167 aa, Triticum aestivum
  Clone ID: PAT_TA_5744.pep
PPEEEAPQSPRPATMTAVRCAARRLGGSLLQRKQAAEGCRLVRSRFMRSRQLSSECAREIQNKKVELRNLVSKAMQKRAELHDVLLKNSDAIGEPEMRLLQHFSVPKAASEPRVPPRTSMGFATRIKCYLEAAVNAAVFAAVTAYVFGVKGDRGVQAQAATKEEKAQ

SEQ ID NO: 111327 - protein, 224 aa, Triticum aestivum
  unsure (1)..(224): unsure at all Xaa locations
  Clone ID: PAT_TA_5745.pep
DPAHGAPAEASSEGKAAAPEPAMAEGGPGGGRRRPTLCGKHCALVESQRRTHIAVERNRRPQMTVYLAPRRSLLPPAYAPRGDQASXIVGGAINYXKELEQLLQSLEVQKSVKNRTGRSPFASSFTFPQYSTSCNATQATASDGGSGADSSGLKSEAGVADIEVTMVEGHASLKVLSRRRPRQLLRLLAGLQHLRIPPLHLIVTTVDAMVLYSFSLKVINLLLK

SEQ ID NO: 111328 - protein, 276 aa, Triticum aestivum
  Clone ID: PAT_TA_5746.pep
MAAAAGSSAAPLPAPISLNDKAAAVGGGVGGDRAAGGCGVCAICLDRIPLQETALVKGCDHAYCVTCILRWASYKQTPVCPQCKHPFEFLSVHRSLDGCLHDYMFDESVCLLLRATWFKPLVVEAHEEAQEEEDIYRSYQYDDGDEDDLYEEYISRSPSIRIGNRRWGDNGYVRGGRREAQPGPPASHAVPSRTPKKKEGSASGSGSGSVSKDVAGRRARRAQKREAADKAAAEKHLKLLQRLGRGKTPEAPPEAPPESLEVGPPAPLEVGPPVIG

SEQ ID NO: 111329 - protein, 91 aa, Triticum aestivum
  Clone ID: PAT_TA_5747.pep
NLDLVGSYLIHHDPEPVITEHLGGALGYALGFLLFREERRWRLETASVEPLMFYLLSIDSSSSVMLLYTLGSAKLHKLLLLPTGISSVFFI

SEQ ID NO: 111330 - protein, 166 aa, Triticum aestivum
  Clone ID: PAT_TA_5748.pep
MASGEAAMQTFVLRVTIHCHGCKKKVRKVLKSIEGVQDVKVDAQLHKVMVTGTVDAETLIKRLHKSGKQALPWQHTPAKNPDPAPPTPADAPAPAEDGSKDAAVADKKPAEEPQADSSDKRPEQETASEKKKPETEKEAESEKKAGKEEEAKPRSSDEKKKDGGEG

SEQ ID NO: 111331 - protein, 164 aa, Triticum aestivum
  Clone ID: PAT_TA_5749.pep
DAWADAWARPRRRINRASPEDADRSLSPAPAHAPMHARHEFNPYGAPQPVMSYNMAHPRASVSHYAPRPEQGYSLQQQQAGYSSSSMMQHPPAPAQQAYSQQAQPMQQWSPSYLYMPYPHASPESYYQDYYSPPGTHAAPPPLPPLQDSYRLFDDENPNSCSVM

SEQ ID NO: 111332 - protein, 184 aa, Triticum aestivum
  Clone ID: PAT_TA_5750.pep
MDLQTFVLRVTIHCHGCKKKVRKVLKSVEGVQDVKVDAQLHKVMVTGTVDAETLIKRLHKSGKQALPWQHTPAKNPDPAPPAPADAPAPAGDGSKDAAVADKKPAEPVKEPQADSSDKKPEQETAPEKKPEAEKEAESEKKADKEEEAKPSDEAKQDGGEGEPKAKGAEPASEPAAAAKEAGGN

SEQ ID NO: 111333 - protein, 283 aa, Triticum aestivum
  unsure (1)..(283): unsure at all Xaa locations
  Clone ID: PAT_TA_5751.pep
MPAQPCQHAPPWQHAPAPAPDRGPPPAGRGRPPACRRSTTSTAADKRRTRRPPARRTSRRRRRPPARKLKRPKKQNLRRRLTKSRKEQEAKPRSSAEEKGHRGQGPTAEAPAERTVLPSEPAAAASQREDEAGPRKRIQPRPKRPHRSLPPAPAPDQVHAPQPVMSYHVAQPRASVSHHAPQPEQGYSXAAAGPGYLLPPPSMMVTQHPPPPAPSQAYSQQAQPMQQWSPSYLYMPYPHASPESYYQDYYSPPGTHASPPPPPPLQDSYRLFDDENPNSCSVM

SEQ ID NO: 111334 - protein, 115 aa, Triticum aestivum
  unsure (1)..(115): unsure at all Xaa locations
  Clone ID: PAT_TA_5752.pep
TIIIVLFSTIVFGLLTKPLIRLLTPARHLTREVSALSEPSEXKSLLEQRASXNGPXTDLENAVSIRRPTSLRMRLASPTRSVHHYWRKCDNAFMRPVFGGRGFVPFVXGSPTESS

SEQ ID NO: 111335 - protein, 57 aa, Triticum aestivum
  unsure (1)..(57): unsure at all Xaa locations
  Clone ID: PAT_TA_5753.pep
LSSALQQLARLRHRRDHQLXQAGCNLCVPPTKDDGRXFPVNDNSXLMRRLGLPWMSX

SEQ ID NO: 111336 - protein, 82 aa, Triticum aestivum
  unsure (1)..(82): unsure at all Xaa locations
  Clone ID: PAT_TA_5754.pep
NDASDXYTTIGELADVHAPXHARRDSXXAPPGRQGQGYAALSGYTRXNYKEKKTIFCCELKQVDYTIFSTMYELNTRAKCSP

SEQ ID NO: 111337 - protein, 158 aa, Triticum aestivum
  unsure (1)..(158): unsure at all Xaa locations
  Clone ID: PAT_TA_5755.pep
XICLGFAGSFLLAGVCLFSWLPGRAARSCFAGFLAGTQAFLRAMASGARRELFSIGAMNNDRDLRSTPSPASKMKRSVTVRPKAVLSAVLAEAGLPEVKYKTCASYRGRVAATPSQSRSSAAAEHMRINGDQLWMPMGHAKCCSSVLGSIFKPTWILN

SEQ ID NO: 111338 - protein, 319 aa, Triticum aestivum
  Clone ID: PAT_TA_5756.pep
QLAESLRRLSTCTDLDLSSNELTGNVPTWVGEMVSLETLDLSGNKFSGEIPGSIGGLMSLRELRLSGNGFTGGLPESIGGCRSLVHVDVSWNSLTGSLPTWVFASGVRWVSVSYNTFSGEVMVPVNGSSVIQGVDLSSNSFSGRIPSELSQLLTLQSLNMSWNSLSGSVPASIVEMKSLELLDLSANRLNGSIPSTIGGRSFKVLSLAKNSLTGEIPPQIGDCSALTSLDLSHNGLTGAIPATIANLTNLQTADLSRNKLMGGLPKQLSNLAHLVRFNISHNQLSGDLPPGSFFDTISVSSVSDNPGLCGAKLNSSCPG

SEQ ID NO: 111339 - protein, 97 aa, Triticum aestivum
  Clone ID: PAT_TA_5757.pep
KDSATQPKVKYFTQVKARPPTFVTFMSGKTELSDTDIRFLTRSLKEDFDIGGIPIRILQRSIPRKVSSFKSNIKKRGSSIKRMKTDKRTEVSDPTQS

SEQ ID NO: 111340 - protein, 342 aa, Triticum aestivum
  unsure (1)..(342): unsure at all Xaa locations
  Clone ID: PAT_TA_5758.pep
RPRVRVRISIADESGREKCPPSFYYMPTNAVSQNARVRMFLAKIGSEDCCPECFGNCLSAPAPCACARETGGEYAYTLDGLVKPAFIDECVSMNRFPEEHHRVYCKTCPLERSRNKASXKPCGGHLVRKFIXKECWSKCGCNMQCGNRVVQRGIRCNLQVSFTEEGRGXGLSKLDDLPKGTFVCEYAGEILTHTELHERAIQNMQNARYTHPILLDAGWCSGGEPKDEEALCLDGTFYGNVGRFINHRCCDANLAMIPVEVETPDHQYYHVAFFTSKKVEAFEELTWDYGIDFDDERQPMKPFECLCGSRYCRGGRRHLLRKERRRSRVTGTAGRAEVLEGC

SEQ ID NO: 111341 - protein, 187 aa, Triticum aestivum
  Clone ID: PAT_TA_5759.pep
SFMNGASVDKASLDDDDGSAPRQTTVSAGELRELVKMREVGHPITIYDSPASTVTAASSSSGELRQGRFPIPVSTRSDSAHWPRVSIYKGHPFVRNHSSESGKLINLPATMEGFKTIIGEKLKVDAEKALILNGEGAEIDSLDVIRDNDKLFIVTEEHMRMLASMDSSVALSHTSSVGSAVSAAHAI

SEQ ID NO: 111342 - protein, 315 aa, Triticum aestivum
  unsure (1)..(315): unsure at all Xaa locations
  Clone ID: PAT_TA_5760.pep
MVNLVEAQKPLLHFLIRRAGLRQHTVDVDGAGTVLTFWVPKDKLPKDKSTVSRARRKPRPPRPSVVLVHGFAAEGIVTWQFQAGVLAKHYDVYIPDLLYFGGSTSPSTDRSPGFQAECLVARCLGVERCTVVGFSYGGMVAFKMAESHPGLVRSLVVSGSVVAMTDSISETTLERIGVKSSAELLLPDSVXKGLKALLSIVAHRKLWFPERLHRDYLQVMFTNRKERAELLEGLVVSNKDATVPVLPQKILLLWGHNDNIFNIELARTMKEQLGEETMLQSIDKAGHLVHLERPCVYNRRLLEFLAYVTAEASKE

SEQ ID NO: 111343 - protein, 111 aa, Triticum aestivum
  Clone ID: PAT_TA_5761.pep
NYRRSHFSKARPLDNIDIPGDEEGRADHPHVHAHGHSHGDAIVVSSPEEAAIADTIRHRVVSQVLELGILVHSVIIGVSLGASVRPSTIKPLVGALSFHQFFEGIGLGGCI

SEQ ID NO: 111344 - protein, 73 aa, Triticum aestivum
  unsure (1)..(73): unsure at all Xaa locations
  Clone ID: PAT_TA_5762.pep
TGLVSXLDPVGLLAYLXMTCCTPTPVSSHTNCKTNQHQQIISKTXVIQTGLETAKLRWPLQFLSSFHAVIPIG

SEQ ID NO: 111345 - protein, 193 aa, Triticum aestivum
  Clone ID: PAT_TA_5763.pep
MSVELLTKFLTVLFGYAMPALECFKAVEQRTGRTDQLRFWCQYWIILVILVIFDEIAGALISRIPMYYEVKLAFLVYLWYPQTRGSDIVYENFVRPLVMQYEPNIEERLRYLRANAGDLIVFYLKNFTDRGYELFLRVLDFARSQASSGSRTRRFFSFRGDRAERPSFVDDDYVHGSDRRSAARQRRPRGADY

SEQ ID NO: 111346 - protein, 222 aa, Triticum aestivum
  Clone ID: PAT_TA_5764.pep
KDHPALDSGLLAHKSDINSFGTVILQLLTGKQPGSPGLASEVRRALSCGKLSSILDPTAGEWPMEAARRLAEFGLECIGDRPELTPDTVRELEQLHLIRGRQVPSFFLCPILKETMDDPQVAVDGVTYEGRAIREWIEDGRAVADLKLKHLDLTPNHALRFRHSRLGLSASVVNDDDDDDGDLRTVVFNLQLTSRYRASLCTIHLLPLLVQCAAGLNVGKCK

SEQ ID NO: 111347 - protein, 172 aa, Triticum aestivum
  unsure (1)..(172): unsure at all Xaa locations
  Clone ID: PAT_TA_5765.pep
IPTRPHNLTYSGHLSGDHRPTSPPDPSDGDNGRRRPAAGGASRRAASRCPVKAGLQFPVGRVARHLKVGRYAKRVGAGAPVYLCAVLEYLTXAAEALELAGNARDENKKTPDLXPRHIQLAVRNDEELSRLLGXAVTIAAGGVLPNIHSVLLPKKAGKGAGTGGSASQSQEF

SEQ ID NO: 111348 - protein, 303 aa, Triticum aestivum
  unsure (1)..(303): unsure at all Xaa locations
  Clone ID: PAT_TA_5766.pep
XIYMGGGERCKRMNHYIWGFLCALGEAQFLNRTLVMDFNVCLNSRYTASGKDGEEDYRLYFDFEHLKESASVIDQSQFWTDWGKWHKKDRLKNHYTEDXKVTPMKLRDVKDTLIMRKFGHVEPDNYWSRVCEGETEAMIKRPWHFLWKSGRLMEIVSAIASRMSWDFDSMHVVRGEKAQNTQLWPNLDADTSPENLLTTLNDKVGAGRYLYIATDESDKSFFDPLKNKYKTRFLDDFKDLWDENSEWYAETKELNNGKPVEFDGYMRVAVDTEVFLRGKRKLETFNDLTRDCKDGVNTCAAAS

SEQ ID NO: 111349 - protein, 53 aa, Triticum aestivum
  Clone ID: PAT_TA_5767.pep
SPLRIVPFQHSSTQWSTYIPGCFQTDIIFVSLGLHLAISELEYSEHVLGKCLF

SEQ ID NO: 111350 - protein, 142 aa, Triticum aestivum
  Clone ID: PAT_TA_5768.pep
MPPRRDPGFTFPPELTQLIQQQNTLMQLLVQNQNQGNNNNNNPPPPPPVDHLARFLRLNPPVFSSSTEPIVADDWLRKTARELTTAGCTDAEKVKFAAHQLEGPATSWWENFTATFPVDTVPWDQFQQAFRTAHVSAGAMAM

SEQ ID NO: 111351 - protein, 176 aa, Triticum aestivum
  Clone ID: PAT_TA_5769.pep
RLNCIRALPEGLENLVNLEVLNVSQNFHFLRELPYGLGLLTSLRELDISYNSISVLPDSMGCLAKLNKFSAVGNPLVCPPMDIVEQSLDAMRTYLSSRMNGTGVNAKKKKGWLPRMVKYNTFSGRMTPGRKSAHDNSEGFSMSDYHSLNGSASPGFLSMLSPRRLFSPRRDSPKHH

SEQ ID NO: 111352 - protein, 97 aa, Triticum aestivum
  Clone ID: PAT_TA_5770.pep
HDDSLHHLPVLLKVLPEAVLVGVPRDATDEQLPGVRLHLRLRLLLPTRNARLQEPIESAGIGHQNGAEFGAAGRRESGEFKGRAHRLIQGRGLELAA

SEQ ID NO: 111353 - protein, 485 aa, Triticum aestivum
  unsure (1)..(485): unsure at all Xaa locations
  Clone ID: PAT_TA_5771.pep
STEIIEKPNAQEATESSEETQNSTNDTRLEKRTVANAEPDHDHTMDNQSSNAYAIPDKPNGDVSSSSGGIFKYLGGPKPGDAEYNLCSAIHCYGAAKGAMFTFPVRSAEFSTILKKRGWAFNELGRIRLESKNLSRADIAFADAICAFQEVSDHPNVILINCNLAHGRRALAEKLASRIEEFQMYDLPEGSYMPSXSSAKSEYFQAIXNYYTAAXKRQLKYAIADNEVDKSLYNEVYTQYAHTHLRLGMLLARESFLTGSYEGGLVDESSNRTVLEISASDAFREALSTYESLGELRKQEAAFGHFQLGCYXRDLCLKFLDLVTKEVKQKNEDKFRKKAKWYGSLAEKNWQKALEFYGPKTHPTMFLNILMAQSALSTSIFDSFHSSAMLEAALMHLLEGRHVVEANEEYSNDVNLDIKPKFWSQLQSLLKSMLRNLDTSRPAASAAGQANGGGRGDAAKLKEMYRLSLKSSSLGQLHALHKLWV

SEQ ID NO: 111354 - protein, 165 aa, Triticum aestivum
  unsure (1)..(165): unsure at all Xaa locations
  Clone ID: PAT_TA_5772.pep
HLEKGHTIFYIDLGTRPTTHRKAAGGSTDSTMGGWFSFPGNDGRAIPREWAVAAGLDATPFNMRRLKNVGRPGPRTPEEFDAYHIRNLARWALRHYNSSHPGAEFRCPDQPTTEAKAACVGFREDLWYHLNFLACLKDDGDEQXSSADYLFRCSNTIIHPKHAPS

SEQ ID NO: 111355 - protein, 273 aa, Triticum aestivum
  unsure (1)..(273): unsure at all Xaa locations
  Clone ID: PAT_TA_5773.pep
MKPPALLSLPRSSSPSVSPSPLCPGRRSAAVQRHRPSIPSKPAAGICYASQAVELLPSLYPGTGVVVRDAKLEDCWEVADTHCSSFFPGYKFPLDLVLRLDRYIALLSGFSVPPGCTRSCLVAVNPTAANSAISIECGDLRDAEFHGKYGLSKGSVAGILTVDTVAGFLPRRGRLKQRRTXGIASLANVAVRKEERRXKGLAKMIVAEAEERARSGGIRSAAWRCDGRTPSEVGLCMKQRRKSIRVPEDAXWPAPKIDQXVRYEFMMKLVPKS

SEQ ID NO: 111356 - protein, 104 aa, Triticum aestivum
  unsure (1)..(104): unsure at all Xaa locations
  Clone ID: PAT_TA_5774.pep
XMXRMKLLWGDAVEEFRPERWLDDDGVFVPXSPYKFTAFQAGPRICLGKEFAYRQMKIFAAVLLYLFKFEMWERDSXVGYRPMLTLKMVGPLYVRASPRPSTGN

SEQ ID NO: 111357 - protein, 94 aa, Triticum aestivum
  unsure (1)..(94): unsure at all Xaa locations
  Clone ID: PAT_TA_5775.pep
RFPQLXXTHYSPTKVCAMXTCMHACVYVRIIWTKNSRETVTQNAASSISCRRRSGRPARPVRLVTFVSTETRRRVVLYSHFLGSVMLIFQCSSA

SEQ ID NO: 111358 - protein, 119 aa, Triticum aestivum
  unsure (1)..(119): unsure at all Xaa locations
  Clone ID: PAT_TA_5776.pep
LSGREDGTRKQVQGVLTWRELAPSERPTKSGAMGSXLVAKNDDHVPFSNSKLTYLLQPCLGGDSKTLMFVNVSPEASSPGESLCSLRFASRVNACEIGVARRQTQSKSSSDNGSRLGYG

SEQ ID NO: 111359 - protein, 48 aa, Triticum aestivum
  Clone ID: PAT_TA_5777.pep
NYPKKYVQVGDQKVFSSEKLRRLGWKFRTLEETLKDSVESYMAAGILN

SEQ ID NO: 111360 - protein, 259 aa, Triticum aestivum
  unsure (1)..(259): unsure at all Xaa locations
  Clone ID: PAT_TA_5778.pep
NYNGQPIPSAALKAIVKHLDLAPEAVEEAAIDSGRLTGLVFVSERQTPPPRLLRXGLRFEXGDEVRVLNLWGTSNGXATFSVGARLEDSGCIAGGYEVDGHTADHYLVFVSTKEPVQERRSPWNVVYKTNLRTGETERLTPPGTSDLSPSVSPSGKRIAVASFQGKKWDGEVKDLLTSIYVMDLESTYLERERVIENAGWPSWGSETVLFSHKMVGDNWGVFPVHFYTGETSXLPREXPIXTPAAPIKQICWNRLFRTE

SEQ ID NO: 111361 - protein, 132 aa, Triticum aestivum
  unsure (1)..(132): unsure at all Xaa locations
  Clone ID: PAT_TA_5779.pep
EGLICDEMLTALLTWAPPPDCTTAXHRTARHMPNTVRAHPQWTASTHCKIYPMEASELHCTQITSVFLKNIGNYSKQQQYWDGMHMVSCMASRLRTARRWWRGGRQPKRRGAGRAAGAARPPRPRSSGGRGG

SEQ ID NO: 111362 - protein, 190 aa, Triticum aestivum
  Clone ID: PAT_TA_5780.pep
MYDSCPDDRVDEFRRKMIFGALPMLDDESGLNILSILIGSKLPVSASMRPELVDIDGVSYRLQREIQLLKAFNLVRCRNCLALIARRSDMVIPSSVDQCGPQVMPLLYKGAQEVITVHNTSGLALHGNPSDAHSWFPGYTWTIALCAACESNIGWLFRADKRNLLPKSFWGVRISQTKDGTQSAKDRSSV

SEQ ID NO: 111363 - protein, 446 aa, Triticum aestivum
  unsure (1)..(446): unsure at all Xaa locations
  Clone ID: PAT_TA_5781.pep
FRPRPLDIHKKLPILKSARDFEDDDPTVAAFAAARVGVLLRHSGSDLTAAAAATDGEGNSTPSKKNAQEIPTPQFDDVETYDRDYTRTFAQPSCYIRGRGARAEIGEFVEYDLDNEDEDWLDDYNNERKNLNPEKLEVLLFKLEILDHKARERAGAITPTFIGPVPVLLQLDVAMEALQYLSVRYAVFQAVYNYWRAKRERWQKPILRRLQPPPPVNDTNPYNVFRPREKAHRLHTRRMQRRENNIQSFEKLRLVRRNLDQAKALMGALIKREETKREARECEGNLQRVQMQYKHEAQLVDDGTTLSGFQQASSRFGSSDDDYADSDDTATEEPYFRQPVLHHRYPDNKQSAIPTLRIKREPGLPVLKRRPQQNGWVFKRDPEEPVLLFTRPLDPDKLVAAXIKLPPXDPPIEIDATVPXFPXXXXIARXGXXIXXXWFHSFLLLI

SEQ ID NO: 111364 - protein, 219 aa, Triticum aestivum
  unsure (1)..(219): unsure at all Xaa locations
  Clone ID: PAT_TA_5782.pep
AWSRPRSLMHGSSYQRKLAILKGGATKLLDKPKRRTPAVSGRGAAHGKAQRSXSMSTSPECHRVRGRSPAFAALTSAFEKPSTRNLSTPPPAVKKLFPKSTGPDTSKEAAISELTSSLEGPLKRTIPKSVKASQEAGKAIQEEDGAGDDEPEDDEGRTVFPYERLVTTSEDPALDIDITQREIYLSTAEFREKLGMKRTAFYKLPKWKQNKLKSAVQLF

SEQ ID NO: 111365 - protein, 249 aa, Triticum aestivum
  Clone ID: PAT_TA_5783.pep
RVCALAAEWRQTFHSDVVVDLICYRRFGHNEIDEPSFTQPKMYQVIKNHPSSLKLYEQKLLETGEVTKEDVQRIHDKVNRILNEEFAKSKDYVPNKRDWLSAYWTGFKSPEQISRVRNTGVKPEVLKRVGQAITTLPESFKPHRAVKKIFEQRAAMIESGEGIDWAVAEALAFAALIVEGNHVRLSGQDVERGTFSHRHSVVHDQETGAKYCPLDHVVMNQNEELFTVSNSSLSEFAVLGFELGYSMEN

SEQ ID NO: 111366 - protein, 259 aa, Triticum aestivum
  Clone ID: PAT_TA_5784.pep
GRTLSNLASDGSLRIQNAEIQNKQENAEEVGAWNCQGLKNSRGILDSSANSLSETGKSSGTPNTYQPDILSRSIGSSKRTSIICYVRRKRKQKRKRESQSVGSFARAPCERLRPRTKRAVIEEPAEQIETAKPSAAATKGKRSKVVELFQWEIDFCDMTFESRADLRAHERNICTDESCGKRFQSHKYLKRHQCVHRDERPFKCPWEGCGMTFKWLWAQTEHIRVHTGERPYECSVADCGQTFRYVSDYSRHRRKFNHY

SEQ ID NO: 111367 - protein, 226 aa, Triticum aestivum
  unsure (1)..(226): unsure at all Xaa locations
  Clone ID: PAT_TA_5785.pep
RPTRPRKVVGVVKNPKRRFRFTANLGKRSEAAAMKRTNQEKLRVAVLVSKAALQFIHGLAPQSEYTVPAAVKAAGYGICAEELSSVVESHDIKKLKAHGGTEGLLSKVSTSESDGVSTSKDKLASRQEIFGINKFAETEARSFWVFVWEALHDMTLMILAACAFFSPVVGIATEGWPKGAHDGLGIVASILLVVFVTATSDYRQXXXFKDLDKEKKKITVQVTRSG

SEQ ID NO: 111368 - protein, 140 aa, Triticum aestivum
  unsure (1)..(140): unsure at all Xaa locations
  Clone ID: PAT_TA_5786.pep
RVSTSFAAASSGAAGRKPKWGTTSLPGTLPAFRMHRGASAFTTHGCSIRLLHQMPLARESSPRQAIARDVNLHSPRTGXTCSLSLGHRSRLCFWHDWWISRRTSPRRLLPHPPCCQLSDQAPEDLSHILLQRSFSREGLV

SEQ ID NO: 111369 - protein, 72 aa, Triticum aestivum
  unsure (1)..(72): unsure at all Xaa locations
  Clone ID: PAT_TA_5787.pep
SIDPIKGVCLSXXITLDXPEVMMHPQLLPPXHXXLXTFCAAPRRPLRXHPPTSSPASSPPVLSPLLVTVPAR

SEQ ID NO: 111370 - protein, 91 aa, Triticum aestivum
  Clone ID: PAT_TA_5788.pep
TTAWQTNLTSTRSLSPSLRIFRTCRIRYSASATEKALEGHPELIRQFNRFLPNNCQITVREEGGSTPMSSRENISAVAGLVKLKEGGSPRV

SEQ ID NO: 111371 - protein, 101 aa, Triticum aestivum
  Clone ID: PAT_TA_5789.pep
MRRPLGACGSRSSPAAAFLLAAAAICAQFATGLADDASKDESKGHTGQTVLFVLLGIGAAGLLSFFLFKYWQKKKREEQHARLLKLFEEDDDIEVELGLRD

SEQ ID NO: 111372 - protein, 101 aa, Triticum aestivum
  Clone ID: PAT_TA_5790.pep
MRRPLGACGSRSSPAAAFLLVAAAICAQFATGLADDASKDESKGHTGQTVLFVLLGIGAAGLLSFFLFKYWQKKKREEQHARLLKLFEEDDDIEVELGLRD

SEQ ID NO: 111373 - protein, 132 aa, Triticum aestivum
  unsure (1)..(132): unsure at all Xaa locations
  Clone ID: PAT_TA_5791.pep
TVGNTWTLSPWQISFCSSFVDHKLQSWMHPSELATQKXRVLRAPQLEKQEEHQDDLTSEAVPQKYCRDLISLMFFSRDYSLYYGLVDSPTPQHTFEGTIRIQGHFCKLRILXVPLPCHTRSCGARLLAYXAL

SEQ ID NO: 111374 - protein, 54 aa, Triticum aestivum
  unsure (1)..(54): unsure at all Xaa locations
  Clone ID: PAT_TA_5792.pep
TDGFSGREIAXXMASVQAAVYGSTECELTPGLFREVVDYKVAEHQQRRKIAGHA

SEQ ID NO: 111375 - protein, 190 aa, Triticum aestivum
  Clone ID: PAT_TA_5793.pep
LKALPTVCNPLDPRSSMCESDVVAPIVPSVPLYISPFLCYHNTFLVTPSLNNYIHLRVPGYVIGGSCLTFVLSLLTTAFAFGPCLVVGVFLLITRVRAFCSFFFAVLLGSLFFFVSFLPDFCLVLCLLVRTSTLFICITPTLYSPWTINPPSVVDPGDVVGQPENTCQLLDATTIVVVLIMFLFLRHGLT

SEQ ID NO: 111376 - protein, 216 aa, Triticum aestivum
  Clone ID: PAT_TA_5794.pep
MSEEAPGSSYDVLEEQLKIQDAVSEARRARLIAESEGVAAVVEEESDASDYSKAVDEGASEAAPGSSNGEEISQDLGTPSEPAELREQDVESEEPEENHGSGKEEGKEPPHLGLESDSSLSPSYLDRISKPAAAAGVAIVVVILSAGIAALSMRKKQAQVATSANAPDEQEQAEEAETRSGSASSEGHRLAKGPEAEETERFGDSGFSQYSSSLSS

SEQ ID NO: 111377 - protein, 155 aa, Triticum aestivum
  Clone ID: PAT_TA_5795.pep
MDASATVAAGKAKKGAAGRKAGGPRKKSVARSVKAGLQFPVGRIGRFLKKGRYAQRVGSGAPVYLAAVLEYLAAELLELAGNAAKDNKKSRIIPRHLLLAVRNDQELGRLLAGVTIAHGGVIPNINPVLLPKKTAEKSPKEPKSPKKTAKSPKKA

SEQ ID NO: 111378 - protein, 557 aa, Triticum aestivum
  Clone ID: PAT_TA_5796.pep
MSSMMQPQIILLKEGTDTSQGRAQVVSNISACTAVADTVRTTLGPRGMDKLIHDDKGTTISNDGATIMRLLDIVHPAAKILVDIAKSQDSEVGDGTTTVVLLAAEFMKEAKPYVEDGVHCHNIIRSYRSAGNMAIERVKELAVSIEGKSLEEKKSLLAKCAATTLSSKLISGEKEFFASMVVDAVLAIGHDDRLNLIGIKKVPGGTMRDSFLVNGVAFKKTFSYAGFEQQPKKFLNPKILLLNIELELKSEKENAEIRLSDPLQYQSIVDAEWNIIYDKLDKCVQSGAKIVLSRLAIGDLATQYFADRDIFCAGRVTEEDLQRLSSATGGTVQTSVNNVIDEVLGTCEIFEEKQVGNERFNIFSGCPSGQTATIVLRGGADQFIEEAERSLHDAIMIVRRAVRNSTVVPGGGAIDMEISKHLRLHARSIAGKSQVFVNSFAKALEVIPRQLCDNAGFDATDVLNKLRQKHAADGGANYGVDINTGGIADSFANFVWEPAVVKINAINAATEAACLILSVDETVKNPKSESAQGDAAAMGGRGGGGMRGRGGRGMRRR

SEQ ID NO: 111379 - protein, 108 aa, Triticum aestivum
  Clone ID: PAT_TA_5797.pep
KKKLILRIHGDGGGRRPEAIDSSSGQIRSTGFPCRILAAASPILDAEATQTLVRTTAQSRIGDVGAAVVTLQLDLNITCEGLSLSAPNSEESIGKDGPQAPGWTKRSE

SEQ ID NO: 111380 - protein, 253 aa, Triticum aestivum
  Clone ID: PAT_TA_5798.pep
MAAEDQIPRAQANPEKTKKRKKPKKDKWGQPIAAAADEPAVEQVQEQEAPEEPAATAAAGAEGVGEGAESYERGKVVASGMPYTTTEEEIRELFDQFGPIRSLQLSRFPDSGNFRGLAFVTFESDEVAMKSLELDGSKIGNRFMRVERCRVTASSKRQKKTEFQSDPEKPDGCLSAYVGNLSWNITEKDLRDFFKSSRIASIRFAIDNRTGDSRGFCHVDFEDDESLEKAVGMNQSELRGRPVKIAYAIINRA

SEQ ID NO: 111381 - protein, 80 aa, Triticum aestivum
  Clone ID: PAT_TA_5799.pep
TLPSDDNAITNKIMGWFLIGSLHTCMGKNMQNQLSGAPASFENTAKLNSPTCCPTYFLVNNIGKTTDTALKGAHLEVQIS

SEQ ID NO: 111382 - protein, 93 aa, Triticum aestivum
  Clone ID: PAT_TA_5800.pep
MPLYDCMLMVKPLVTKEAIAELVARVAARAYQRNGVVTELKSFGKVHLGYGIRKLDGRHFQGQLLQMTMMVSPFFTQELHYLNKEDRLLRWLV

SEQ ID NO: 111383 - protein, 153 aa, Triticum aestivum
  unsure (1)..(153): unsure at all Xaa locations
  Clone ID: PAT_TA_5801.pep
MPLYDCMLMVKPLVTKEAIAELVARVAARXAYQRNGVVTELKSFGKVXSGYGINEXFDGRHFQRXQLFEKWTMIVPPSCLSSTEWHYLNSKDGXRGLRWLVVKHRDAVYGLEFINEDDGRXEMDGFRRESNSTQDDEDVDEYDDDYDDDEYDD

SEQ ID NO: 111384 - protein, 229 aa, Triticum aestivum
  unsure (1)..(229): unsure at all Xaa locations
  Clone ID: PAT_TA_5802.pep
AMMSINCRMDPKIPRSEVLMVEATDGAGREEEAAVEPEHDGARHEDEEAEYEYEEVVESDDHGEDDDGVTYEYEEMETEDNGQDDEAAAVAGLNDADADAAEINASHQLSMVDVHPSQPDEEPGHTQPQLSDVEEDTEAGVARVDACLIEPVADNSGCSEVRGETEAPQSQPETGLQVRGEREALQSELGTELQVRNEMAVLQSEPETEIQVAAEIVXRRVNLKLNXKV

SEQ ID NO: 111385 - protein, 182 aa, Triticum aestivum
  Clone ID: PAT_TA_5803.pep
SLLVSTENEAFAATFTFDTVKSSWKQLGKWVLPFEGRGHFDPLLGAFVGLSKDPDTLGQLICCYMHTSDTGHTLELKLSKEKLFSEDPALRHIGATLVYMESQSKFCLVECVSIVDDSADQELKEEEDLPQSGCCLCCLTTFYLCHDMNGDPTTGRSCMVQYYEVPRATSMLFLQDPVAFWM

SEQ ID NO: 111386 - protein, 215 aa, Triticum aestivum
  Clone ID: PAT_TA_5804.pep
YYGQPPAGPQQGYPQQPDPYARPPYGGPGQWPTRGSAPAYGAYLAPPPASYAPPAQQPPAYGQTYPTGPDGYAQQGYSQQGGQGPAAYGQSAPAGPGYSQQGGYAQYPASQPAYGDQSAQNNANYGYQGAPADPSYGNAYPQSGYAAAPTTGQPGYGQAGYTQPPATNPPSYDQSAPPAAQSGYAAPAANPQPAVAKGVSPQPATAAGYGGQWTA

SEQ ID NO: 111387 - protein, 96 aa, Triticum aestivum
  Clone ID: PAT_TA_5805.pep
IPELNLWFGLSAGNPELPCAADLSPVLRGHEPKQRYVWRDPDLPEEWHPSSYGSSNITSFGSGRFCITNFYEDMNNCLMDRQSGPVGESIVVFSGL

SEQ ID NO: 111388 - protein, 77 aa, Triticum aestivum
  unsure (1)..(77): unsure at all Xaa locations
  Clone ID: PAT_TA_5806.pep
XVFHPNINSNGNFCLDILKDQWSPALTISKVLLSICSLLTDPNPDDPLVPEIAHMCKADRTRYESTARGWTHKYAMG

SEQ ID NO: 111389 - protein, 455 aa, Triticum aestivum
  unsure (1)..(455): unsure at all Xaa locations
  Clone ID: PAT_TA_5807.pep
MATTAAAAAAAAATASTRANSLSRIFSSSSPIVQPPKRNPKTKSAPKPKPTPKPPAADAVSIADEKPPKPLGAQPAAKGDSDGKHKLPKPLGLPARARGRHRVPDVAVSRLTSLGRQDGIKAIIEAQMPFLEASDEGFATRLIRLYXRASMPSHAAATFHELPTQHKSTMTFNALLAAYAEAGDFDGLTAAFQEIPATHPSVVPSVYSYNILIRSLCQKPDLSAALDVVLLMEKHGVSADIITFNTLLNGFCNNGPTDEAETVWEMMKERNLEPDAKCYNAKLRGLVAEGRTDDAAAVLERLEKDGPKPDTVSYNELIRGYLKAGRLQEAKKLYDDLGKNHCAANKGTYETLVPHLVQAGDLDCALRYCYEMFSSKRSSRVECGVLQDVVNALVDASRVEEAAKLVDIGRKKYYYSRKGLRMPGSAKGSELRAETDEEEAISEEKECEVEDETEK

SEQ ID NO: 111390 - protein, 251 aa, Triticum aestivum
  unsure (1)..(251): unsure at all Xaa locations
  Clone ID: PAT_TA_5808.pep
MSRRYDSRTTIFSPEGRXLYQVEYAMEAIGNAGSALGILAXDGVVLVGEKKVTSKLLQSSRSAEKMYKIDSHLACAVAGIMSDANILINTARLHAQRYALSYQEPIPVEQLVQSLCDTKQGYTQFGGLRPFGVSFLFAGWDKNHGFQLYMSDPSGNYGGWKAAAVGANSQAAQSMLKQDYKDGMTREEAVALALKVLSKTMDSTSLTADKLELAEVFVQPGTGEVQYQVCSPDAMGKLLAKAGLTQPAPEA

SEQ ID NO: 111391 - protein, 125 aa, Triticum aestivum
  unsure (1)..(125): unsure at all Xaa locations
  Clone ID: PAT_TA_5809.pep
AVQPKRGPQRKRRQKRDFQQXLVDDGXSSLTRRARGGRPRGGGPGQDAGGTGETGAAGGARGGRTRGSKRRKDQPATVEIEAEASPPTXKPDSVGLEADERGMVSWGRPAGRGRRPRSPAGGGLV

SEQ ID NO: 111392 - protein, 157 aa, Triticum aestivum
  Clone ID: PAT_TA_5810.pep
STTRARTRGQNVPESSNAKSWWRVSVASPKLRDRTLLSPKRGIFYCVLYLHPGDYHRVHSPVDWSIFKRRHFSGNLFLTNERAVRTIRNLYVENERVVLEGQWKEGFVAIAAVGATNVGSIKLLIVPDLMTNNPWCMALYSQSYDERVYNLRAPHDG

SEQ ID NO: 111393 - protein, 119 aa, Triticum aestivum
  Clone ID: PAT_TA_5811.pep
DAWADAWGPIDPDPNCLVSPVDGKVLRLGQLRGPGTMIEQVKGFSYPVSSLLGASSSLHDATEEDISGEPTEQNVPESSNAKSWWRVSVASPKLRDRTLLSPKRGIFYCVLSLHPVDYH

SEQ ID NO: 111394 - protein, 238 aa, Triticum aestivum
  unsure (1)..(238): unsure at all Xaa locations
  Clone ID: PAT_TA_5812.pep
MECVVQGIIETQHVEALEVLLQGLSGVPKERVRVHELCLKSVPMLGAVPSEVRLLCDLAQPTPSWTIRHVXGGAMRGAXGAEQISXLVRTIVESKASSHVLRYSYGIGYKLDRXILKAGFAFRFQRGAQFTVTVTSANKMPTHHRPDAGVRVRAGIQRVGKTAXPAAANKYTEVLPAVPPFRGYPSGAGRGVCEKGEVNLEASLLQRPPVAKATSKWWSETFGVACKCRPSEGMLVCT

SEQ ID NO: 111395 - protein, 167 aa, Triticum aestivum
  Clone ID: PAT_TA_5813.pep
MNNLYWLIQITLSCTMASAEDVKQRQVVEDRARNISHNVRCTECGSQSIEDSQADVAVLLRRLIRDEIKSGKSDKEIYKKLEEDFGETVLYAPKFDLQTAAIWLSPVIVGGVAAGVWAYQKHRQRTNVHIMALNLVRGVPLTPREKETMIDILTPPPPARRWWWPLK

SEQ ID NO: 111396 - protein, 125 aa, Triticum aestivum
  Clone ID: PAT_TA_5814.pep
TGNCGTLRAECGFVTLCSPGRPAAEVWKELWPTDRRRQREFFCFGMDVLLKLHLQGTRRFFNAFFDLEPHYWHGFLSSRLFLPELLMFGLSLFAHASNTSKLEIMAKGTVPLAKMVGNLIQDKDR

SEQ ID NO: 111397 - protein, 277 aa, Triticum aestivum
  Clone ID: PAT_TA_5815.pep
GIRHEAISSRADDVNDWVSTKKTAPSLPMERRERSSAFGSESQGRADDSTSWVSNKSYSAPPPPPSDGRRGGSVWGFNRDGRPGADSRARTRAEAGGGGGGRGAGAGVVLQKRTLPIAVATDGEKDEGVEEEKGEFQPKSWSCNPFGAARPREEVLAAKVENLTKEVYGQEEEKLVIQPKVRSWNPFGAARPREEVLAGRGAGRRDTAEKLEALKVGEVPERSRARGGGGTPVQGGEKENGDEGAGSRGRAWKQRTAVEAEVLSEQGSEATGGAPAN

SEQ ID NO: 111398 - protein, 130 aa, Triticum aestivum
  Clone ID: PAT_TA_5816.pep
RNKHIHASMVASMRPSSCCFCRCTHHGVLFLLLLYPPRNLAAAWRRPGRWPPASFEHPWRLGPHARVWSVSIHGCRRVRPHSMVDLEDSGGSGRRRRVDAAVDLGAASPHPSILNMGHSLPSPPLPWDIR

SEQ ID NO: 111399 - protein, 336 aa, Triticum aestivum
  unsure (1)..(336): unsure at all Xaa locations
  Clone ID: PAT_TA_5817.pep
LVSGDPTVQSLGNYEKAYVFKSKXWXCAAFLSNYHMNAAVKVRFNGRHYDLPAWSISILPDCKTAVFNTATVKEPKLLPKMHPVVWFAXQSYSXATNSLDGSAFTKNGLVEQLSMTWDKSDYLWYTTYVNIGANELAKNGQWPQLTIYSAGHSMQVFVNGKSYGSVYGGYNNPKLTYDGHVKMWQGSNKISILSSAVGLPNDGNHFERWNVGVLGPVTVSGLNSGKRDLSHQKWTYQVGLKGESLGLHTVAGSSSVEWGGPGNKQPLTWHKALFTAPVGSDPVALDMGSMGKGQMWVNGHHVGRYWSYKAPSGGCGRCSYAGTYRQDKCRSNCGEL

SEQ ID NO: 111400 - protein, 55 aa, Triticum aestivum
  Clone ID: PAT_TA_5818.pep
TQIQAAKFVHRGVIKIHNIAKIICASLIYDDKKYVRPYRNPIHLSNLNYHSTHIW

SEQ ID NO: 111401 - protein, 229 aa, Triticum aestivum
  Clone ID: PAT_TA_5819.pep
LQGLRLEDFAGSLLVEVEEGRMGVERVLREHLDIRKQLKVISHRFRRFIVAALLIGTASQFASVLLTARGDSIDDLLHTGELALCSVVLMSGLIIILSSAAKITHQAQALTGQTTKWHACCTIEPVPDDEINPGSNQNSMLEEYPEDESDCESSEETGDEDMLENTKFLQPHTHVISFQKRQALVTYLENNKAGITVFGFTLDRSYLHTIFMLEWTLFLWLLGKTVGFS

SEQ ID NO: 111402 - protein, 103 aa, Triticum aestivum
  Clone ID: PAT_TA_5820.pep
MSGRGRAGQGLGKGGAKRPRRVLRGNLQGGTQAAVARRARRGASKRISGLSSEESRGVLKSFPDTVTRHAVSKTDPARRKTFTAMDLVCALNGHGRTPSGFGR

SEQ ID NO: 111403 - protein, 63 aa, Triticum aestivum
  Clone ID: PAT_TA_5821.pep
MPREGILLAVHPPARAGANLIVCEQARRAQFHGYNLTFWSHLRFGVPSTIIVTAIGLIIVVSY

SEQ ID NO: 111404 - protein, 134 aa, Triticum aestivum
  Clone ID: PAT_TA_5822.pep
HEDPLTQILRRSTRLLGKGMAALEAWVGVETRASSSHSMDDDDADRMDDDECTAVWSFSTCFSPTRLRQIANSQSTAKKHVITKSSFGSLLNISSFSVPADMLDWIVMKIDTQKALFSHKKKSIVHERHGVQIF

SEQ ID NO: 111405 - protein, 84 aa, Triticum aestivum
  unsure (1)..(84): unsure at all Xaa locations
  Clone ID: PAT_TA_5823.pep
HRRRPSSIAAAPVHLRPPRPCPRVRNSDTAGDPQFDYGVDDPSFLPEQPDAGVQESGVIVDDKSYYTGGXXLLRAGRRRRPGVV

SEQ ID NO: 111406 - protein, 100 aa, Triticum aestivum
  Clone ID: PAT_TA_5824.pep
FLLSSKLTLTKGNKSWSSTAVAAALELVDPPGCRNSAPAAPRHLHPAPNGAVGLAPPVPPPTGATRSPPQPSPSPTAASHPRCWRTPCASVGPATTSSSR

SEQ ID NO: 111407 - protein, 387 aa, Triticum aestivum
  unsure (1)..(387): unsure at all Xaa locations
  Clone ID: PAT_TA_5825.pep
SSASTNREDEQCRTTHSGSSGNLSPEPVGTNVPLSEASSPGPSEYRVCKPIGAQDASTQTDDSERDVPSKRTCAAGIRTEDCTSDAEIQECHERSTQASPKVPLLVRESPQVCSSDASPGGRVETLESLIRAGASRRSSYNKVLEEEHLYGPMGVKLKPANLLMQLITCGSISVKDHRGFGLIPTYRPRFTQVEFPSPMFSTPMALRHLDNVPCSARTIGIRVSESEHLSSESLVEESKQEESGERRNXTLKRSSSYDEDRVYRAPDSRRDMESXAESGSFRCLPQTIKMISCKQSRSGTAFSPNSDVRYSSSQQERSTASSPLGSSRGASNRMTDPLGKLSSSRGESFHEEKDKMIKIEERLASGARVIIQSAPLCEESDDSIESL

SEQ ID NO: 111408 - protein, 268 aa, Triticum aestivum
  Clone ID: PAT_TA_5826.pep
MRRVRVSSHHSPVQKLGDSHMKLTPKFRLTAATTSSPSSSELEQPQPPWETPLIPGLPDDAALNCLLRLPVEAHGACRLVCRRWRHLLADKARFFTHRKAMGLRSPWLFTLAFHRCTGKIQWKVLDLDSLAWHAIPGMPCRDRACPRGFGCIAVPGEDGAHLLVCGGLVSDMDCPLHLVLRYDVCKNRWAVVPRMLSARSFFAGGVIDGRVYVAGGYSTDQFELNSAEVLDPVNGVWQPIASMGANMASSDSAVIGGRLYVTESCAWP

SEQ ID NO: 111409 - protein, 185 aa, Triticum aestivum
  Clone ID: PAT_TA_5827.pep
AGLLSLVGLDCIFNMGAMLFFLMADACGRPENNSFDLTRQIPTSYRLWNLVASILGFVAPLALLFASHRGALQPHLPFIPFLVLLGPYLLLLSVQMLTETLTWHWRSPVWLVAPVVYEGYRVLQLMRGLQLASEIAAPGWMVQSLRGLVTWWVLVLGIQLMRVAWFAGVSSASDPSYGSSDDVNR

SEQ ID NO: 111410 - protein, 120 aa, Triticum aestivum
  unsure (1)..(120): unsure at all Xaa locations
  Clone ID: PAT_TA_5828.pep
GSPLPPPPPSLPWPWPSGTPSPCPPWTWPCGSPPLAXPDHDEXPPPPAPAPPWPCRTPAPAPSPPGTGCREIPRSRWPSAWQTAFSRRPSPISPSGCGSGFGGLGISLSLSLAVRTRGRT

SEQ ID NO: 111411 - protein, 226 aa, Triticum aestivum
  Clone ID: PAT_TA_5829.pep
PHTHYQKAARGMDAVAVENALFAAPGATGFEGFPYLAFQAEEEQAGAFVGDRAAAEEEAALVRAKTEAAAGNPKAKVKAAQAAKATEAKAEEEAEDEAAKLTAKAEAETEAAIKATTKAAKEERMIETISKADSGGGSDADDVPYDKPCHDSDSEEDPDMIRSRIVGRWDLLIEEEKVRFPRLKFGGSCLPECTGDSYPGEYTGDDQEDSDDEQYYPRLLDEGILV

SEQ ID NO: 111412 - protein, 60 aa, Triticum aestivum
  Clone ID: PAT_TA_5830.pep
RCERTKAAWALPLRPYGFWTFDRFNSQLSWDPQISQAAGRRDPYDDLLARHAGPAPPSSS

SEQ ID NO: 111413 - protein, 108 aa, Triticum aestivum
  Clone ID: PAT_TA_5831.pep
FWRQASGSLRAPWAFIMEFAENLVLRLMEDPEQRDEAQRAHVYRMKERCERTKAAWALPLRPYGFWTFDRFNSQLSWDPQISQAAGRRDPYDDLLARHAGPATPSSSS

SEQ ID NO: 111414 - protein, 121 aa, Triticum aestivum
  Clone ID: PAT_TA_5832.pep
MEFIMEFAENLVLRLMEDPAQRDEAQRAHVYRMKERCERTKAAWALPLRPYGFWTFDRFNSQLSWGPPDQARPPARRDPYDRPPRPPRRPRHALLLLLKDRIPGITPVREVWLHRILRAQQ

SEQ ID NO: 111415 - protein, 213 aa, Triticum aestivum
  Clone ID: PAT_TA_5833.pep
MPAVASTPANLSTAVKDDESMSFPPRRPSPAVTEIGLGRGIARGLTSQALAAPISVGPAPGNGSITAIPPINDLSKRNIMNTDERVNSGGLPQQLVSPLGSKVQPQPVVKTNDAVSSDSSNTSESAVIGGRVFSPPVVPGAQWRPQAPAGFQNQSETGQFRGRPEVTDQREKYLQRLQQVQQQQGNLLSASHITGINQKQFPTQQPNSLLTTV

SEQ ID NO: 111416 - protein, 327 aa, Triticum aestivum
  unsure (1)..(327): unsure at all Xaa locations
  Clone ID: PAT_TA_5834.pep
RPDRXLALLDEYESEELGAALCANHRSGYVAVLGKPNVGKSTLINQIVGQKLSIVTDKPQTTRHRILGICSEPEYQIILYDTPGVIKKEMHKLDSMMMKNVQSAIGNADCVIVVADASKLPEKIDDMLEAGVGNKDTKVPVVLVLNKKDMIKPGEIAKKLEWYQKFTXDVDDVIPISAKFGHGVVDIKEWILSKLPLGPAYYPXKDIASEHPERFFVGEIVREKIFLQYRQEIPYACQVNVTSYKSRPSAKDFIQVEILVERESQRSIILGKDGKAIKTLATASRLDIEDFLQKKVYLEIDVKVKENWRQDERLLKRYGYGGEIQAL

SEQ ID NO: 111417 - protein, 161 aa, Triticum aestivum
  unsure (1)..(161): unsure at all Xaa locations
  Clone ID: PAT_TA_5835.pep
IGEARQMADGKNLEXARYKLADAQNALEDIVLNDGEKLVGMLRAELQQLLDLMETQELYEAEGRPYALASETSHGRQRYAARGGDMDAVRLFATPRMDTYLEQAKKFEEDPTAPLPSADDDAKEEMAANPLAAISAPIAFYIKVAIQALQEIEKLVAPPTK

SEQ ID NO: 111418 - protein, 524 aa, Triticum aestivum
  unsure (1)..(524): unsure at all Xaa locations
  Clone ID: PAT_TA_5836.pep
MAFNDDEKPPASNVGSTKGLVTISTPTYSKDAAALTADAVTAVVELNATSSTAVREGLDLVAVLDVEXSMQGDKLQSMKRAMQFVIMKLTPVDRLSVISFASSANRHCPLRSVTQQAQTDLKSIVDGLVANGGTNIKAGLDTALAVIAGRATTKARTPNIFLMSDGQQSDGDARQVDPGNVAVYTFGFGKDADHALLSDVAKKSPGGTFNSVPDGGNVSAPFSQLLGGLLTIVAQDVQLTLTPKAEDPSAPDLDTMTVAPGTDYTQTTDGDTGVITIKFGTLFSGETRKVAINLKLLESTLTTAYDGLVAEAQHSYTVQGSPQGQTPQDVVIPRSPDAPADPPTSGKAQAVLAEMARRQHAGAIGEARQMADGKNLEEARYKLADAQNALEDIVLNDGEKLVGMLRAELQQLLDLMETQELYEAEGRPYALASETSHGRQRYAARGGDMDAVRLFATPRMDTYLEQAKKFEEDPTAPLPSADDDAKEEMAANPLAAISAPIAFYIKVAIQALQEIEKLVAPPTK

SEQ ID NO: 111419 - protein, 92 aa, Triticum aestivum
  unsure (1)..(92): unsure at all Xaa locations
  Clone ID: PAT_TA_5837.pep
RXSPPGIXWCLRPLSPXXXXGWQPXXRPHHEARPSXVTMXXVXSPFLXPXHXXXTGVASXRPPXXPQVVNPHQRPQTLSPKQTHQGENARLM

SEQ ID NO: 111420 - protein, 60 aa, Triticum aestivum
  Clone ID: PAT_TA_5838.pep
LAGYLYLWHVCMHAFRPDGRVRFDVRYDLVVSFEFMVWLCTLVSSWASFDLSYCVVMNLV

SEQ ID NO: 111421 - protein, 52 aa, Triticum aestivum
  Clone ID: PAT_TA_5839.pep
WEYIKPKMCILFCEKKVCYHLKTHFKTKNVFSYSLIMPLTWNNKKQCTFDLL

SEQ ID NO: 111422 - protein, 442 aa, Triticum aestivum
  unsure (1)..(442): unsure at all Xaa locations
  Clone ID: PAT_TA_5840.pep
DNVIQRDKKLKLVLKLRNILVSHPDRVMSLRDLGRFRRDLGLTRKRRLIALLKRFPGVFEIVEEGVYSLRFRLTPAAERLYLDELYLRNESEGLAVAKLRKLLMMSLDRRILIEXIAHLKXDLGLPSNFHDSICLRYPQYFRVVRMDRGPAVELTEWDPELAVSAAEMAEEENRAREAEERNLIIDRPLRFNRVKLPKGLKVSRGEARRIEKFREMPYISPYADFSHLPSGSPEKEKHACGVVHEILSLTLEKRTLVDHLTHFREEFRFSQSLRGMLIRHPDMFYVSLKGDRDSVFLREAYKNSQLIEKSHLVLLKEKMRALVAVPRFPRRGGPRTGEETEGPKWAAQGYNEGSDMEDVEDDDFSDMEDLIGELGGKSDNSGYRWGDGWVGESDGSPPDFGDGDDSSPQEVEAPKAKSNAANDANDDSSVPVFPDGRQRERW

SEQ ID NO: 111423 - protein, 217 aa, Triticum aestivum
  unsure (1)..(217): unsure at all Xaa locations
  Clone ID: PAT_TA_5841.pep
MVVAXKKLNPERVXGMEXWKSEVNFXGRISHPXNLXKLLXXCMEDNELXXVYEFMAKGSLENHLFRRGAIYEPLPWSLRLKILIGAARGLAFLHSSERQIIYRDFKASNILLDSHFNAKLSDFGLAKHGPDDGESHVTTRVMGTYGYAAPEYVSTGHLYVKSDVYGFGVVLLEMLCGLRALDPSRPSEKLNLVNWAKPLQSDRRSLAAALAGSRSRR

SEQ ID NO: 111424 - protein, 200 aa, Triticum aestivum
  unsure (1)..(200): unsure at all Xaa locations
  Clone ID: PAT_TA_5842.pep
MVRGKTQMKRIENATSRQVTFSKRRNGLLKKAFELSVLCDAEVALVVFSPRGRLYEFASATSLQKSIDRYKAYTKDTVNNKTVQPDIQQVKADALSLAKKLEALEDTKRKILGENLGGCSTEELHFLEGKIEKSLRVIRGKKTQLLEQQIANLKEKERTLLKDNEXLRGKRNLEAPLFLPAPNCVAPLQPRGEPAPEHQP

SEQ ID NO: 111425 - protein, 245 aa, Triticum aestivum
  Clone ID: PAT_TA_5843.pep
RNSARGPALRWLDPQGVVARLKKLHRRFDDMMNGIIAERRAGAGTAGEEKGGKDLLGLLLAMVQEDKSLTGGEEDRITDTDVKALILNLFVAGTETTSTIVEWAVAELIRHPDMLKRAQEEMDAVVGRDRLVSESDLPRLTFLNAVIKETFRLHPSTPLSLPRMASEECEVAGYRIPKGTELLVNVRVVTVTAATLVHSFDWELPTGQTPDKLNMEEAFSLLLQRAVPLMVHPVPRLLPSAYEIA

SEQ ID NO: 111426 - protein, 159 aa, Triticum aestivum
  unsure (1)..(159): unsure at all Xaa locations
  Clone ID: PAT_TA_5844.pep
QESARGRELFADIVPRPAENFXRQFCTGEYRKSAIPXGIKGCQFHRVIKDFMIXQGGDFVKGDGSGCISXIMAPKFDDENFIAKHTGPGLLSMANSGANSNGSQFFLTCAKCEWLDNKHVVFGRVLGDGLLVLRKIENVATGPNNRPKLACVISECGEM

SEQ ID NO: 111427 - protein, 123 aa, Triticum aestivum
  Clone ID: PAT_TA_5845.pep
AWFTLFRGPWEGHGGCWGRTRGSRSPPRPSSPPPGPAASRPPPSSSPAEKKASETAGAAGSSGACSLTWARRTPGAGEGPGGGGRRRSRGRRGEGSACWSGRRTPLLLLETKTTVTAHGGGWW

SEQ ID NO: 111428 - protein, 249 aa, Triticum aestivum
  unsure (1)..(249): unsure at all Xaa locations
  Clone ID: PAT_TA_5846.pep
RPRRLTNDAKRANLRNKRKLSNLTVSWTSSCSSDELKNVXTFLEVLLPPENLEVLEINGYMGTKFPSWMMESMESWLPNVTFLSLGNIPNCICLPPLGHIPNLHSLELRCISGVHSIGPEILAKGQKNTLYQSLKELHFEDMPDLEVWPTSLAGDSEESQQQVFMFPVLKTVTASGCPKMRPRXTPRRRIADLSLSNTSEMLSVGRVFGPSSSKSASLLRRLWIRKCHPSSCDXNLLRXRPKLEDXTIE

SEQ ID NO: 111429 - protein, 203 aa, Triticum aestivum
  Clone ID: PAT_TA_5847.pep
KYPLPTHDVVVRGGAPNAFSQSIVAYDETQRPTLKKALLLGDAISDLPKVDNCQPHEVIEYGGQPKTDFQRYIRLSRKDMLDYSFGDATCPEEGKLLDHQPLRLNQDDYDRVQQIPIKKGANFRDLPGVKVGANNIVEWDPEVERVYLKSGKPLVPDYAMSFIKGRSPKPFGRLWWDETVSTVVTRAEPHNQIILHPNQGRVL

SEQ ID NO: 111430 - protein, 170 aa, Triticum aestivum
  Clone ID: PAT_TA_5848.pep
QLHQHRTDRCEGKGLLREVERVYLKSGKPLVPDYAMSFIKGRSPKPFGRLWWDETVPTVVTRAEPHNQIILHPNQGRVLTVRENARLQGFPDYYRMYGPMKEKYIQVGNAVAVPVARALGYSLGRAYQGEVDAGYDALFVLPDSFTNIGQTGARARASSVGTPAGEVVEQ

SEQ ID NO: 111431 - protein, 226 aa, Triticum aestivum
  unsure (1)..(226): unsure at all Xaa locations
  Clone ID: PAT_TA_5849.pep
APSPPPPITSSNTPTPGRYLGTXGSRYSRSRSPVRRDRYSSRYSPERERSYSPNRGVRSYPRPDVRRFYDPVAARRYRPPHGSTRQVSPADASQSPLCSRPSYSPYDRPHSPRHGHRHRSRSPYRYRRRRSLSHDRSVSAYYSRRYSPRSRRRSYSRSISPRRSYSRSCSPASEESRSCSPRKGRAGSKASRSRSPGKRRSRESYAHSRSSCSRSVSRERSTSAST

SEQ ID NO: 111432 - protein, 300 aa, Triticum aestivum
  unsure (1)..(300): unsure at all Xaa locations
  Clone ID: PAT_TA_5850.pep
NLVTYKGPTMVACTLHAVAILLKEGLEWDWFINLSASDYPLMTQDDILHVFSSLPRNLNFIEHMQISGWKRIQRAKPIVLDPGLYLSKKFDLSTTPERRELPTSFKLYTGFCXWIMLTKSFLXEYCIWGWDNLPRTLLMYYVNFISSPEGYFHTVICNSDEFQGTAVGHDLHYIAWDYPAKQHPLTLSMKDFNSMVKSGAPFARKFXRKTDKVLDRIDRELLHRSEGRFTPGAWCNGSFEGGADPCLSRQEDSVLEPGPGAERLRGLMKKVLSWDYRNGSCSTLSYDQTKRDWYVPKSKG

SEQ ID NO: 111433 - protein, 266 aa, Triticum aestivum
  Clone ID: PAT_TA_5851.pep
HASGSPFTQLGNPTLSPHLPLHSPPHPMATAAVDPGESTPATAATPRAGPARPDPARRPPVTPRELGFTPFRDPPPPPPQEEEGALPNSPEGKIQAPECKPLAGSQAVAQTEGVRTPASLVKSTHEALGQEAFTDEQHEQLDAQILVNADLSQGKPLAKAAVRPARDSPSGRVGPNSPEEVQTPECKPYARSQALPETVVTPPLPSLYACTDHVHPAVFTHASLPSHMVWLPPYRRTVFIFWNVFLILTWFVIIVVVRCNILTCLS

SEQ ID NO: 111434 - protein, 370 aa, Triticum aestivum
  unsure (1)..(370): unsure at all Xaa locations
  Clone ID: PAT_TA_5852.pep
KSFQKRFGQSPVFIASTLVEDGGLPQGAAADPAGLIKEAIHVISCGYEEKTEWGXEIGWIYGSVTEDILTGFKMHCRGWRSVYCTPTRAAFKGSAPINLSDRLNQVLRWALGSVEIFLSRHCPLPWCAXGGTLKWLERFAYTNTTFYPFTSIPLLASPPRPAGSPRSRRAPPPPPPASASLFFISLFISIFATGILELRWERGXSIEEWWRNEQFWVIGGVSAHLFAVIQGLLKVLAGIDTNFTVTSKATGDEDDEFAELYAFKWTTLLIPPTTLLVINIIGVVAGISDAINNGYQSWGPLFGKLFFAFWVIVHLYPFLKGLMGRQNRTPTIVIIWSVLLASIFSLLWVRIDPFTVKAKGPDVKQCGINC

SEQ ID NO: 111435 - protein, 110 aa, Triticum aestivum
  unsure (1)..(110): unsure at all Xaa locations
  Clone ID: PAT_TA_5853.pep
MGRPLIYEILEKPASSGVIALCSLIWFLIQKRGIGYADVGLSYXAAVEGGQHWRLITAAFSHVSVVHLVFNMSALWSLGAVEQAAGLGVQYYLHYTLVLVVLSGLLVLGI

SEQ ID NO: 111436 - protein, 208 aa, Triticum aestivum
  unsure (1)..(208): unsure at all Xaa locations
  Clone ID: PAT_TA_5854.pep
VSLVCLLHRAIPESAKSMETFDSLTVFRAKDYNATIEFYWAPFLAESNSDDAVVHRVTDRIVRXTAIEKHAKFWKGADVVVFNPSLWWMPGQKMKILQNSFEDKNKDIKEMETEDAYGMVLNAVAKWVENNMDPKSSRAFFVTMSPTHTQSKDWGDKSDGNCYNQTPPIKDXSYWGPGTSKGLMRVIGEVFSASKVPVGVVNITPLSE

SEQ ID NO: 111437 - protein, 101 aa, Triticum aestivum
  Clone ID: PAT_TA_5855.pep
GEGGGGPLLPTRGGRGHQRRRQAQGHGRLRRRPPRQPGDAGQQAAGQGHRGRRVQGDHRPDAVLAPGDAGAGREHRRAQEQAPDPLRGRLPGVHGGRSNNL

SEQ ID NO: 111438 - protein, 225 aa, Triticum aestivum
  Clone ID: PAT_TA_5856.pep
RTYTLKVKSSNKIEDVEAKMHDHHLDVQGLIFAGKKLVYGRTLADYNIKNLSTLQLVLHLRISVKTLTGKIIDLAVKSSDTIKHVKAMIQSQENIPWDKQGLIFAGKRLEDGPTLADYNIETLCTFELVPFLHVTVKMLNGESIDLAVLSSDTIEDIKVMVYDQEGIPQRFIFAGKLLEDYRTLADYNIHKLWECALHLVTCIGRNSAIHIKMLTGKTIFPAVGI

SEQ ID NO: 111439 - protein, 102 aa, Triticum aestivum
  Clone ID: PAT_TA_5857.pep
MWERRTHARILVSDADAGCIIGKAGSDIHAMEARSGAHIKLSGRGRPLPGTDRRVVLVSGLFRTVMDAAELVLEKLFYLGDQVIDAEATVVLVVPDACCGAL

SEQ ID NO: 111440 - protein, 229 aa, Triticum aestivum
  Clone ID: PAT_TA_5858.pep
GMVRELLLSFHRSTGQKPQRIIFYRDGVSEGQFYQVLLYELDAIRKACASLESNYQPPVTFVVVQKRRPTRLFANNHNDQRSVDPKSGNILPGTVVDSKICHPTEFDFYLCSHAGIQGTSRPAHYHVLWDENNFTADGLQTLTNNLCYTYARCTRSVSIVPPAYYAHLAAFRARFYMEPDTSDGGSVPSGATTSRAPAGARGGSRAAGNVAVKPLPDLKENVKRVMFYC

SEQ ID NO: 111441 - protein, 61 aa, Triticum aestivum
  Clone ID: PAT_TA_5859.pep
MTRIFVQRGPGGSSSNSARSGSQALQQQQQQQQNQPAAAAREEELTVQPQPLELLSLGDTT

SEQ ID NO: 111442 - protein, 185 aa, Triticum aestivum
  Clone ID: PAT_TA_5860.pep
HGNHYNSVVDPRRLTVGAGLGFSSLRGTNSVDRDQVKAAIKAQQDQQIENALLAEGRLYSDLELTEKEIERMVMEASRAEYLNQQQVNFRESSRSGAEPSSSAAISGSSGSAADRGSENCFVLPDTVLTRSMQLLLAMGFSYMQVMEAYSIFGEDMDSMICYLVEMGGTGASAGGSNRRKGKAAE

SEQ ID NO: 111443 - protein, 294 aa, Triticum aestivum
  Clone ID: PAT_TA_5861.pep
VLFDSNKATAFLPIDPRFLLDIDNIEEAGIRPGLVEQFMIIDENPNDETLILSLQSIQQDLAWERCRQLQAEDVVITGKVIGGNKGGVVALVEGLKAFVPFSQVSSKTTAEELLDKELPLKFVEVDEEQGRLVLSNRKAMADSQAQLGIGSVVLGTVESLKPYGAFIDIGGINGLLHVSQISHDRVADISTVLQPGDTLKVMILSHDRERGRVSLSTKKLEPTPGDMIRNPKLVFEKADEMAQIFRQRIAQAEAMARADMLRFQPESGLSLSSEGILGPLSSDTAEEEGLPTDE

SEQ ID NO: 111444 - protein, 194 aa, Triticum aestivum
  Clone ID: PAT_TA_5862.pep
VRLSYHPGNHYNSVVDPRRLTSLTVWGVRSFSSLRGTNSVDRDQVKAAIKAQQDQQIENALLAEGRLYSDLELTEKEIERMVMEASRAEYLNQQQVNFRESSRSGAEPSSSAAISGSSGSAADRGSENCFVLPDTVLTRSMQLLLAMGFSYMQVMEAYSIFGEDMDSMICYLVEMGGTGASAGGSNRRKGKAAE

SEQ ID NO: 111445 - protein, 125 aa, Triticum aestivum
  unsure (1)..(125): unsure at all Xaa locations
  Clone ID: PAT_TA_5863.pep
ATMLDIDFGTYPFXVTSSSPSAGGICTGLGIAPRTLGDIIGVVKAYTTRVGSGPFPTELLGKTGDLLRASGMEFGTTTGRPRRCGWLDIVALRYCCQINGFSSLNLTKLDVLTGLKEIKLGTSYC

SEQ ID NO: 111446 - protein, 224 aa, Triticum aestivum
  unsure (1)..(224): unsure at all Xaa locations
  Clone ID: PAT_TA_5864.pep
SAAAPPPRPPPPPAAPPPSPPAPPPPPPPPPPPCLPAPPRPPPPSPPLRFSPPPGPGPLRPSPASPVPSPPXSPPPRPAPPPCRGPHRAAPARQPRPPPLPXPPASAPPWPSPXAPSRPPAAPRRELRPPPSRARPRPPAAPPPPPAPPRSSSSPPPSLAPPARPGSTATALPFACLASLWLSTVNGWATKKLQARRLHLTAVDGHMSDEPNRAIRQSRLCSTF

SEQ ID NO: 111447 - protein, 343 aa, Triticum aestivum
  unsure (1)..(343): unsure at all Xaa locations
  Clone ID: PAT_TA_5865.pep
IRHEAPXRLQDNADHVDKSEETTPRPKLKPLHWDKVRASSDRAMVWDQLKSSSFQVNEEMIETLFICNPANAAPKEATKRPALPTPKAENKVLLDPKKAQNIAILLRALNVTKEEVCEALCEGNTQNFGADLLETLLKMAPTKEEEIKLREFKEETSPIKLGPSEKFLKAVLDVPFAFKRVDAMLYIANFESEVKYLKNNFEILEAACDELRNSRLFLKLLEAILKTGNRMNVGTNRGDAHAFKLDTLLKLADVKGTDGKTTLLHFVVQEIIRTEGSRLSASNQSTPRTLANPLRDELECKKLGLQVVAGLGNELSSVKKAAAMDSDVLSSYVAKLAGGIEKI

SEQ ID NO: 111448 - protein, 65 aa, Triticum aestivum
  unsure (1)..(65): unsure at all Xaa locations
  Clone ID: PAT_TA_5866.pep
MAPAAALLLACAVAALACLALADPPASEQTALLAFLAAVPHERKLGWSASTPACAWVGVTCXXXN

SEQ ID NO: 111449 - protein, 148 aa, Triticum aestivum
  unsure (1)..(148): unsure at all Xaa locations
  Clone ID: PAT_TA_5867.pep
PLESTRPPSTGAAVGVHGRETGKRRKNRISPPPTITWTLVLHNLGGGRRCFSTSSDSSQLRFRLHATWRHGGGGRLCALCWVQKQPTLSACWLSADYLTTCLVIIXCXXTCLGQKLSXLLXFMXVIVNCQNTCFLGXHLDLGKKSXKL

SEQ ID NO: 111450 - protein, 269 aa, Triticum aestivum
  Clone ID: PAT_TA_5868.pep
MLASMCFRLYNKKGDIAVWQKSLDAGCYDKLTPVTTPAKCDDSVDADAAWYVPMRSCVTAPSPKSRGKALPKWPQRLSVAPERVSVVPGGSGSAMKHDDGKWKAATKHYKALLPALGSDKVRNVMDMSTVYGGFAASLVKDPVWVMNVVSSYGPNSLGVVYDRGLIGTNHDWCEAFSTYPRTYDLLHADGLFTAESHRCEMKFVLVEMDRILRPTGYAIIRDNPYFLDSVASIAKGMRWTCDRHDTENKENEKEKLLICHKQLWSAKKA

SEQ ID NO: 111451 - protein, 88 aa, Triticum aestivum
  unsure (1)..(88): unsure at all Xaa locations
  Clone ID: PAT_TA_5869.pep
XXXLASDCXTTGAEXDXXESCCXGGSETEQGSYNSTXLKMGTWQGRAAARQGAWLRSTPDWWAPIPGRRPGWDLRSQMLGLAARSAWY

SEQ ID NO: 111452 - protein, 101 aa, Triticum aestivum
  Clone ID: PAT_TA_5870.pep
MNCKSSISLLFAALIPYMFLVFDASQAAVPTDTLLPGQSISGSEILVSENGVFELGFFSPSPGAMKHYLGIQYKNLIGSHRAMFWLGNRIPITSFLNTTLY

SEQ ID NO: 111453 - protein, 156 aa, Triticum aestivum
  Clone ID: PAT_TA_5871.pep
GGTRPTPAPPLVPTTRTSSHFRLPISFLSEPPPTPTPPPHNLPPRAAPSRLAPDQPQSSSPSTAIAGSHQRRAAPAGHPPPTGLPPTPTPTDGTHPSPPQSPTSFPPRRPSLATNLLPRARSRRRRSATVLEATRPRSGTRPVLPVGIFLRRPLPS

SEQ ID NO: 111454 - protein, 128 aa, Triticum aestivum
  unsure (1)..(128): unsure at all Xaa locations
  Clone ID: PAT_TA_5872.pep
MGACNSCEATAVAAVTGASAVGEATAARVVLADGQLQRFPGGTRASQGHEGRGGGGXAGACGLCSADGLELGGAVAAVAGDQELQPGQLYFVLPGAMRRRALQAEEMAALAIRASAALAGDHDGPLVF

SEQ ID NO: 111455 - protein, 177 aa, Triticum aestivum
  Clone ID: PAT_TA_5873.pep
ARVETHKISKPTHGSRTCIANFHTPLSMASSLVTFHSFRSLLTDSSHFKFGHPTPLAMASTLETSGTHRSLRTDPTKRGIGRPCPNQPRPGRLHQPVGPGASGGARRQRPTRPRGSWPSFEPAGTPPRHSRVTANGSSLARPHPPLNERMAATPNGSTSHLQHGPHTAPGVRAGTPP

SEQ ID NO: 111456 - protein, 160 aa, Triticum aestivum
  unsure (1)..(160): unsure at all Xaa locations
  Clone ID: PAT_TA_5874.pep
SSXLTRRVLVWXQRQQEGGGGPSPISSHPPRRRRRSRGRSSAPPPRTPPAPRAAPWPAAAASMPVSRPPARSLDGESRPPSAAWSGRAITTTPCNGGIVSSSTCFPDSNGVVAISGEACRGIVLGFLAVAREGGGGGGRRHEGGGQGARDSWEAGDATRW

SEQ ID NO: 111457 - protein, 300 aa, Triticum aestivum
  unsure (1)..(300): unsure at all Xaa locations
  Clone ID: PAT_TA_5875.pep
MGFMCCSSHPLRAASLLLLCFCVVLSRVHAGGSRSRELYIAYLGDVKHEHPDDVVASHHEMLGTLLQREGSSASMVYHYKHGFSGFAAMLTADQATRLAEFPGVISVQPSKTYRSTTTRSWDFLGLHYPSSHMPASELLHASNYGEDIIIGVIDTGIWPESRSFSDQGYGPVPSRWKGKCQVGPDWGNNNCSRKIIGARFYTVGIADKYLKADSLSPRDHNGHGTHTASTAAGSTVEEEVASFHGLAAGVARGGAPRAXIAMYKSLWSVDETGSTASVLAAIDDAIHDGVDVLSMSLASR

SEQ ID NO: 111458 - protein, 329 aa, Triticum aestivum
  unsure (1)..(329): unsure at all Xaa locations
  Clone ID: PAT_TA_5876.pep
MCLPCPLVYEDRAVELATNPAKLQALTNKLKEVRLTCPLFDPARWVRTWGIPGTTGASYIDYWGTDELVYPTRYAHIYSENLGHLPNCDFVNDYKRRNCDLLCPWFARTKXSQYGLAQXKFSFACFEHLYKVGPRIIXSWGNIVKRVPNSVXWLLWWSPAGGTSATPHAAARGVSPDRIIFTDVAMKHEHIRRSELADLFLDTPLCNAHTTGTDILWAGLPMITLPLEKMATRVAGSLCLATGLGDEMIVSSTKEYEDRAVELATNPAKLQALTNKLKEVRLTCPLFDTARWVRNLDRAYFKMWNIYCSGRHPEPFKVKEDDSEFPYDR

SEQ ID NO: 111459 - protein, 130 aa, Triticum aestivum
  unsure (1)..(130): unsure at all Xaa locations
  Clone ID: PAT_TA_5877.pep
SLYXRNQKLYVSVFREKRTPIQPMPSTTANQREACFTWQTFPGKRRKSNMILSNCMNTLENIISNSEFTIQKSQPSITTASIMPLTGSASPVDHNPSWQKGGPNVYVLAVDITTMTTARPTPDQVWQCGS

SEQ ID NO: 111460 - protein, 198 aa, Triticum aestivum
  unsure (1)..(198): unsure at all Xaa locations
  Clone ID: PAT_TA_5878.pep
MPYVQQVAGREAACADGLCDRLLLLLRYFNPVGAHPSGYIGEDPLGVPNNLMPYVQQVAVGRRPALTVYGTDYNTKXDGTGVRDYIHVVDLADGHIAALRKLYEDSDRIGCEVYNLGTGKGTSVLEMVAAFEKACGKKIPLVYAGRRAGDAETVYAATAKAEKELKWKAKYGVEEMCRDLWNWASKNPYGYGSTDNGH

SEQ ID NO: 111461 - protein, 161 aa, Triticum aestivum
  unsure (1)..(161): unsure at all Xaa locations
  Clone ID: PAT_TA_5879.pep
TGARPHGVASRRAGEDRTKSHDGPKPGPAPTPXGGRSRRRGDPEDEAGRPXGSRPPAQPGGSAPDSWQGRGSPARXSPGSTDARSPRRRPEATGERDPDNLGARERGRKPRGSSRGRGAEGGAGGPRERSGGGPGRRRGRRGAAGARGRPRGATAAATAGR

SEQ ID NO: 111462 - protein, 231 aa, Triticum aestivum
  Clone ID: PAT_TA_5880.pep
EGVQWVVMGRPGPQKHAHAARLAEVLAVPYISMGTLVRQELSHTSSLYKKIANSVNEGKLVPEDIIFGLLTKRLEEGYCKGETGFILDGIPRTRMQAEILDEIVDIDLVLNFKCADNCFMKKRSGGDICSHCGQHFGVSSLVSRERNLSLGSSTWPAQAQHASVIGLENPRMEKLRAYAEQTKQLEDYYKKHRKLVELKTSARPGETWQGLVAALHLQHLDPSPTPHKLTV

SEQ ID NO: 111463 - protein, 99 aa, Triticum aestivum
  Clone ID: PAT_TA_5881.pep
SRYRARGRPLTYQTEADPICLKQSFSLHQQFQEGHLYGLYLDPKVLHLISSSKVKICQTATMDRSLFQRTDKSSATNSNVLLFLGEPMETPPLRVELIR

SEQ ID NO: 111464 - protein, 216 aa, Triticum aestivum
  Clone ID: PAT_TA_5882.pep
VFPCLAIFLVLALYYQTFAPLARRITGHPHGASQLQRVGLGLVFSILSVAWAGAFERYRRRYAVEHGYLGLFLSPMPGLSAYWLLIQYCLIGIAEVFCLVGLIEFLYQEAPDAMRSVGSAYAAVAGGMGCFMATALNNAVDAATGDIRSGRPSWVAQNINVGRFDYLYWLLAVLSTVNFAVFLYFASIYKYRTPPPTTTAGSNSSKVEVSVVSGHK

SEQ ID NO: 111465 - protein, 167 aa, Triticum aestivum
  Clone ID: PAT_TA_5883.pep
MASFAVKNPLLAAAARFRTLPSRAGRPLPFSPFTRTARRRGQETVTCFVPQEGQAPGPAPEPVPSLEEEAASAAARRVAERKARKQSERRTYLVAAVMSSLGVTSMAIASVYYRFAWQMEGGEVPMTEMLGTFALSVGAAVGMEFWAQWAHKALWHASLWRMHESHH

SEQ ID NO: 111466 - protein, 344 aa, Triticum aestivum
  Clone ID: PAT_TA_5884.pep
MGTRHLITGQNNCAPDGASSSNPFGALANTLLGQSNKAESLRGLPGASVNVPTTSDYSGAPLSTLPGSENEFKQDQRPFAWGADFSRGGPANDWVESFRPPGHSAFGGPEANFAEFEQIYNNAGPTLGPALDGPPQRVLSGVLHSFILSGRAGVPFQAVPVPALGLSEADKQCIRDRSFIMAHHILADQPEEYIQAQVNTLLHSLDIDNSHRMEDAWDGPYPEMEEYWNQSQSALRSGPMHNAANNWISEFGKQNNNPEGWITEFGKQNNNPEGWAHSFEQQYGPNGWASEFEQHQSQMAMDQMGGANMANLAAMQQSRMLAETLSSNNDPKFQNSKFFQFVSK

SEQ ID NO: 111467 - protein, 187 aa, Triticum aestivum
  Clone ID: PAT_TA_5885.pep
EPLDASVCVDRKCDGLVARGTYYVNVNKLGHGAHWRRTQGQKVYSPFLLGFAHEDESSWKSYSVVKASMMNANYSLPDNVAIITLQSLDDGTALLRLAHLFQAAEDPQYSVMAKVELKKLFGKRTIKELTETNLSANQKKSAMRKLKWRVVGDTESSPAPITGRPVDNQALVVELGPMEIRTFLLKL

SEQ ID NO: 111468 - protein, 132 aa, Triticum aestivum
  Clone ID: PAT_TA_5886.pep
ARPEGVEARHAGFRRWRARRLGGASEELGGDGPATAAREQTEAPRAASPASRGGPANHPHRRRARRGPGKAEPTAGTRRGEARWIEGGGSAPQGAGGGIKGAGRAGAERARAAARAGTRSGRPRELATAVEH

SEQ ID NO: 111469 - protein, 269 aa, Triticum aestivum
  Clone ID: PAT_TA_5887.pep
MANHYAPLRVILLLLLVFPCFASEADIQCLKSVQQSVTDPNGVLKSSWNFANRTAGYTGRFTGVDCWHPDEDRVLSARLTYLGLLRSFPVGRLAASCLAGLGLSTNYFSGPIPQDISREIPYLTSLDLSYNGFSGTIPPNISNMTYLNVLNLQHNQFSGEIPPQFSLLTRLTAFNVAENRLSGFIPYSLGKKFTASNFAGNQGLCGVPLDECQASAKSKNNAAIVGAIVGVVVVIIIVAIVVFVCLRKLPAKKAKKDEDENKWAKSIKG

SEQ ID NO: 111470 - protein, 114 aa, Triticum aestivum
  Clone ID: PAT_TA_5888.pep
MPRTELLPPACPLHGSLSLYDHIQLQLLQKDVNLLNPMAELEKHSQEEASRAVHQLIMYVRIRSCMVQRKYSFLFQLICLLAPFVFVLYVRRMSCARTASTCEHDPFQALVMCC

SEQ ID NO: 111471 - protein, 179 aa, Triticum aestivum
  Clone ID: PAT_TA_5889.pep
SGLEHLVASIAPRIRPVLDTVTTVSYELDDAEYGENEVNDPWVQKLLLAVDTNVTWLQPMMTSNNYDSFVHLVIDFIVKRLEVIMMQKRFSQLGGLQLDKEVRSLINHFSEMSQRPVRDKFSRLSQMSTILNFERVSEILDFWGDNAGHLTWLLTPAEVRRVLGLRIDFRPEAISALRL

SEQ ID NO: 111472 - protein, 93 aa, Triticum aestivum
  Clone ID: PAT_TA_5890.pep
FFFFFWRNQYAIRVYQHASMSTEKAIKHVLANPKSAETQSNHSQPRVRQKKMRPCSKEKASTGGTHHSPSFLTRHPYFNFIFFIDARHVKLRP

SEQ ID NO: 111473 - protein, 242 aa, Triticum aestivum
  Clone ID: PAT_TA_5891.pep
ENLTVNSGFSKEVLLQGTSHSLKEKARQGDNPRVRHEAVVENWSNKDFTFSYSVYSGDLSGGIHVQPSTSQDYDDRDTFSIFILPGSGNRKVFKKAVVFVVDTSGSMKGKPLENVKNAVSTALSELVQGDYFNIITFNEELHSFSSCLEKVNEKAIASANDWMNANFVAEGGTDIMHPLNEAMALLSSAHDALPQIFLMTDGSVDDEHDICQTVKNELLSRGSKSPRISTFGLGLYCNHYFL

SEQ ID NO: 111474 - protein, 214 aa, Triticum aestivum
  Clone ID: PAT_TA_5892.pep
MSREIKCYVCNQNGHLCCTDFSDSCSKEVTCYNCAQSGHTGLGCAKQRRETSAATTPTLCYKCGEDGHFARGCTNSAKPGRFKGELSSHSRRKDKWKNDSGPRSAPHGSHKRKSPLFEDRWETPRGKSRARGGWIPEDHDDLPSKKYKGNGWDSQSTPKKPYNNHHHRSSGGDYSSPQGQDFSWHNSQYSPSARKHGSSSSRFASNTHHRFERS

SEQ ID NO: 111475 - protein, 193 aa, Triticum aestivum
  Clone ID: PAT_TA_5893.pep
KNRSREVRCGSICSKLTESSRMMFPRNPTMHIVGWHLFLWGQNCTFFQPFVAFCHLAFLVELNLRQIDGNNEENDFSRPDPWTRTSPWTDPVFRKLEGIRSPEWKRTRDPGDLAVGVEEDERSGRRFGRRSRGRVGLHPVSWPRLKGSVVADDHHRGNYAQMRKREEGGWLGDGTGTRTTEKEHHRLSREGAG

SEQ ID NO: 111476 - protein, 198 aa, Triticum aestivum
  unsure (1)..(198): unsure at all Xaa locations
  Clone ID: PAT_TA_5894.pep
MLLNPASEALVLDSIRQHLMEDTAAPAPEARRQRPAYCRSASFGSLVADQWSESLPFRADDSDDMVVYGALRDAFSCGWLPDGSFAAVKPQXPPAFPGLLLHPLPPAYRIPLNFPLRIEIAAAAAAAGQKRXSPQPASPDSSPSCSAPGSSKRRKRGEAAAASMAMALVPPPPAQAPVQLTLPAQPWLAAGAVQQLVS

SEQ ID NO: 111477 - protein, 272 aa, Triticum aestivum
  unsure (1)..(272): unsure at all Xaa locations
  Clone ID: PAT_TA_5895.pep
MLLLNPASEAAAAALDSIRQQLLEEPMAPARPAYCRSASFGSLVADQWSESLPFRPNDADDMVVYGALRDAFSCGWLPDGSFAAVKPEPLPSPDSYDGCCLGSFLASPPGLDAPWAEEAEVAATASRGKHFRGVRQRPWGKFAAEIRDPAKNGARVWLGTFDSAEDAAVAYDRAAYRMRGSRALLNFPLRIGSEIAAXAAGQKRPSPQPASPDSPPPSSSAPGSSKRRKRGEAAAESMSMALVPPPPVQAPVQLTLPVQPWLATGAVQQLVS

SEQ ID NO: 111478 - protein, 469 aa, Triticum aestivum
  Clone ID: PAT_TA_5896.pep
MDHQAHGAGEKKGIMEKIKEKLPGGHGDHKETAGAHGHAGTVTHGAPATGGAYGQEGHTGTTGTGLHGAHAGEKKGVMENIKDKLPGGHADHQQTGGTYGQQGHTGTATHGTLATGGTYGQQGHTGTAMHGTPATNGTYGEHGHTGTATGGSYGEQRHTGVTGTGTHDIGEKKSLMENIKEKLPGGHGDNQQTAGTYGQQGHVATGTHGTPATGGTYGEQGHAGVTGTGTHGTGEKKGLMENIKDKLPGGHGDHQQTGGTYGQQGHTGAATHGTPAGGGTYEQHGHTGMTGTGTHGTGGKKGVMENIKDKLPGGHSDNQQTGGAYEQQGHTGAATHGTPASGGTYEQHGHTGMTGTGTHGTGEKKAVMENIKDKLPGGHGDHQQTGGAYGQQGHTGTATHGTPAGGGTYEQHGNTGMTGTETHGTTATGGTHGQHGHTGTTGTGTHGTDGVGEKKSLMDKIKDKLPGQH

SEQ ID NO: 111479 - protein, 434 aa, Triticum aestivum
  unsure (1)..(434): unsure at all Xaa locations
  Clone ID: PAT_TA_5897.pep
MENQAHSAGEKKGIMEKIKEKLPGGHGDHKETAGPHGHAGTATHGAPATGGAYGQEGHAGTTGTGXLHGADAGEKRGVMENIKDKLPGGHQHHQPTGGTYAQQGHTGTATHGTLATGGTYGQQGHTGTAMKFSRTTVCSQFSSIYTPSCKFPFCSFSFVHLIIRQAFVTXTHGTPATGGTYGEQGHTGVTGTGTHGTGEKKGVMENIKEKLPGGHGDHQQTGGTYGQQGHTGTATHGTPAGGGTYEQHGHTGMTGTGTHGTGEKKGVMENIKDKLPGGHGDHQQTGGTYGQQGHTGTATQGTPAGGGTYEQHGHTGMTGAGTHSTGEKKGVMENIKEKLPGGHGDHQQTGGAYGQQXGHTGTPTHGTPAGGRTYGQHGHAGMIGTETHGTTATGGTHGQHGHTGTTGTGTHGSDGIGEKKSLMDKIKDKLPGQH

SEQ ID NO: 111480 - protein, 222 aa, Triticum aestivum
  Clone ID: PAT_TA_5898.pep
MRRLAGGAALVLLLLLLAITARPAAADFFSPLSPLLAPVMGSLCKAVACGKGNCTVTTGLPGYRCDCEPGWKQMHVGDSLRFLPCVIPNCTIDRSCSNDNSAPTPAPSPKNVFVSTVPPELPYCHSGGTCTKATLLTYHCEGPGALSNVLNMTTMPCFQDCSYGADCAAIGILPSTNSNSTAPPAGSASVSNNCNAPVPGSVLRQILLPLLILASLAMGQAT

SEQ ID NO: 111481 - protein, 109 aa, Triticum aestivum
  Clone ID: PAT_TA_5899.pep
MSKWEPVTFEESLSFVKRVKARDYLLYLSLLNVLTRSDQIPLEAYNELLLLFRDHGDLLEELGKFRPLPSFPSTVYSYNTIWMFIFLMPFLLLSLLLAFEKPLDSFLLR

SEQ ID NO: 111482 - protein, 272 aa, Triticum aestivum
  Clone ID: PAT_TA_5900.pep
MSLCCCSAGSRRLLLPRLFLGQRRQARRPLLHLRTTVTAAASSSATSLSTQQQRQVSLYVDALLDWNQRMNLTAVTDESEVMTRHVVDSLAVLPPLERAYTSRGGDISGIRLVDVGSGAGLPGLILAVARPSWKFTLLESMRKRCTFLEHAVEVMELSNVDVVCDRAENAGQSHDFRESFDVAAARAVAELKILAEYCLPLVRVGGLFIAAKGHDPHEEIRSAKAAVGKLGASMLDLCNVESMGPHGQRTAVVYLKERTTPKKVPSATRYPF

SEQ ID NO: 111483 - protein, 263 aa, Triticum aestivum
  unsure (1)..(263): unsure at all Xaa locations
  Clone ID: PAT_TA_5901.pep
MPPGAAAAAKSDDEDDYEEYIPVSKRRAMEADRLRHQRLSKPAAAASAGSLPPPPPPPAANPAAAPDDAAPAAKPSLLVTSTQLKRAAPEVTATEQIILQEKEMIDNLSNKNTLMSVRELAKGITYTEPLRPAGTRPLRLRPVPPPKAGALRPSAHILVEXDEIPPPXPDXXEXPXSRXPVLLDCSXEKGXLWQXPRPIXRXAGGLSRGGXFFPGXGXNEREGLTRGSRENWGGGAPKKWGFLQRERPPRGRGPLKNFAHRGG

SEQ ID NO: 111484 - protein, 346 aa, Triticum aestivum
  unsure (1)..(346): unsure at all Xaa locations
  Clone ID: PAT_TA_5902.pep
MGDLKEMKYRRRIGLQERAQCSDQRAVDWGVLKQDPVELLRKLDELRDQITRSCQVAEQPREHRRVGRRPPSLLPDLPEPVPLPGYHRPRYGARYGHGLPLSPCEPQHSDHGERYARQSSGRYRQYPGRQWDNGGIGHGNYHQYACASPHYLHGQRPAPQEEHIPMARYFAGQHECYRFERSPSISSDYDQRSVASSLYSHRSVSKKRAEYFRKKAEHLCRPMHGAAPFVVCSACYNLLQLPMEKCMGWKQNRLQCGSCSEIISVKRVKGKAIPYTSSPPFSLSNTEQSSHDRXRRDFEHQHHDDVTSAWNNLPEHSSMQINIDFGDDNSVSSTISHERTDRECGS

SEQ ID NO: 111485 - protein, 91 aa, Triticum aestivum
  Clone ID: PAT_TA_5903.pep
SQQQAAYTRVKSYNTSKPTKALAKRGQKFRITCRRRHDQSRKARINEAKRTTQTLRRWRGSSRQSVDLSKTGESAVQQLNVLAPCQRHPLH

SEQ ID NO: 111486 - protein, 189 aa, Triticum aestivum
  unsure (1)..(189): unsure at all Xaa locations
  Clone ID: PAT_TA_5904.pep
LVCITAGAGLVHTWAAVLMGICAGSVPWFTMMVLHKRSFLLQKVDDTLAVFHTHAVAGLLGGVLTGLXATPELTTLHTHVPGTRGAFYGGGIQQVGKQLAAALFVVAWNVAVTTGIILAVGLVIPLRMPDEQLRIGDDAAHGEEAYALWGDGERFDVSRRAAARATEVGDQSVDQRLAAMGARGITVQL

SEQ ID NO: 111487 - protein, 113 aa, Triticum aestivum
  Clone ID: PAT_TA_5905.pep
GCKHADTRGHLFCLCCGTATLPQAISCSLVAWSGLTLAGKIVLKHPDVQKVLYGGPFLLKQECSSSDGQKGPTAEDSPPPVKEEEEPVSPETKKSSDASVHRDESDKTSTKDG

SEQ ID NO: 111488 - protein, 108 aa, Triticum aestivum
  Clone ID: PAT_TA_5906.pep
EEYKHDDIPVQDICIDTLAAMIARLERAARLDYPTTREKNTHIFFCSNLLALLYYLPCPVCFRLSASCCRSTDCELGSAMAAQVRQHLPAFHNLIKEVVQLADDALRP

SEQ ID NO: 111489 - protein, 136 aa, Triticum aestivum
  unsure (1)..(136): unsure at all Xaa locations
  Clone ID: PAT_TA_5907.pep
PLSSPSQVLRSPWPRAPPRQVRPRVVPAPAPSKHVLRPPXVFPASPEITPSTAPPRPCVXSEPPPALTRCCSSSSSRPSPRNAMATPLLLTAPGPLRPVTGVRRRHGFAPRIPHLRPVPLAPSRTYSRCFKDEDDQ

SEQ ID NO: 111490 - protein, 158 aa, Triticum aestivum
  Clone ID: PAT_TA_5908.pep
MDVSRRKKEVTRWAPLPPGSPSLWMNRQPRRALESSTSEAEKPHMRLIGPAHPSVQPSSGSDEESLENTSISSTTSNRSPGLSKSAFLRLQIEIFEAKKDDNREASPECSICLDGFYDRDELIRLRCGHRFHSTCLEPWVRKCADCPYCRTNIRSRPR

SEQ ID NO: 111491 - protein, 128 aa, Triticum aestivum
  Clone ID: PAT_TA_5909.pep
FVFNKKDNDDSLPVCLEAKPVERSAGDMIGLGGSFSTKETEIRCTKGTETLWSDRISGKVTVLAGNANFWAVGCEDGCLQVYTKCGMRAMPAMMMGSSAVFIDCDDCWKLLLVTRRGLMYIWDLNNRT

SEQ ID NO: 111492 - protein, 135 aa, Triticum aestivum
  Clone ID: PAT_TA_5910.pep
MVAWDFRLPGFFLSRLPSGSPFCVDGACKYSTHIVNLRVMGDSERGTICPNYPQCNGRLVRQYTEADLYRQLSYFCYVLDATRCLDKLDQKMRLPFEKEFAVLNQTISSAFLEIQKIRDRCAFGWVQLTDLAVSI

SEQ ID NO: 111493 - protein, 571 aa, Triticum aestivum
  unsure (1)..(571): unsure at all Xaa locations
  Clone ID: PAT_TA_5911.pep
LAGARLRPQSCSAIAPSSPERPPQLEVLCEKLYNSRDSAERAHAESTLKCFSENRDYISQCQYILDNASTPYALMLASTSLVKQVSDRSLSLQLRLDIRNYVMNYLAASGPQLQNFVTISLIQLACRITKFGWFDDDRFREIFKEATDFLALASQDHYLIGLKILNFLVMEMNQANSAMPLTLHTHAAASFKDQFLLQIFQISLTSLHQLKSEVPDELRRVPISLALRCLSFDFVGSPVDEXSSEEFGTVQLPASWRPLLQDPSTVQIFFDYYKVNDTSVSKEALECLVRLASVRRSLFVEDPARSQFLSHLMSGTREVLQTGQGLADHGNYHEFCRLLGRFKVNYQLSELLNVEFYGEWLGLVAEFTTKSLLSWQWASNSVYYLLSLWSRLVTSVPYLKGDTPSLLDETVPKITEGFITSRINSVQASFADNSPDPDNPLENAESLQDQLESLPYLCRFKYESCSLFIINIMEPLLQAYTARSRLPASGDAAELSVIEGQIAWMVHIIAAILKIRQTVGCSQDSQELFDAELAARVLQLINITDTGVHAQRYQEISKQRLDRAILIFVQN

SEQ ID NO: 111494 - protein, 132 aa, Triticum aestivum
  Clone ID: PAT_TA_5912.pep
MAFLQKVGNALKRSAGSGSAMLQAVRSMSSSKVFVGGISYGTDDQSLAEALAVCGRVLHSGGGGGRESGRSRGFGFVTYTSAEEAGAAITGMDGKDLQGRIVRVSYAHDRGSRPSFGGGGGYGGGGGGDYGG

SEQ ID NO: 111495 - protein, 159 aa, Triticum aestivum
  unsure (1)..(159): unsure at all Xaa locations
  Clone ID: PAT_TA_5913.pep
RRTPIDLMPFLGPEETSQSEPLESTFIFEDREFSELENLAMNIQGIRKGMEHDRGGRNQGCGEAEMTDDFWEELLSEGMRDEAEILELERRRSRYVDAXAQKLGHLSKSDPKFTRIHNHLIYIPLSLIAILYIVVQIYSHRLDCIAVPTPDYVVYIVVV

SEQ ID NO: 111496 - protein, 208 aa, Triticum aestivum
  unsure (1)..(208): unsure at all Xaa locations
  Clone ID: PAT_TA_5914.pep
MEGSISGPSEKRVAVVTGGNRGMGLEICRQLAGHGLAVVLTARDDKRGAEAARTRRXERRADGPSHLPVLRAPARPARLAPSAGCLLGGLVWLACHAGVLGVTTDGGDPATLQEXLQARMGMEGAEWLSQRPTQTTQDAEDCLRINYHGNKTVTEALLPLLRSAPPGRLPTGTSACGPPSLGAAQVFPATNSGGEAGRRQPHHASLDE

SEQ ID NO: 111497 - protein, 185 aa, Triticum aestivum
  Clone ID: PAT_TA_5915.pep
QILACYAARGRYVISASENSHVYVWRNDDSPEQSSSSSKGVVSVANSYEYFYCRDVTVAAALPSTAGSAATSRTNSRRKHQELDCVSEYPLPHAGDGDSSDFQQQQSRNDLSNGSNHSGGDRASATWPEELMTPTKQSPRSSTSLPDGDGAGQAPSRSAWGMAIATAGSGGQIRILQNFGFPVRV

SEQ ID NO: 111498 - protein, 194 aa, Triticum aestivum
  unsure (1)..(194): unsure at all Xaa locations
  Clone ID: PAT_TA_5916.pep
XGVDAWLGRAALGSSFRRWSPASRWQGETGVGRWLSRSRWDRGRAWRLGHIARRGLPGGGVVCPIWILLLHHFWFVKVDGPADARDLGSPSPFGSCLSSLPSSRGARDQRPDASTTELLCCCVSSCHPRASSVPATHHQYSASSVLFPIDVSKPPLPASNSVKFAVVVGMRQARPLPHCPLASRVVHDQGPLAK

SEQ ID NO: 111499 - protein, 102 aa, Triticum aestivum
  Clone ID: PAT_TA_5917.pep
PTTPALGITDLLLHKILVLGTLKYVTKYGNHVLEEEKWKWLATSGSARKLIIAEVSPKRVKCTVAGYIQLISEKITKYQKTKILKLRLGFYFSTLFPFIAEQ

SEQ ID NO: 111500 - protein, 232 aa, Triticum aestivum
  Clone ID: PAT_TA_5918.pep
MAPRRFLLLLPVLLVLLGADGFGRGAGQNTDQFAYNGFASANLTLDGLAAVAPNGLLALSNGTSQAAGHAFHPTPLRMRNGAVQSFSVAFVFAIVSNFTVLSDNGMAFVVAPSTRLSTFNAGQYLGILNVTDNGKPDNGVFAVELDTMLNPEFQDMNSNHVGVDLNSLRSVQNHSAGWYDDATGVFNNLSLISRQPMQVWVDYDGATTRLDVTMAPLDVPRPKKPLIFAPVN

SEQ ID NO: 111501 - protein, 82 aa, Triticum aestivum
  Clone ID: PAT_TA_5919.pep
KGSTKPTCGCRMPQVPLLPNLNDNCLNYIGTLLDQKIRPSKMTKCTTLTSEILQSQCIQSFQVIVRTLRPSSIHHPCLCVVA

SEQ ID NO: 111502 - protein, 247 aa, Triticum aestivum
  unsure (1)..(247): unsure at all Xaa locations
  Clone ID: PAT_TA_5920.pep
AGIRHEGRVIGRSRSCRSLTGSTLLDEMEMEDCTPVNRSLVIFPGRPEEYQRRGSALNYDAGSETLSRXAGSEISASRGASKTGDAEFTGIGEFVAELKEMAQVHYQKQVGDQSANGKSIGLDPIMDGLQSPSRWPLEFEKKQQEIIELWHACSISLVRRTYFFLLFKGESADSIYMEVELRRLSFLRDTYSRGSTPSNVTVGSLSSSPVASAKKXQXESEXLXXXXXNXLSXXXXXPHXXXXSLYI

SEQ ID NO: 111503 - protein, 137 aa, Triticum aestivum
  unsure (1)..(137): unsure at all Xaa locations
  Clone ID: PAT_TA_5921.pep
SLGVAAPLAGRPPVRGVVDVAPVAQPVAXPGFCPRGLLGVALDWCEPFDTYPRTYDLLHAFGLFSKEQKRCNASIILLEMDRILRPGGRAYIRDKKETIVEIKEITDAMGWRSTIRDTAEGAYASRKVLMCDKPMVR

SEQ ID NO: 111504 - protein, 195 aa, Triticum aestivum
  unsure (1)..(195): unsure at all Xaa locations
  Clone ID: PAT_TA_5922.pep
MAAKRVLLLCGDYMEDYEAMVPFQSLQAYGVTVDAVCPGKKAGDACPTAVHKPIGHQTYAESKGHNFALNASFDEIDAAGYDGLVIPGGRAPEYLAMDEKVLALVRKFSDAKKPIASVCHGQLILAAAGVVRDRTCTAYPAVRPVXVAAGAKWVEADTMKKCVVDGNLVTAAAYDGHPEFISLFVKALGGSVAGA

SEQ ID NO: 111505 - protein, 317 aa, Triticum aestivum
  unsure (1)..(317): unsure at all Xaa locations
  Clone ID: PAT_TA_5923.pep
MGYEWIWCNAWMDRCNPRAPCCLDEKVLADAGVRQVRLTMTNAALHQYVMLSRVGHGGRTGPDPVRASRVLASLGCWWGQGPARQGSSVRRNWSSSAPCVALRGYRWLTMNACRGSCERTWRRLLHLCGDYMEYYEVMVPFXALQALGCHVDAVCPDKXPGDKCPTAIHDFEGDQTYSEKPGHDFALNASFDGVDASSYDALVIPGGRAPEYLALNEKVLSLAKGFMDKGKPVASICHGQQILAAAGVLQGRKCTAYPAVKLNVVLGGGTWLEPDPIQGRFPRCFTDGNLVTGAAWPAHPEFVAQLMALLGIKVSFA

SEQ ID NO: 111506 - protein, 185 aa, Triticum aestivum
  unsure (1)..(185): unsure at all Xaa locations
  Clone ID: PAT_TA_5924.pep
MYHHQQQLQSHNQLLASRQTFPSERHLLLQGGIIPGESGLILSTDAKPRLKWTPELHDRFVEAVNQLGGPDKATPKTIMRLMGVPGLTLYHLKSHLQKYRLSKNLHVQANVGNSRTAAGCTIATEKQSEGNGSPVGHHLNTQTNKSMHIXGEALQMQIEVQRRLHEQLEVQRHLQLRIEAQGSTY

SEQ ID NO: 111507 - protein, 267 aa, Triticum aestivum
  unsure (1)..(267): unsure at all Xaa locations
  Clone ID: PAT_TA_5925.pep
MREQCRSMEEAISFRREAQLGLVGSLQHLVPDLVPSLDRSLRLIADFNDRPFTPTPNPNAGDPQNPSLKPHHRRTVPDPTRSTRRKTSPGSSPASAAVGGAAPGGLDAVRTMVAVSLLELIPFAEIDAAVLARRLQAESSSASDAERAALADLATELGGSVPAAVALALRRIAXXSGGVQIEEAMIGGKQMMMVWAIDRSKLLKELPESATLLSPQPPPIPQATSSETDANTAIIPRPPPPHQQQQPDMWAHSMPPMFPRPRGMTMA

SEQ ID NO: 111508 - protein, 135 aa, Triticum aestivum
  Clone ID: PAT_TA_5926.pep
PPDTRRDRRRPLLPNHYAPHHVAPLLPGAPLRPAASSPDSSVLVVTPCLAAPAAPVVTLNFRPQSLDPRSINLAERDTESSVRGSRFCAAQNSPRRRRRLLPKTTRRSTSAISSGVLDFSPVPAAPILGDPVVIA

SEQ ID NO: 111509 - protein, 260 aa, Triticum aestivum
  Clone ID: PAT_TA_5927.pep
RSAGVGKTELAKALAEQLFDSQKMLVRFYMSEFVDRGSVLRLIGAPPSSNGHEDGGQLTEKIRRRPYSVILFDEVEKADPSVLNLFVQLLDDGVLTDGKGRTVDFKNTIIIMTSNLGAEHLTAGMAGNGTMEAARDLVMHQVQKHFKPELCNRMSEIVIFEPLSRDKLKEIVKIQMKRIVARVASKGICLSVSDAALEVVLSESYNPMYGARPVKRWLLKNVMTDLSEMLVNGQVVEGSSVSIDAADDRRLKFEVVKKVH

SEQ ID NO: 111510 - protein, 179 aa, Triticum aestivum
  Clone ID: PAT_TA_5928.pep
SSLVVIEFFPSSTNVFLFRSFLASDSSSCCAFFLMMLEACFTAASSYLDFHPGMAIWTTPKVAAMLTVSTEVQTRQDNVPTCIAASTGLRRAAASWLMMTPLSRDTSWASWRWSEMSAILTLEISRRISGGMSSRRLAWAVMERRRRRHGGGRRGRRPFRCGWLQPSRAAAEVGGGEEP

SEQ ID NO: 111511 - protein, 156 aa, Triticum aestivum
  Clone ID: PAT_TA_5929.pep
MDRGRSAGPGAVGSAGSLGLRIGQAACSSAALMFMSVGVEFFSYTAFCFLVTIMGLLVPWSCTLAMIDMYSILVGCPLHVPGVMAIVVVGDWVLSILSLAAASSSAAVIDVLLEFHGSHCAPRLCERYQLSAMMAFLSWLLTAASSLFNLWYIASR

SEQ ID NO: 111512 - protein, 155 aa, Triticum aestivum
  Clone ID: PAT_TA_5930.pep
LVDVPLDTALMTGEIFGPCFPIITVDKIEESIAHINAGAKPLAAYLFTKDKKLQQDFVSNVSAGGMLVNDVALHLTNPHLPFGGVGDSGTGSYHGKFSFDCFTHRKAVLIRGFGGEANARYPPYTAEKQRILRGLIKGSFFALILALLGFPREKR

SEQ ID NO: 111513 - protein, 230 aa, Triticum aestivum
  Clone ID: PAT_TA_5931.pep
IITTKAFVTELVDSLKRVLERFYGEDPLQSADLSRIVNISHFGRLTKLIDDKEVAAKIQLGGQTDQEQLKIAPTVLVDVPLDTALMTGEIFGPLLPIITVDKIEESIAHINAGAKPLAAYLFTKDKKLQQDFVSNVSAGGMLVNDVALHLTNPHLPFGGVGDSGTGSYHGKFSFDCFTHRKAVLIRGFGGEANARYPPYTAEKQRILRGLIKGSFFALILALLGFPREKR

SEQ ID NO: 111514 - protein, 475 aa, Triticum aestivum
  unsure (1)..(475): unsure at all Xaa locations
  Clone ID: PAT_TA_5932.pep
WRSCGAGFREGRTRPAEWRTAQLRALVRMIEEKEDDIXDALHADLAKPRMEAYLHEISLAKGACMFALKXLKNWMKPDKVPSAITTFPSTAQIVPEPLGVVLVISAWNYPFLLSIXPVIGAIAAGNAVVLKPSELAPATSSLFAKLLPEYVDSSCIKVVEGGVTETGALLQQKWDKIFYTRNGNVARVVLAAAAKPLTPGALELWGKCRVIVHSNVALYFADKRIAVGKWGCXHGQACIPLHYNNTTTTFXPNWIYSTIRGLDRLGGKDRMQSDLLSSLGXVLISSINQLTXIDKKEVTSNIQLAGQIRQKQEKITPAPSVFVPLDTELMTREILVPMPMLPIITVDRSKETHXTNAGGGQMAAYLFTKDKKLQQDFVSNVSAGGMLVNDVALHLTNPHLPFGGVGDSGTGSYHGKFSFDCFTHRKAVLIRGFGGEANARYPPYTAEKQRILRGLIKGSFFALILALLGFPREKR

SEQ ID NO: 111515 - protein, 215 aa, Triticum aestivum
  Clone ID: PAT_TA_5933.pep
LATIHGDNLARMVNSSPDAEARARGADSWPVLEHLAQDRHAARDGFAAASFELPQETLSAGDEFSASSLAPAAAAATGDEPPPEEAPPIEKDPFAASDMVVSKPEEALVGAFKKNKETALVVADPAAALAGLEVTTLPPAEATKPTFIGVEGFEGDYGGIEFGNEEASLAEAFEGFNAPFGGGLDASEFVTTTKKDHKDKTPYWLEILMGGARHR

SEQ ID NO: 111516 - protein, 136 aa, Triticum aestivum
  unsure (1)..(136): unsure at all Xaa locations
  Clone ID: PAT_TA_5934.pep
GGRAPLFDAHGGGPDLXCDGALGEPFLYLGEKLIATSSLEKCAKRLHALALLLLVCFATHAQGSGTESGDAEAFACYKLDVFPSCNPKTSRCYCCTMDQCKTRYGTMDECQAHCVASPLGVNEPAAPSSSSSYVLP

SEQ ID NO: 111517 - protein, 428 aa, Triticum aestivum
  unsure (1)..(428): unsure at all Xaa locations
  Clone ID: PAT_TA_5935.pep
LVPLIPYEYVASRQGNDKLDRILRAXKPEEKKSMLVVSEFIGCSPSLSGPIRVNPWNIEAVAEAMECALVLPEKEKNLRHDKHYPYLEXNDVGSWAGSCQAKXSTTTKGECNRRSGGIEEHRALRXAKPQGVSKGLQWSTLLQAYRRSKTRPDFVLCIGDDRSDADMFNPNAKSVHILNSLCQDQRNAVLLCSGFKRCTLDEWYPAENLGMAAEHGYFMRLKRDXAEWETPTPPADCSWMQIAMPVMQLYTETTDGSIIXEERDTVLVWXNYEDADPDFGSCQAKELVDHLESVLTNEPVSVKSTVHSVEAKPQGVSKGLVARRMLAALQERGMCPDFVLCIGDDRSDEDMFQFITSASCADSFASTAEVFACTVGRKPSKAKYYLDDTAEVVRLMQGLAYVSEELALQNPALGEEDPEDLWCVGELQ

SEQ ID NO: 111518 - protein, 140 aa, Triticum aestivum
  Clone ID: PAT_TA_5936.pep
ELKQLQTHLEEINKLAHKQVRRILWSGLGFLITQVGLFFRLTFWEFSWDVMEPITFFTTATGLVVGYAYFLITSRDPTYRDFMERMFQSRQRKLIQRQKFNLDRYLELQRCCKDPLEKICGTSHFSNADIAHLHELSVHK

SEQ ID NO: 111519 - protein, 105 aa, Triticum aestivum
  Clone ID: PAT_TA_5937.pep
FFLTLLFFVSATFFQPSPSMPRFIVVHSQATLPHITTELQSEASIYAALTCSMGAAPAIQSRLLPCPWGAAPAIHSVCSRVHGLRIYTQTRAMVPLQIQQLHSPY

SEQ ID NO: 111520 - protein, 170 aa, Triticum aestivum
  Clone ID: PAT_TA_5938.pep
TLFIVSLASVVILASFLSRKLAPSSKSRRPPGPWRLPLIGNLHQIVGAQPPVVLRDLAKKHGPVMYLRLGQVDTVVVSSRSAAEELLREKDLSFASRPNLLVAEIIFYGNIDIAMTPYGPYWRTLRKICTVELLSERKVRHFSPVRDSETMSLVRNVREAAAASGGNPFN

SEQ ID NO: 111521 - protein, 167 aa, Triticum aestivum
  Clone ID: PAT_TA_5939.pep
TTPRPPTAPPTRTTNSAPWSSRSPCSSPARLASPTCLPGPPAPASPRSLSSSPPTAASSFSPWPGAPSSGRAPYAASSIPSEAPAVRPPRRSSSARSPTASPCSASPAPWAPLLMPHAGKNFQPAESQVSPWWKIGARIDGDAARSEKHAFYLILHASTYTSTISKK

SEQ ID NO: 111522 - protein, 506 aa, Triticum aestivum
  Clone ID: PAT_TA_5940.pep
MDRLVAAGILGFLLIASVGSHAHAARAPEQYWKSALPNTPMPSSLSQLLNNQAGGTSVNVGWGGVHVDAGHGMPGGTTVDVGKGGVGVNVKPGSAKPGGTTVGVGKGGVGVNVKPGYGKPGGTTVGVGKGGVDVNVKPGSGKPSGTTVGVGKGGVGVNVKPGYGKPGGTTVGVGKGGVGVNVKPGGGTTVGVGKGGAGVNVKPAYGKPGGTGTTVGVGKGGVGVNVKPGYGKPGGTTVGVGKGGVGVNVKPGYGKPGGKPRGKPVHVNVSPFIYNYAATETQLHDDPSAALFFLEKDLHAGKKMNVHFMATPGAGEKFLPRSEADAIPFSSEKVPEILSRFSVAPDSAEAAEMKQTLRECEATAANGEKKSCATSLESMVDFATSSLGTSHVRAVSTVVGKEGSPEQEYTMAGVRRAAGADQLVACHAEPYAYAVFACHLTQATRAYTVSMVGKDGTAVEAVAVCHANTAGWNPRHVAFQVLKVKPGGAPVCHFLPQDHVVWTRSG

SEQ ID NO: 111523 - protein, 117 aa, Triticum aestivum
  unsure (1)..(117): unsure at all Xaa locations
  Clone ID: PAT_TA_5941.pep
MLLAVEGGGFFSSSASGYSHGLALLLLGRRTEEQPVRASSWNHYRLVDRDAGHGGQLPPTKDDVPGKCASFTCFXCTPAXLEGASPPKLSSSNTRQQLSSSTXRKGTXQWFLKRKRE

SEQ ID NO: 111524 - protein, 273 aa, Triticum aestivum
  Clone ID: PAT_TA_5942.pep
DGLPWYVGSRNPHPPGSLGPPPSPRPRPEHHPLCGAGSGLCVSGCGVLGVLLPGSSSEFVRCNGRRYFSNPQYYFHVNDQYVRNKLKVILFPFLHRGHWTRISEPVGGRLSYKPPMYDINAPDLYIPFMAFGTFIILAGFTLGFMGKFTPEAINLQFTRGLIGWGLQIVFLKGLLYSMGGGEVPLLDLVAYSGYLFAGLSLAIVARLLWAYSYYVMMPWMSLCMGIFLVRTMKRVIFTEMRGSERHSTRQHYFLLFMAIVQFPLFFWLGSIGA

SEQ ID NO: 111525 - protein, 300 aa, Triticum aestivum
  Clone ID: PAT_TA_5943.pep
MRGPGSARAGGSPVGVPVLVLLRPDSAIGHRMPPGPRAVGDGRRWQATELAVSGLSRRVVPGLAPDQFKAEVRIMKRLRHPNVVLFMGAITRVPNLSIVTEFLPRGSLFRLIHRPNNLLDEKRRLRMALDVARGMNYLHNCTPVIVHRDLKSPNLLVDKNWVVKVCDFGLSRMKNNTFLSSRSTAGTAEWMAPEVLRNEPSDEKCDVFSYGVILWELCTLQQPWEGMNAMQVVGAVGFQSRRLDIPDNVDPAVAEIITRCWQTDPRARPSFAEIMAALKPLLKPLPANQAPRQRVQQAEG

SEQ ID NO: 111526 - protein, 90 aa, Triticum aestivum
  Clone ID: PAT_TA_5944.pep
RTSWMQFYHFVQNTWIASISDQQDHTSRVVLIIWFIGTIIIVRVLLIIRAQLHIFFLDLDVAPGEQIDADLVHQPDFVSILPVLDLTMLI

SEQ ID NO: 111527 - protein, 151 aa, Triticum aestivum
  Clone ID: PAT_TA_5945.pep
CALSCLPAPPGQIHPRPGRIRLAPRWTRQATRILPPSFISTRRHHQRTGSSSYLTLGRKEGSSSQDRAPPPSTRGRVLASALSCDLSGRRCTRRPTSLVLLIVLSGGGAMAEPYSGRLHSGSAPALTVRVVAAAVQFNCPVVCSPEFLLCL

SEQ ID NO: 111528 - protein, 583 aa, Triticum aestivum
  unsure (1)..(583): unsure at all Xaa locations
  Clone ID: PAT_TA_5946.pep
MAGGITCGSLLQKLQLVWDEVGESDEDRDKVLYQLDQECLDVYKRKVEQATNSRDPLIQALEDSKIEPARLDGCTGDSSVGRVXVKLMGEXKKHITDSAPTVGCLSTNTKERKKEFVSVQSGIFQMCGQIAGTTEVGLQAPQRSVSRGEHHRSTMMILRSQRHEDVREQLHGLEKDLRNMRVVHHLYTILGHDLFTAVGKDFPSPVTSIDDSLNDTSDDNLSRLGDEVFTLLEDTVLRLSKLKKFAVQLXITLLRLMGAPLLAPGMLGHVTCDXSASVVVFTAPXDLALDLIEQAETEVQRLDQLKYSKMKEIAFKKQTELEDIYAGAHTVIDTAAAHMKLLALIEAGNIEPTELIADMEDQIAKAKEEALSRKDILDKVEKWMSACEEESWLEDYNRDDNRYNSSRGAHLNLKRAEKARIAVSXVPALVESLVAKTRAWEESRGLSFMYDGVPLLAMLDEYVMLREEREEDKKRMKEQKRYVEQKLNTDHEGPFGSRVSPNRPATAKKIPGPKSNGTSMNGTPPSRRLSISGQQNGRSGGKDSKRDSMTKAVSSPGNGAAAAAAKEDASSHISGTDLAPTTP

SEQ ID NO: 111529 - protein, 323 aa, Triticum aestivum
  unsure (1)..(323): unsure at all Xaa locations
  Clone ID: PAT_TA_5947.pep
AAGRVLGFLNSRQVSLSFARKAAFEVHWYSFSNGQEWAAGNPNEVCARIGPSVSRRALYLFDQGWPVFLSEFRAPAPAAAASACRSAGTAXSVVTSPCRCLSADNSCDPESQWFKLASTTRSVAANSMLXGAACETRELEDSLALIGTGRTDIYNXEAAPYTVLFHPATGLCVKLRXNWSNMELGACADTEAWEYAPQQGRLALRDSPLMCLRAQGAGRPVRLGTPCDDDMSRWRLVSDSKLHVAVNTSSSSSSGSGSGMLCLDVGADGQSVVTNPCRCLSADNSCDPESQWFKLVSSTRSVAANGMLAELPVKLGSSKIRSL

SEQ ID NO: 111530 - protein, 458 aa, Triticum aestivum
  Clone ID: PAT_TA_5948.pep
GFVSPIPNPRSSDPAAASAIAAARDPLQGQARPGQACWPPSRVTASAVTTAASSSPEAAAPPGPDLPRRPAPPCSPLRPCSGCTHEFDLDKPPVLQEVADFFSGHGIEDFTFSRGRLSEWRCRAKLAVRGTPEKPLIGLYQEGTHTVQDIPDCRAHHPSINYAIKLLKQGISELSVQPFDEDAGTGELRYVQMTVTTYNTSIPVAQRYEQARVQVSFVWNSRDERSKNSEKLSLLQEFLWTNGGPRSNLHVIHSIWANFQTSTSNIIFGHKWRHIGGEADLWERFGGVDICLDPYSFGQANTLSFNSLLHKLIKYVPRGATARPWYSGAGVIGLAIAASRKCRSVRCVEINKMSKLSFEKSASRLPPNLGCTITWHNTDASAEPIHWLEGSSVAIVDPPRKGLHPSVINALQRVALSERKAFKAKSSLTKVKDEKRPWILRAREPAVHVDSTCPGGRS

SEQ ID NO: 111531 - protein, 195 aa, Triticum aestivum
  unsure (1)..(195): unsure at all Xaa locations
  Clone ID: PAT_TA_5949.pep
RATARAAGQLPPPSPPSEVSRGRAVAARRTGSAVSVEFISWRGYRWPLQLAAAASRAPACRVRPRLPLDTAGHAPQQGHRGRQGNSPLKEESTYLVSEDDIASYEETSSEDTEDVKVCDVCGNVGEEKKLAVCSRCNDGAVHIYCMLVMLKEVPXRGWLCDECQAEVEIEIEKKKLEKSQVNFVMVSMENKVDAE

SEQ ID NO: 111532 - protein, 214 aa, Triticum aestivum
  unsure (1)..(214): unsure at all Xaa locations
  Clone ID: PAT_TA_5950.pep
FSAFGRPASVILVRRVVLQASLGAALAFGSEMSGGISDVHVDHLHIHGSSKGISFRTAPGRGGYIRDAIVSDVQMEDLRVAIEFTGDWSSHPDEHFDLSALPEISXITLKDMVGKNITFAGVSSGNGXEPFTNICLSNTNFSIADTAHSPSWACSNISGYSESVLPEACSDLHSQSSNSSICSSTLSPQCPCDSVPCTLRPIFLLSILLSSLPS

SEQ ID NO: 111533 - protein, 145 aa, Triticum aestivum
  Clone ID: PAT_TA_5951.pep
ARRRAAHAISAGVAHRSPARAPARSRSGPRCPPPPPELARPHTDIDEQPPAPSTQAAAAAQSWPPPRHAVLQNGPPPSRGSAPRQPAARRGKKPRRRRRWPGFARRREPAAARRGGRNGGLEEAGARVRLAARGSGRDERVSSNG

SEQ ID NO: 111534 - protein, 75 aa, Triticum aestivum
  Clone ID: PAT_TA_5952.pep
GRSMSAIWASGRKTRLARAVDMLPPGPLHARLTRPGPFSEGCAGFLFIGGVWDVLDIPLLYDLRSLYCSFLKCYG

SEQ ID NO: 111535 - protein, 61 aa, Triticum aestivum
  Clone ID: PAT_TA_5953.pep
MRAHILACRRISMSCRTDRYHSDNILCEHPRTSLHSPMIISLRKSRLVNKKHTCGEHHFKR

SEQ ID NO: 111536 - protein, 134 aa, Triticum aestivum
  Clone ID: PAT_TA_5954.pep
DQLTTELDWTEGKEILLMSGNVRVKQREALMEAFNDMNSEAKVMLASTKACCEGITLVGASRVVLLDVVWNPSVGRQAIGRAYRIGQEKIVYTYNLIAEGTKEKVKYDRQATKDHMSKLLVSNEPQPTGSNLSP

SEQ ID NO: 111537 - protein, 224 aa, Triticum aestivum
  unsure (1)..(224): unsure at all Xaa locations
  Clone ID: PAT_TA_5955.pep
TKVFWDFFKSCAFGSTSSCNNQESLELEHIGKDIVPKLKGSPLAAKTIGRLLRMELSTTHWEXIKESELWKLKQTDTDILPALRLSYMYLPQKLKRCFSICAMFPKDHKFGKDFLADIWIAQGYVXEGPQESSMCFDALANRSFFQKPSPQSLKYAIHDLMHDTAQLVSKDECFIIKHASDLDKVPSNVRHLSIFTNGNVQCSELKSICDKKNLRSLVCDESYS

SEQ ID NO: 111538 - protein, 230 aa, Triticum aestivum
  Clone ID: PAT_TA_5956.pep
PRVRPRVRADVDNGHASSSKESSNGFDDLDCKETPPEWEDHALFSKGVEVQQQQQSAQQENELSFTVRPRERKALSVQQLSSEFYANGAGTEGIDAYGCKDMQEVKGIFLEGHCGLPENLDTEVDQLAWEHSSLLLQGLDYESYSEAKLIDMVKGLSERIETMEKKQIISNKEVKCLQGVNDRLLKRVVELKNTVKNLNSKIDPLSLDDSLNQFVEECLGSEDVIYLIGG

SEQ ID NO: 111539 - protein, 195 aa, Triticum aestivum
  Clone ID: PAT_TA_5957.pep
RLRAPARLRRAAPPSPSAPPGLLAFGTSNGHTLGGEQDAYTVSWDDKRAATKVLLSKVFLQNRVESLRPYKAHADKYICSLVPGAGGFQSQYTPGGLLFTERDSNMEYVTSTAFLLLTYAKYLSSTGGAVSCGSTAVTPSTLVSLAKKQVDYILGANPAGMSYMVGFGARYPRRVHHRGASMPSVHDHPARIGCD

SEQ ID NO: 111540 - protein, 128 aa, Triticum aestivum
  unsure (1)..(128): unsure at all Xaa locations
  Clone ID: PAT_TA_5958.pep
PAPATPAAAYGCAACGADLNLSASNLYPAGTYFEAGNKGTLSFSWVDESRLRFAAEDRIRPFFEALDYWGIQRKRTRVSCDACGRLLGHVYDDGPPLMDGTGQLGMGPXQVVPRRPRYRFKVKAVTAA

SEQ ID NO: 111541 - protein, 547 aa, Triticum aestivum
  unsure (1)..(547): unsure at all Xaa locations
  Clone ID: PAT_TA_5959.pep
MAATAVVGAASRSPLLLHHHRLPQVPAGGGGSLRVGALGAGRDWRRRVRVRVGVRVFARYSSQPQDFSSRLQDRAGELPKLVEDLLQTSISTGPRGAFRMAQGIQALLGVGGEWLNDFSKTANTSEGIPAQMRLGLLSPLYLRRLFERMGATYIKLGQFIASAPTSFPAEYVEEFQNCFDRAPPVPYSEIESILREELQRPLDSVYEYIDPVPIASASIAQVHGARLKSSQKDVVIKVLKPGIEDTLVADLNFIYLVARVLEFLSPELERTSLVAIIKDIKESMLEEVDFRKEAVNMEAFQRYIEAMGFDRQAKSPFVYQHCSTKRVLTMERLYGVSLTDLDSIRSLVPDPELTLVTALNVWFGSLDLMXSFHADVHAGNLWLLRDGRVGFIDFGIVGRISPRTWAAMEIFLASFATEDYNAMASALSEMGATGNDLDVDSFAKDLQNIFSSLQELDTEIIVAAARSSDAAAVSANVVVDERQMNALFLDLVRVSESYGLKFPREFALLMKQLLYFDRYTRLLAPSMNMLRDERINITSNKHTRTMN

SEQ ID NO: 111542 - protein, 202 aa, Triticum aestivum
  Clone ID: PAT_TA_5960.pep
TPSYHSLHHTQFRTNYSLFMPFYDYIYNTMDKSTDELYERTLIGKEETPDVVHLTHMTTPESTYHLRVGIASVASRPSDNHVWYMWMIWPMAWLSMVLAWVYGSSAFVVESLKLKKIMMQTWLIPRYNFQYSLIRERESINRLIEQAISDADQRGVKVLSLGLFNQERQLNGSGELFTQKYPKLRVRLVDGSGLATAVVLKS

SEQ ID NO: 111543 - protein, 216 aa, Triticum aestivum
  Clone ID: PAT_TA_5961.pep
STPRPCDSRASRFLDSELKKDNERLRRLYTETLFKFTNQIKYHTEAQGLKEELGKANSRLLSMEEEHKREIEQLKHDNEMNCNALESKRSCALVQQAADEAAIKQLKLDLGAHKAHIDMLGSKLEQVTAEVHMKYKNDIQDLHDVIMVEQEEKDDTQRKLKTAENELRILKMKHAEQQRDSVSVQHVESLKQKVMKLRKENESLKRRLASSELDCS

SEQ ID NO: 111544 - protein, 237 aa, Triticum aestivum
  unsure (1)..(237): unsure at all Xaa locations
  Clone ID: PAT_TA_5962.pep
RDSLKLLEADIQHANSIASEFRREYDGACLQMRMSYCPAAHLFLFLVQWTDCNLAXALGLLRILIYKVYADGTTTMSTHERKASIREFYAVIYPSLAQLHEGINEVEDRKQKAICIERYRRREEDHKRVISEIDDNIEEECGICMEINNKVVLPTCSHAMCIKCYRDWRSRSQSCPFCRASLRSVDPAALGLDTDTRFLVDMATVRRENLRRLFMYIDKLPTVIPESVFEVYDSHVK

SEQ ID NO: 111545 - protein, 164 aa, Triticum aestivum
  Clone ID: PAT_TA_5963.pep
GYIQVCTYRGAGREVSILLDSREIGDNELCDRLTWTKRERCNAADFHLAVCDPLSSRYVLLPTIPEDLAAQPQECLWDFQAVLAPNTTDDGEEQPFKVICVARYTTKLVLFVLPSTTMQWSMLEPPIFPSLEHMSCFDCVRGCFYWTQPAGWSDHLMVLDTLTM

SEQ ID NO: 111546 - protein, 91 aa, Triticum aestivum
  Clone ID: PAT_TA_5964.pep
FFFLRLGKSDNPACIMTQHFIPASHRWMEPHNREHACTLSSQLSAPTTSASIMAARSSSFLIAIAVDPLFTPALAVGLQCRGVRSVMGMGA

SEQ ID NO: 111547 - protein, 81 aa, Triticum aestivum
  Clone ID: PAT_TA_5965.pep
FRSTAPEAKRARAGRGGEAAARGGAGCLAEADSRREAAMCTVSMVFLLEERVTSMTRAGKWWTRRVHAYVWGGHRALPPGL

SEQ ID NO: 111548 - protein, 193 aa, Triticum aestivum
  Clone ID: PAT_TA_5966.pep
NSVRLWVLCSGRSHRLLVCEYVENGSLASILFGDKSIILLDWKQRFNIALGVAKGLAYLHHECLEWVIHCDVKPENILLDQNFEPKITDFGLAKLLNRGGSNQNTSHVRGTTGYIAPEWISGRPITSKVDPYSYGVVLLELLSGSRVSELTVGSDAEVDMVIRKLVTMLADKLEGNDESWIEEFVDCKLGGQF

SEQ ID NO: 111549 - protein, 149 aa, Triticum aestivum
  Clone ID: PAT_TA_5967.pep
MPLVAAARLKREDCPRTKHDSLFSPWKVLVGPSDWEDHSAGKEGVQRYHTRNLPDNFPGLYELGVARPSYDGVRARRNRSVVVVVVYLGQADSVRARLQQYGRTGSHLDAGNPLAAVGKAEVNALTAGPGLFREVFSRGYSVMFRCALM

SEQ ID NO: 111550 - protein, 191 aa, Triticum aestivum
  Clone ID: PAT_TA_5968.pep
MSVDPEARNKQELTAHVLSPQHVEENLAATTDGQIDETIRLKTIRTRSPVEAAPVNSASQKVNEAPIPNDEMTIGVVQEHRKGVKTESCQGVKQGMGDVDVVTEESSPVSTLKLGNAGSAPAEFDHLNIVQQRADALESLLEICAKLLEQERLDELAGVLRPFGEGAVSSRETAIWLTKSLMTPPKLGGSP

SEQ ID NO: 111551 - protein, 217 aa, Triticum aestivum
  Clone ID: PAT_TA_5969.pep
GPVVLVVPDACCGALIGKGGEVIKSLAEESNAGITVSPYDICYGFHDRLVTITGHLDNQLQAIFLILSELLDDVRYSSSVASLSFPSSSVRYGGDGQDEHVERYHSRPDTPVRSPDYDSHVQGTLTMGVADEYVGAVIGYGGRTIQEIERVTGVQIKIVKGEFIPGTNEREVVISGTREAVDAAEAMIMQRVSDATKGRRRQQGGGGGDRRPVKEVE

SEQ ID NO: 111552 - protein, 135 aa, Triticum aestivum
  Clone ID: PAT_TA_5970.pep
SAARPARRPTSSTGPPPTPRRGRPPAGRPPRPCRPAASVPRSPCPSPAPPGPPPRAARPCARPRARKDPVAPPLVPCSSAGPVSPRPRGRPMPGAPWAPCRAAPTTTSCRCSELLFATLLQDLAAYMTWLYASSQ

SEQ ID NO: 111553 - protein, 317 aa, Triticum aestivum
  unsure (1)..(317): unsure at all Xaa locations
  Clone ID: PAT_TA_5971.pep
PRVRPRVRPRGRPRVRGRVGLGAIALCLLCHALHTEGVRLRSTIQELKEDGQTKRILTSLKSNSIEMTAFGEDSSSWGQPYYAVHQTTSGGPGDNYYGLHVTTDVYSHNLKPGQQTSTAIWVNHVGNGVKSSLNTISIGWHIYPEHYGDSHPHLYTDWTRDGYAQTGCLNMDCPGFIRANGAVIAPGDVIHPVSGVPGGRVQNITLRLLKDKXKRRLVGILRLERHPHGAEKANHVAFGAFVDAEKALPTPPMGSGVLPNGGKGHAASFTNLQLIDKDGNNSPIKANLPELITKAKCHSITHIDHSQCLYGGPGGCV

SEQ ID NO: 111554 - protein, 257 aa, Triticum aestivum
  Clone ID: PAT_TA_5972.pep
MCPVARHHAIFNNDKSGSEENSDGGLLFSWAMHQVSNHLTTLQVMLPNITEGGSLSNMLENCMYCAMGLGLVGLDFRCLLPPIFENAVLNLFSKNMSTAVENFQVVLDSHRWVPMPSIGFVTNGAVDDTSDDVTPPSVLMEHPPRAVSVGAVAAASDELTPPAPLSVQPPLALVVVGGSPAVSDPLPCAPASRMHRPAEPPRSLSLCQAFIEVAYPYCAACFGRCYPNGGALITECPQLIGCCQPTTYKIRFGDQQH

SEQ ID NO: 111555 - protein, 156 aa, Triticum aestivum
  Clone ID: PAT_TA_5973.pep
VFGFTGNPCVNYCDNCVCNFLSLFSSPSRSLIVPKSSPLDAMIYQRRGTCFLVITVMLLLLPLMASYPCVATAHDPLRHAPGGDIGVWGRSDGPHHEGEKVFGMGAARRLGQRKPMKNPPSPVPNENMGVVLPLTPPPPSLINKQVLEVRDTSMPW

SEQ ID NO: 111556 - protein, 163 aa, Triticum aestivum
  Clone ID: PAT_TA_5974.pep
VDPRVRGRVGGDDILQEVFILLPTPADLLRAALACQPFLRVARSAAFLRRFRRRHPSTCPVVLGCLLYRPSKRRGASAPYLLPADLLGATRRTIEGGDFALSFLPRRGRPDGPGTPWRILDCRNGSLLLRDGASGELAVADPLTRRWVSLPALPGGRRVGYAL

SEQ ID NO: 111557 - protein, 202 aa, Triticum aestivum
  Clone ID: PAT_TA_5975.pep
MATNRFLCEICGKGFQRDQNLQLHRRGHNLPWKLKQRGSKEVVRKKVYICPEASCVHHDPSRALGDLTGIKKHFFRKHGEKKWKCDKCSKKYAVQSDWKAHSKICGTREYKCDCGTVFSRRDSFITHRAFCDALTEESNKGISGGGLPPPPTAQAQQHAMLYSPATILDASKQQATKEPRRRFEPINQSTKGPWQQAIANRR

SEQ ID NO: 111558 - protein, 144 aa, Triticum aestivum
  Clone ID: PAT_TA_5976.pep
TRPPPSSPLRIVAGHRSPSRSHSGSPPCSSSCSPALASSPSFPTACFLSFLSHPEVKRVVFYAPVKSFWAAELVWAPTPDPRARTLDLGDGAAWTEWSGDGVEQRSGPGEGCLAGCGRPGWGCASMRRPHRDQEAGVGDAAAHR

SEQ ID NO: 111559 - protein, 222 aa, Triticum aestivum
  Clone ID: PAT_TA_5977.pep
MTLIELLPDYARIVDDGLYRAIDIYLKAHPSLMESECKKLCKLIDCQKLSQDASSHAAQNDRLPMQMVVRVLYFEQLRLKSSFSGGHSGGGGEYCSFSQRITMPISGSGVPSSCVSPRAAGAADSYASLRRENRELKLEVSRMRVRLTELEREQGMMKQGMRDGRPGEHGRAFFASISRGIGRMAMFGPAGERRKKSSRATASSQCSEGKSRRRKKPSVTYA

SEQ ID NO: 111560 - protein, 284 aa, Triticum aestivum
  unsure (1)..(284): unsure at all Xaa locations
  Clone ID: PAT_TA_5978.pep
TIITYMTDGVLLRETLKXADLDKYRVIVMDEAHERSLNTDVLFGILKKVVARRRDFKLIVTSATLNADKFSKFFGGVPVFNIPGRTFPVNILFSKTPCEDYVEAAVKQAMTIHITSGPGDILIFMTGQEEIEATCYALAERMEQLISSSTKNVPKLSILPIYSQLPADLQAKIFQKAEEGTRKCIVATNIAETSLTVDGIFYVIDTGYGKMKVYNPRMGMDALQVFPCSRAAADXRAGRAGRTXPGTCYRXFTKSTYQNEMLPNPAKRFKGLNLGKGGSPYWSP

SEQ ID NO: 111561 - protein, 89 aa, Triticum aestivum
  Clone ID: PAT_TA_5979.pep
AIGMKSRRPSNRGQIIQSQLSSRVLRPLAAESFLQEFHYPASHDIVHFNNYTFHEHNSFQSIQFKSLTLKICFLQREPINLSAASSLSY

SEQ ID NO: 111562 - protein, 320 aa, Triticum aestivum
  Clone ID: PAT_TA_5980.pep
MARASTRLPPFLLLLAATCAAVANAQLSENYYGSSCPAALLTIRTTVATAVLLDRRMGASLLRLYFHDCFVQGCDASVLLDDTPSFTGEKGAGPNAGSLRGFEVIDRIKLLLELICPRTVSCADILGVAAHDAVVDLGGPSWTVLLGRRDATTASASLANSDLPGPNSNLNDLLAAFSKKGLSSTDMVALSGGHTIGRAQCQNYRNRIYADTDIDGTFTASLRGDCPQGGGNDGNLAPLDASSPDYFDNSYFSGLLSHRGLLHSDQALYDGGSTDGLVSSYASNNDQFGSDFAAAMVKLGNLGVLTGAYGEIRVNCRAVN

SEQ ID NO: 111563 - protein, 265 aa, Triticum aestivum
  unsure (1)..(265): unsure at all Xaa locations
  Clone ID: PAT_TA_5981.pep
MEEQGGQAALGWAARDDSGVLSPYSFSRRVPKDDDEHYVVRVPGGLALDRTAPLLCAGVTVYSPMMRHGLNEPGKHLGVVGLGGLGHGAVKFGKAFGMKVTVISTSASKRQEAIESLGADEFLISRDEDQMKAATGTMDGIIDTVSAWHPITPLLALLKPLGQMVVVGAPSKPLELPAYAIVPGGKGVAGNNVGSVRDCQAMLEFAGKHGIGAEVEVIKMDYXQHGHGAAREERRPLPLRHRRRRQPRLCRLGMAAKVSIRAQPQ

SEQ ID NO: 111564 - protein, 126 aa, Triticum aestivum
  unsure (1)..(126): unsure at all Xaa locations
  Clone ID: PAT_TA_5982.pep
VRGEENSGISHNKRCLXKLEXGNISIGVKNVXVXKSGXPXDKVRDSIGHVFXGKGQXFGVTQKDPIRDNHRNKSCNRSSQPRCAXLSSPYRVIKDQCCDSWESVPTIISDRDSDLIGVRIPQTQDA

SEQ ID NO: 111565 - protein, 87 aa, Triticum aestivum
  Clone ID: PAT_TA_5983.pep
LLTLRGCTIVSPHAPSRRPAVAPPLPVFGSHRPSFHLQQGERHWKTCLEASEHHCWLHDRVKQRMNAPGGGVGSDTSITVNVCQGRS

SEQ ID NO: 111566 - protein, 184 aa, Triticum aestivum
  Clone ID: PAT_TA_5984.pep
MGFWEAFLNWLRSLFFKQEMELSLIGLQNAGKTSLVNVIATGGFSEDMIPTVGFNMRKVTKGNVTIKLWDLGGQPRFRSMWERYCRAVSAIVYVVDAADRENMAIAKSELHDLLSKPSLTGIPLLVIGNKIDKPEAFPKQSFTELMGLKAMTDREVACFMISCKNSTNIDSVIDWLVKHSKKKN

SEQ ID NO: 111567 - protein, 154 aa, Triticum aestivum
  Clone ID: PAT_TA_5985.pep
VPTTAKNHSLLILLVAASVVASSVTATSSTSPSSTAYELLEKYGFPRGILPEGVQDYALHPDGSFEVSLPGGCEINIGGFTLRYEGNVHGNIQSMLINALTGVSVKVAFQWVSINAVERHGDQLIFNATVISKSFPVNNFSRSPRCNRIPGIPK

SEQ ID NO: 111568 - protein, 333 aa, Triticum aestivum
  Clone ID: PAT_TA_5986.pep
MANLLSSAPIHASLPDCFVFPPDQRPPASSQAVSLPVIDLSRGRDEVRRAVLDAGKELGFFQVVNHGVSAEAIRDMEAVCAEFFRLPAEEKAAFYSEDTDKPNRLFSSTTYELGDEKYWRDCLRLACGSPVGDTKNNWPDKPKKLREVVEKFVEPTRGVGMELLRLLCEGMGLRPDYFEGDLTGGNVIINVNHYPPCPAPGLTLGLPPHCDRNLITLLLQSTVPGLQVSYKGDWINVESVPNAFVVNFGHLLEIATNGVLKSIEHRAMTNAALARTSVATFIMPAADIPIGPAEELVGEGNPPRYRTVTFDEFMRVYKTVGARRESVEKAFKL

SEQ ID NO: 111569 - protein, 218 aa, Triticum aestivum
  Clone ID: PAT_TA_5987.pep
CRFGTRHRNPPNFGRPKPWTEIDGCRRPPRSRRRRRCLATTTSCARSSSASASPPASSAPPSSPSGGSTTPPTRPSSAASATATRPASSAFSPATPGHRTSSCRFRSPRSSPPSHAVRPPPATAPSPPAHTSASCTAGTAASSPCSCTREHTGTPSSSRCSLGSPKRSSHRPRCPAISRRPAHTQGVFSQTFLTRGRGPRRQRHHLGESVDGLARSPC

SEQ ID NO: 111570 - protein, 145 aa, Triticum aestivum
  unsure (1)..(145): unsure at all Xaa locations
  Clone ID: PAT_TA_5988.pep
IIPLCLRTMEMGSELSKTVATFIVQKILLDDIGLRYVCATPERFYAVGSVLGNMVISLADQPSTRLLKHIIRCYLRLSDNPRACVALHNCLPDMLKDGTFNISLTDDPATRRWLQQLLHNVTVGGMGGPGMGGPXQPGLDHMMGI

SEQ ID NO: 111571 - protein, 292 aa, Triticum aestivum
  unsure (1)..(292): unsure at all Xaa locations
  Clone ID: PAT_TA_5989.pep
EDLGFSTGRPIAAYLIYRCLVHWRSFEEDRTTVFDRIIQKISAAIEARDSNEKLAYWLSNSCTLLLLLQRTLKTSGSAASARQRRRPSSLNSPKENQAPXHPERSVSDGRLVXGALTDISQVGAKYPALAFKQQLTALLEKVYGVIRHDLKKELSSLLGLCIQAPRTFVVSPRGTGPQGTDMAQQASMAHWQSIIKILTNSLNVLKSNYVPPFPGSASCSPQSISIPSNVQLFNISLLRRRLLNPVMGYVQSGWDELGWVPLGNKIAQPWDELNIFGKRHLFNTREHIPQKH

SEQ ID NO: 111572 - protein, 43 aa, Triticum aestivum
  Clone ID: PAT_TA_5990.pep
FFFFFFVTENCSRHWINLDTLRSCLAELITRLHVLSTIYARNW

SEQ ID NO: 111573 - protein, 190 aa, Triticum aestivum
  Clone ID: PAT_TA_5991.pep
MPVPASQSRTLSPRDHRISRRSSDRFSESETRSPRSRHSNVPSPSSVHDTTADISITSIRRETISTMPPPSKTPQRRSMGNTQSSPAPNRSTMSRRVASSPRERPSPRRQPSVELGEDSIISGYNDTNHSPAMSNRASAKNSPAQSVRSRRSSVKNSPATSSARKHATMKPNFTAVNDGPSERSSPRNQP

SEQ ID NO: 111574 - protein, 128 aa, Triticum aestivum
  Clone ID: PAT_TA_5992.pep
APPPGLLLLSPLVDLPPLTRPDDATSPHAAAAVAATQRPPTSRSPSNPDPPPVFLQYFSMIELAPNNDVLEKCIKDILSQIKPADDDLNKRLSAIKELEVSMQPVAALKGPRVCHCVTSDLWRQYGIC

SEQ ID NO: 111575 - protein, 191 aa, Triticum aestivum
  unsure (1)..(191): unsure at all Xaa locations
  Clone ID: PAT_TA_5993.pep
KKAAASSATCTPLWFSPRGVEACLLLAIALASGSSRGCASAWVVAHQSYRPPPGRFPLPVRWPDCSLPGARRFLCSLTYXVYVVGTTTMSTHERKASIREFYAVIFPSLMQLEHGISDSDDRRQRAACSERYRRXDEPEDSKRPVSEIDAEIEEECGICMELNSRVVLPNCSHDMCIKCYRQWRSRSQSCP

SEQ ID NO: 111576 - protein, 58 aa, Triticum aestivum
  Clone ID: PAT_TA_5994.pep
KNDLKNMQTFQQLNRMGVKVNNTLSSSTKSLCNKGHIRPVLHYSLRKISITNWSSSPG

SEQ ID NO: 111577 - protein, 210 aa, Triticum aestivum
  Clone ID: PAT_TA_5995.pep
MREAASPASALHLQVPGPASGSEAADGPACQPPLLVGSRWTPLPRGAQVSPASVPVGDPRPRRALNNCTACAGDFSPFNRRHHCRNCGDIFCDKCTQGRTPLTSDADSQPVRVCRRRLAPVSRCLSSAVEAPVPPVVLCREVPASGLLPPRELDKKSSSGSRSSEGSSGKRMREVACPICTVHLQVQVPASGSETIECGVCQHPFLVSSR

SEQ ID NO: 111578 - protein, 153 aa, Triticum aestivum
  Clone ID: PAT_TA_5996.pep
ASPPPSPPSRSSRPASSPTSSTSPSAARPPPRAWSPPSTCASPSPCSPSPPPGSAAPRAASPCASAPSASPAPSPRPPRPQPPWCSRSPRAPPRPPGWSPACCPPRRSSPTSPWRWAGPGPPPSASPRPTRGPPPRPARTPRRGWASSCASSP

SEQ ID NO: 111579 - protein, 134 aa, Triticum aestivum
  Clone ID: PAT_TA_5997.pep
IAGLTVGTVGTIVPWLFPSLFTNDLLVVQQMHKVLIPYFTALLVTPSVHSLEGTLLAGRDLRYLSQSMGACFSIGTFLLLLVRDKFSSLTLCWWVLVFFQWSRFGSALQRLVSPTGMLYNKNFNQPEHIKVKAT

SEQ ID NO: 111580 - protein, 184 aa, Triticum aestivum
  unsure (1)..(184): unsure at all Xaa locations
  Clone ID: PAT_TA_5998.pep
MAGAAASSLEGGGRVVDTYKKALTTAASVAAYAMLVRSMARELLPEELRAAVRWGAAFVRARLGAGDKERHTIVIRRHLDAGYNXEXLFEAARAYLATKIDPTAMRRLCLARTRYKEPDGSSSWSTLLCMDDGGSTTDTFDGVEFKWTSSRRRDKQEGGIRPANSVLPERGGHRTAQSRGQRRP

SEQ ID NO: 111581 - protein, 84 aa, Triticum aestivum
  Clone ID: PAT_TA_5999.pep
PRTSLKQQSTSKHARLTQPIDLHSCVDTSLLMTISRGLSPVSVEALTCHTIYFHEKSREEFLAERLRFINGYAIPDQRSLASLV

SEQ ID NO: 111582 - protein, 69 aa, Triticum aestivum
  Clone ID: PAT_TA_6000.pep
FMVHGPCGDYKVKCACMKDGLCSKRFPKDFNEKTSVDDRGFPIYHRRDLGYYVRNKGTVKLDNRWVVFI

SEQ ID NO: 111583 - protein, 293 aa, Triticum aestivum
  Clone ID: PAT_TA_6001.pep
MAPSPASASASASLAATPHRPAPRPRAPARLRLRSAAAGRNSGLSVSVGVRSVPGISVVNSQRRRMVAAAAATEMAPAARGEGGGKPFVDEMRAVAMRLHTKDQAREGEKEPQAPPVARWEPTVEGYLRFLVDSKLVFQTLEDIVDRAAVPWYAEFRNTGLERSEPLKKDLEWFTEQGHTIPEPTAAGTAYASYLEELSEKDPQAFICHFYNVYFAHTAGGRMIGKKVAEKILDKKELEFYKWEGTLSQLLQNVRITLNQVASSWSREEKDHCLEETEKSFAYSGDLLRQIFT

SEQ ID NO: 111584 - protein, 77 aa, Triticum aestivum
  Clone ID: PAT_TA_6002.pep
PPYVRSCLCAAGPLALYTSPTYPFVAKTIYTPPPPLARVSKYDSSLVCELCSYHSTLERKRERDYHSHGAQDLHVSM

SEQ ID NO: 111585 - protein, 210 aa, Triticum aestivum
  Clone ID: PAT_TA_6003.pep
AGGELEPFPQRLNAVPPRIARGFVPGFSVQTYQEDNKLWQKHVNAYKKTNDLLDTGRYRNIMDMNAGLGSFAAVLESPKLWVMNVVPFIADTSTLGVIYERGLIGMYQDWCEGFSTYPRTYDLIHANGVFSLYQNKCKFEDILLEMDRILRPEGAVIIRDTVDALVKVEKIANAMRWETTLADHEGGPRVPEKILFAVKQYWTADSKSRR

SEQ ID NO: 111586 - protein, 280 aa, Triticum aestivum
  unsure (1)..(280): unsure at all Xaa locations
  Clone ID: PAT_TA_6004.pep
ARGQCEEGEMPRSSRRRRHPCSTAVGPLNDDDLLREILLRLPPQPSSLPRASAVCRRWRLLLSDPGFSRRFRIHHRRNPPLLGFFVRNEGLPFLPSLDAPDRVSPGRFSCRRGDGDRFMSLGCRHGLVLVSSKPKNQILVWDPVTGDQHRLDVPPGVAIHAEKTPINGGGAXRASGDDARHFQVALTVADNDDLQHRRALACVYSSETGAWGELVSTQLPSRVPMSNVGTFVSTYKPAVLIGDSLYWRLAGNFAGILEFDLEKQSLAVIRVPVHILETLK

SEQ ID NO: 111587 - protein, 133 aa, Triticum aestivum
  Clone ID: PAT_TA_6005.pep
RHGHRPGAPLELETAYTPALRTQLFAKSEDLGIDANDLVDHDADDDYYYRTSPKNFQEEDGTRAAGSPATGAAYWATHRAELARVSELVSSEVPKSRLDAASVQPERRDVGADIENALLDALVLELVMDLGGC

SEQ ID NO: 111588 - protein, 205 aa, Triticum aestivum
  unsure (1)..(205): unsure at all Xaa locations
  Clone ID: PAT_TA_6006.pep
FTMTGPLNKTGGFGFAFPKXSPYVTDLSQAILKLTESDEMNMIERKWFGDPNDDGATQDGGPFTSNSLSFSSFWGLFLITGATSLLCCVVHLATFVAANRRELPPHLSWKDWLSSLFKLFDDKDPSSHTFRVKDDGGAVSVRNDAVASPPIAHSELGSPLSAPYTSEWSGTASPATGEIELAAGGQERHEVAPNPDGCGENGRGQ

SEQ ID NO: 111589 - protein, 76 aa, Triticum aestivum
  Clone ID: PAT_TA_6007.pep
ARGSPCPPSTDHGLAIFGGHPLSRSFAGLLRQRLARRRTPIMRGPFLYPCCTVQPATRPSFHGSRCVLHCFLALDP

SEQ ID NO: 111590 - protein, 112 aa, Triticum aestivum
  Clone ID: PAT_TA_6008.pep
MEHQGRGAGEKKGVVESITEKLPGGHGDHQQATGGTYGQQGHAGVTGENIKEKLPGGHGDHQHTTGMTGSETHATTATTDGNYGKSGHTGTDGTGENKSIMDKIKDKLPGQH

SEQ ID NO: 111591 - protein, 84 aa, Triticum aestivum
  Clone ID: PAT_TA_6009.pep
ATPSFGPPGCASRRPTRCSPRGCNDVDYGFGEPTYVFTLNDDVNIVPSVVYLKPPKPKQGIRLVLQCVEEPHAAVFTQELEKLA

SEQ ID NO: 111592 - protein, 110 aa, Triticum aestivum
  Clone ID: PAT_TA_6010.pep
YTSVYAHFIWRYNLNFLKQHTVPEGVTFGHLRQNLGDDGCSVTSSACLLWVIDRGSFGPISERSNSLSLPYTKQYDTRFQLQCRRSKNQATCQLQTNIIKLFGWICCGAA

SEQ ID NO: 111593 - protein, 222 aa, Triticum aestivum
  unsure (1)..(222): unsure at all Xaa locations
  Clone ID: PAT_TA_6011.pep
SASAIVAVLLALIILYIYTRKCASRPSRRSNRRREVTVFVDIGAPLTYETVVRAAGSFNASNCIGSGGFGATYKAEIAPGILVAIKRLAXGXXQGIQQFQAEXKXLGRCRHDNLVTLIGYHLSDSEMFLIYNFLPGGNLERFIQERAKRPIDWRMLHKIALDVARALAYLHDNCVPRFLHRDVKPSNILLDNEYTAYLSDFGLARLLGNSETHATTGVAGTF

SEQ ID NO: 111594 - protein, 261 aa, Triticum aestivum
  Clone ID: PAT_TA_6012.pep
RERPVRVESEQPFPARSPIFSDGVAGRSREGRGTRSSLVYSASSFRWYSAHVAYGGMPMWIAPPPWASSGRWLTAVVFMVVLTGGQSLPSSASSATPPISSPGSLFWRCSASSPASMVAVVVELKQGKDGGPDRVCAHPRWLLVNGYGAGHGAWLPAVSSMPSDLLAEGRPYFFLPAMEPIGRQCFFNMESAARCRGGFATPSGVVPGGGKVAFVMKVLGTRSRFSFGCGGPLCKMQGPVCYLGLVRGPFAYCCVPPLFYY

SEQ ID NO: 111595 - protein, 213 aa, Triticum aestivum
  unsure (1)..(213): unsure at all Xaa locations
  Clone ID: PAT_TA_6013.pep
DVYTCIEQNRLNXIRNNQGKLRTELYSGLQDAIERGDTRTEQVGKRIIVPSSFTGGRRYKAQNLQDAFAICRWAGYPDLFITFTCNAKWPEIQYMLDEAGGGLNPADRPDIVDRVFMIKLKELMRDILXKKHFGETIAIIYTIEFQKRGLPHAHILIFLKDKDKYLEPSQIDKIISAEIPNKDEDPKSFEAVENFMMHXPCGEAKKNSPCMVD

SEQ ID NO: 111596 - protein, 306 aa, Triticum aestivum
  unsure (1)..(306): unsure at all Xaa locations
  Clone ID: PAT_TA_6014.pep
PGVAASASSAPRRRGRRRRPRSTPSRPCCPHPVRGLGQWFSRKEGGGAWGGRHFWLPLLVLVGTPHRGAGAATCSGARGRRPAPALCLLFRRGTRCPSPSATRSGVPGWFPAAPAPALGKEFCHARAPKMMLDLHSDGSHMVDGNWXALGKLLIYCNGCTKGGLFGNIHVPGHFVFRTRFSRTAGKSFLPLQCRMDVLYVSDPCEHLDQGEEGDLGFFRGIFKSFATSRVKKILIEKQARFHPTEVCPYCKAKLWNMLHADMMPASASARLGAYDDSVEYFVCLNGHVIGLGTLLPLSDSEEAPEE

SEQ ID NO: 111597 - protein, 241 aa, Triticum aestivum
  Clone ID: PAT_TA_6015.pep
PPAPPSSSPSASPASYQDMVRPFEDDYLCPAWFAPGGVRATHSKDGSTKRSSKDRSCSPFYIPGLRTADVAVVEEYLRSVNIMPVFLDIKMPRKSVFTLRETFYVLYGGTPVKELSELVCYRLNLEEGRPMQFLMNGDLLAEATTVSAIYEKHLLSDNLATLQCYIDKKKFVPRSFNVDKSVKVPIVEPVYVNEEYIPFPPFRIRNIRDAKKAAADARSGSYGNATISHGSYSEEGHLQFY

SEQ ID NO: 111598 - protein, 166 aa, Triticum aestivum
  Clone ID: PAT_TA_6016.pep
GVFGFGAVILEIVSGRPRAGCGAAGCSQLLEAVWQLHGAGEGRILEAVDRRLAPGEFDEGDAERLLLLGLACTHPNPGERPRARAIVQILARSAPPPDVPASKPAFMWPALPVVLGDDDGEMAVSGTSTALTSSSSYYASSAGWTTQNYWLTKGTRLGGQGHHGVS

SEQ ID NO: 111599 - protein, 340 aa, Triticum aestivum
  unsure (1)..(340): unsure at all Xaa locations
  Clone ID: PAT_TA_6017.pep
MLLTKPHPALTLPSASLPNPNLNAARVRPLASSAPHGRRGLRVSASSSPXAPAQAASAALNRVDVLSEALPFIQRFKGKTVVVKYGGAAMKSPELQASVIRDLVLLSCVGLRPVLVHGGGPEINSWLQRVGVEPQFRNGLRVTDALTMEVVEMVLVGKVNKQLVSLISLAGATAVGLCGKDARLLTARPSPDAAALGFVGEVTRVDPSVLRPIIASGHIPVIATVAADETGQAYNINADTAAGEIAAAIGAEKLLLITDVSGILADRDDPGSLVKEIDIAGVRRMVAEGKVGGGMIPKVECCVRALAQGVHTASIIDGRVPHSLLLEILTDEGTGTMITG

SEQ ID NO: 111600 - protein, 175 aa, Triticum aestivum
  unsure (1)..(175): unsure at all Xaa locations
  Clone ID: PAT_TA_6018.pep
GEAAARTTASRPSAVAMVQVGKLVDNYLAEVASDANLKPAKFCKLALAMPDHARIYDDGVYRAVDIYLKAHPRLTAEERDRVCGVVDCRKLTVEACTHAAQNERLPLRAVLQVLFFEQLQLRRAITGTLLASTAXRRARHPNPQPQPPAAALRHAAGPEXAWRTTXVQESKTCRX

SEQ ID NO: 111601 - protein, 158 aa, Triticum aestivum
  Clone ID: PAT_TA_6019.pep
RRSPPPPPRPSRAPPTSSAPALPPPPPPPPPAPQTLTLTPGPPPSSSPRARPAPPNSPPSPPSPPSSPPPPAAQMPTAATPSRAPTAATPSPPSTPSRSTSTAASRRPAAPAPARPRTSPATHPPRPSRSSRSFSATCSRSPATTSIGGSGSVTSPWR

SEQ ID NO: 111602 - protein, 166 aa, Triticum aestivum
  Clone ID: PAT_TA_6020.pep
MRNGSTVCDAAAAVGLGVAPRYRGVRKRPWGRFAAEIRDPAKRARVWLGTYDSAEAAARAYDVAARTLRGPLATTNFPQDPVSFPTLPTLPHPFRPASPGPACSARLQPFESYRAPPAAAAPRPLPPAPPPAPRPADRSRGGALPRGDCPSSPSAVLHGGDEAASA

SEQ ID NO: 111603 - protein, 140 aa, Triticum aestivum
  unsure (1)..(140): unsure at all Xaa locations
  Clone ID: PAT_TA_6021.pep
MGLRDIEMTLPPGFRFYPSDEELVCHYLHGKVANRRLAGGAAGTMVXVDLHVHEPWELPDVAKLSTGEGRVFRCPGPSYAPARRAAIVGMRKTLVFYRGRAPNGSKTCWVMHEFRIENPHSPPKEDWVLCRVFHKKKADT

SEQ ID NO: 111604 - protein, 113 aa, Triticum aestivum
  Clone ID: PAT_TA_6022.pep
SRREVSARPPRWTQRPCAPRGCCCCSPPAPRQRRPRWPPSRRTPGDGGGCTSAGPSRPSRTSSASSPTSTSRTPSLLRPPSPSAAAPATCTWRRPCSSPTTSCSSCPSASSSL

SEQ ID NO: 111605 - protein, 138 aa, Triticum aestivum
  Clone ID: PAT_TA_6023.pep
SQEEEHVCTRKRKQSEVKSMLDGPTTSQHRKKALCELGSTGSQAWLRKEINELALKRYLHFPARFGFLERCKITLKSVERNKSWEVEGVNYHPGTNRSYNCLTRGWKAFCKENELKAGDICTFKVINSTLWHVVIDRC

SEQ ID NO: 111606 - protein, 326 aa, Triticum aestivum
  unsure (1)..(326): unsure at all Xaa locations
  Clone ID: PAT_TA_6024.pep
VGAAAGEKLRKYIASSTPQKPATGTILFQGTHLGVHPAPVVAAFSARGPNPQSPETLKPDLIAPGLNILAAWPIGVGPAGIPSDGRRTEFNILSGTSMXCPHVSGLAALLKAAHPTWSPAAIKSALMTTAYTRDNSNGTGLDESTGKVADVFDFGAGHVDPMRAMDPGLVYDIAPADYVSFLCNLNYTGQNIRAITRRQADCRGARRAGHAGNLNYPSLSVTFVADGARAKMRTHFIRTVTNVGGGRSAYRATVRSPEGCNVTVRPDRLAFRRDGQKLSFTVHVEAAARARMEPGSSLVRSGALTWGDGRHAVVSPIVVTLQAPVQ

SEQ ID NO: 111607 - protein, 173 aa, Triticum aestivum
  unsure (1)..(173): unsure at all Xaa locations
  Clone ID: PAT_TA_6025.pep
PNLSDFIPEVAWLALQGLRRRIEGLFTRLHAMIGERIESQMGDRAAAAGEPTKKNFLDVLLRLXATPTMTRASERQTILSLISDLFSAGXGYKLQPPLEWAMAELLLNPSCMSRAREELDQVIGPKAQLEASVAGQPPSPLAIVGHPRPLRPPAPFRLPPGARPTTQVQGYTV

SEQ ID NO: 111608 - protein, 162 aa, Triticum aestivum
  Clone ID: PAT_TA_6026.pep
ERPAAGDKSEYLLRLIRRRRRRHPSLRATPPQQDVMFPQPNAFGPLRPPQPPPWQWQWQQQQHHHHHHPHQQLPFQPEAAALAAASSFWQRDNVREHLKKLQETVAISSALINELEEIALVRNSSDASAQEPDSSAVASSSGSGVSSPGRPCHFSELASEIK

SEQ ID NO: 111609 - protein, 200 aa, Triticum aestivum
  Clone ID: PAT_TA_6027.pep
RSNVEIQREVQPWPYCTYPSDRSGDLDSLGYPKPSSTVVSEGLVLVNTFEETFGDVYDSGKGVWSQLTNMGSHSLPRRVVSLASFIGERRFFVCTGLFIDWNGCTPILTSASLVRDPKDGNKIAEKLKIEVLLPNKERKEGKLQHYDLYYNVALIVVEDYRCLRPARIHDDWWNHFTLEDPNVVAVGCCFKSGRLMATHG

SEQ ID NO: 111610 - protein, 155 aa, Triticum aestivum
  Clone ID: PAT_TA_6028.pep
SPGCRCCARGFLFLHCAAASLPTPPSRFCEIRRVPTRSEARWEKEIRRAASSERPRTRPRPRPRRPAAAAPVRDIRRYKCEFCDVVRSKKRLIRDHVLEHHKDEVDGLDEYNVGGGGGSAPPGKEIGHDCKECGARFKKPAHLKQHMQSHSPEAV

SEQ ID NO: 111611 - protein, 239 aa, Triticum aestivum
  unsure (1)..(239): unsure at all Xaa locations
  Clone ID: PAT_TA_6029.pep
VCFSAPQANPLDSHRYYILDLSPASTINSPFRVLSYRSNSFSSESHVKSNYTNSFYWDTLPVPPFLGDDYGRTIDICSSMMINGSTICISXSKKGVGTYTFDISXQKLWTQAGNWVLPFYGKAEYVPELNLSFALSADSPHRLCALTCTSMHHGGPPALQHTFDELDLPENWSPYKCHLVNLGSGNFCIISFCKTMNCEFAVFTGVEVKPCINGDGPLRTIKHLSKSFSLGSHSIKSVL

SEQ ID NO: 111612 - protein, 177 aa, Triticum aestivum
  Clone ID: PAT_TA_6030.pep
GWDYVTQRWRGSIEICRGPVNCIKFIARKQWFVAGSSDGLHVQEEAIKKKKIQRFRARVNSVTSLAVHPTKPYVVSSSYGGLIKLWDWDKGWECITTFEGEHSDVVCQLAFNPNDTNSFASVSNDRTIKVWGLDSPKSHYTLSGHSDNVKCLDFFTRDDGQYLITGSVDNTAKIWDL

SEQ ID NO: 111613 - protein, 416 aa, Triticum aestivum
  unsure (1)..(416): unsure at all Xaa locations
  Clone ID: PAT_TA_6031.pep
RFDRFLLESYLEDNDFVKWCPSIPHCGRAIRVGTGDRYCEVKCLCGVTFCFNCMEQTHSPCPCTIWRHWNTRIHGESENIKWIVKNTKSCPKCFKPIEKRDGCNLVKCKCGQYMCWLCGGPTGSAHTWTNIEGHSCNRYKESKDKVDTGRRQLERYAHYCNRFKIHEDSYKEQHEKLGPAIKEKVKQLESNHLRPRLIRDGDWLTDAXKRLLWSRQVVSRSYAFAYHMFGGELQAHRSERGSLAPAQNLFESQQEQLERHVEQLSKVLVTDILALPDQGDSEGEAGGRQPPTSSPERLLRGDVHLHSRTSCCPLPNGTHGHRRLHPGRPCAGQGVPGLTGFFTWCPLLRAHILGATDCGALASLSCCRRKGGRTGAPHGGSCPPRTRWCPPPYPSWTNGDFFFSLRPNVSHFLTLH

SEQ ID NO: 111614 - protein, 205 aa, Triticum aestivum
  Clone ID: PAT_TA_6032.pep
MEAPLLVAALLLLSSTLVVSDFCVCRSEQPQAALQKTIDYACGAGADCNSIHEQGPCYNPNNVVAHCSWAANSYFQKKRAMGATCDFGGTALIISTDPSSSGCSYPSSASAAGTSTTPTGTGTGIGGTTGGTGGTFTPGAGTSTGGMGGTGTGTDTTSGATGTGFGGLGPTGTSNMDTAAAGLHTRSRAVEPAFLALLLFFLAFA

SEQ ID NO: 111615 - protein, 193 aa, Triticum aestivum
  unsure (1)..(193): unsure at all Xaa locations
  Clone ID: PAT_TA_6033.pep
KDKTPHKAVMIMYXGQEETVESVDRLRQAFPAVPVYVRAQDMSHLLDLRKAGATDVVLENAETSLQLGSMLMKGLGVMSDDVSFLSKLVRDSMELQAQEALNNVEDRETTTMESLQVRVSDLVESNGNGSGMIPREQSLGLSSRPEVRVMKTTPDNPMPNLNNKNESEDGVKYCLLETADGEETVEPPAEARR

SEQ ID NO: 111616 - protein, 88 aa, Triticum aestivum
  Clone ID: PAT_TA_6034.pep
SAPASVDLKRVFPDKKIGKIIETSLSANQERAAMEKKRLKWKVAGPPPKENVVRGGPLDPSKLVVELAPMEIRTFVINFDHRLAAHPM

SEQ ID NO: 111617 - protein, 801 aa, Triticum aestivum
  unsure (1)..(801): unsure at all Xaa locations
  Clone ID: PAT_TA_6035.pep
FGSSADIFAGIFPKIYEPPPGEFYFEVDDTSPVVQDDPLLFDYNVEQRVNDFVAAALAQANVTRTNHIMFTVGTDFQYHYAESWFRLMDKLIHYVNKDGRVNALYSPPPLASAAKVGTNGPWPLKTNDFFPYADNPNAYWTGYFTSRPALKRYVRMMSGYYLAARQLEFFIGRSKSGSTTDSLGDALPLAQHHDAVTGTEKQHVANDYAKRVSIGYKKAEELVSTSLACLSESGSNSRCSSPTTKFGQCPLLNITYCPPSEKNFSQGKSLVVLVYNSLGWEREDVLRIPVMSDSIVVHDSEGXEIESQLLPIANXHPYLRDRHVKVYLGTSPAASPKFWVAFPASVPPLGFSTYFISSGKRSASISSTSTLNSPANGRGFLPVGHGRLKLHYDAAGSLSQYSDSKTQVEANFEQKYKYYLGQDGSGDDPQASGAYIFRPKGVVPIKTDGQVPPTILRGPILDEVHQQINPWIYQITRVYKGKDYVETEFIVGPIPVDDENGKELSTEIITSMPADKTFYTDSSGRDFIKRVRDYRSEWKIEVNQPVAGNYYPINLGIYVEDGSKELSILVDRSVGGSSIKDGQIELMLHRRLLNDDGRGVAEALDEKVCLDDQCEGLVIEGKYYLKIDPQGDGARWRRTFGQELYSPLLLAFAEKDGGNWGNSHVSSFSAMDPTYSLPENVAXLLTLEELEDGSVLXLRLAHLYEAGEHKDLSAPASVDLKRVFPDKKIGKIXPKQXLSANHERAAPAMERLKRLVAGPPPKAHPLRGGPLVPSGRGPVGPPPETPSFVINFDHRLAAHPM

SEQ ID NO: 111618 - protein, 136 aa, Triticum aestivum
  Clone ID: PAT_TA_6036.pep
MATEAMAGAVRDLAALSMRFLLHLGGNQTNLAFSPLSFHYVLVLLAAGATGDTLNQIVSFLGPSGGMAHASLASHAASAFLARGNGSEPDVRCGVGLWVDSSLRLRPAFADMVASRYNATAQAMPFQEKVIYLYEH

SEQ ID NO: 111619 - protein, 137 aa, Triticum aestivum
  Clone ID: PAT_TA_6037.pep
VVAARAPTARRNSAAESSLPFGGAQAVTVFLMACAPNYIAIGFSNYGLYTGTRVLSPSYKNFPRKSSYKFLKVRALQGNDGRRRLIDIIRIIPELSRNYFKTGPRALFGGRTLGGYVYEKPTSALGRDALGVNDVIA

SEQ ID NO: 111620 - protein, 247 aa, Triticum aestivum
  Clone ID: PAT_TA_6038.pep
MAAAASSSASPLLLPSGPRGASSRAWLPSGGGGGGRAFIRGGNSRAPCCRRAAAGGGSAAQCGGADDDNGGVVTRRGVVGAVVLGVSSSALCLQAALDAFAGGLPPEEKPKLCDAACEAELENLPMVTTESGLQYKDIKVGQGPSPPVGFQVAANCIAMVPNGQIFDSSLEKGQPYIFRVGAGQVIKGLDEGILSMKVGGLRRLYIPGQLAFPKGLTSAPGRPRVAPSSPVVFDVNLLFVPGLDDDE

SEQ ID NO: 111621 - protein, 290 aa, Triticum aestivum
  unsure (1)..(290): unsure at all Xaa locations
  Clone ID: PAT_TA_6039.pep
LRHKTSKQEEEVRNPMEQYEVVEQIGRGAYGTAYLVHHKAEKKRYVMKKIRLTKQNDKFQRTAYQEMSLMASLSNPYIVEDKDGWVDEGTSVCIVTSYCEGGDMAQRIKKARGVLFSEERVCRWFTQLLLALDYLHCNRVLHRDLKCSNILLTKDNNIRLADFGLAKLLMEDLASSVVGTPNYMCPEILADIPYGYKSDIWSLGCCMFEILAHRSAFKATDMATLVNKINRSSISPMPPIYSSSLKQIVKSMLRKNPEHRPTAXEYWRHPYFQPVSGLESNPTALHLPSK

SEQ ID NO: 111622 - protein, 184 aa, Triticum aestivum
  Clone ID: PAT_TA_6040.pep
SARGPRSRSNLPHPRSPCGRSEARAKPAAPLPLPFPAPAPVRPLPPPAPFLFPCPRRHPQPTPTSSMRYEPAARRSPFPGCRRPAASLVPPVPPASAADRRPRVPSPSRPRQRPLRNPPRPPPQRYMARTRTTPSPSPSPPLQRPAPSGRPFSLSAICVGFDPFVAFPSCYILFGSRFPMPANP

SEQ ID NO: 111623 - protein, 86 aa, Triticum aestivum
  Clone ID: PAT_TA_6041.pep
VQESQTLRVDMDGMRSRVQGLERECSSMRRAIKKIDGGASPGSAGPDADTPAGWRSRYRCKFSTQVCDSQARDAVVSRASRMGMSP

SEQ ID NO: 111624 - protein, 303 aa, Triticum aestivum
  unsure (1)..(303): unsure at all Xaa locations
  Clone ID: PAT_TA_6042.pep
ERPPGQVQNQKKERDGGESMKLASRXTVVKKAQDIEPLEPTGFDLYDARGPPSSGRRGRGRGSRGGSRGGRGRSRGGRIPRGISSSSRIEFMDEDAAYEKAPRKNARRGRGRGRGRGRGRRTVRPRQPLSEGRGRSIPKANLLGSFSMLSNVKPSAVEESPRSSGAEEWGLESRRPYIQGEGDENSSGSESDQSEDNGENGQPMDEEYEEEQVPDYSRAYSGGLRPLAHVMMDDETEDDDEDAEGDGEGDEEEYDVNHASADVDDEMDEDDDIGDDGDDGGDGVEVNADEDEGATSYSSEYSE

SEQ ID NO: 111625 - protein, 198 aa, Triticum aestivum
  Clone ID: PAT_TA_6043.pep
GNNITQNQSVLHIWGQVGPEDRVGAGPSHRGARGALGQTAAASSGRPGRSRTFQSIYLMLQSFVANQLLDCPTADDTTQVKLLFGAKGTVSIQGKCVGGERRVAIYRMERGVDKWTVNCSCGAKDDDGERMLSCDSCHVWQHTRCVGISDFVQVPKRFVCASCKLLHKSKMYSSFPNKRCKTGSFSHASSGLWRPNIS

SEQ ID NO: 111626 - protein, 205 aa, Triticum aestivum
  unsure (1)..(205): unsure at all Xaa locations
  Clone ID: PAT_TA_6044.pep
TALQVRGTPKFFADWDPARELQGEQLLPFPKLQELETDEVAGVLTAPGCRLLSSSLTKLSFEHNKEVECFTKEQEEALSLLRSLQDLQFQWCPKLRRLPAGLNKLTNLKKLLIWRPGAILSLPKNGLPGSLQELVVDDCIKLRCLPAGLHKLTNLKRLQSRLCPAIRSLPENGLPDSLQELDVRCLLNKKLTQEXRRLMGTIPLI

SEQ ID NO: 111627 - protein, 217 aa, Triticum aestivum
  Clone ID: PAT_TA_6045.pep
AKVPHVEVLERVSSILKEYGFCPTGEIVDVKNLCPYNCCVMSDEELFHQGLMNSTKGVTGTDNPCATMEEVHAAEKSLPKGWDNTFTRRKFFPYWRSVLQARAFLRVYPSYATADASRPTVPTPVPGHKLPSLGKAPQLLSNRQSRRLFGTGASAARSALGYEELRRSRGSSMDSTPSQIHNLSLLVGVAQVTNDHGQSRRLFGTAASILLKVATKV

SEQ ID NO: 111628 - protein, 280 aa, Triticum aestivum
  Clone ID: PAT_TA_6046.pep
RAAAPAPPPQKCQLPPLRACSLLGSRHRRPPPPVLNSGRRIFSAPTRSAFSPLRAATLKPAFSPAWPQRPPPPPPPARPQPSKLILGSSSVARKNILNEMGFEFQVMTADIDERSIRREDPDELVMLLAEAKADAIMSRMNISDYQKEGDQPTLLITSDIVVVHEGIIREKPSSKEEARQFLKGYSGGHVSTVGGVVVTNLTTGKKLGSLDKAEVYFHDIPDEIIENLIDEGVVFRVAGGLLLEHPLVLPLVEAVVGSSDSVMGLSKDLANKLIHEALLA

SEQ ID NO: 111629 - protein, 211 aa, Triticum aestivum
  Clone ID: PAT_TA_6047.pep
GAPLLFCCRSHSLAAPHTSPLCSPHEGERRIRPSLRRRSALPLGTSPRRGGVPRAVRSPFPAPVQASYSSSSCSVTLTTGTVARAGGKIVLPWRFSRMVHSGGAGCHRCGLWPGGSAPIIVVTVSMMRPSRFRAHAVHLDCPPRTEQRNVDDLVVMRPYQRPRSGDDFAKRKNAGNVVVMRPERRMRDGSVDRAAPGNVRAAGDVERAILS

SEQ ID NO: 111630 - protein, 67 aa, Triticum aestivum
  Clone ID: PAT_TA_6048.pep
HCREMVFPNIAKFLSNTGEWHDNGTPWSKEKPNLLRFIAPLPAHMKISWNIMSSLPSVIVYLCLNDF

SEQ ID NO: 111631 - protein, 262 aa, Triticum aestivum
  unsure (1)..(262): unsure at all Xaa locations
  Clone ID: PAT_TA_6049.pep
MEAPEYFVCNPATXEKIWSVLPAPEPVPLPGVQTSYSFCLCSDPAAPSRFLVFVFVQRDYYMTLRVYSSDTGEWASTASGRRMVPYGGETVYDFFNDALHFTAARLGDDTPGKVIPSVFTVSTDGVTWRRFRVPSEVEFSFIGQSQGRLYGLDIEHFMIAXLSVWVLEDYASGQWTLKHTASIMELLGRPYCELGEQLMLVALHPECNLIFLVGWMRSQETLMSYDVDSQKLHVISTLXDYQMTTFRPYIPCFAEWLPSDAH

SEQ ID NO: 111632 - protein, 111 aa, Triticum aestivum
  Clone ID: PAT_TA_6050.pep
CCRHHRRRSPISTAYSSPPFRRRRVFLTMGSLIVVAANAPSHLHGRHSNMSQSSNIYQTAGTPSLFSSSTQPYHSYSRIMNYQRHDPAFSVTRGKRTRTDCSMLSTTRAYH

SEQ ID NO: 111633 - protein, 197 aa, Triticum aestivum
  Clone ID: PAT_TA_6051.pep
GQPRHRTLACTVQEVEDVKIVLMVLPIFLSTIMLNCCLAQLSTFSVEQAATMNTHVGGLKVPPASLPVFPVTFIILLAPIYDHIIVPFARRVTGTEMGITHLQRIGTGLVLSIVAMAVAAVVEVKRKNVATDAGMMDSTAPLPITFFWIAFQYLFLGSADLFTLAGLLEFFFSEAPPRMRSLATSLSWASLALGYYL

SEQ ID NO: 111634 - protein, 167 aa, Triticum aestivum
  Clone ID: PAT_TA_6052.pep
PGQEASTTTSQGSASVGPSARGGAFTPRRTTRATKRAPQSKQGKATPAENALMHALGLMPQDLEVDEAIVDELQQLFDSPLRTQHVRVIAALFGKDWCWMFDPVMDLNPHILCWNVRGLNCPAKKKAVREFVISVQVNLVCLQETKLDVIDPFITMQCIGPSLDGFV

SEQ ID NO: 111635 - protein, 176 aa, Triticum aestivum
  Clone ID: PAT_TA_6053.pep
MGNCCSDEMGAGRHSVGPAASSADAASAVADRFLRSRGAGASTQIELSLSASNLGDQEYFFKSNPIVVVYSSNDGALEEIGRTEVIVNSSSPSWNAKIILQYQFEVLQPLVFHIYDIDPQFHEVGEKMLKLEEQQFLGEAICNLSDVITKQNRLFTLKLGVSEHNLPNPSKFGELT

SEQ ID NO: 111636 - protein, 266 aa, Triticum aestivum
  Clone ID: PAT_TA_6054.pep
SCTFVWPVDSGNEIHMISSTQAPQKHQKYVANALGLPLSKVVCKTKRIGGGFGGKETRSAIFAAAASVASHAPGRPVKIVLDRDVDMITTGQRHSFLGKYKLGFTNDGKIQALDLEIYNNGGNSLDLSLAVLERAVFHSENVYAIPNIRVSGKVCFTNFPSNTAFRGFGGPQGMLIAENWIHHMATELKRSPEEIKELNFQSEGTELYYGQLLQNCTMHSVWDELKASCNILEARKAVNVFNSENRWRKRGIAMVPTKFGISFTAK

SEQ ID NO: 111637 - protein, 359 aa, Triticum aestivum
  Clone ID: PAT_TA_6055.pep
MKGETMDGSKGPVVVTGASGFVGSWLVMKLLQAGYTVRATVRDPANVEKNKPLLELPGAKERLSIWKADLSDEGSFDDAIAGCTGVFHVATPMDFDSKDPENEVIKPTVEGMLSIMRACKEAGTVKRIVFTSSAGSVNIEERQRPAYDQDNWSDIDFCRRVKMTGWMYFVSKSLAEKAAMEYASENGLDFISIIPTLVVGPFLSAGMPPSLVTALALITGNEAHYSILKQVQLVHLDDLCDAMTFLFEHPEANGRYICSSHDATIHGLARMLRDRFPEYSIPHKFAGVDDDLQPIHFSSKKLLDHGFSFRYTAEDMFDAAIRTCREKGLIPLGDAPAPAAAGKLGALAAGKGQAIGAET

SEQ ID NO: 111638 - protein, 252 aa, Triticum aestivum
  Clone ID: PAT_TA_6056.pep
DVLSLSLGGDTSASFDDDPIAIGAFSAVSKGILVVCAAGNSGPRMGSITNEAPWLLTVAAGSVDRSFAAGLHLGNGRSIDGEALTQKVSLSSKSHPLLYSEERRNCNYKSDSGITGKIFPGLRARSKTQQSNIHRIVGAGAAGVVLFNDEISGYATMVQDFNSSVVQVSAADGDVLIAYAASSESSSMASLIYNNTLFGVRPAPVVPFFSSRGPSVVALGILKPDILVPGLNILAAWPPSTSSGRGPLYIIS

SEQ ID NO: 111639 - protein, 55 aa, Triticum aestivum
  Clone ID: PAT_TA_6057.pep
KWQLDLIFFFFFFWILPARSCSFRVTECKLTDTRGHTQSEKEKKNMGIDHRGTRI

SEQ ID NO: 111640 - protein, 176 aa, Triticum aestivum
  Clone ID: PAT_TA_6058.pep
MASRRAVLALVVAVAASAASVAADDPDYSYVSGTKLGPENWAKLSPKYSACNGGAAARKQSPIDIVTKSAVPKPDLDPLTRTYVATDATLINNGKEISMTFNGKPGSVSIGGKAFSLKKLRWKTPSEHTINGKRHPVEVQLVHESDAGSGELAIIAILYKLGAPDSFYYQLKRKLA

SEQ ID NO: 111641 - protein, 263 aa, Triticum aestivum
  unsure (1)..(263): unsure at all Xaa locations
  Clone ID: PAT_TA_6059.pep
RIYLKVSVIAAQDLIAAXKGRPLAPTIAKIQMGSHIRRTRPGQPQGSANQAWNEEFMFVASEPFEDPLVVTVEEKVAAGRDEPIGRIIIPVASPYVPRNDLAKSIPSKWFNLSRGMTVDEAAAEATTGTKHREHSKTFASKIHLRMSLETAYHVLDESTHYSSDLQPAAKKLRKSAIGVLEVGILSARGLGGNKSPYCVAKYGSKWVRTRTLLGTAAPAWNEQYTWEVFDLSTVITVAVFDNNHLHHSDGKDQRIGKVRVRLA

SEQ ID NO: 111642 - protein, 332 aa, Triticum aestivum
  unsure (1)..(332): unsure at all Xaa locations
  Clone ID: PAT_TA_6060.pep
DPSCRSPPLSPPTPIPSEPRPIRCSAPPENSPNRGLHLKGTSSSWPLTLCSQPTVLQVQAVPASVPPTPSLIVISQNLTQERKASITTENRLQSSPVLKCSRVDEVVQSHQDHQTTEIPILLHQSVVFPGQTLQLQTVEFRYRIMMQTLLLQEGQSFGIIYSSRKDSRMADVGCMXIIVQCDKLVDDRFLLTCVGGDRFRVLEVVRTKPYVIARVQVLKDRDSPDSSNLGCLMQQVEGHLKDVTMLSDKLSWKLMGDKARQLSRMHSPESFSLVVARLFVKDRSEQQWLLGLDDTAQRLVREGMYLQQRSKYLAAVAAIRDAFGQLSCNEKQ

SEQ ID NO: 111643 - protein, 72 aa, Triticum aestivum
  Clone ID: PAT_TA_6061.pep
LRRQPKGRKYRALILKFIKDRMATLLLVDVGIQVTTVVAAGKVGDEASVVVEMVHPRDDILSVTEIAQDTEE

SEQ ID NO: 111644 - protein, 249 aa, Triticum aestivum
  unsure (1)..(249): unsure at all Xaa locations
  Clone ID: PAT_TA_6062.pep
ARGSFWAFLRKYSQYREMARTLGLEYLPAGGPRRFSYAELKTATKDFTDVVGRGAYGTVFRGELPDRRAVAVKQLHGVGGGEAEFWAEVTIIARMHHLNLVRMWGFCADKDQRMLVYEYVPNASLDKYLFSSSSSAAPSRGDAQGDGEESSQGEGQGRQPVMLDLHTRYRIALGVARAIAYLHEECLEWVLHCDIKPENILLEDDFCPKVSDFGLSKLTSKKXEKVTMSRIRGTRGYMAPEWVIHREPI

SEQ ID NO: 111645 - protein, 133 aa, Triticum aestivum
  unsure (1)..(133): unsure at all Xaa locations
  Clone ID: PAT_TA_6063.pep
MSSMASSKRLLVFALLLAAAILVASTDEHPEAKKEENEAGVENFHFGGGHHGHGGGGGGYGGGGGGGGYGGGGGYGGGGYPGGGGGYGXGGGYPGHGGEGGGGYGGGGYPRRPDGRYRRGVRLPRPRGGGRLE

SEQ ID NO: 111646 - protein, 140 aa, Triticum aestivum
  unsure (1)..(140): unsure at all Xaa locations
  Clone ID: PAT_TA_6064.pep
VIFLSCPPLNEEXSKKSTSTALSEIVRTNETCRLYSEACISVSKEMDIKVVDLWNAMPXQTEDWATACFTDGLHLSEEGSNIVVEEILRILKEAEWDPCLHWKAMPTEFGEDSPYDLVASSGKSTINPSEWTFHRKRSWE

SEQ ID NO: 111647 - protein, 186 aa, Triticum aestivum
  unsure (1)..(186): unsure at all Xaa locations
  Clone ID: PAT_TA_6065.pep
MDTRVPPVPMDPATAERLRRDGHDPDEMEAVFARVLSRIHFALPDQSVSVDARLFGLLPHDSVDCVSRLPDVLLRNIVSRLPVKDGARTAALSRRWRGVWXRSAPLVLVDSHSPPAGTAAARADARRVTSAVSRILDAHPGPFRCVHLTSSHMEDFPGLLARWLQILAVKGIQDLVLVNRPWALDF

SEQ ID NO: 111648 - protein, 179 aa, Triticum aestivum
  Clone ID: PAT_TA_6066.pep
TRPPERPSYDDAGFGPVPAGWKGKCEGGSDFNSSACNRKLIGARYFLAGYEASKGPVDTSKESRSPRDNDGHGTHTSSTAAGSAVRGADLLGYASGTAKGMAPRARVATYKVCWVGGCFSSDILKGMEVAVADGVDVLSLSLGGGTSDYYRDSIAVGAYSAMERGIFVPCSAGNAGPGA

SEQ ID NO: 111649 - protein, 318 aa, Triticum aestivum
  unsure (1)..(318): unsure at all Xaa locations
  Clone ID: PAT_TA_6067.pep
MPPPATPAPSATVHPCLRTHGKEVARLHLFDWIVLLLLVATIGLLGLVQPFHRFVSQDMMADLRYPMKRSTVPDWAVPVIAVVVPMVFIVGIYIKRRNVYDLHHAILGLLFSVLITAIXTVAIKDAVGRPRPDFFWRCFPDGVPKYNNVTGDVICHGKPGVIKEGYKSFPSGHASGAFAGLGFLSWYLAGKLKAFDRRGHVAKLCIVLLPLLSATMVAVSRVTDYWHHWQDVFAGGVLGLXVASFCYLQFFPPPYSEHGVWPHAYLEHIRRPEGEMQAQSTTNSNMHHNSLPLDLSGSNETRTTSHALDSMEEGSRDQ

SEQ ID NO: 111650 - protein, 120 aa, Triticum aestivum
  Clone ID: PAT_TA_6068.pep
GPRRRAGHAPPLLGEVVAHPRPAPPRSRPSPACGGPARSSLPSPKGPTPGSSSHQLPALEVLGIHPPPGRPRPRPLPPPRPRTAGHEAPQLRQLVQPTSSLITKESVFNPLPDPPIRSQA

SEQ ID NO: 111651 - protein, 92 aa, Triticum aestivum
  Clone ID: PAT_TA_6069.pep
NVSISSSSSSRSSSSSSTSSSSSSSTTSSSSSSTTPSSSSSSSSSLALPSLGNAPMAPEYLDCSRALVKASICTSYEQLTTSANAAAMPSRS

SEQ ID NO: 111652 - protein, 74 aa, Triticum aestivum
  Clone ID: PAT_TA_6070.pep
RHSFLGTVFHREYQTPRRLIDILSACHRISRRQRLPPPRRPPSISTVLHRTVIFMLVLKNNDSESTYFDHSLVP

SEQ ID NO: 111653 - protein, 80 aa, Triticum aestivum
  Clone ID: PAT_TA_6071.pep
ICGLLCSFPAAGGLSNQRMGGTCHRDSGLVACRNWSSTGHRLTAGLSQLLENLAQMTRATLCQPLVAGHSCRQIVFLLSD

SEQ ID NO: 111654 - protein, 645 aa, Triticum aestivum
  unsure (1)..(645): unsure at all Xaa locations
  Clone ID: PAT_TA_6072.pep
QLSALRLRRRLGLGAPTSPPPSPAPPPGRPPGLFLSLWVSPPEAGIRLALLPPRGWNSHASFSRTVWRKCFLPXASVLAEKLLPHGXYQYAVIDYLWVPKVCLMGQSSTFLWGFDXLDPRGSNRFLDLQRFPSSKYDKGFSQIANKVHEMGLKFGIHLMEGISTQAVNANTPILDIETGKPYVENGRQWAARDIGLTHKTCAWMPHGFMSVNTDIGAGRAFLRSLYRQYADWGVDFVKVDCIFGTDYSPEEVITISQLLQELDRPIVLSIXYRITGDDWDNWKDVSSHFTVSSAFAAANKIGATGLRGKSWPYFRMFPXGWGHDPGVNKGPHRPYAFTWHEQKAQMTPGMTLWSMAKSPLIYGGDLRHLDNSTFSIMTNPTLLKINYYSKNNMEFHYVSGETTSNTRHSGHLSPRYTVNPTKHDGMVVGLTSCTNDQANGWFVFPQDGKSDHICRIYETENGKNVSFCLGKTKPLLASDDDINEKEEDQTKFHLAVADINDSCLDASASRRRTASEVKLLMFSRCKWHARQMWELNDKGNLVSSYSRLCATVESSKEAVGITGARAWIATGSKGEIYLAFFNLDSVSRKITARISDREKVLGTAFVRKHSCSCSDVWSGRNLGLVEEEISAAVNPHGCVVFELMC

SEQ ID NO: 111655 - protein, 104 aa, Triticum aestivum
  Clone ID: PAT_TA_6073.pep
RGPTKTPEGEVRSGTRNRVAKLTMPVFTAVLVMALLITASSSGEVSTTERDRDASKVTKGHTSLYHLQMQSHSRMRILTDFLDYDYGGANSKHDPHRRPGNGGH

SEQ ID NO: 111656 - protein, 208 aa, Triticum aestivum
  Clone ID: PAT_TA_6074.pep
MASPFGVLVCLLIVLPQILAISSPIHEIAPLKTCQFPCMTEVNLHLFLHQFVDGPNNPNRNEETLLQASFPFGFGTTIVHDWTLTETTNSRDTVVARVQGVHVQAGLTKPNRWYTTHNIEFQQGRFAGSTLQVMGITAGLESGQWSIVGGTGQFIMAQGIISFTNHPASTFEDGIKELNIPCTLHKGYYTSRLRCISSLESPPAQFGI

SEQ ID NO: 111657 - protein, 111 aa, Triticum aestivum
  unsure (1)..(111): unsure at all Xaa locations
  Clone ID: PAT_TA_6075.pep
YXTXRHHXXYMETEAVDMNMTSPHMIHGDTRVDMNMVSTSHDDAMHTFDLVNVNLESSLPMAAAGVMQMHPHPPVYHPKRLLNMRDQVMDSNKRSNVETNTYFIGGGMHVG

SEQ ID NO: 111658 - protein, 230 aa, Triticum aestivum
  Clone ID: PAT_TA_6076.pep
WGLIVTLPHLLGHLVSSGSNAVFPYPDYTAKLSDFGLAKDGPVGEKSHVSTRVMGTHGYAAPEYLSTGHLTAKSDIYSFGVVLLEMLSGRRAIDKNRPQGEHNLVEWARPYLTHKRKIFRVLDTRLEGQYSLNGAQTIAALAVECLSFEAKMRPSMDAVVSILEGIQDSSDPARRPADPTRRPAAERPQDPKSGSKTAPGASNSGKGRRKSSGDLLKEPGRDPKPSAYSS

SEQ ID NO: 111659 - protein, 184 aa, Triticum aestivum
  unsure (1)..(184): unsure at all Xaa locations
  Clone ID: PAT_TA_6077.pep
XPVLVPGAKKNISYYFLKEFDMWVGFDQNPLYALLHESIYCEGSSSKWSADKIFNENGSLFDPVKATEEGRPVYLTGEMVFPCFFDEINALRPLKEAAHLLAEKEDWPPLYDISVLNNNKVPVAAAVYYEDMYVNFNIAKETASQIAGIRLWVTNEYPHSGLRDGGPHVFEHLMGLLKGKRPLF

SEQ ID NO: 111660 - protein, 194 aa, Triticum aestivum
  Clone ID: PAT_TA_6078.pep
RDPPRSPPDPKILPDPLLTLSTYRPSFPASSQELVLDPDPLLPPATEVTDQAAPYPSCFSSHLLLFSDLSHAQASLFPLAAESTMDDPILPSLHMDGNQPPQPAPCPRLPRSSSSLRSLLGALPPASVAINKEHQRGAALTALLLLKFRRQTTLETRASSRTPTSPRQVPVSPERVIVPVRQVPLQLCPSPLLP

SEQ ID NO: 111661 - protein, 149 aa, Triticum aestivum
  unsure (1)..(149): unsure at all Xaa locations
  Clone ID: PAT_TA_6079.pep
MEAPAARGGARMRLRLVSLVVVVAMAAATARAQLQVGYYDTLCPAAEIIVQQEVSKGVSGSPGTAAGLLRLHFHDCFVRGCDGSVLLDSTPGNQAEKDAPXNSSLRGFEVIDAAKTRLEXGCYGVVSCATCSLRARXASPVGSTSAGRR

SEQ ID NO: 111662 - protein, 276 aa, Triticum aestivum
  unsure (1)..(276): unsure at all Xaa locations
  Clone ID: PAT_TA_6080.pep
MVKLATAREARLYGPALAVRRWEYINAGAYMFGTLLLATGLAALCASEGGAGATDAGLAVAAVALAVVAAVNAHDLGAHLAGVDCRVGLARFDPQLGLVELLAPALHAAGCVLAIVGLALQLFSQGEKLERRAADALLAGAVLWLLGSVLSSCQVYERPDGRAQLLQSSVQVPVLLGSLLFLVAAALHRRREPTLAGKGESQSESEGWISLCGSVLWVAGALFNVLKVFVMXPRATPRGSRSFRGGAPERLARDREGRVPLVWEVGAADRAALTVW

SEQ ID NO: 111663 - protein, 249 aa, Triticum aestivum
  unsure (1)..(249): unsure at all Xaa locations
  Clone ID: PAT_TA_6081.pep
MGLGSDASSSSSRLDSAPLLPHHSAEGGHLSSQPKTFANVFIAVVGARVLGLPYTFSRTGWAAGSILLLSVALLTFYCMMLLVACRRRLADDHPKMLSSFGDLGDAVFGAPGRLAVDTMLVLSQASFCVGYLIFISNTMAHLYPVFAPSSNVFLSPKALFIYAMLPFQLGLNSIKTLTLLAPLXSIFADVVDLGAMGVVVGQGRVDLARRXQPTVAAFGAPAALLYGGGRVRTPKGSVWAWPLGGPGQE

SEQ ID NO: 111664 - protein, 88 aa, Triticum aestivum
  Clone ID: PAT_TA_6082.pep
EDLALCHVFPLEGKAKGTRNRNGKRSRSGHEVDPHEPITHAGVEELHQMMADSKNNPIIDADMDVHLLLADQPPKHWAKLHQDTHQNS

SEQ ID NO: 111665 - protein, 79 aa, Triticum aestivum
  Clone ID: PAT_TA_6083.pep
IFVLLNFPVKVLLPHCEVWHCNYFCLMVILPFTGTSINEGSTTNCTRYIRTTFQHNWLSEDDIDRHRRTGALRRRTARK

SEQ ID NO: 111666 - protein, 115 aa, Triticum aestivum
  Clone ID: PAT_TA_6084.pep
EESYKAAGLPEKIPTLALIHPKNPDVVYFFLKEHLFGVDVRGRKVVECQVYGLVAPPSICLASRFVRAWELPRALSSSGSGLMASAWLRALMRVHTSDRQGIITWWGAHRIACKR

SEQ ID NO: 111667 - protein, 183 aa, Triticum aestivum
  Clone ID: PAT_TA_6085.pep
MVSWSEGYSSSSDDSPGHIDFCSEVSSAARLSDSALILVDAVESVHIQTHAALRQAFLERLRPCLVLNKLDRLITELHLTHAEADTRLHRILADVNSIYSALRSHSYFSVLASLEDQPSSSSSASQDDPPEDADDDEEDAFQPQKGNVVFACALDGWGFRIHHFVELYATKLGASASALLTGC

SEQ ID NO: 111668 - protein, 217 aa, Triticum aestivum
  Clone ID: PAT_TA_6086.pep
QLAATSQQAEAFAKAHEDFRTTTAHLGMTFVKLAKFEKDQSTCSSHRTRAININNFANAVVKVSRSQTKLDAEIVKHLDTIHKYLETMTSVHNAFTDRSNALLHIQSLSSDLFALHNRVAKLESVSSRGIDQERTRYQKVEELKETIRTSEDAKSHARKEYELIKENNMNEIKRFNKEIRQDLVEMMKGFVTSQVAQSDNIASIWAKLAEDTKGYAD

SEQ ID NO: 111669 - protein, 147 aa, Triticum aestivum
  unsure (1)..(147): unsure at all Xaa locations
  Clone ID: PAT_TA_6087.pep
MSSSSDNPNTVTDRGLFSKSSKDEKKKQEEKKEEEEGGGGFIDKVKDFIHDIGEKIEEAVGFGKPSXDVARIHVPHIGLHRADLVVDVLIKNPNPVPIPLVDIDYLIDSDGRKLVAGLIPDAGTIRAHXEETVKVPITLDFDDIRST

SEQ ID NO: 111670 - protein, 306 aa, Triticum aestivum
  Clone ID: PAT_TA_6088.pep
MSSSSDNPNTVTDRGLFSKSSKDDAADKKKKQEEKTEEEEGGGGFIDKVKDFIHDIGEKIEEAVGFGKPSADVARIHVPHIGLHRADLVVDVLIKNPNPVPIPLVDIDYLIDSDGRKLVAGLIPDAGTIRAHGEETVKVPITLDFDDIRSTYADIKPGSIIPYLLRVIFLVDVPVFGRIKIPLDKSGEIPISYKPDVDVDKIKFHHFSFEETTATIHLSLENKNDFDLGLNLLQYEMWLGDDSVVEAELTDSTRIEKQGITKMQIPFTFRPKDLGSAVWDMIRGRGTGYSIKGKIDVDTPFGNMKL

SEQ ID NO: 111671 - protein, 271 aa, Triticum aestivum
  unsure (1)..(271): unsure at all Xaa locations
  Clone ID: PAT_TA_6089.pep
MAEAPGFRTAHRATWPGSTGSTTAPHPGRPRPRTPSTAPPTRRRCAPRRQIRSSSTATAGRPTRAARPPPANAARTAATGRGTPPRTTGADGEAASSAATRRPTKPTWGPGTIQLNALLFLSVSLLMASSGTTPSAFKFHFPGDTTRVHNQCVRGDHGTSINRSLTNHHNFDLGLNLLQYHMWLGDXSVVEAELTDSXRIEKQGITKMQIPFTFRPKDLGSAVWDMIRGRGTGYSIKGKIDVDTPFGNMKLPIDKVGGTTRLKKDDDDDDE

SEQ ID NO: 111672 - protein, 51 aa, Triticum aestivum
  Clone ID: PAT_TA_6090.pep
WCSSPSLPPSSCLWPPSCRLCIPFCHFTLTLSTTWMYTVIFLILINAYALS

SEQ ID NO: 111673 - protein, 181 aa, Triticum aestivum
  Clone ID: PAT_TA_6091.pep
DQGGWRNHGFSTKSSELDNQSSARVLVEPAKAHPAPLSVLRFRRRILVQPAEGHPLLRLGRRVLVQPAEGRPSCWLSVLLSIELLLELQPEPPQAKRVQWLLPFLHFKYWVDGKLIHWLLLQVLCHCSLLLELDPKLPQAQAAQCFRFIAFLLHFLLFFHCHGLSNVLLSGSFRHRCCLPR

SEQ ID NO: 111674 - protein, 300 aa, Triticum aestivum
  unsure (1)..(300): unsure at all Xaa locations
  Clone ID: PAT_TA_6092.pep
QFGDREGIEDAIVGKRRFQYEDEVRKNPLNYDSWXDYIRLDESVRNKDRITDVYERSIANVPPAEEKRYWQRYIYLWINYALYEELDAQDMERTREVYRECLKLIPHKKFTFAKLWLMAAQFEIRQKNIKAARQILGNAIGMAPKGKIFKKYIEIELYLGNFDRCRTLYEKYIEWSPANCYAWRKYAELEKNLSETDRARSIYELAIAQPALDTPEVLWKEYLQFEIDEDEFDRARELYERLLDRTKHLKVWINFAEFXASXGLGENAEMRRIRMMLVTRNNNNRSGVASLKGIHYQCAN

SEQ ID NO: 111675 - protein, 431 aa, Triticum aestivum
  unsure (1)..(431): unsure at all Xaa locations
  Clone ID: PAT_TA_6093.pep
PPPPPPGHRVCPPRLPFAAAPPAAPAPRCFAVACWGPSGGPAPTRGSLAQXTAHRAAPDCLACRRRLVGTVNATNSVRVGGRISVLRCTISFEAFMFYDGKSTRRIPFSSPSSMAPVPAPAPTGHGIRPWVIALSVAAPVALVVALCCFIVYCCRLRKRHAKKGKVTLHEKSTHQFQGDELVWEMEAELSEFSVYEFHQILEATSNFSEENKLGEGGFGPVYKGYFPEGIEIAVKRLDSDSDQGFIEFKNEVELIAKLQHRNLVRLMGCCSQGEEKVLVYEYLPNKSLDFFIFDEDRKVLLDWEKRFAIIVGIAEGLLYLHKHSRLRVIHRDLKPSNILLDSTMNAKISDFGLAKIFSSNNNEGNKTRKVVGTYGYMAPEYASHGLFSVKSDVFSFGVXVLEITSXEKESMSVELXXTSSGXAXXLXPXER

SEQ ID NO: 111676 - protein, 153 aa, Triticum aestivum
  Clone ID: PAT_TA_6094.pep
TSVAFRPFSCVAYISGMQSDQQNEISILFLSASALCFLASRSFLTSSNLYPSIPAPVALYLYVHIKAPAMQPNNRSFPFQPVFSQNEAIVLLMSSAIVLLDSFMPSPEYIRLVVQLHPGLLRPPWLEKRGAGALRRSANPVADRSIANTAVVA

SEQ ID NO: 111677 - protein, 199 aa, Triticum aestivum
  Clone ID: PAT_TA_6095.pep
MAIGLPSTDHFVLLTILICLLVHHCSAVYDVESTAESGKLMSAQLKLVGGSADFGPDVKSLTLTASLETDSRLRVRITDADHRRWEVPQDVIPRPAPGPQPKDVLLDSPGNPSMPSNSTMSSASSDLTFTIHASPFRFTVSRRSTGDTLFDTSANLVFKDRYLEVTSALPADRASLYGLGEQKKQTFRLQHNDTFTLWN

SEQ ID NO: 111678 - protein, 321 aa, Triticum aestivum
  Clone ID: PAT_TA_6096.pep
PAAPPPVKPPPVTPTPTPTPVKPPPVTPTPTPTPVKPPPVTPTPTPTPTPVKPPPVTPTPTPSPVKPPPAGTPPSPVSPSPPPSSPAGTCPMDTLKLLGCVDALNGLVHAVIGSSASDNCCPLLSGVTGLDAALCLCTTIELKALNINLVLPIAIQVLVNQCGKTVPSDFQCPAPTPATPPPTPAVPPSPVQPALSPPIPVTPSPTPPSPAPVSPPSPVVPSPVPATPPPSPSTGQCPIDTLKLLGCVDGLNGLVHAVIGSSASDSCCPLLSGVADLDAALCLCTTIKLKALNINLVLPIAIDLLVNQCGKTVPKDFQCPS

SEQ ID NO: 111679 - protein, 35 aa, Triticum aestivum
  Clone ID: PAT_TA_6097.pep
TKPLIHTTDKTISLFFIGNHYYSSIINGELNFQGV

SEQ ID NO: 111680 - protein, 183 aa, Triticum aestivum
  Clone ID: PAT_TA_6098.pep
MSPEEGERLLFPSFVFPDGFPADDATPAVSGGEQKKAGRQRRRRRARQAAAGEGAGGDDAAKKRRLSDEQAQFLEMSFRKERKLETPRKVQLAAELGLDTKQVAVWFQNRRARYKSKLIEEEFSKLRAAHDAVVVHNCHLEAELLRLKERLAETEEEKNKAMAAAAAATTGGGGGSSPSSSSF

SEQ ID NO: 111681 - protein, 171 aa, Triticum aestivum
  Clone ID: PAT_TA_6099.pep
MGKMRALFSRSRSGGRASRSSSTKSSSTPPSPARSPSVREDEMERVFRKFDANGDGGISRAELAALFESVGHAVTDDEVSRMMEEADADGDGYISLAEFAAINAAPDAAVEEDLRHAFRVFDADGNGVISPAELARVLRGLGEAATVAQCRRMIGGGDRLVACLVSFLMMA

SEQ ID NO: 111682 - protein, 268 aa, Triticum aestivum
  unsure (1)..(268): unsure at all Xaa locations
  Clone ID: PAT_TA_6100.pep
MTEPQVASSDATNIECAISRQGDFYVINGRKWWTSGAMDPRCKILILMGKTDFSAPRHKQQSMILVDINTPGVQIKRPLLVFGFDDAPHGHAEITFDNVRVPVTNILLGEGRGFEIAQXGRLGPGRLHHCMRLIGAAERGMNMMVERALSRTAFGKKIAQHGSFQSDLAKCRIELEQTRLLVLEAADQLDRHGNKKARGILAMAKVAAPNMARQVLDMAIQVHGAAGVSSDTVLSHLWATARTLRLADGPDEVHLGTIAKLELQRARM

SEQ ID NO: 111683 - protein, 160 aa, Triticum aestivum
  Clone ID: PAT_TA_6101.pep
MDVTGDAGGGRRPNFPLQLLEKKEEHPCSVSPAAGLGTNGSATGELQVRKAAPPKRTTSKDRHTKVDGRGRRIRMPAICAARVFQLTRELGHKTDGETIEWLLQQAEPAVIAATGTGTIPANFTSLNISLRSSGSMLSTIPAHLRAPPACPVSFWRWRTG

SEQ ID NO: 111684 - protein, 270 aa, Triticum aestivum
  Clone ID: PAT_TA_6102.pep
ELQPPAPMQPEAPSEQLCYVHCHFCDTVLVVSVPSSSLFKTVTVRCGHCSSLLTVDMRGLLFPTTTTTVAAESAASAVTTTTSPPPAAAAHHGQFHYPSSLNLAPGNPPRHSLLDEISSANPSLQLLDQHGLGGLIAAAGGRNAAAPAPLPPPPVAGGKGGKEPSPRTNPVVNRPPEKRQRVPSAYNRFIKDEIQRIKAGNPDISHREAFSAAAKNWAHFPHIHFGLMPDHQGLRKTSLLPQDHQRKDGHGLLKEGLYAANMGISVLISS

SEQ ID NO: 111685 - protein, 235 aa, Triticum aestivum
  unsure (1)..(235): unsure at all Xaa locations
  Clone ID: PAT_TA_6103.pep
HEGKHINFKGFMIGNAAIDEASDDRGMVDYAWDHAVISDELYDAINKNCRFDQAGNSSDFSSSGHNPASNPACDRAMNGFYGAFDHIDLYSLYTPACTANPAGTAGQLPRRLHRSSSTASDNGRPLRPRYNSYDPCLDSYAAEYLNRRDVQHALHANATGSIPYAWAACSDSLFQHWQDSPASTLPVIKRMVDAGLRXVWVYSGDTDGRVPVSSTRHAVRKLGLKTLKQWRGVVH

SEQ ID NO: 111686 - protein, 146 aa, Triticum aestivum
  Clone ID: PAT_TA_6104.pep
MSNPSTATGQRGNTGKLSNLGDSARKQYLREHRSSSRYSQLAAADQSDKPKWSQSHQFQERPSSSHRKDEVVADKEPTGVNGTRKNRIQYSGPLMPPGVNMEEILKEHERQIQQAVRRARLDKGKGKHAERDQSESLLYAAHNGRS

SEQ ID NO: 111687 - protein, 141 aa, Triticum aestivum
  unsure (1)..(141): unsure at all Xaa locations
  Clone ID: PAT_TA_6105.pep
AIHDSWEKVFPEVXSNGLNQIGASDLPSDDSEEDYDPTLAEGDTVDEDKSSAEDGDEGSDSDDLDFITSSDESEPSKKKRSESKNKNTVNDLALPSDDSEDDDFDPEGPNSSEDQKTKTDSDEXDFTSDSDDFCAEISKSS

SEQ ID NO: 111688 - protein, 60 aa, Triticum aestivum
  Clone ID: PAT_TA_6106.pep
DGLNDATSSLPPTEEASYNEPDHGPSKKTKSQSKTKLTGQMIHKRRSRWNFALCLCLKYR

SEQ ID NO: 111689 - protein, 45 aa, Triticum aestivum
  Clone ID: PAT_TA_6107.pep
RCEIDLLPEKQKKLIYMEVYCISFQAPNRLATSVHCMRLQVIQYN

SEQ ID NO: 111690 - protein, 102 aa, Triticum aestivum
  Clone ID: PAT_TA_6108.pep
KKLSISSIGGGNKKENMKGNGRSNEGGSRWSFGRWGSTRTASTNTLSNLVSPISLLLSKFTCFFTSTVHVHTLPCHPLASLPDPPFVSVSSLCLTQVTHRKL

SEQ ID NO: 111691 - protein, 212 aa, Triticum aestivum
  unsure (1)..(212): unsure at all Xaa locations
  Clone ID: PAT_TA_6109.pep
GPIYRFYMGRQPLVVVADPELCREAGIKKFKSIGDRSVPVTIASSPIHYKSLLFTKGSTWQAMRNVIISIYQPSHLASLIPAIQPYIEQAGNLFCPGEEITFSDISIRLFTDVIGQAAFGVDFGLTKDAADDAEKIIHDAPRDFIQXHLYATTSLKMDLSGSLSMLVGTFLPALQKPLREADAARAGLHGPGGWTKTNDGAQRASSTIVAER

SEQ ID NO: 111692 - protein, 360 aa, Triticum aestivum
  Clone ID: PAT_TA_6110.pep
MESCSLVDTAAAALCSTAGGRRRGSAGNTMRFFNCSSSSREHGVSASYSIGRMLSGVRSAARRKLFRSEPEWMGVNLPDSTGHHWWTTLENNFVLEASEDEYGGVVVDADRLPSDEAAFARSLAASLSYWQSVGKKGVWLKLPVDRSEFVPIAVKEGFKYHHAEEAYLMLTYWIPDEPSLLPANASHQVGVGGFVINDQMEVLVVQEKYRGWALDGVWKLPTGFIQESEEIYTGAIREVQEETGVDTEFVDVVAFRHAHNVAFQKSDLFFICMLRPLSSAIKIDETEIQAAKWMPLEEFVKQPFIQEDHMFQKIMDICIQRLRKCYCGLTAHNVVSKFDGRQSTLYYNVGEPEDVNCDAA

SEQ ID NO: 111693 - protein, 84 aa, Triticum aestivum
  Clone ID: PAT_TA_6111.pep
RNSARGQVVVNEQKVDKFLYTMLKLNSTILRYSRMAAVVLVSLPPPPLNHPAYFYMEYMDLLVENVPRMLIVRGYRRDVVTFFT

SEQ ID NO: 111694 - protein, 264 aa, Triticum aestivum
  Clone ID: PAT_TA_6112.pep
APRPSSPALPLPRAPLTPPCLAPAAGARRARRRRPRAAPPSRPASPSRGVPSPRRPAAPPPLPAAAPPWLGRPPPHPVGPASPSNIATRNERHGGQASDPANPLPLRRVVGYGAGPPPPASPAPRPLPSPSSPQRAPLPRFFCSLQRHHRSFMAAGTFIRCHTPPGLAHVPIQPANVRIRFPRVRPRPFYLVGVVKAQALSTKSTASRPCSVSGGAASQRPPLHRALLDPTTSPKAHSATALLRPHRPPAGGRHRHERRRGGMR

SEQ ID NO: 111695 - protein, 185 aa, Triticum aestivum
  Clone ID: PAT_TA_6113.pep
TEVRGTSSQGTKLTLASLLSCPKEGRSAPVFKKMRKAKRSGDHLTRSFLKSRRASKNESLVSGCFIGDSDQGVRSGLSDRLISYMSKSVVSITLYNEGTILFSCSGIAMERKGCHLTRFLTSASLVRALNGTNEDHDDLKIEVRHEGNEVYMGVMAEYDLDRNFAVVNVDAFLDVQVQSFQHAPR

SEQ ID NO: 111696 - protein, 170 aa, Triticum aestivum
  Clone ID: PAT_TA_6114.pep
VARGMNYLHNCTPVVVHRDLKSPNLLVDKNWVVKVCDFGLSRIKHNTFLSSRSTAGTAEWMAPEVLRNEPSDEKCDVFSYGVILWELCTLLQPWEGMNPMQVVGAVGFQERRLDIPAEVDPAIAEIIERCWQTDPKTRPSFSEIMAALKRVLKKLSANQPRRQRAQEADD

SEQ ID NO: 111697 - protein, 237 aa, Triticum aestivum
  unsure (1)..(237): unsure at all Xaa locations
  Clone ID: PAT_TA_6115.pep
IRLSHGRIRLSQRPEPSLTGSRRPCFSTAGEGEGSGLGREAVEEMGRAVTGRRHFFSNQIEQWFEVPQCVVRTSPCSPVRSPPPRSGTYLPLSSFSAGEHGECLPVSTGSVRGISTPPSLNGSMVRQSGMRTRAARLWRRGSSCRSFSLVCVRSAVCCYGVAGINVPPEAAHSSSRRSSRRWERSAMLYGALFHGTVVICCGAAQNMCSIRAWQAHNVARSRNVPXSXVIPLIXNIQ

SEQ ID NO: 111698 - protein, 309 aa, Triticum aestivum
  unsure (1)..(309): unsure at all Xaa locations
  Clone ID: PAT_TA_6116.pep
GVESMLIDISTLRAATKDFAENNKLGEGGFGPVFKGTLLNGDEIAVKRLSKSSTQGVEELKNELALVAKLKHKNLVRLVGVCLEQQERLLIYEFVPNRSLDLILFDEANRQQLDWETRCKIINGVARGLQYLHEDSQLKVVHRDLKASNVLLDMNMNPKISDFGLAKIFGRDQTQGVTNRVVGTYGYMAPEYVMRGNYSVKSDAFSFGVLVLEILTGTKNSDCYNSHQSQDLLXTTVWEHWAAGTVLEVVDPSMNKSFPEGHPLRCCPAGLSGVRPIPAARPLLAAVAMPRASNPASPPTPAKDRSSFT

SEQ ID NO: 111699 - protein, 80 aa, Triticum aestivum
  unsure (1)..(80): unsure at all Xaa locations
  Clone ID: PAT_TA_6117.pep
IYEILLATDDLISLPAPPLSVPTGRLQSAPPRNQPPGTPSSGAPPAHHRLGYWIXHKGNKKKMENKNCDINCSQEINKPR

SEQ ID NO: 111700 - protein, 78 aa, Triticum aestivum
  Clone ID: PAT_TA_6118.pep
SGSTLIMPVLDNQLKSPSPLLVPARDAVTPLSESEAVDLVKDVFASATERDIYTGDKVEIVVINKAGTRREYIELRKD

SEQ ID NO: 111701 - protein, 216 aa, Triticum aestivum
  unsure (1)..(216): unsure at all Xaa locations
  Clone ID: PAT_TA_6119.pep
NELQLLLDXRFRRAYQNLSELLIASRNLEFFTNGYRYLIQILPAAVVAPMFFAGKIEFGVINQSVSAFNHILSDFSLIVFQFQSISAFSAVIDRLGEFDDLLGENESSLSPQRDSIDGINISFKSGSPSVLSSNGSQMQSEPGIVLEICDLTLLTPRGGNILITDFSMELKDKDHLLVMGPSGCGKTSLLRALAGLWTSGTGNIIYHARDSRQLQT

SEQ ID NO: 111702 - protein, 109 aa, Triticum aestivum
  unsure (1)..(109): unsure at all Xaa locations
  Clone ID: PAT_TA_6120.pep
SCQSKPIIALLVVIEMFFFWQARQSPPRQRFTCQSLTKSYTRQISHVFYQNRPSPQRLAMIDATRFGQPSTRLWRLACCQAPRCDLAPSFFQLCTRNPHLSHDISXMEY

SEQ ID NO: 111703 - protein, 200 aa, Triticum aestivum
  Clone ID: PAT_TA_6121.pep
TSGPSDRLVARSVQAGSVLSRRKIQPVRAADSGPKICRSGPGFHRASSQDRQTDTSAWRERGGSTVSTKWGMAGAWLGHGGALARAWRGCGGCMATQAWWGRKKTTVVYVRHRGAVVRAATGLSGPGDLVHWMRQSLISRLSQRNQRGRSYVAASIIVPFVSVHWPFVAVGLPLVMFLVTLASFGSSVACRHLADELRFL

SEQ ID NO: 111704 - protein, 100 aa, Triticum aestivum
  unsure (1)..(100): unsure at all Xaa locations
  Clone ID: PAT_TA_6122.pep
EPNVPNPKLLSWERAIRWIWLQIFGRTNAHCAERSAYDSSISFEGRQIRVSISCILWVQGVVESLWVIRACNVMPXRXVRIXHHAGPSNITTCQHXRXKX

SEQ ID NO: 111705 - protein, 265 aa, Triticum aestivum
  unsure (1)..(265): unsure at all Xaa locations
  Clone ID: PAT_TA_6123.pep
LFNCGNSCYANAVLQCLMCTKPLMIHLLLRLHSKDCNTKPSVVAAEVLLSAQGKSNNTVVYSCLSHTLCYLRIGCSKNWCLMCELEQYASTLRESGGPVSPSRILSNLRNIGCRLGGGSQEDAHEFLRHLVMSMQAACLDGLGGEKQVEQSLQETTLIQQMFGGRLKSKVKCLRCHHESERYENIMDLTLEIHGWVESLQDALTXXSLXPEDLDGDNMYKCGRCCAYVKARKQLSVHEVPNILTVVLKRFQTGKYGKINKCVTFP

SEQ ID NO: 111706 - protein, 79 aa, Triticum aestivum
  Clone ID: PAT_TA_6124.pep
KAPPKKYKGGTSGFMKTRVVLCLMQLLALTLVIFLQINLTVRLKLLNWEKMLRSSHNKNVQHPGFRHVCCTILLIQVWC

SEQ ID NO: 111707 - protein, 220 aa, Triticum aestivum
  Clone ID: PAT_TA_6125.pep
RVGGCDIGVASTKAYTSQIVVMAMMALAIGSDQISTQARREAIISGLFSLPSNASQVLKLDSEMKELASSLIDSESLLVFGRGYNYATALEGALKVKEVALMHSEGMFAGEMKHGPLALVDENLPIIVIATRDACFSKQQSVIQQLLSRKGRLIIMCSKGDASAVNPGGSCRVIEVPKVADCLQPVINIIPLQLLAYHLTVLRGFDVDQPRNLAKSVTTQ

SEQ ID NO: 111708 - protein, 215 aa, Triticum aestivum
  Clone ID: PAT_TA_6126.pep
MNRICRRRSALPPPAKTTPTDDENLLPEVLIRLPPQPSCCCPRASLVCKQWRHLIADPQFLRRFCAHHREPPIIGVFLDFYRGDLSFRSVLDRPDLIPPERLSVRFDGIEGGGVEGNDGIWSFRRCRHGRVLFTRGDHLGKGCRHVLVWDPVTGDRRFIGSPPQLDHDWSKSHVQADVLCVAGDKDHVHGSCHSSPFNVVLVCADKLAARACVYS

SEQ ID NO: 111709 - protein, 110 aa, Triticum aestivum
  unsure (1)..(110): unsure at all Xaa locations
  Clone ID: PAT_TA_6127.pep
IPTVPRLMGYCHVXXPVYLKCGDLTDALAKEILDEDQGDEIGEYTPDVLVSEFMKGETQLVEKLLQTEINLLRSIRDGSALMQHMEDFYYVTLLETVRSRYQLVDDASQE

SEQ ID NO: 111710 - protein, 113 aa, Triticum aestivum
  Clone ID: PAT_TA_6128.pep
MPAVMKALAAASPVSAPPSPRRSVAGSSGPPPQPLQPSFGRISLRDRPPETGPPIASRDSSSPAAAPALAKRPPHPLLPRARASRGGARTSTSPRSLHFTNGDGRADDRPTCA

SEQ ID NO: 111711 - protein, 106 aa, Triticum aestivum
  Clone ID: PAT_TA_6129.pep
CLSRRGAAAGAGAGRISAATGAKVGGRREGLTPFFSFSLLFTPDECTEQETECCSSEPSCSAQANMRSFHSRHTRDDNIDMNIEDMMVMEAIWRSIQDFLYFLAPE

SEQ ID NO: 111712 - protein, 563 aa, Triticum aestivum
  Clone ID: PAT_TA_6130.pep
CHCEHKMDSARSWFQKFQPRDKSKSPAEPASHGKDPGKPPVDDAPSSATKQKVAAAKQYIENHYKTQMKSLQDRKERRWMLERKLQDAEVPAEEQNNILKHLEKKETEYMRLQRHKMGVEDFELLTIIGRGAFGEVRLCREKTSKSVYAMKKLKKSEMLRRGQVEHVKAERNLLAEVDSAYIVKLYYSFQDDEFLYLIMEYLPGGDMMTLLMRKDTLTEDEAKFYIAETVLAIESIHKHNYIHRDIKPDNLLLDLSGHLKLSDFGLCKPLDSSNFPNLNEPDYTPGKGAKPLPDNTSRLTNSSAPKRTQQEQLSHWQKNRRMLAYSTVGTPDYIAPEVLLKKGYGMECDWWSLGAIMYEMLVGYPPFYSEDPMSTCRKIVNWRSHLKFPEEAKLSSETKDLISKLLCNVEQRLGTKGAHEIKAHTWFRGVQWEKLYQMKAAFIPEVNGELDTQNFEKFEETGAQVQSSSKAGPWRKMLPSKDANFVGYTYKNFEIVNDDEVAGIAELKKKSSKSKRPTIKTLFESMDEDEPVHGSFLNMLPHKEGQPSSHSSAPPEQYQPRRK

SEQ ID NO: 111713 - protein, 195 aa, Triticum aestivum
  unsure (1)..(195): unsure at all Xaa locations
  Clone ID: PAT_TA_6131.pep
MATAVVVSAAGLPAAPSPSPVRYTPRRAALRDVPQLHAALLKSGELTTSPESFHSFLEATALPSPATTAAHLAYAIRLLRLGPHPPLSARSYNILIRAFFRAGHPEDALHLFVEMLGAAIAANVCPDQHTIANTVKSCARMYALATGRSVQAYAVKLGFMADQFVLNSLIHMYASCGDVAAAKVLFNAVXXXXVV

SEQ ID NO: 111714 - protein, 298 aa, Triticum aestivum
  unsure (1)..(298): unsure at all Xaa locations
  Clone ID: PAT_TA_6132.pep
KXPNXLAVPKXSXSFPXLAFLXLXNGMSCTHXALXFAXXKQFKSXEIXNADAXVAAAVGFWVSGTTXVISRAISFPKLEVLKLRNMKNLEDWSLSVEESQTLLPCLKSLHIQFCPKLKALPEGLKDAALCDLHVEGAHCLTEIKDLPKLSDELYLKDNRALLRISNLPALKSLTIDDCAKLKHVSGLDTLQHLRLVFPPSTETYYFRGVGHSYWEHRVPHGRLXELLIRFAGQIGLRRFELQCALPLLRSCLEGGKNWHVVQQIPEVRNTATDGKNYIMYNKARRIYETNAQCEEKST

SEQ ID NO: 111715 - protein, 258 aa, Triticum aestivum
  unsure (1)..(258): unsure at all Xaa locations
  Clone ID: PAT_TA_6133.pep
DTSKYLVPGVVDPQFAQNLHDLLLEGGALLPSGLLSCQNSHNSGNTTEMGKNSNPEVKETPGWLLVAQTGQNTPERSVAEDSLPKIPLPPCEDVQYPVENTEATIGSLGTISIEGERVAEHSLANMSGSSSANLGKLSCSSMKTISSVMDDVAEDEISWEDLHIGERIGLGAYGEVYHADWNGTEVAVKKFLDQDLSGVALXQFKCEVQXMSRLRHPNVVLSLGXLTQPPNXPILTXYLPRGSLFPQWHPAKYKFYTQ

SEQ ID NO: 111716 - protein, 156 aa, Triticum aestivum
  unsure (1)..(156): unsure at all Xaa locations
  Clone ID: PAT_TA_6134.pep
QSIASPHLFTVPIHEGMDTGLQRLEEGMFSRYNMTRRLFARGLLFGVNVFVTALFPFMGDFVNLFGSFALFPLTFMFPXSMIILKIKGECDGRWGRLWHWGVIVVSSAVGLATSAAAVRLILHNASVYRFFADTEHDYPAAQDGRMMMQCVRPTVT

SEQ ID NO: 111717 - protein, 80 aa, Triticum aestivum
  Clone ID: PAT_TA_6135.pep
PVFMIKPIIGGGFPVLHKLARGTLLAAGNAAVGASARMSHPPRMRRGLLLIHLRRHRVGGVVVVMVIGGGESHDVDEWFV

SEQ ID NO: 111718 - protein, 94 aa, Triticum aestivum
  Clone ID: PAT_TA_6136.pep
PYHLLICRDRSSAGVGEDGIRRQRMVERRRGGRREFCRQVPGHVLVLWRWWKAAGLGGAPDGRDARGHRAPERQQRVSYSASSSARESEAGVPI

SEQ ID NO: 111719 - protein, 233 aa, Triticum aestivum
  Clone ID: PAT_TA_6137.pep
ENGAATPAKTGDGASTGIKKPRGRPRKERPPEEMSPETGDAMPAPETRDAAPDENEAATPAEAGDAASTGFKKPCGRPRKERPPASIPTETEDATPAETGDARPAETGAATPAEAGAATPAEAGNAASTGIKRPLGRPRKVKKLGRPRKEKPEEAAISGETGDDAAAAIFAESGAATRGKTAGDDRRHKGPGGQEGPETACRTQTPNQKPRALNKKKGGAKRGTGGQKIPTEA

SEQ ID NO: 111720 - protein, 203 aa, Triticum aestivum
  unsure (1)..(203): unsure at all Xaa locations
  Clone ID: PAT_TA_6138.pep
LFAVWDFDGQDVYKKIVDATENFSDTHCIGIGGNGSVYRAQLPTGEIFAVKKIQMMEDAEIFNCEVEALMHIRHRNIAKLYGYCSAPQGRFLVYEYMHRGSLAASLKNNETAIEMVWXKRLNVITDVAHALSYMHHDCFAPMVHRDITSSNILLDLEFRACISDFGIAKILDMDAPSCTKLAGTKGYLAPELAYTTRVTEKCD

SEQ ID NO: 111721 - protein, 137 aa, Triticum aestivum
  Clone ID: PAT_TA_6139.pep
MDLHKKLTAVSLTDDLVVDILSRLTYKSFCRCKCAYKAWSAFSSDPDYREKLPKKVTTGLLYQGHNKSAIPLVSLCPDDGEIDGILADVPHYEHLEFLDCCNGLVLCKYRSSYTSTNVCRFVVCNPATREWRILPDT

SEQ ID NO: 111722 - protein, 205 aa, Triticum aestivum
  unsure (1)..(205): unsure at all Xaa locations
  Clone ID: PAT_TA_6140.pep
AVRGAPVSWLSFLLLLVTGGGIIVYYDXKKKRHIEELKNNTNSVKPAQAVGTAAIGGPFSLLFHHGLAGPAGDLWGGGARRSVRFAHSPXDICPDELQKMAAAINKLKEKAKLEIVPVFISVDPERDTVEQVHDYVKEFHQDLIGLTGTPDEVXKVARAYRVYYMKTEEEGSDYLVDHSIVMYLMNPKMEFVKFFGKNYDVHALA

SEQ ID NO: 111723 - protein, 173 aa, Triticum aestivum
  Clone ID: PAT_TA_6141.pep
HPLLHPTHPRFTSPSPPLLSSPLPTGSLPFSDPCRDPPPCGRTRVQAFLHHPTDQAHPGGQARAAPRRGMGAGRRGGPEGEHSGGAGGADQQAAGAWEEQLLPEAGARNKLKEAAPLGGAGGAAGIQRLRALVPRSVPSKSPPGRRRGLAWWCGGVAAWFVSYRPYQAAKSSH

SEQ ID NO: 111724 - protein, 88 aa, Triticum aestivum
  Clone ID: PAT_TA_6142.pep
YVIMQKIFCLLKKLVLVENIYILTRSSSTKTCSRTMVNHKRSLNKSFKIPPNFLMIISGCSIYCSFKACNQIDKRDTEKHHQWDIVLH

SEQ ID NO: 111725 - protein, 90 aa, Triticum aestivum
  Clone ID: PAT_TA_6143.pep
ITKVSLHLLSHSYFQFLCHNVCGVLHVHNCLKGGRIFPPLPHLESNTQVINNCVGQLPLFWTVVLKRTVTYRVLQVSSDTVNGLGKPRLL

SEQ ID NO: 111726 - protein, 117 aa, Triticum aestivum
  Clone ID: PAT_TA_6144.pep
RLPPPPHYHHPPTSWNSQSFRHPPPPPPHHHPPTSWNSQSFRHPPPPPPPHHHPPTSWNNQSFRHPPPPPPHHHPPTTWNGHSFRHPPPPPPHHQPPRPLCSSIRRSPEPPYSKPHT

SEQ ID NO: 111727 - protein, 208 aa, Triticum aestivum
  unsure (1)..(208): unsure at all Xaa locations
  Clone ID: PAT_TA_6145.pep
TGCKYIAVLGVDXMSEXVRAILDQAGFTQVGVYRMSSEQIGCSLADAASSSAYTHFLKTASRSPPSLHVIYINTSLETKARTHELVPTITCTSSNVVATILQAFAEIPDLNVRVWSLIPIWGANIADLFKRMTIMSXEEITEIHPDHNRTTTSSLLQRLHYYQNGNGIVHDMLGKNEDTFNAHLNQEKSLGTRQGWIWSPIVNHWQME

SEQ ID NO: 111728 - protein, 252 aa, Triticum aestivum
  Clone ID: PAT_TA_6146.pep
VSPPAALTLAMDGDGDPHDGHHPQNPAPSDPRHPQLEEEGNPLPHEAQKEMEAVRRANKVARKIRRLRAKALARGQGKLQKEDLPQITPASSVALAMGTHGYSETPPDTQHSGEQALKPGQVLRTGVLVEAPDKIPSSAGTDVSAAPPRPHIRQSVLYSDRPRRSRKPTSDKLPPTGTATCVRQSALYAGRLSRLRGSQEPEITNKLLVEENANKVSGSVDLPESKTLALNDTRPKLELTDRVEENAGKVSG

SEQ ID NO: 111729 - protein, 204 aa, Triticum aestivum
  Clone ID: PAT_TA_6147.pep
MKLKLLSPCLLLLAFFATAAYAASASASRAAAVVRGAGAPSQSELESDPENQCVYTVYVRTGSIWKGGTDSTIGVTLLGPDGTGIRIRDLAGWGGLMGAGHDYYERGNLDIFSGRGPCMSQAPCAMNLTSDGTGAHHGWYCNYLEATVTGPHLGCAQQLFTVEQWLATDASPYRLYAVVDKCKTKRQEPRRSPAGEAEATVTAL

SEQ ID NO: 111730 - protein, 132 aa, Triticum aestivum
  unsure (1)..(132): unsure at all Xaa locations
  Clone ID: PAT_TA_6148.pep
RTGAXLEAGTDANITLELYTAGNADGVAISDLPSWGGLMWQGHSYFERGNLDIFSGRGPCMASAPCRMRVSSDGTGAHHGWYCNYVEVTVTGPHRGCAQQLFTVEQWLATDAAPYKLEAVVDRCPADGAADA

SEQ ID NO: 111731 - protein, 188 aa, Triticum aestivum
  Clone ID: PAT_TA_6149.pep
MKLSYLLLAALFAAAYASSERAIAVAGAGGRGSLLSDPEQQCVYTVYVRTGSIWKGGTDSAIGVTLLGSDGTGVRIADLEQWGGMMGAGHDYYERGNLDIFSGRGPCMERAPCWANVTSDGAGAHHGWYCNYVEVTATGPHMGCAQQLFTVEQWLATDASPYRLYAAVDNCGDKQAAKGQEARASTAL

SEQ ID NO: 111732 - protein, 185 aa, Triticum aestivum
  Clone ID: PAT_TA_6150.pep
MKLFCLLLVSFFAAAYASSERAIAVAGAGGLLSDPEQQCVYTVYVRTGSIWKGGTDSAIGVTLLGSDGTGVRIADLEQWGGMMGAGHDYYERGNLDIFSGRGPCMERAPCWANVTSDGAGAHHGWYCNYVEVTATGPHMGCAQQLFTVEQWLATDASPYRLYTAVDNCGDKQAAKGQEVRASIAL

SEQ ID NO: 111733 - protein, 185 aa, Triticum aestivum
  Clone ID: PAT_TA_6151.pep
MARLAALLLAFAVAVSAAALAHGRDLPTQIKLTKGGGAVGGDSQECVYTVYVRTGSIWKAGTDANITLELYTAGNADGVAIADLPSWGGLMWGGHSYFERGNLDIFSGRGPCMAGAPCRMRVSSDGTGAHHGWYCNYVEVTVTGPHRGCAQQLFTVEQWLATDAAPYKLEAVVDRCPADGTAAEE

SEQ ID NO: 111734 - protein, 127 aa, Triticum aestivum
  unsure (1)..(127): unsure at all Xaa locations
  Clone ID: PAT_TA_6152.pep
KKISGLPNLFSGDISGAFTPLPRSRLKTPRCLEWGLSRFRWAHAPLWLFRRSPPSPIPQPDSCPDHLGGGSFRLLVTAVYCLAPSVALYPSESVVLSFACRELLCSXEAATLPSVSFRSLRKKNSFX

SEQ ID NO: 111735 - protein, 141 aa, Triticum aestivum
  unsure (1)..(141): unsure at all Xaa locations
  Clone ID: PAT_TA_6153.pep
QRGRGRLGRNSGVAGADRRRANTTGACAVNGERPVRRKILCGPVHVPWERRQPRLVGLQDVHGLRHGWPLAPVRVRAPRARRRVPAPSIAPSXSSPSXARPARQGXRPPVQVXNQLNXXRFSTXRLRRRRRVSRGRXKLNA

SEQ ID NO: 111736 - protein, 101 aa, Triticum aestivum
  Clone ID: PAT_TA_6154.pep
SVGIGGRSDPIHVQAAAMEPAELAKIIFSRVQEVEPDNVSKIVGCILLREPDEDELVHLAYATDAALRNTIYEAKGTLAVIYARFSAFLGHHYHQPNGVGY

SEQ ID NO: 111737 - protein, 66 aa, Triticum aestivum
  Clone ID: PAT_TA_6155.pep
DIIVTYSLPVMLNAIGLAGVFGIYAVVCCIAFVFVYLKVPETKGMPLEVITEFFAVGAKQAQATIA

SEQ ID NO: 111738 - protein, 122 aa, Triticum aestivum
  Clone ID: PAT_TA_6156.pep
MAARLAQLRTKAAQAAEFASKHGGAYYKEAMEKNKQYVVQPPSVEKCQELSKQLFYTRLASLPGRYEALWKEVDGVKQLWKNRKELRVEDLGIATLFGVELYAWFCIGEIAGRGFTLTGYKV

SEQ ID NO: 111739 - protein, 105 aa, Triticum aestivum
  unsure (1)..(105): unsure at all Xaa locations
  Clone ID: PAT_TA_6157.pep
ARPPPAPPPVPPPPPPPPPPXPPAPPPPPPPRPPSPPPAPAARTASPTAPQKPRGGGRALKWEAELDAPHAAQGRPPGAQGFTSERVAARRPRRPAGDWWTARLY

SEQ ID NO: 111740 - protein, 300 aa, Triticum aestivum
  unsure (1)..(300): unsure at all Xaa locations
  Clone ID: PAT_TA_6158.pep
MNPLTQVKRTQVINQKEAALGLSEDASWHAKFRGSAYVFVGGVPFDLTEGDLLAVFAQYGEVVDVNLVRDKATGKSKGLAFVAYEDQRCTVLAVDNLNGAKVLGRIIRVDHVXXYKKKEEEDEEELQKKREERGVCYAFQKGECNRGDACKYSHDEQRNANTGWGSKEDDPKWEHDRHRGPQNKGESRGVCYAFQKGECSRGDTCRFSHDEQVAVQGRGVCYAFQKGECSRGASCRFSHDEQRNANTDRGSREDSNARRQHDHDPPKSHKIFPDRTKEEARSGDRGWSILKIRVVQGPRF

SEQ ID NO: 111741 - protein, 118 aa, Triticum aestivum
  Clone ID: PAT_TA_6159.pep
SRASSTRAPARMARQGTLVLVAGAALLLLLCGAAMGAKRAAIPDDLRDVVDDEEDDDWRHWGAGSGTRDVPNRPPPDLSRMDPAVLRAEILRGHGGPSLRFVKLRSRVRRFREEVAVI

SEQ ID NO: 111742 - protein, 202 aa, Triticum aestivum
  Clone ID: PAT_TA_6160.pep
TRPPSRPPAAASRAARPHASAQSHRSIYSTCGLSVLGFTAMARDNGDGLAAIAGRIGVLGSVVLNIVALAIYLRGRAAAEKQASKKVKKAAAVAPSSGKPPVACDSVINLDHGDPTMFETFWRGPIGESATLVIPGYQTMSYFSDVGNLCWFLEPRFEREVRRQRRINYPLLLDVPHVDGLPQLGALPMGRRRQRIRWQRLH

SEQ ID NO: 111743 - protein, 207 aa, Triticum aestivum
  Clone ID: PAT_TA_6161.pep
RAASHAAALAHPASATPPPRPASPLRRPPRPRRRPAAAVLGWFPHPARGDEMSDDVIWHCIRHNHCSFMAKIETGIFCRNPYNATGICNRSSCPLANSRYATIRDHDGVFYLYMKTAERAHLPKKLWERVKLPRNYEKAMEIINKHLEFWPKLLVHKIKQRLTKMTQYRIRMRRLQLKVREKIMTVPRKKTQRDLRRLDKAEKAAQL

SEQ ID NO: 111744 - protein, 100 aa, Triticum aestivum
  Clone ID: PAT_TA_6162.pep
MFCSLFCSNHLYCGLVIIPKYRTMKKNSAKGVKDFVAGKIEPSIKSEPIPEKQEGVHVVVAKNYQEVVIDSKQDVLLEFYAPWCGHCKSLAPKYLGRDHA

SEQ ID NO: 111745 - protein, 605 aa, Triticum aestivum
  Clone ID: PAT_TA_6163.pep
MRVLAFLLLLWISAAATASPPPLETLGIPPQDEAYYRGGVIKCRDGSGKFTRDQLNDDFCDCPDGTDEPGTSACPEAKFYCKNTGHSPITIFSSRVNDGICDCCEGSEEYGSNSTCKNTCWEAGKAAREKLKKKVATYKSGVVIRNQEVEKAELAIAKDEAELTKLKGEEKILQGLVDKLKEQKRLIEKAEEEERLIKEKEEKRIKEEVENKQLRKTIAPDASQEADSQDTNEKAQEDESKVVEHHDGDITDHDNHSPEGETSVEVPDIKAGTGDDEPPVETSAVPTEEQDPTSVNSEGLSKAELGRLVASRWTGENVDDVGKSDKKGHEDELDLPEPAEEAFEDEHDIPEPVEENYAGYHSEIEDDRHKFEDEELSNVSDDEYVDDHEEPDVSYKSDDDRKGDDHSDLTASGQASWLDKIQQTVQNVLQKFNFFKTPVDLSEAAHVRKEYDDASSKLSKIQSRITSLTDKLKQDFGKEKEFYYFYDQCFEGKEGKYVYKVCPYKKASQVEGHSSTNLGRWDKFEESYRMMHFSSGDKCWNGPDRSLKVRLRCGLSNELNGVDEPSRCEYVAVLSTPAMCVEEKLKELQQKLDAASSNLSGHDEL

SEQ ID NO: 111746 - protein, 246 aa, Triticum aestivum
  Clone ID: PAT_TA_6164.pep
MRRRRMASSSSPRCSIRRSHGKCGICYTDAERVPGVGKDGLIRHFFHRPSKAYTTGTRKRRKVHTDEQGGETRWHKTGKTRPVFTDGKLKGYKKILVLYTNYGKQRKPEKTNWVMHQYHLGSDEEEKDGELVVSKVFYQTQPRQCGGSTAAAVRDAAITAGNIIKGGGAGATSDHHRHHHEDGHNNNMLKEAAGMVDFYSPTAAALIGYGSQVAPPNNRAAARLAAASAHLMPNFEVHTGGTGFGP

SEQ ID NO: 111747 - protein, 191 aa, Triticum aestivum
  unsure (1)..(191): unsure at all Xaa locations
  Clone ID: PAT_TA_6165.pep
YMMDCTANDCHHLLKSADKXELYPTVLLFPAENKSAISYGGGMSLGNLIEFLESHASNSRHMSEYKGFLRKKRMVMQHEAPQTVRFHMKDKSGSNVGSDPPSQPEKRKVHIVTGSILDATEKLGAAVPFDNARVLIVSADSHEGFHGLIINKRLSWDTLKNLDSSLEPIKLAPLFYGGPVVVQGYHLVSLS

SEQ ID NO: 111748 - protein, 411 aa, Triticum aestivum
  Clone ID: PAT_TA_6166.pep
MPLFKRTPFFLLDPPKDLDPKEKVFQVRFTKEIFRDYQEYLNRLNLYRKRVWTCKVSGKSNLTYEEALVSEQRAAEKAQQLPRELMSPVLQMIQYSTLNLTDLVNKIYGSLQENLFEGLELHAKRDGSEAACKILKVIGSGKTTSYEVGWIGQDNAITSTSVLRADDLIRKKAPCGRNMLKIFVRESTSQNSPWIVHMNLAKKYGIPTEPPKDMINGEGLSKARKRLANGTAEDASKRSKKDEEEQVVPVKYPIDDLLVKPVADDPLLSKRCPASTDFKVPISSVGDLLMVWDFCMSFGRLLCLSPFSLSDLENAICHKETNLVLLVEIHTALLNLLINDEGEYYEFIQNKNRKSKVSLVTWKEYLCDFMEMTSISSNISTVRRGHYGLVPTSLKLEILRELVDEAIATIA

SEQ ID NO: 111749 - protein, 135 aa, Triticum aestivum
  Clone ID: PAT_TA_6167.pep
MDMDTFERLQAETRLRDALMRLEEAEETDDDEERGAEEEELECPFCGEEFDGVGLCLHIEDEHAAETKAGVCPICTDRVGMDLVGHMTSEHPSFLKGRWRNPGVFSSRPNVSELKKMIRYVSRQLANKCQLWNSL

SEQ ID NO: 111750 - protein, 152 aa, Triticum aestivum
  unsure (1)..(152): unsure at all Xaa locations
  Clone ID: PAT_TA_6168.pep
MPRRFQWGLLRSDRAPGSPPDGVVARAAGPAVDAPAREGPPPRAAQAPPQAPPSSASSLPKEQSQVELELRLLQALGFYPPSKLKGIHRHFILYGLMEYLRKSLDRQFSADEVLQCXRFFNLEMLKPDDDEKDNFGQTEEFALPDNFFKKEE

SEQ ID NO: 111751 - protein, 105 aa, Triticum aestivum
  Clone ID: PAT_TA_6169.pep
ELRTDKFDRVFQRLIFNCFVFCQVFNEVSSREMERINVFKGILNNNVFVAVLGSTVLFQIIIVQFLGDFANTTPLSLREWFSCIVIGFIGMPIAAIVKLFPVGSQ

SEQ ID NO: 111752 - protein, 470 aa, Triticum aestivum
  Clone ID: PAT_TA_6170.pep
THALGDLFIYLCAEGFGCVEDAAEDASDGQKDATGTGTPTRPGQESASSKIDDISQLEGTNEMDAQCKGDQTPKDDDQAIEMEGDFAAELADVSENESNDSGSEGEDNLDNQMGDTGDASEMVAKKSWDKNEDDDSKTSDEKYESGSLAKGADENNRELRAKDECPMETDPVETDDNEQGKNNNMDDEPSACEDADDVMNKADAYDDRTGPELSELDNDDEDVNMDDTEQTDGLGADNPDNEDMGPEEGHQEDDSAVASEDMEEDDATHDGNNVVDNEGEHDEDGNVEPNNMEKQQLDKMESPAHPSQGIQPNQLETDSNRESEANLANSMDMSSGVAPSVDFSSNEVPSLEISMPNSGEGSRNLSNSKPELQPDAPPSHIKQTNPFRSIGDALEDWKERARVSDDTQDHQPETEHHIDESATEFRYVPEGEQSTSQALGDATADQINDELQVRQPMLEDETRAEVEQPD

SEQ ID NO: 111753 - protein, 299 aa, Triticum aestivum
  Clone ID: PAT_TA_6171.pep
CRRDHTKTEYIVTHVKAEKREKWFKCRYEVNVSDNLGYFSCICGLFEHMGMVCCHSLQVMNVLRLKEIPPRHILKRWSIHGRDNLPDHLKHYQQDMGPPDAPTYRHSALYITALEVVKMGDRNLESYKFMLDGLVDLRERGAEISAPNDGLGIAEQQVSNTGVAGGSNGKTKSCKAACSVRSVEGNHLSAGGATSVSVHPPASQGEGGTKSQDMASEGSCPNANSYNSDYSETASRLDVNVGDSMLAPEREKKRGRPTTSRDKGSVLRRGSTKKIKVFVLFCRGPKEHKFKAPCPERWW

SEQ ID NO: 111754 - protein, 67 aa, Triticum aestivum
  Clone ID: PAT_TA_6172.pep
AALVIKDLMSVVKYCHEMGVIHRDIKPENILLTKTGKMKLADFGLAARVTNGKFLLIFHVEALLDDK

SEQ ID NO: 111755 - protein, 80 aa, Triticum aestivum
  Clone ID: PAT_TA_6173.pep
LHPTSQNPLYWIPTAAGVNPAQVKSEIITYMYHFHAADFFLIYRKAYMEHRTMKIYKNIKIHSVAAKRAEGVTKGPNEHT

SEQ ID NO: 111756 - protein, 298 aa, Triticum aestivum
  Clone ID: PAT_TA_6174.pep
MESAAGAETPNLSAPATPGTPAPLFAGARVDSLSYERKSMPRCRCLPVDAWMSSNACVVEIPAPDVSLPRKLGAEFVGTFILIFFATAAPIVNQKYGGVISPFGNAACAGLAVTTIILSTGHISGAHLNPSLTIAFAAFRHFPWLQVPAYVTAQVLGSISAGFALKGVFHPFLSGGVTVPDVTISTAQALFTEFIITFNLLFVVTAVATDTRAVGELAGIAVGAAVTLNILVAGPTTGGSMNPVRTLGPAVAAGNYRQLWIYLVAPTLGAVCGAGVYKLVKLRDVNGETPRPQRSFRR

SEQ ID NO: 111757 - protein, 234 aa, Triticum aestivum
  Clone ID: PAT_TA_6175.pep
MAVVVKRTKEGASVEKNNSFTADYKMTNGHAHADGLGLSPSHVNTPGSRRNNNDKYSKKIERKRDNILDFNTDPLPHYSMDEEAVGIITMEDVMEQLLQEDILDETDEYVDVHNKIKINMLPPGKSLSPLISPSGGPLSQGLRKTPMASPLSPYHNGGSILRSPAANHARSPGTLPTAFSPGRSPASQTPVRSSPTSSWVSEEFVPKSIEMVVRADAKELRGQQSQLRSLPRSN

SEQ ID NO: 111758 - protein, 182 aa, Triticum aestivum
  unsure (1)..(182): unsure at all Xaa locations
  Clone ID: PAT_TA_6176.pep
MASIALVLTVCFLGFYVPAPSLASSSNNNDFLRCLSTSIPGQLVLTPSSPSFTPLLVSSIRNXRLVAPATANPPLCIVXPTNASHVQAAVRCGRRXAVRVRVRSGGHDNEGLSYRSXPPPTAEAFAVIRPRQAPRRPTSNPHGAAAAVGARAPAGELPGRIATAAPGLGFPASVCPTVGVGA

SEQ ID NO: 111759 - protein, 83 aa, Triticum aestivum
  Clone ID: PAT_TA_6177.pep
GRRPAPFVDRGWPGAPLQWVIHASGALSWWPYPFLDLASPGAPLWYLAMAVAHVPCFSAYWLVVKAKRTYFPRMFPQAYVRTS

SEQ ID NO: 111760 - protein, 158 aa, Triticum aestivum
  unsure (1)..(158): unsure at all Xaa locations
  Clone ID: PAT_TA_6178.pep
MAAAPAPAPSPPEASPPPLDASASASDDEWDADGFVIPDVTIQDDDDDVTTHSVPKARDPEPQQAKEEKIYLGPHGAPPSGAKQQQLNTVGRKQSVRNKLKEADRKSSGNAQENKVEXLRELMGGCDNRXGRGMAKSSRREWLDPHLXAESEFDRKPR

SEQ ID NO: 111761 - protein, 477 aa, Triticum aestivum
  unsure (1)..(477): unsure at all Xaa locations
  Clone ID: PAT_TA_6179.pep
GTSGLDSSSAFXVTQTLRGLARDGRTVIASIHQPSSEVFELFDMLFLLSGGKNVYFGQAAQACEFFAEVGFPCPPLRNPSDHFLRCVNSDFDKVKATLKGSMKARIERSDDPLDKITTSEAIRKLVSAYNRSQYYYAAREKVNDIARIKGTVMDSRGSQASFLMQACTLTRRSFINMSRDFGYYWLRLLIYLLVTVCIGTIYLDVGTKYTSILARAACAAFVFGFVTFMSIGGFPSFVEEMKVFQRERVNGHYGVAAFVIANTISALPFLVLICFMSGTVCYFMVRLHPGFTHYIFFVLNLYASVTVVESLMMAIASVIPYFLMGIIIGAGIQGIFMLVSGYFRLPYDIPKVFWRYPMQYISFHYWALQGQCQNDMDGLLFDNQYPDQPKIPGEFILKYIFQINVHRSKWIDLSVIFSMIFIYRLLFFIMIKVNEDVMPWIRGYIARKRLQKKVPAIGKTPSLRGYVVDPELGPNEG

SEQ ID NO: 111762 - protein, 216 aa, Triticum aestivum
  unsure (1)..(216): unsure at all Xaa locations
  Clone ID: PAT_TA_6180.pep
RDIALKFQDXDAANVFGSALRIQQTENSFAFGSCINRSNIENEDLAPFSARGFNWAVFENELKWYWTEAEQGKINYKDSDELLKFCQKHNKQVRGHCLFWEVEDSVQPWLRSLHGHHLMAAVQGRLQSLLSRYKGQFKHHDVNNEMLHGSFYQDRLGTDIRAHMFKGSHKLDPSEXXFVNDYNVXDGXNSKSTPXRFVXQMADXXNGGGPKLGGIG

SEQ ID NO: 111763 - protein, 159 aa, Triticum aestivum
  unsure (1)..(159): unsure at all Xaa locations
  Clone ID: PAT_TA_6181.pep
XLFVIYMIRFKLRSTYMLDKDNFALYYVVIPCAVLALLVHPSTSHNIANRFSWAFCVYLEAVSVLPQLRLMQNTKIVEPFTSHYVFALGVARFLSCAHWVLQVLDTRGRLLTALGYGLWPSMVLLSEIVQTFILADFCYYYVKSLVGGQLVLRLPSGVV

SEQ ID NO: 111764 - protein, 201 aa, Triticum aestivum
  Clone ID: PAT_TA_6182.pep
TCAGLSLKTQDLTALFLAVRLYCSFVMEYDIHTVLDTATLVATLFVIYMIRFKLRSTYMVDKDNFALYYVVIPCAVLALVVHPSTSHNIANRFSWAFCVYLEAVSVLPQLRLMQNTKIVEPFTAHYVFALGVARFLSCAHWVLQVLDTRGRLLTALGYGLWPSMVLLSEIVQTFILADFCYYYVKSLVGGQLVLRLPSGVV

SEQ ID NO: 111765 - protein, 273 aa, Triticum aestivum
  unsure (1)..(273): unsure at all Xaa locations
  Clone ID: PAT_TA_6183.pep
MRAPRRPMAVVLSWVRRQPPKVKAFLAVVAGMTALVFIRFIVHDHDNLFVAAEAAHALGIAVLIYKLTKEKTCAGLSLKSQDLTALFLAXVRLYCSFVMEYDIHTILDSATLVATLFVIYMIRFRLRSTYMLDKDNFALYYVVVPCCVLAFIAHPSTSHVMINRICWAFCVYLEAVSVLPQLRLMQNTKIVEPFTAHYVFALGVARFLSCAHWVLQVLDTRGRLLTALGYGFWPSMVLLSEIVQTFILADFCYYYVKSLAGGQLVLRLPSGVV

SEQ ID NO: 111766 - protein, 216 aa, Triticum aestivum
  unsure (1)..(216): unsure at all Xaa locations
  Clone ID: PAT_TA_6184.pep
ALLMKQLVDLRLYQQSSNLEVQSLIQRLQVMEQNQKQMMALLAIVVQNPSLLNQLVQQQQQQRRNNCVYEDGNKKRRFPALEQGPXVTDHETSGSGAEIIQYRPPVPETSSQVIADEAFLSATAQPISSAALNMPMDIDTQTTLGNLNTQGSSGDIFADMPALPDFEDMHLWFSEDGEPTLTIQDYDEFPQSGQDCQMEAQHNYNNPQHADAITEA

SEQ ID NO: 111767 - protein, 71 aa, Triticum aestivum
  Clone ID: PAT_TA_6185.pep
QGVSSLSNQVKYPSSSRRKGSGISRPQVSTFLVIWSIGGILLGMLWMSKHEKARVASVQSQSRKRKVCDNC

SEQ ID NO: 111768 - protein, 217 aa, Triticum aestivum
  Clone ID: PAT_TA_6186.pep
QNIMHRDIKGANMLIDGNGVVKLADFGTAKHLSTAAPNLSLKGTPYWMAPEMIRATLVKDVGYDLAVDIWSLGCTIIEMFNGKPPWSGLEGPTAMFKVLNKDPPLPDNLSHEAKDFLKCCFKRNPAARPSARELLTHPFIRNSSHYSKHVQEVIIAGCEEVIRASCDPSLTRKTTTSGGNDARSSESLVSQLTLQPVQVVTPYFPPRNSGFVSNPGS

SEQ ID NO: 111769 - protein, 164 aa, Triticum aestivum
  Clone ID: PAT_TA_6187.pep
LAPSSAPGSSVPVHLYLHPRRRGTQLPSPTSNHFISYRCESHPGFVVCQPRRRPALTTPSGQHGRTTLLPRAGVSAVLPPPATRRTSFLVLQSVAPFDGGVSSVRAEAGNGVFGSCKQCRSGGRDEPEGGDVMGGELARLGGRRWPSFFTGRTRHQRGRDLCRG

SEQ ID NO: 111770 - protein, 133 aa, Triticum aestivum
  Clone ID: PAT_TA_6188.pep
GSVNEWKEKLFKHELALGRETLYSRDTGSCNQRRRSKNQYSMFRRRISRLPAALSGRGAQSLSFLISPPPFPSPLVVSEPWPPRAAAEPPVASRCRVPSYGRSPCLPLTGFYASPWDFRLLPHTTLTRTKETP

SEQ ID NO: 111771 - protein, 192 aa, Triticum aestivum
  Clone ID: PAT_TA_6189.pep
FVNCAAVLFALTAGVDAYTVPALSARAKDSGPKAVNISVPVDHFHNETIYEPHSDKKFPLRYWFDAQYYRKGGPVIILASGETSGEDRIPFLEHGILQMLANATGGIGVILEHRYYGTSFPVPDLKPENMRFLSTEQALADTAYFAQHVEFPGMEEHNLTASTTPYIIYGGSYAGAFAAFARKIYPDLFWGG

SEQ ID NO: 111772 - protein, 276 aa, Triticum aestivum
  unsure (1)..(276): unsure at all Xaa locations
  Clone ID: PAT_TA_6190.pep
FFFFFFKKDLNLMAMSIHSCGNLSHFGIRSLVLNPDIRAVAIVGCCYNLMTEKLGPPTYKHAFLRPTLQAVNGRLVRESDKHDPQGFPMSQRFSTHQGDGVRLNITARMMACQAPQNWTEKESAGFFSRHFYRAVLQKIFLDRGVVRKIRHGDSQGEPRDADIAPSAQDDSESPFDISTNPVIIGSLRKSCYGTFKSYVRGAVEKLTTNTDYKQYTEVMQEKMGGITDEEIEQYEAQYLPRKKELCAIWSLMAFSAMAVESLXIVSDRWTFLKEHD

SEQ ID NO: 111773 - protein, 148 aa, Triticum aestivum
  Clone ID: PAT_TA_6191.pep
ARAGAAPKLARPGPRRRWPGLTLHLPPSPRYRNTSDNDLAYWGLDYPPLSAYQSRLHARLINASLPDAVALRSSRGFESHESKLLMRWTVLSSDLMVFFPAALWFVWAYIRGATARLAMVLLNPCLVLIDHGHFQYNCISLGLTLGAI

SEQ ID NO: 111774 - protein, 132 aa, Triticum aestivum
  unsure (1)..(132): unsure at all Xaa locations
  Clone ID: PAT_TA_6192.pep
MRSLLLEVPISKVYPGTVHRWCKWHVLKKMKETLGPLYMKKSEFQAEFHEVVNHMLTDEFEMAWATLLDNYNMRKHSYKTQIYDIRKXWAKPYFKGFFCAKMTITQGNESVSPFLACDRDRLSICGRRLLTR

SEQ ID NO: 111775 - protein, 213 aa, Triticum aestivum
  unsure (1)..(213): unsure at all Xaa locations
  Clone ID: PAT_TA_6193.pep
YISWLQRHEEIMQDVETCAMAFRLLRMNGYDVSSDDLSHVAEASTFHCSLEGYLNHTKSLLELYKASKVCLSENELILENISNWSGHLLAEKLRCDGTQRMPIFGEVEYTLKFPFYATVEPLDHKRNIEHFDSRVTQQLKRKNMPCHANQDLLDFAVEDFSFSQSIYQDELCHLESWEKENKLEQLKFLRKGSLINXYLSAAATLSTHELSDA

SEQ ID NO: 111776 - protein, 192 aa, Triticum aestivum
  unsure (1)..(192): unsure at all Xaa locations
  Clone ID: PAT_TA_6194.pep
EGKELEQYEAASMGALGTGMREVDPDDEYDDGIDDPDDSQMHSAGRKLGDGIHENIGKEENAALERHMKAAGGRISDDSDAVNTNQKKASGTGDKKHGSKKKPKQKKSGSTCEMKFLNSTAQLVEPAKNEKFASFKLEYVEIEQKPAGSENWEPRFAGHQTLQEREESYVAHDQPIDMGFXVKGPNGSSTGF

SEQ ID NO: 111777 - protein, 184 aa, Triticum aestivum
  Clone ID: PAT_TA_6195.pep
MDHRPQAWGRPRDDVYGAYDASFMSDNGPKQNTQQPIVTGTSVIAVKFKDGVVIAADNLASYGSLARFTDVKRLRPFADSSVVGFSGDISDMQYLDRHLIELSLDEAYTSPDAPRLNAANLHRYLAKLLYRRRSKFDPLWNHILVVGLDDDDKPFLAAADLLGSTYSAPSLATGFGAMLAQPIM

SEQ ID NO: 111778 - protein, 184 aa, Triticum aestivum
  Clone ID: PAT_TA_6196.pep
MANQETHYGFDEGGDDDQSIVSTRGLEAFSRKVTTTATHLIGPNAEATAHHYQAAMAEVHKQMKRPTVQRSMFAMARTTPTDLMRSRLSTHEIQHRALTFLPDDLLANIPEHENPYSLFQGFQASFPELTDEGKKFQRRVSRGRKMLEDSEGTPGSPKKLTQLKKEKAAMMHEFGLLGTRKSMA

SEQ ID NO: 111779 - protein, 83 aa, Triticum aestivum
  Clone ID: PAT_TA_6197.pep
MIIMQVGIVACLGMKKATGGSAVKPRKDLPETVLSRRAVYVQGKKRSFSQCQTIVKMKPTERARRNEEVGFGFTSFGVVVKKI

SEQ ID NO: 111780 - protein, 122 aa, Triticum aestivum
  Clone ID: PAT_TA_6198.pep
RRGLTDDAVKGHSCSGSTCYYKQIGDAYICEKTGRVHVCDDACREFVLDQASGLLVCTISGHCFERFLCPDDEWDTCDADQQQGGVTDEAEPFMGSGRFARAYQLGYSCADEKELEHALRFC

SEQ ID NO: 111781 - protein, 76 aa, Triticum aestivum
  Clone ID: PAT_TA_6199.pep
TATRIFSASEKPSIFLQRCIYRSAQMSYDTKSRVCSRFSIQKTPYRAECPTCSKLKKISGSQTNTCLARFFYLLPD

SEQ ID NO: 111782 - protein, 174 aa, Triticum aestivum
  Clone ID: PAT_TA_6200.pep
PKEFETEILRLKRLLAEKSDTNDHTALVSPETINEVIQKQTPVSSARTPASNRTNTVQSSVKAIAHHGSFQDEASEDCCRRGVCSSGSGTDESSRSCVYHMLVESLVGMKFSLKDETEGLSLSIHHEATGYDFSLTWLEQADGGEWAYKYSSLGTLEEMALKWMKVQDIRFSMD

SEQ ID NO: 111783 - protein, 369 aa, Triticum aestivum
  Clone ID: PAT_TA_6201.pep
MITLGVPTIVQAVILIVLAVLICWRLRKAKQDDEWEIKCGLAAFTYKDLVTATEGFSDRMLLGKGGFGRVYKGVLPTTTQHVAIKRVSPESKQGKKEFMAEIAILGHVRHRNLVQLLGYCRYKQELLLVYDYMANGSLDRYLYDKTTPTLDWAQRLRIIKGVASGLYYLHEDWEQVIIHRDIKASNVLLDDDMNGRLGDFGLARLHDHGVDAHTTLVAGTWGYIAPELARLGKATKATDVFAFGVFTIEVVCGRKPIGPANTSGGLLALADWVRGTWQGGSIVDAVDPELKDYDRAEVELVLKLGLLCSHSLPRSRPCMRLVMLYLEGGARLPNFHPASLVADGHEDEETDHKALSTSAATTVTILSGR

SEQ ID NO: 111784 - protein, 272 aa, Triticum aestivum
  Clone ID: PAT_TA_6202.pep
MDAQYNPRTVEEVFRDYKGRRNGLARALTTDVEEFFRQCDPEKENLCLYGFPNEHWEVNLPAEEVPPELPEPALGINFARDGMQEKDWLSMVAVHSDAWLLSVAFYFGARFGFDKSDRKRLFGMINELPTIFDVVSGKSKTKAPTNNNHSNSKSKSNNKMKTSEPRAKQPKPQLKEEDHEDEAPDAGEDGGGAAGGGGGGEEHGDTLCGACGDNYGQDEFWIGCDMCEKWFHGKCVKITPAKAEHIKQYKCPSCMGANGGGSGSNKRARPSS

SEQ ID NO: 111785 - protein, 326 aa, Triticum aestivum
  unsure (1)..(326): unsure at all Xaa locations
  Clone ID: PAT_TA_6203.pep
HAKQIETDFAAPRVKPEFGTQSAPIFADNVLDPSVRLRKLNSPMFSSPLQSSRTNYSYKLPTPADDKICTSAGTNRSPHSDKPESSHVAANLWHSSPLVKDYMPSSLYSGPVKMPSSTERRSSPLVYSYSTSDSKKMKRESFSGPIPSKAGLSKPLFSAAGHRASVNYPPRVMSTKSHGPGSLPSVAPKVPRITSLPTTSPRISELHELPRPPAPLDTLRPGLVPAAGPLVSGRQLPNVPTRAXSPPSNTASPLPRPLAAMTRSYSIPSNSQRTPIITVNKLLESRHSRESSEVSSPPLTPISLADVSRRSIAETTIDTRRMKETS

SEQ ID NO: 111786 - protein, 116 aa, Triticum aestivum
  Clone ID: PAT_TA_6204.pep
MSRSLSQKIYSDVFARWPKQALRPDHQLQDVLGKAVTERFQNYKPSMEREELLKARALQFLAQDRYNDRFKLKGRLLEPKSQPTYFADLIREIDEAPNRSWLERLGKRLSGMIRFQ

SEQ ID NO: 111787 - protein, 310 aa, Triticum aestivum
  unsure (1)..(310): unsure at all Xaa locations
  Clone ID: PAT_TA_6205.pep
ALPAGPPPLESPPPPLLPLAVGAPVDGVGPGGGGVPWVDGPALGPVRDRRDAFWWVFSAAPDRPRLETPKRATLEDEADEKEVTVCNHEIQIHEDLGHVCRVCGMIVREGLTXIIDYQWRKASRSRSYFSEKRSKDSDEIVTADVRVPEELNALGIAIHPRHEKQMRPHQLAGFHFLVKNLVSDKPGGYILAHAPGSGXTFMLISFIQSFLAKYPSGRXLVVLPKGILGTWKREFQRXQVEDIQLYDLCSVKAVTRAEQLEILNPWQANLSILFVGYNQFSWIINTDGGGTVANTGPHMLLTPEKNKQSH

SEQ ID NO: 111788 - protein, 168 aa, Triticum aestivum
  Clone ID: PAT_TA_6206.pep
STRVPPLLRSHEYPLFSAPSIGAAGHRLHLPHPCISPRHRLSPSLNIRATEQETKDGGVPGVDRKSSDEGRRRPHRGGRRTNELSRWEGMKEKISPPPTRACRRAVLSCPTLAAPSSPPPDSPSSFLAWPSMSPLLYNPAPAPAPTPGWPHPSFCSESRGREGGQRWA

SEQ ID NO: 111789 - protein, 119 aa, Triticum aestivum
  Clone ID: PAT_TA_6207.pep
MMAAAPQWTIESMQRSCAKDDSSCTWNFKIDTHKGAATACKFVVKGSKASQRNGGPVRCGDYTVTCGWRGRFGPGNGFTTLSVVSSEGQIVWPAYTDKQVQGGKVVKPDQSYAPANLPN

SEQ ID NO: 111790 - protein, 145 aa, Triticum aestivum
  Clone ID: PAT_TA_6208.pep
RAAMGRRRRLGLLLATGMSSWTAGGAWRTCSDAEHPMDITMSRVRSASDTGGIYFTYPKVNHLLYTCSLDTFEDGILLDTPLMCMHRYCRNTTDDEEECKRQGTTTPSVREAWKRRRNKRSCWKLQWPDIWARGRTSGACAEELQ

SEQ ID NO: 111791 - protein, 96 aa, Triticum aestivum
  Clone ID: PAT_TA_6209.pep
TCYRVKSRQEVDISFGTNNRNRTKIQSYRHVNESFSTTMSNRGHFPAFHCVFTQNTHGHMETHWIQLVYLVKRKAEGSSAEGAKGVRRGHTQKRHR

SEQ ID NO: 111792 - protein, 114 aa, Triticum aestivum
  Clone ID: PAT_TA_6210.pep
RIGVPPFVVPLSKECLENIHGWCKTHHGASGLTDQVLQSDISECDAQKQVLDFVRRYIGSATPLIAGNSIYTDLLFLKEYMPRLPGGFPPGTVDGGSPPAPWTTSVPAARELPP

SEQ ID NO: 111793 - protein, 65 aa, Triticum aestivum
  Clone ID: PAT_TA_6211.pep
CSTDTTLREGTVVQQEALQIELNLSFFIYLRNITTITSAKQAVIILSAKEKQRKITCHFQGKHQK

SEQ ID NO: 111794 - protein, 135 aa, Triticum aestivum
  Clone ID: PAT_TA_6212.pep
KNYISTVIFALRSPPCRLSLWPPFTSSWFAGCHYVSCRFARRHRWKGCVGRRLCHYYAVTSEGHGIETDQKGNTTGHSAGRGLPVCAGDWITSPPPLSLSLLLLSRHLINSKATGRHDGDQGYVRRVVSFVYHTV

SEQ ID NO: 111795 - protein, 69 aa, Triticum aestivum
  Clone ID: PAT_TA_6213.pep
HEPPLHVAHSPSPPRRLLPPHHRPASFPSAASYPRAAMTPPCPAPSPLGSTPAFSYEPATMIHPWEGGG

SEQ ID NO: 111796 - protein, 205 aa, Triticum aestivum
  Clone ID: PAT_TA_6214.pep
ASHIPFPSLVVLVSQLSLISLSYLHQEINTNRRCSTALSSVRDTKSLCHAYHLLLILMPLPFLFPVSLTSPPCRNRAAPPPMELPPPWSPGTMVSAASASIRQETRPEGFSRLDPNATELPRRPLLILPLSGFLSAAMPAVCFTEPAAKSHIAAALFPVENRRTPHLPRVIRASAMTFPRPNQAGRPSAPLPASPSPATGPKPKG

SEQ ID NO: 111797 - protein, 342 aa, Triticum aestivum
  unsure (1)..(342): unsure at all Xaa locations
  Clone ID: PAT_TA_6215.pep
MPNVKSAGGAGASAIPAGGDGEVEAGFAKLQGGDLEYYMQTYSIMLGRNSKKSTVDVDLSSLGGGMNISRHHARIFYDFXRRRFALDVIGKNGCLVEGVLHLPGNPPVKLDSQDLLQIGDKKFYFLLPTRSIFASFAARQAPVIPPQIPPPAYARPGHPRVSDFHDRFSEGDYGRDSDDIGNGVGEGGMKGKLKRTKKSPGDLDIYGGHRINVEAIGTLGEDNRSEIRSRGDKDVDNQHLQTEEKEVVSSVATVLSDLCGPGEWMPMKTLHTELMDQFGNVWHHSRVRKYLTADDWSPIEAKGRPWYGLLGLLRKYPEHFVINTKSKGRAISEFVSLVSLLS

SEQ ID NO: 111798 - protein, 111 aa, Triticum aestivum
  Clone ID: PAT_TA_6216.pep
RGCRIPLPLPPSCSHSPSSLFICFFLQGSHSGKRSPPWWSVPPRRRRRRLGFLQGRGRLGFHQAPSSSSSSRSIPSVQQREDKGLIKARGARNFHSTAPLLIRHPISKQSW

SEQ ID NO: 111799 - protein, 127 aa, Triticum aestivum
  unsure (1)..(127): unsure at all Xaa locations
  Clone ID: PAT_TA_6217.pep
MPTPESEQFKAQKPTVAPTFNGVDYDDTKAFKAAEDALIREQWVGAMMTRLXGEELNKCYVREGVNHLENCGHLRERYLQLLKSNKIKGTKFLQQNYIDQKEHDLDLAAKVHTSDKIAKMNRDRFSS

SEQ ID NO: 111800 - protein, 106 aa, Triticum aestivum
  Clone ID: PAT_TA_6218.pep
RKENAVSALYEICRRGGSALVRRVAKIPGLNTVIQNIMLTGTKRAKKKASLIVKMCQRSQMPSAMSLGTSLRVVDHSLVGNSSLRRAASFGSGELSNPVSISVHVP

SEQ ID NO: 111801 - protein, 299 aa, Triticum aestivum
  Clone ID: PAT_TA_6219.pep
MVAPAAEAEAEAGRKTLPDECKTLWQIAGPVILTGVFQFLIGFVTVAFVGHIGKVELAAVSIVIGVIEGLGFGLLLGMGSALETLCGQAVGAGQLHTLGVYMQRSWIICLATAVALLLVYMFTDPILRLLRQSPEISAVAGRYARWCVPQLFAYAVNFPMQKFYQAQSRVWVMTVISGAAVGVHALLNWVVVAKLGRGLLGAAMVGNASWWLINAVQFVYVVGGSFPEAWTGFSRKAFASLGGFVRLSLASAVMLCLEMWYYTAVIILVGCLKNPEIQVGAVSICTNYNIWTLMVSVGF

SEQ ID NO: 111802 - protein, 214 aa, Triticum aestivum
  Clone ID: PAT_TA_6220.pep
AAALPPTTAHGVAEAPGPPPPPLPADPLSGAHGVIVSPVPPPESPRLQPFIETDEIIISNKSRNGRPRQLLSMGPNEWLEVTVGVVGKRGEMHSLNPSITVKESGEILSLEEKFQGGTGINLTPPPATIMSEDALEKCKNCIEMMANTLGLDGFSRIDAFVNVRSGEVLLIEVNTVPGMTPSPVLIPQALTEEPPIYPHKFFRTLLDLAFARAD

SEQ ID NO: 111803 - protein, 190 aa, Triticum aestivum
  unsure (1)..(190): unsure at all Xaa locations
  Clone ID: PAT_TA_6221.pep
TRPAKALAADLLVHYGHSCLVPAXSSLLPVLYVFVEIRVDALRLAAAVRGAFPDPDAAPRLALAGTVQFIAAVHAAREMLTRDGYRDIVVPQAKPLSAGEILGCTAPTLKKAEGVGVVVXVADGRFHLEAFMIANPAVKAYRFDPFLGVLVLEEYDHVGMKQARKEAVLAARKAKSWGVVLGTLGRQGSL

SEQ ID NO: 111804 - protein, 123 aa, Triticum aestivum
  unsure (1)..(123): unsure at all Xaa locations
  Clone ID: PAT_TA_6222.pep
GCAAACPSLPPPRPVPTCETSNSSSSSSAPPRPLAHRRKRPSSAGHRDLDRRAAPRSRSPGSPAAADAIRAXPRAAGLDSGPADSAPAPRRNFARPNFDGILPTRRARGAPPGLRPAPGPRGG

SEQ ID NO: 111805 - protein, 90 aa, Triticum aestivum
  Clone ID: PAT_TA_6223.pep
FFFFFFFFFRNEGSIFIAANFCTTYTCTMSFGTLLPFYLYIHVQSLKVRKKIYRHVTCRNPAQIVLNNSNMDKRGFFLMSKKERKRVLPK

SEQ ID NO: 111806 - protein, 124 aa, Triticum aestivum
  Clone ID: PAT_TA_6224.pep
LFVATQMAVTAADGTRGGLIDITFSFSSPLDASASNRILTACAPTWRAKDVGGNDTYGITKNPFCYGWRARGCEKSGVRRSTRGVYPGSGHKRCIIPCSCWFAFIWCSWTSYKVCRVQKIRILP

SEQ ID NO: 111807 - protein, 285 aa, Triticum aestivum
  unsure (1)..(285): unsure at all Xaa locations
  Clone ID: PAT_TA_6225.pep
MAGTTRLEAGGSDGEYTQDGTTDLHGNPILRSKRGGWRACAFXVVVYEVFERMAYYGISSNLVLYLTTELHQGTVXSPANNVTNWVGTIWMTPVIGAYIADAHLGRYRTFMVASIIYLLGMILLTMAVSLPSLKPAKCGLGTADPNCDHKATSVQLGVFFLALYIPAVGTGGTQPNAATLGAPRGDDPLPRGRKPRLPFCHWXVFSRGCPPPLANTVLVYIQDRIGWXTVGYALPXAGLAVXIAVSXPGRPSXRHKATPKXPSPRWRLIVAAXRKCASRAVGPRD

SEQ ID NO: 111808 - protein, 92 aa, Triticum aestivum
  Clone ID: PAT_TA_6226.pep
MAGIMHKIEEKLHMGGGSDEHKKDGEHKKDGEHKEGMMEKIKDKISGDGHGDGKKDGDHKEKKDKKKKDKKHGEGHKDDDGHGSSSSDSDSD

SEQ ID NO: 111809 - protein, 102 aa, Triticum aestivum
  Clone ID: PAT_TA_6227.pep
MAGIMHKIEEKLHMGGGSDEHKKDEEHKKAEEHKKKDGEHKKDGEHKEGMMEKIKDKISGDGKKDGDHKEKKDKKKKKDKKHGEGHKDDDGHGSSSSDSDSD

SEQ ID NO: 111810 - protein, 106 aa, Triticum aestivum
  Clone ID: PAT_TA_6228.pep
MAGIMHKIEEKLHMGGGSDEHKKDGEHKKKDGEHKKDGEHKKDGEHKEGMMEKIKDKISGDGHGDGKKDGEHKEKKDKKKKKDKKHGEGHKDDDGHGSSSSDSDSD

SEQ ID NO: 111811 - protein, 190 aa, Triticum aestivum
  Clone ID: PAT_TA_6229.pep
MALPHHRIPLASPFSLERSSQKQQRHGRHHAQDRGEAPHGRRQRRAQEGRGAQEGGGAQEEGRGAQEGGRDHFPRREEARNSSAMAGIMHKIEEKLHMGGGSDEHKKDEEHKKAEEHKKKDGEHKKDGEHKEGMMEKIKDKISGDGHGDGKKDGDHKEKKDKKKKKDKKHGEGHKDDDGHGSSSSDSDSD

SEQ ID NO: 111812 - protein, 294 aa, Triticum aestivum
  Clone ID: PAT_TA_6230.pep
PRPFCRSLVTCAFNTRKLSPVFVAGPNMDEAPPVWVDRVGFKANITESFTRQSKFTYGLVVEEITTRDETNSICTHGSRAMPSGGLSMDGPPTTLSGTGVDRMAFLQANITRDNTEFVNGAVIGDRCIFQLDQGLGIGSKSPLFNRHQLTLTKFINLNNQEKGVGKPLPAVLVLHGHYAGCVGDLPSYDAFTLGGPYSVRGYGMGELGASRNVLEVAGEVRIPVKNTYVYGFAEHGTDLGSSKDVKGNPTEFFRRVGHGSSYGVGVKLGLVRGEYIVDHNTGAGTVFFRFGERF

SEQ ID NO: 111813 - protein, 79 aa, Triticum aestivum
  Clone ID: PAT_TA_6231.pep
EDLVLDYIDTGAAVSSMVHLEAVHGENQAALLSDPETKCTDVSFVNVGMATKLRLVGGYSGPLVGTNIRTPVSKAEIQS

SEQ ID NO: 111814 - protein, 128 aa, Triticum aestivum
  Clone ID: PAT_TA_6232.pep
AGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSPAAAEKEAKSPKKKKAAKSPKKKVAAKE

SEQ ID NO: 111815 - protein, 148 aa, Triticum aestivum
  Clone ID: PAT_TA_6233.pep
MAGRKGGERKKSVTRSVKAGLQFPVGRIGRFLKKGRYAQRVGSGAPVYLAAVLEYLAAEVLELAGNAAKDNKKTRIVPRHLLLAVRNDQELGRLLAGVTIAHGGVIPNINPVLLPKKSAAAAEKEATKSPKKKAAAKSPKKKPAAAKE

SEQ ID NO: 111816 - protein, 148 aa, Triticum aestivum
  unsure (1)..(148): unsure at all Xaa locations
  Clone ID: PAT_TA_6234.pep
MAGRKGGDRKKAVTRSVKAGLQFPVGRIGRYLKKGRYAQRVGSGAPVYLAAVLEYLAAEVLELAGNAAKDNKKTRIIPRHLLLXAVRNDQELGRLLAGVTIAHGGVIPNINSVLLPKKSPAAAEKEAKSPKKKTSTKSPKKKTAATKE

SEQ ID NO: 111817 - protein, 238 aa, Triticum aestivum
  Clone ID: PAT_TA_6235.pep
MASFLVECLGWLIVVLFSLYIFQLLRDARRRLPPGPWPPKPIIGDLLDLGEDGQQHRAFLRLADRYGGLMCLRFGMVPHVIISTPDALRAVFGGEGKKVDNIAGLPSLDVLSAMGHRAHTIFALPSQDGKWRAIRKFAAAEMLAPRRISAGAGALLQTKIVEALHRQVSGHAARGTAGRGQARRSPPRPVLLAGAAPPRRPAPQGAGRVQGHHRRVSLGCSARLTSPTYSRRSPRSTS

SEQ ID NO: 111818 - protein, 175 aa, Triticum aestivum
  Clone ID: PAT_TA_6236.pep
DLLIRTRPSRLILHRGGGRRARHERREARDVPQQIRHLLLVVIFVLTHGVAVVASAAAVVAAVVHDLLVLSEKLQEVGEDVPLQPLNAGQRRCCGLLRLFEELHVLGEDVPLQPLDAGKRRCCGLLGLFEELHVLCEDVPLQPDHRERRRHARRLCLSDDLHVLRGRHAAGRLVA

SEQ ID NO: 111819 - protein, 155 aa, Triticum aestivum
  Clone ID: PAT_TA_6237.pep
PRVRNSGGVHNQLRSLSSTIKRLGSRINSVCEYSAKETCAYCSTPVHFESPDIALCGSVNPAIVPTERHKLSRCAASMRLCSVLEPTWYCVCCGGMVDKLVPDTYFAMKTSPLLGAANPDDESSLYSAPAVPRCPFCGILLQRLMPEFLLSVSPV

SEQ ID NO: 111820 - protein, 180 aa, Triticum aestivum
  unsure (1)..(180): unsure at all Xaa locations
  Clone ID: PAT_TA_6238.pep
MASSASRLCLLAIAFLLAVAAPRVDAWGGRFFFSKMTRPGAVVEADKAADTATVATEALDTNSAPAAFSRPSSNRGYGLYGRPEENEKYPPAYFRRGVHRDAEKLTTTNVVPETEPRHGEEAAVPVXEEQSSGEEEPAFPADGSGRGRPLSYMRHGGKHDRDYYGMSDPLHQGRPFHVDV

SEQ ID NO: 111821 - protein, 142 aa, Triticum aestivum
  Clone ID: PAT_TA_6239.pep
RTPPICGRRRRWARTGHACLDPTGEAVLRPAAPPRPAAEAEGPRFAPSRPAARGRASGLAARRGSRRRWRECRRNPCRGRPQGSGGSSGQDRRAPPLSPPQPPPSSPPLSPPQPPPSSPPLSLQQPPPSSLRFPLSAAAYSG

SEQ ID NO: 111822 - protein, 237 aa, Triticum aestivum
  unsure (1)..(237): unsure at all Xaa locations
  Clone ID: PAT_TA_6240.pep
DPPSSKLTLTKGNKSWSSTAVAAALELVDPPGCRNSAPRRLPLSPRCRSTPPPLSNPSFSSLAAPPSLPRPLLLPSSRLPPPRHKPRRRPHVDPILLRVAALPAISSFPHSHTSSSPPPPVPSPAPPPGATSSPXPPQPMLSPXPPPPRQPPRSTSTGSCCPVASRIRSRPPPGTRTRRRASRPRRRRRGCRGGSRPVGRGISSVCLRPSSPTPSRWSRHSSAASSGHCAWATRTFF

SEQ ID NO: 111823 - protein, 311 aa, Triticum aestivum
  Clone ID: PAT_TA_6241.pep
FLPSHCRWIPMDVRDGCVLLGRDHGKDARPPICRELAVCDPLHRRYVLLPPVPDALVASVERPPPVLRRPSDEPLLLPLSENDAAAEGTAFTVISMVHCETKLVPFVFCSSTGQWRAAAPMLWSAMPVSPMDPAYLRRHHAYGCFYWDSTNIKRKELLVLNIQRMEFSIAELPSSGWGTLAVAIVEAGEGRLGLFGIRDGTAGGSKHDLCYSVRQNKGKNSGQWRMVKTFSLGPEGLHYLKAATERYVLLICSEAPRFVGLSMVMPDLLEYFSVDVKKLQLERVCVKPFGKSLSRTRIYAHFPPSLSSPTI

SEQ ID NO: 111824 - protein, 71 aa, Triticum aestivum
  Clone ID: PAT_TA_6242.pep
LDYSKAHIYQPRLISIALARTAPIRMGTRNPKSNSKYRCAAEEIYPQKGSAQWNIKKRKIKNDKKGTRENA

SEQ ID NO: 111825 - protein, 470 aa, Triticum aestivum
  Clone ID: PAT_TA_6243.pep
MMMSPPCVASCGGKWPILHVRKNLDAVWSTTPSTTEDTATALCWDGKPISSLQCGLSDKLQRCLGRADGLEQYLKKTPCSVDACDYLQTLKMRLHGMIHNFCIKALKLLPTPSGSLMCGFLMAGHCYGSMDPVSNIIVNSIWYNFLGGPLPASEGSKIEQYNDILDPLSLLRTQVHSLKGLMELATFAGPQFSTEACALELLCGTKCDIVDMLQSSLKMIKKNHFHEAAKAAGHPLPLQLGELHRLLVVFPEQRSVLLSFMTKARTDGTVLRLDDMTLHIRRMWSRYSKVRVGCYEQAPDLFPESRRLVSSMRSQYEEGRSWFRSKIEQVLKDYTTQHFWEPQYKLDIICGVEEINQSCPPSGKMCYRVNFTATSDLQLQRTLFFAEFLFSGGPRPETCCPLPYEYAGRCYSGVLTARKIVYPDDAKYIPHDITHDGTCHVDDMLEMDFVLSSEKDVELVEKLNKMHTEE

SEQ ID NO: 111826 - protein, 187 aa, Triticum aestivum
  Clone ID: PAT_TA_6244.pep
MALVGQAAMVAQFAGVDAYGLIKMIADAAQTVRRNRATCLQLARRAKMIGDLLHQLHAAQLMQQPETRNPMEQLEETLRRALLLVRSCQGRGYLYRCFMGARHADELREVQGEIIFYLQLFPLVSYVDTTLTWVRLLNKDAAPEAPSCKEAPVVRPYFVPDEWLLLVSHSGSILWHCIHMLYILLFL

SEQ ID NO: 111827 - protein, 466 aa, Triticum aestivum
  unsure (1)..(466): unsure at all Xaa locations
  Clone ID: PAT_TA_6245.pep
LVADRRQKCWTYARPRLLVLRLGESCFGPLRGPLCRPLHALLRREAREFANELRASTKAPKNPAVWLEGSNNAGQNGSSADTSTVSDAYSKMLTIFIPLLVDESSFFAHFMCFEVPALVPAGAPYVNKRRSGANDPDDDDLSLMDPDGNDIKPDNTSXELGTLNDALQELLDGIQEDFYAVVDWAYKIDPLRCISMHGITERYLSGQKADAAGFVRKLLDDLESRISVQFSRFIDEACHQIERNERNVRQTGMLAYIPRFAVLASRMEQYIQGQSRDLIDKAYTKLVSTMFTTLEKIAQSDPKTADIVLIENYAAFQNSLYDLANVVPTLAKFYHQASESYEQACTRHISSLIYLQFERLFQFSRKVDELTYTIAXKEIPFQLGLSKTDLRRVLKSSLSGIDKSIGAMYRRLQKTLTSDELFPSLWDKCKKEFLDKYESFVQMVTRIYGNEPIMPVAEMRDTLASF

SEQ ID NO: 111828 - protein, 261 aa, Triticum aestivum
  Clone ID: PAT_TA_6246.pep
MATTGRVRRSPLLAAWLALGLAWHCALHHAPAAAVTLSTASRWVVDEAGDRVKLACVNWPSHLEPMLAEGLGKRPVGAIAGDVAAMGFNCVRLTWPTFLVTNASYSSLTVEQSFQRLNLTESLAGIRANNPAVVDLKLIDAFKAVVSSLGENNVMVILDNHVSKPGWCCDNTDGNGFFGDGYFEPDVWVDGLTKMATMFAGVPHVVGMSLMNELRGPRQNSNDWYKYMQRGAEAVHAANPRVLVILSGLSFDNDLAVLISR

SEQ ID NO: 111829 - protein, 232 aa, Triticum aestivum
  Clone ID: PAT_TA_6247.pep
VFFPEWLANPVLVLKKNKQWRMCIDYTSLNKACPKDPFALPRIDQVIDSTAGCELLSFLDAYSGYHQTKLNPADRLKTAFITPFGAFCYLTMTFGLRNAGATFQRCMQKCLLKQLGRNAHVYVDDVVVKTEKRGTLLEDLKQTFENLRRSSSSLLQAGPAPVPPPDPGPAPGLAGAPSAPPAARPAPQTPLPAGSPMPAARPIAPPSTASSSAWASDRNAARRSRSSPGYHV

SEQ ID NO: 111830 - protein, 230 aa, Triticum aestivum
  unsure (1)..(230): unsure at all Xaa locations
  Clone ID: PAT_TA_6248.pep
AYAVSGEXAANAPAVPDGKDPYITKEYLKGKXYNVYVHSYLYYGGLAARVEILKAKKGPFSSCILRGFSGKYTYNGEEYDASASPEGAAYDKCREEIARALKLDAPCAAKNCTFGGVWNGGGGAGQDTIYVASFFYGKATQVGWVDKGAPSAKSSPAAYLAAAEKVCPLSVQEAKAAYPGLLDVPYACMDLVYEYTLLVDGFGIAPSKEITLVEKVKHGEYLIKAAWPLG

SEQ ID NO: 111831 - protein, 116 aa, Triticum aestivum
  unsure (1)..(116): unsure at all Xaa locations
  Clone ID: PAT_TA_6249.pep
MAAAAAADEPCRCHIVXAVPFPGRGHVNAMMNLSRLLAARGAAVTFVVTEEWLGLLRSSSSSAPPPPGVRLRAIPNVIPSEHGRAADHAGFLDAVATEMEAPFELLLDRLREEEGE

SEQ ID NO: 111832 - protein, 105 aa, Triticum aestivum
  unsure (1)..(105): unsure at all Xaa locations
  Clone ID: PAT_TA_6250.pep
LSRPPTRWDATPNWEDILSLGEQQRLGSARLXLARLFFHSPKFGILDECTNATSVDVEEHLYRLATDMGITVVTSSQRPALIPFHSLELKLIDGEGKWELCAINH

SEQ ID NO: 111833 - protein, 216 aa, Triticum aestivum
  unsure (1)..(216): unsure at all Xaa locations
  Clone ID: PAT_TA_6251.pep
PPPPPHSPXPPPTTPTSAPPSPTNSSPPTPSLALSPNFYAASCPSVELAVNDVVRSASTLDPSIPGKLLRMVFHDCFVEGCDASVLIXGSGTERTDPANLSLGGFNVIDEAKRLLEAVCPATVSCSDIIVLAARDAVTFTGGPSVPVSLGRRDSLVSLASNVRANIIDTGFSVDAMAASFASKGLSLDDLVTLSGGHTIGSAHCGTFRERFRPDAN

SEQ ID NO: 111834 - protein, 310 aa, Triticum aestivum
  Clone ID: PAT_TA_6252.pep
RVCAICLGSMRTGHGQALFTAECSHKFHFHCITSNVRHGNHICPICRADWKELPFQGPQLADATHGRARVSPVNWPQDDGHMAVIRRLSNSYSGNLLEQFPVFRTPEADIFNDDEPIDIQSETVEENNAVTGSVEIKTYAEVHAIQQSVTQKVFSILIHLKAPKSLESVSSRAPLDLVTVLDVSGSMKGAKLALLKKAMGFVIQTLGPNDRLSVIAFSSTARRLFPLRQMNVNGRMQAMQAVNSLVDGGGTNISDGLKKGAKVIEHRRLKNPVCSIIPLSDGQDTYSVPTYDDGVQTNHSMLVPPSILPG

SEQ ID NO: 111835 - protein, 95 aa, Triticum aestivum
  Clone ID: PAT_TA_6253.pep
MSKARNALVVTGLVIFAGTGLAFPFYFVKSKNRPIIDSTKPLPPQATFRGPYVNTGSRDIGPDHTEYPKKWICISILFSLCFSSGHARKPVSGTL

SEQ ID NO: 111836 - protein, 101 aa, Triticum aestivum
  Clone ID: PAT_TA_6254.pep
ASLSPQTTPTRRRTHPKSAATMVAMAGQERKAIDLEDGWNFKQKGKIYNLINIPERKPELQFSSIVSGHVPLFLSRRTNWEPSPWPPISIYGFKGQLPHTS

SEQ ID NO: 111837 - protein, 142 aa, Triticum aestivum
  Clone ID: PAT_TA_6255.pep
AQHAVIQIEQRQEEEETAPLVSAASANPTVANEEHTQISSSKPAEEGFEMFESSRGIKLGLGDFVFYSVLVGRAAMYDLMTVYACYLAIIAGLGCTLILLSICRHALPALPISIMLGVVFYFLTRLLMEPFVVGASTNLVMF

SEQ ID NO: 111838 - protein, 185 aa, Triticum aestivum
  unsure (1)..(185): unsure at all Xaa locations
  Clone ID: PAT_TA_6256.pep
NELLSMVHSLLFSIHETELQDFVRGQCTGSCIRHLLVKLLRYSGYDAAVCVSKWQGFDKIPGGDHXEYIDVIXDNDLTGPERLIIDIDFRSHFEIARAVDPYGTLLDSLPVVYVGTLPRLKQFLNVMADAANWSLKQNSMPLPPCRSRSYLQMKWHSKYERNGLPSDQQEFQGASPSHALCFGHL

SEQ ID NO: 111839 - protein, 453 aa, Triticum aestivum
  unsure (1)..(453): unsure at all Xaa locations
  Clone ID: PAT_TA_6257.pep
MASPEENPKFPCLGALLGXFRPKRKLPLALQEPLPAALPRIPVASFPDVPSGRVTEIPGETSVLDAVRILSEHNIRAAPVLHPEPGVPADWQGRYLGIIEYSAIILWLFDAAYLAAVALSAGSATSAGVGMGAVGAVGVAALGATGPAAVAGLTAAAVWAAVAGALTAERCVAKDGVTAPDHLGEDFYRVRRQREPFKSTTVRSIVESCPWSPFVPVTLDSSMLAVLLLLSKYRLSNVPGIEPDKPVIKHXLTRTFVVKGLPQSKGRDWFDFISAHPLKDMGRPFMSLDDGITVNSDDLILEAFKCMKDNKIGGVPVVDGPKRKLVGSVSIRDIRFPLLRPDLFSDFRHLTVLEFMNALASTLQDSGGNGLVKPPLTCAPDASMGSVIDSIGSRITHRIYVVDGDFEVVGVVTLRDVISCFIHEPPGFCDSYLASAMEKLEDKGDADSSVENS

SEQ ID NO: 111840 - protein, 178 aa, Triticum aestivum
  Clone ID: PAT_TA_6258.pep
SCNSAVYDMDMKSFVLAPSSYFCKPYDSITVSIRNRCSSGNFLDHEDDHGLYVMNSLDDSFEFFNYCKVGLSTYPLLYNKWDWSPLPSPPSRTSPLVAAAVIDNSTICASSKNGTYTFDISREVWSHTGSWVLPFHRAAEYVPELGLWFGPPRPLGNLAKIAYVQLFSSSANGSGSLS

SEQ ID NO: 111841 - protein, 226 aa, Triticum aestivum
  Clone ID: PAT_TA_6259.pep
MGENGVGKNNYQGSAAAAPMEVSSAEHGQAGGSKCYDDDGRLKRTGTMWTASAHIITAVIGSGVLSLGWAIAQLGWVAGPAVMLLFSLVTYFTSSLLADCYRSGDQSTGKRNYTYMDAVNANLSGVKVQLCGVLQYANIVGVAIGYTIAASISMLAIKRANCFHGNGHADPCHVSSAPYMIIFGVAQVFFSQIPDFDQISWLSILAAAMSFTYSSIGLRLCIVQVI

SEQ ID NO: 111842 - protein, 294 aa, Triticum aestivum
  Clone ID: PAT_TA_6260.pep
MKVGNSLSRQVVELLAEWDAEFVPHKHLKKRLKLIGLGADGEERQAKRARVSDPAGDGGDGAAAAMTPEEGDFMRLLEAELDKFNSFFVEKEEEYIIRQKELQDRVARAAGMESREELLRVHKEIVDFHGEMVLLENYSALNYTGLVKILKKYDKRTGALIRLPFIQNVLLQPFFTTDLLYKLVKECEAMLDQLLPSSKPSVSIEEGKEDGNTADQHLNPSFSLANSKCIPELDEIEFMESMYMKSTVAALRAWKRIRSKSSPVSAFSLPPSQGNNATRRQERGATKISVMQHG

SEQ ID NO: 111843 - protein, 182 aa, Triticum aestivum
  unsure (1)..(182): unsure at all Xaa locations
  Clone ID: PAT_TA_6261.pep
APPLCAWLVAAGAHADCGADEQHRQTQCLDAGSGATFGLDPRPLPAPPRASARSGMAMSVALQPERVIVEKKRPDVKQRRVVVTGMGVVTPLGHDPDVFYNNLLDGHSGISEIETFDCSKFPTRIAGEIKSFSTEGWVVPKLSKRMDKFMLYLITAGKKALEXNGGLTEKVKNDLDKTRCGV

SEQ ID NO: 111844 - protein, 126 aa, Triticum aestivum
  Clone ID: PAT_TA_6262.pep
AWSRPRYQEETELMKREIEDLKTNAKVFQLSKCTAPALPLDLPAVHFMCMHSFHLRCLGDNEKECPECAPEYRSVMEAKQKLELNARDHDLFFRQLRGSKDGFSVVADYFSKGVVSKTTIPPENAP

SEQ ID NO: 111845 - protein, 164 aa, Triticum aestivum
  Clone ID: PAT_TA_6263.pep
SAAPPPPPPPPSSRPTPDLHCLLPPGPPSAVPSSDPATSNTWRNAAPPLNHQHPRVPPSTPTCAPPALCSSPPKATWLPPTVAALPNPVRSGRSGDPATSNRRCPAGSGEIWPARHGSPPTPTTSYYGRHQTGAFDGDLLPADCKDKGRVASRVQFAPLLDGVR

SEQ ID NO: 111846 - protein, 188 aa, Triticum aestivum
  unsure (1)..(188): unsure at all Xaa locations
  Clone ID: PAT_TA_6264.pep
GRVGASLPSTQESVQDEEAEFVEDSAPIITPITSRKDTATQTSPDLSRSSSPSARPSFVRSFSMQQAKERESCFSDLEIRDVQMDERVSLTRWSKKHVTQASNKNSTNMLEWNKKTVDSKSSSWESTETKCTLKVEREEQNLLLGEESSKSETEAAIQXLVMKLXKKRSFSLDRILNTSSLLKENTRD

SEQ ID NO: 111847 - protein, 348 aa, Triticum aestivum
  unsure (1)..(348): unsure at all Xaa locations
  Clone ID: PAT_TA_6265.pep
LCNLPDSASTSVGCGTKKDRPCDKIAARTQDSTACLPXSCQKPMPRDGQAAESVTNKSGAAVWSFIDLNEDAPNEDNSESSVVSSDCHVTSLQNKHAKPKFLIDLEVPACEDDDAATAAAESILALSMDVPATAETPDDTLQWFAELAISSTDDHAGQGEVQGCANNSSDDDPDSFESLTLKLEDIKTGGLCSRPPAPAITTCDEQTVSPVNLLMKPKRGQQRKRRQKRDFQKDILPSISSLCRPEIIEDIQLLEGLVQTTGGSWESSLTRRRRTRGNKKPKKRVLDAVEEEVQVGVEEEEVQVSPPAKPDDADIEGESNIGMIGWGRTTRRCRRTRCPSGITVAAAS

SEQ ID NO: 111848 - protein, 397 aa, Triticum aestivum
  unsure (1)..(397): unsure at all Xaa locations
  Clone ID: PAT_TA_6266.pep
MAEVETFLFTSESVNEGHPDKLCDQISDAVLDACLAEDPDSKVACETCTKTNMVMVFGEITTKANVDYEKIVRDTCRGIGFVSNDVGLDADHCKVLVNIEQQSPDIAQGVHGHFTXRPEEIGAGDXQGHMFGYATDETPEFMPLSHVLATKLGARLTEVRKNATCPWLRPDGKTQVTVEYHNDNGAMVPIRVHTVLISTQHDETVTNDEIAADLKEHVIKPVIPEQYLDENTIFHLNPSGRFVIGGPHGDAGLTGRKIIIDTYGGWGAHGGGAFSGKDPTKVDRSGAYVARQAAKSIVASGIARRCIVQVSYAIGVPEPLSVFVDTYGTGKIPDKEILEIVKENFDFRPGMIIINLDLKRGGKGRYLKTAAYGHFGREGADFTWEVVKPLKWEKPSA

SEQ ID NO: 111849 - protein, 154 aa, Triticum aestivum
  unsure (1)..(154): unsure at all Xaa locations
  Clone ID: PAT_TA_6267.pep
IFLKRNGTNFLGNVWPGDVYFPDFMHPRAAEFWAREISLFRRTIPVDGLWIDMNEISNFYNPEPMNALDDPPYRINNNGTHRPINNKTVPASAVHYGGXSPEYDAHNLFGLLEGRATHRAXLXRXXGRRPFVLXKSTFVGSGRYTAHWTGRQRR

SEQ ID NO: 111850 - protein, 83 aa, Triticum aestivum
  Clone ID: PAT_TA_6268.pep
RCPRPWRWQRWLHMVTAEVAVSMSSGRSQRWTTSWGAIVKNYATQLASQPWSQLAQLSPTSGSSSGDRCAPSLYFTMIYFICN

SEQ ID NO: 111851 - protein, 103 aa, Triticum aestivum
  Clone ID: PAT_TA_6269.pep
KECAASFISSEPNNITTLANTLIHQVQLAKKRADAFMGILIRAVAYDGLDARVLPHELLHAQPAAMVLLADTLVRDVDDNHIAARVPVHRHSSSRIHTRDRLG

SEQ ID NO: 111852 - protein, 93 aa, Triticum aestivum
  Clone ID: PAT_TA_6270.pep
LFCLRQPAIQSSKLTAYLSSSKTQNIMQNIGFLSPMRMPLPATIQFIGHIYFVSSQTLLNSTKYIEKSVDAAEVQKIDVDITFYINLVKVRRV

SEQ ID NO: 111853 - protein, 247 aa, Triticum aestivum
  Clone ID: PAT_TA_6271.pep
VVFVVITAGIAMIKLTRGQIPMPMLFPDVHGTWASIFKLFTAAPVLVTAFICHYNVHPIHNELKDPAQIKPSVRASLVLCSAVYVTTSFFGFLLFGEETLDDVLANFDSDLGIPYGGVFNDAVRVSYALHLMLVFPIVFHALRLNMDGLLFPSARPLACDNRRFAALTVALLAVIFLAANFIPNIWDAFQFTGATAAVSIAYIFPAGMALRDRHGIAKKRDKVLALFMIVIAAVSNGVAVYSDASSL

SEQ ID NO: 111854 - protein, 202 aa, Triticum aestivum
  unsure (1)..(202): unsure at all Xaa locations
  Clone ID: PAT_TA_6272.pep
PVPPPPPPWAAVPRRRPPRRGRRRPPAPPPRPPPPAGPPXLRPGPALPRPGGRRGLPVGADVGPRCAPARWPPPAPAPGAGPPPPAAAAPAPSAPPGGPAAPPPPPPAAAPRAAPPAPAPTGPAPGRPPRGXRAPAGAGRPGRPPPPPAPPARPAPPAAAPAAAATEPAPXRPAGRGEHEEDKQASTITTSSPPPSVSSPAA

SEQ ID NO: 111855 - protein, 325 aa, Triticum aestivum
  unsure (1)..(325): unsure at all Xaa locations
  Clone ID: PAT_TA_6273.pep
MAPLSTAVRLLRSPAAPPARLAGAPARVRGGRRRLRSVRAEAAKEAEVGELQAGVSVYKPRSGEVLVSDAARSLAAAIDDGRTRLEIEFPPLPSSISSYKGSSDEFIDANVQLALAVVRDLKKLKGTRSCIVFPDQPEKRRASQIFKTAIDQIEGISISSLDDLPTGPVDTFFKSIRSTLDFDFADDNEDQWKSDEPPSLYIFINSSTGDLSSIEKYVDQFAASVPAVLFNLELDTLRSDLGLLGFPPKDLHYRFLSQXFTPVFYIRQRDYSKTIAVPPCVAGGGAPVFXEAPWPGAFMLRARRWSEACFARECILRSLXGQAKG

SEQ ID NO: 111856 - protein, 168 aa, Triticum aestivum
  unsure (1)..(168): unsure at all Xaa locations
  Clone ID: PAT_TA_6274.pep
MPAAGAAAAQGGVAAHPSLQSMLAALLYDPLLPDVPRKPSLADVDTLINLELGSAMRVTVLKLDXTSFDVAVLNXATLKDLKLAIRKKITEIEQGQMGHRHIAGPPSRLIVCLTQLCVSLTEDGSALSSYDIRNNSKVGFSPHVMSRVHQKHSRRRKHRFFHGLSRKM

SEQ ID NO: 111857 - protein, 129 aa, Triticum aestivum
  Clone ID: PAT_TA_6275.pep
RVIGPLLQPTVNASSSVIVDFLKGDNEVKSKIRNFVDVRDVADALILVYETPEVSGRYICSSHARKVSDVIDLLKSMYPAYKFANKVVQVDDEPSFSSRKLEMLGWKTKPLEETLRDSVESYKAAAVLS

SEQ ID NO: 111858 - protein, 161 aa, Triticum aestivum
  Clone ID: PAT_TA_6276.pep
TVAVRDIQGQGFPDEYSGAADAVFLDLPQPWLAIPSAGTMLRQDGVLCSFSPCIEQVQRACETMRSCFTDIRTFEILLRTYEVHEGALKSATVNEASSEGCSLPGKKRKIRSAGEARHGAQTSSVIARPCSTARGHTGYLTFARKSVHGSQTGATEVCPTS

SEQ ID NO: 111859 - protein, 103 aa, Triticum aestivum
  Clone ID: PAT_TA_6277.pep
RRLWFHHDGEGNRGGDRGLVPELVGGLPASSALGDDETEPQRSWLGGSGAEGVRGEVEEGGALSSMVANGGAFLRFLSTERRERLDRDAALTLPPLLSAGLNS

SEQ ID NO: 111860 - protein, 232 aa, Triticum aestivum
  Clone ID: PAT_TA_6278.pep
HDLKFLCWSKFLRLISVQGLKLQELPDEIGDMIHLRYLRVECPGLKKLPRSIRRLLNLQTLDISKTAVVEIHPHFWKIKTLRHVLAEKLTLPTSLVNELAELQTLHGVVAGEGKWDQGRSPLDKMAKLQSLELHGFNAANHGSALEGALTNMHLLGHLKLEGDGIPSCLFTGPVLRCLQTMELDRAAKWPVVRWDIVRKVRPNLVGLKLKNNSQVPKELLDEMEAQKLMLLS

SEQ ID NO: 111861 - protein, 119 aa, Triticum aestivum
  Clone ID: PAT_TA_6279.pep
VQLSIDHCLFKAQYSDIGTKESYERNSRGVEIFSKCWFPENHRMKAIVCLCHGYGDTCTFFLDGIARKIASAGYGVFALDYPGSGLSEGLHGYIPSFDTLVDDVAEHWAKIKGNAEYRD

SEQ ID NO: 111862 - protein, 213 aa, Triticum aestivum
  Clone ID: PAT_TA_6280.pep
MASFTNLSVPLLLLTILFPTLALCYINPDATSVHQNATKSSASRAYIVLVEPPRSNAGEDAHRQWHESFLPTSLADESSESRLLHSYTEVFSGFAVRLTDAELDAMAKKPGFVRAFPDRTLQLMTTHTPEFLGLKNGTGFWSRAGYGKGVIIGLLDTGLYAKHPSFDDHGVSPPPTRWKGSCKAARCNNKLIGAKSLIQGDEFGDEEGHGTHT

SEQ ID NO: 111863 - protein, 387 aa, Triticum aestivum
  unsure (1)..(387): unsure at all Xaa locations
  Clone ID: PAT_TA_6281.pep
SNPMVPASELIVQDSNFVDERHGFLLTGPIWHTHCPPRGFTESRSGLLTGINYVDPIMWSGSNXKSMLVRREVGSVNIHVNILPPXRSVFVGGSVFSAQSLSSSSSKXTKFCPQGNVAVPDLYVNGRPDSVGADDLHSVLQGIXLMGSGTHRITCPPQTNGATEFRRSDGTGFLANTRSCMLSGPASRFPPQSPYFAYQPVGFGESVGFPEVLQGQEVSQTVPLFQGIVSDTCSAKGGYGLYNYMRTSSAMNGGFSSAAQGYPLSLSTPPPAEAASPSSAAVPPQLWLASKSNEEAANGSQLNQFGIPKSPGDGAAKLGSDGRKVARTSCMLFGFSLTEKMLPTEEDCAKEGSHEADCQNPRMLDLFGYNRATPGALHALCAAPLGI

SEQ ID NO: 111864 - protein, 131 aa, Triticum aestivum
  Clone ID: PAT_TA_6282.pep
SVPCCALFPIAAGHHPHTFSPFSRGSISSMDASHTVSSFPHLITREEKGKREGDRPCRSDPSATTSTEMAKWMERTCKSSSQGQQGSILVLFSMGVTHRAPPTSEEKTTAPPGLLLPTPQGPSLPLMLCLN

SEQ ID NO: 111865 - protein, 131 aa, Triticum aestivum
  Clone ID: PAT_TA_6283.pep
FYVFPGKNACTYKYFGGLGLHDTHEGSCSLIDDQGIKEKVADFLFLFFPHKEKFQAEASRTCDAWRLLSLKEVGWGPPEDRDALEDAWRTNPIRVHNHPDARVQIRLKFPFILLFGRVSRIGIYLFLLDLL

SEQ ID NO: 111866 - protein, 182 aa, Triticum aestivum
  Clone ID: PAT_TA_6284.pep
LTSAASVLTRDWAQGSQQLAKHLYDIKVQPSTLLPKQIGNMYTASLYAALASVIYNKHASLTGQRIVMFSYGSGLTSTMFSFKLNEGQHPFNLANIASVLDVTAKLESRHVTSPEKFIDTLKLMEHRYGAKDFETSKDISLLPPGTFYLTKVDSMYRRFYEKKTDGIVDGKIKCSNGIANGH

SEQ ID NO: 111867 - protein, 128 aa, Triticum aestivum
  Clone ID: PAT_TA_6285.pep
SHDKRKPYDDMDRKAIRFPCCCFSSFHPKLQKLNMVQGESKRKACTICPPNATTGACCCYLFPMSFQGWSASLPRNFELEPYCALRAATGSDTGLTRIPAPPSRAAFPGCCCRNPEMSSIPFLFCRSA

SEQ ID NO: 111868 - protein, 138 aa, Triticum aestivum
  Clone ID: PAT_TA_6286.pep
YLQRRSKPGRKSYLRGSVPNVGCGERRRRELVRQIDGRIYTIASWYVRADQLVRGAGPGGSAPELGERPGERLRRGGDPGGLRPGLGGAHGDEGGAGARRDRAGWTCELRTYFGIRHGSEPNRVARREAAAPAWRALT

SEQ ID NO: 111869 - protein, 200 aa, Triticum aestivum
  Clone ID: PAT_TA_6287.pep
DIMEQEVGVLLSRLRYIQSTLFHTHVTYLEFLDRVHSSELKLRAQGLWEVPHPWLNLLIPRSTIHRFATEVFGNILKDSNNGPILLYPVNRSKWDNRTSVVIPEEEIFYLVGFLSSAPSASGHGSVDHAVSLNDKILDFCDKAGVGMKQYLAPYTTQQQWKAHFGARWETFERRKHMYDPLAILAPGQRIFAKASLPMSS

SEQ ID NO: 111870 - protein, 303 aa, Triticum aestivum
  unsure (1)..(303): unsure at all Xaa locations
  Clone ID: PAT_TA_6288.pep
TIGSVMVSGDRLAADDSFSHGVVLDTKQNLLNVSYDIGYYAPADDWVRPTNGSYSFSYSPETRRRISAEGVYDPESGILCMVGCREHNGSTDCQTLXTVKFASLDARGQGHGRGVISSLRDKSDRLFFKKVDITLYGMYSDQVSEAISRMDLEGIMLVASTTLSCVFTVLQILRTKKNPEAAPATSITMLAILTLGYLTPLVLNFDALFTSRRSRYSVYWMSDWREVNEXMRAPTLVAFVLQLRLLQLVWSGRRKSADQTSRHPSPSCRELLQISCRFTSEEPGRGVTCLSPRARPSPPAPPA

SEQ ID NO: 111871 - protein, 137 aa, Triticum aestivum
  Clone ID: PAT_TA_6289.pep
PAAARLAGGLPVSVAPASAGKPVVLVWDRLLALLCPAAFSPPSGLLRVVGSPGLPVLPVAASPRGPQNVRVVKWPNFLLRGRLSRRLIFPLLLCLSGGVFPGASFTSCTVRVIPPALCPPVGARAILAQIKRKGHLS

SEQ ID NO: 111872 - protein, 153 aa, Triticum aestivum
  Clone ID: PAT_TA_6290.pep
SVVAAEVPYWKFMRSFRHPFSVGMRFKMKYENEDASERRSTGMITGSRESDLKSHGSKWKCLVVRWDDDVECRRLNRVSPWEIELAGSVSGSHLSSPHSKRLKPCLPQVNPDMLLPSGSVSSDFAESARFHKVLQGQELLGSKAHDGTCPGGR

SEQ ID NO: 111873 - protein, 214 aa, Triticum aestivum
  unsure (1)..(214): unsure at all Xaa locations
  Clone ID: PAT_TA_6291.pep
VKADCSKNYAVAPEAVTEAISIDLSSGLIPFFICATVGTTSSSAVDPLPELGNIAQGHDMWFHIDAAYAGSACICPEYRHHLDGVEKADSFNMNAHKWFLTNFDCSLLWVKDRSYLVEALSTNPEFLKNKASQANSVVDFKDWQIPLGRRFSARQPSLVSRRWRLQSLQCHPCWPSHVARQFGLLVPAAAPSLLVSPGLFSLASFRRLXPTSEG

SEQ ID NO: 111874 - protein, 144 aa, Triticum aestivum
  unsure (1)..(144): unsure at all Xaa locations
  Clone ID: PAT_TA_6292.pep
YDFLWVAEXGMKMKCYNGSQLWDTALTVQAIFATGLTKEFGHTIKVAHDYIKHSQIRADCPGDQSKWGRHLSKGGWTHSTADQRWPVSDCTAEAFKVLLLLTKVPELVDEPIETSTLDDAVNILLSLMNDDGSFGAYELTISYE

SEQ ID NO: 111875 - protein, 167 aa, Triticum aestivum
  Clone ID: PAT_TA_6293.pep
SGRSCQCLSRFLFISVAADWEIFVISEHPVRYARAICVVRPIAGSTPWPPARLRPRFPPAEVPKRVQARRGRALRVRFAAVVVVPGPPRPAPEEEAGARAVLQGRRDAGESGGAVPRNAPRPLHAQDRLLLLSNRRQLTSPFNPYYIHSIPVLVRPKLPVPFAFLVH

SEQ ID NO: 111876 - protein, 142 aa, Triticum aestivum
  Clone ID: PAT_TA_6294.pep
PPAWPRAAVELLPMATPSQVRHMAVDDGAVFHRPPEQSGPPGTPGETRIRREHPLEDSGAALSVMTSSRGLTGSSYTTPRGHCVLKGLCACDSSLPSARFCAPRRPRNGRGRRDAGLQAGAARPRGRAAAPTASPPGRGQRR

SEQ ID NO: 111877 - protein, 324 aa, Triticum aestivum
  Clone ID: PAT_TA_6295.pep
TRFLSCFRGRPDPAVRALHDPLVRKTRLGDAFLDDHHDDGTAKLEESGTPKEGPGNDGGVDDDLRREANYLKSCGAISDTPPEILKASNQVEEQEINECNETSNNAQETKEALVSENKDYLSEGFNSDGHDGALKHDQDTDEGTDDHVTEVESAPRSSSQERSSAQIIRNQNPDPSDSPFPTPLVLRDDIQTPGFTTHQGNFKPGKRGRASKQFVYPVLRPIENKLQWTELRDVPSPVAAALPPDSGYLPAPSPPKPRHRTRPPSATASSELAPGAAPLPSPSGGRLLQALADEKPHHQRKISGKLIHLEEDAIESPASATASS

SEQ ID NO: 111878 - protein, 92 aa, Triticum aestivum
  Clone ID: PAT_TA_6296.pep
RPPAAATSSRRPSCRRRRRHLPRRLNAPGARPRPEHRIIDSSPTLIATVADADGAHYITWEDLGVPHGGVGVQLLSDPVRRPSITCRSAGSG

SEQ ID NO: 111879 - protein, 181 aa, Triticum aestivum
  Clone ID: PAT_TA_6297.pep
MQWYFVAALLTVLTSSQGIWTTLSQSNGKYKYDYATIPFLAEFFKLSVSSFFLWKECQSSSPPRMTKEWKSVRLYLVPSVIYLIHNNVQFATLTYVDPSTYQILGNLKIVTTGILFRLVLKRKLSNLPWMAIILLAVGTTTSQVKGCGDAPCDSVFSAPFQGYMLGILSACLSALAGVYTE

SEQ ID NO: 111880 - protein, 247 aa, Triticum aestivum
  unsure (1)..(247): unsure at all Xaa locations
  Clone ID: PAT_TA_6298.pep
MCTALASKPSFSTIHTAPARAPAGAPAVLRAVTQRRFTAMDPPLSQQPTLLALSLLLLALYLARRALLGKRRNYPPVAGTMLHQLFNFGRLAEYQTELSQRYRTFRMLTPTCNYVYTVEPANVEYILRTNFANYGKGTMTHDVLEDLLGDGIFNVDGAMWRHQRKVASFEFSTRVLREYSSGVFRDTAAELAGIVAAPAAAXERVDMHDLFMRSTLDSIFRIRVRGQPGAGCPSPARRARRSPGRST

SEQ ID NO: 111881 - protein, 200 aa, Triticum aestivum
  Clone ID: PAT_TA_6299.pep
MLLNQIRGKAVVFTGHSLGGAIAALAALHYLCISSLSSPCSPSPPVLCVTFGSPLLGNGALSRAILRERWGGNFCNVVSQHDVVPRLLFCPLDAVPVRVIIGMQLQQWPGHTHHTGVMTTRVVDAEQEGLRQLIQAHVRTVAMEQKLVDPESRGGSPYRPFGAYVLCSPEGAACVDNSTAAVQMLYATFAACYTRGDTTS

SEQ ID NO: 111882 - protein, 150 aa, Triticum aestivum
  Clone ID: PAT_TA_6300.pep
MGEMESTSPPPGGAGGAVLQVVFVDGERSVDLGTVTVQPSLGVRKLQAVVADRVGVAPQQISASLARPRRQRRVPLDEGADLAAAVAREGAGCYVLAGLRRSRRDRRGGRSRRDRKGAGAGAGPQQPLLMAPTMASERTILKRRPLTDLA

SEQ ID NO: 111883 - protein, 102 aa, Triticum aestivum
  Clone ID: PAT_TA_6301.pep
MSNKRISLLSQIHEKVLFWNAKVLVSRIWHFRGGTDEGNIVHTDLVVLDQEGTHMYGQIPPEPSERLKDVLVEGNVYLMKGFMCKQAKQTYRAVDSPYMMQF

SEQ ID NO: 111884 - protein, 145 aa, Triticum aestivum
  Clone ID: PAT_TA_6302.pep
CPVGDRANGGRVGAHGVHHDHRTRRRCPRRPQSCRRRLLPRPGGASTEQDPRQPNARGRPPRRNGPRAAAPWEEHHPRSSAAGGPRATGPHAGGGQRRGTGRTGGGTGTSAGINAGQGATSTGAPHPARGGPEPRGGAHEAGRRG

SEQ ID NO: 111885 - protein, 187 aa, Triticum aestivum
  Clone ID: PAT_TA_6303.pep
MMMTRASMGAMEGAALDEVVRRLVEGGRGGRQVQLSEAEIRQLCVDAKRVFLSQPNLLRIQAPVKICGDIHGQFVDLLRLFDLGGYPPTSTYVFLGDYVDRGKQSLETICLLLAYKIRYPDKVFLLRGNHEDAKINRVYGFYDECKRRFNVRLWKIFSDCFNCLPIAALIDDKILCMHGALTPQLAK

SEQ ID NO: 111886 - protein, 156 aa, Triticum aestivum
  Clone ID: PAT_TA_6304.pep
THASAAESPYADHKLQLAQRPKELLDSTTLVESSITNAASSSLPQSPSCEVPDILELELNTSPPLSSCVFSLTPTGLLIKYFVRVDKEGRFHTYPDRGGDPFRVCMKLNKLLTHIMSVGEITCAWMDFHLGRSPCGMLYTGLMMAQEEILQQPLLP

SEQ ID NO: 111887 - protein, 98 aa, Triticum aestivum
  unsure (1)..(98): unsure at all Xaa locations
  Clone ID: PAT_TA_6305.pep
RRGPMTPTLKLAGGRSKNIENNYASSLLGYSRPSCGNDGGGGAPADGTTWPLQGTSHQQACRPLTPESSPPTLSSPALAGLXXNLXDQLKXPXSXREK

SEQ ID NO: 111888 - protein, 99 aa, Triticum aestivum
  Clone ID: PAT_TA_6306.pep
AGPSDSNFQGNSSNSCHKCSNNNSLRKIRPLSSSNILVMPNSPISRNKTTHQQRRHRRKTSLLGSQNKISVRTKGILRLNMWMSSVTAVGSLDITNPVP

SEQ ID NO: 111889 - protein, 233 aa, Triticum aestivum
  unsure (1)..(233): unsure at all Xaa locations
  Clone ID: PAT_TA_6307.pep
HLPNPTLQPLPRGARGGRPPPPPPPPTMAMATALRKLSARGQPLSRLTPLYSMASLPATEERSAVTWPKQLNAPLEEVDPEIADIIELEKARQWKGLELIPSENFTSLSVMQAVGSVMTNKYSEGYPGARYYGGNEYIDMAETLCQKRALEAFNLDPEKWGVNVQPLSGSPANFHVYTALLKPHDRIMALDLPHGGHLSHXYQTDTKKISAVSIFFKDMPYRLDEXTGLIDYD

SEQ ID NO: 111890 - protein, 541 aa, Triticum aestivum
  unsure (1)..(541): unsure at all Xaa locations
  Clone ID: PAT_TA_6308.pep
CLRIRPTLQPLPRGGAPPGGRPPPPPTMAMATALRKLSARGQPLSRLTPLYSMASLPATEERSAVTWPXKQLNAPLEEVXDPEIADIIELEKARQWXKGLELIPSXENFTSLSVMQAVGSVMTNKYSEGYPGARYYGGNEYIDMAETLCQKRALEAFNLDPEKWGVNVQPLSGSPANFHVYTALLKPHDRIMALDLPHGGHLSHGYQTDTKKISAVSIFFETMPYRLDESTGLIDYDQLEKSAVLFRPKLIVAGASAYARLYDYNRMRKICDKQKAVLLADMAHISGLVAAGVIPSPFEYADVVTTTTHKSLRGPRGAMIFFRKGVKEINKQGKEVKYDFEDKINAAVFPGLQGGPHNHTITGLAVALKQATTQEYRAYQEQVMSNSARFAESLTSKGYDIVSGGTDNHLVLVNLKKKGIDGSRVEKVLENVHIAANKNTVPGDVSAMVPGGIRMGTPALTSRGFVEEDFAKVADFFDSAVNLALKVKAAAAGTKLKDFVATLQSDSNIQAEIAKLRHDVEEYAKQFPTIGFEKETMKYKN

SEQ ID NO: 111891 - protein, 143 aa, Triticum aestivum
  Clone ID: PAT_TA_6309.pep
GGGVVRRRRLPMANSKGAMSGGGRGVLLLCMSCCYSMQQWGRTSRGTWRGGRTGLEEVESGRIRLRRGGAAARPSEEWRRAANAKGGGTNWSTQRMGSCSRRLAGAPGEEKRKGNERMKRTGEHWEGEEEGAAVLILNGAHRR

SEQ ID NO: 111892 - protein, 77 aa, Triticum aestivum
  Clone ID: PAT_TA_6310.pep
TESGFIDPDRVVEVVAPPPARPCRGCRLRPATTVLLPCRHLCVCDACDPGASASLAAAAACPTCRCPVTGTVQVFFA

SEQ ID NO: 111893 - protein, 168 aa, Triticum aestivum
  Clone ID: PAT_TA_6311.pep
GTRAGGGVVHHTAVRLASGRLGPLDPVRVAGCAMLCPMFGGEERTASEAEFPPGPFLSLPAVDQAWRLVLPPGSTRDHPLANPFGPDSPALDGVALPPMLVVAAARDLLRDRAADYAARLKAMGKPVELVEFEGQHHGFFAVEPYGDAGSEVVRLVKRFVYGNGGASD

SEQ ID NO: 111894 - protein, 298 aa, Triticum aestivum
  Clone ID: PAT_TA_6312.pep
NKTRTFTIRSSFGTVSKSFIDDLFSSFTLLRAVTFFGVDFEVLPSSIGDLKHLRYLLIQFNGKLRLLPKSLGKLVNLEMLHLYGCNQLEEFPNEARNLVSLVYFNLTSKQKYLRLCGWSSLAILKMSYCYELISLEEGFDSLRALRELLIFDCPKLTALPSSIWQLSTLVALSISGCEELDLMVPAGEASGGLYSLQNLQLGRLPKLAHLPESFKSASSSLQYSQIVGCGNLERLPSYIQDFRFLKRAVINGCPELSIRCAVESGEDYPFVSHIPEVYTDGTPLSKAGPPAGERSSLD

SEQ ID NO: 111895 - protein, 107 aa, Triticum aestivum
  Clone ID: PAT_TA_6313.pep
AYSKTSSSAQSIYSSTSVLPPSSKIKGGAISSGGATKGSSTSCTATGMTSCSTGLGSKLLPSGRGTVSLSLSRSCLVISTSLTLPPAGRVSSAWLLSTLWISLSLKP

SEQ ID NO: 111896 - protein, 65 aa, Triticum aestivum
  Clone ID: PAT_TA_6314.pep
SLQALKKISQECPTACLRADALIAVPSWLDFFSIGVQVILLNTFMFFLHLDITFSILKLLFFCSI

SEQ ID NO: 111897 - protein, 207 aa, Triticum aestivum
  Clone ID: PAT_TA_6315.pep
FVMQALHTLKKGFWNIARAMLAKYKNSDHIDSHLFLSFSFGQGSRPAARAAPPPPPPPLGSLPWWFVLFLPLLCSRRRRPHAVSAPFFPALLLRSVVSPSCFPGPVSPPATVRRWFCLFLGALFPLSKYEVMNRTRRKGMLDLQPFLDSETQKRDVYGAWEQYLGLERTDTAIKGPIQPIRDMHLNISLLCSGGFMYLQNITHMRRQ

SEQ ID NO: 111898 - protein, 70 aa, Triticum aestivum
  Clone ID: PAT_TA_6316.pep
FFFLQPHFAFCAGFLFPVDGTGSYTASAPSDSQHAATRDFVRTFYNTRIKASGILVCRPVTGTPACRRII

SEQ ID NO: 111899 - protein, 98 aa, Triticum aestivum
  Clone ID: PAT_TA_6317.pep
GHRAPARVARNNPSRHASPAWLRQLRFIDPLPLRPCLTSRAAARSSLTLVFRLFYLNSGVDVSGSGVYTLELDVDRCTTLMHYNQEKSMQKKPEELFK

SEQ ID NO: 111900 - protein, 196 aa, Triticum aestivum
  Clone ID: PAT_TA_6318.pep
KIVARPRPALDALPKEKCKSIGSPQASKLTPNHKVDIGNIRCGSTPSGMIACHIMPQSTEGEDCLQSHIPPLGSDSLFDGPLDNGSPSPASNESCGPEITNNSLVSNGAITDIPSGGHTGVYSGQNETPGSQNSGEFTQYFHEGYCKISELDDCRELTEAVTDADSSSSHCEREKPEEDGDNDDMLGGVFAFSEEG

SEQ ID NO: 111901 - protein, 292 aa, Triticum aestivum
  Clone ID: PAT_TA_6319.pep
TAQKEEHLEFFDSMKESFRKAFRVMDKELKLHRNIDSICSGTTAVTLIKQGQDLIVGNLGDSRAVLGTRDRGGHLVAHQLTVDLKPDHPREARRIKRCNGRVFAHQDEPDVARLWLPNCNSPGLAMARAFGDFCLKDFGLISVPEVTYRRIMEKDQFIVLATDGVWDVLSNQEVVEVVASCSGRSGAARAVVDLANQTWKFKYPTSKTDDCAVICLFLSKDAAAGGLSGLSVASKGIGSSPGMPPLLRTPQHFSERVIPEDADDECDPNISGDERSLEGLTWMNTLLTLPKI

SEQ ID NO: 111902 - protein, 250 aa, Triticum aestivum
  Clone ID: PAT_TA_6320.pep
MMATLLPTLSSPVSWATAFLLRTPLKSSRSHHPLLRSLLASASPLSSPRTPRSLITMASAAIPARRDLLMLGIETSCDDTAAAVVRGDGEILSQVIASQSDLLVKWGGVAPKMAEEAHALAIDQVVQKALDEANVSESDLSAVAVTIGPGLSLCLRVGVHKARKIAKVFHLPIVGVHHMEAHALVSRLVNKDVDYPFLALLISGGHNLLVLAQNLGEYVQLGTTIDDAIGEAYDKSARWLGLDIRKGGGP

SEQ ID NO: 111903 - protein, 141 aa, Triticum aestivum
  Clone ID: PAT_TA_6321.pep
MPGADETFPAESRATVFFGAVTSKSEPLTFEESLRFVKKVKARNYMLYLSLFDILGRTELSQLEAYQTLQLLFRDHPDLHEGLEKFRPPMPTKHAAANSNLWPWVFACAAVPLVAMSLIPALGNPVLWLVQQTLGEKMRAA

SEQ ID NO: 111904 - protein, 199 aa, Triticum aestivum
  Clone ID: PAT_TA_6322.pep
MPADAKPRALLPVRPLLLLSIPFLSLLLRFGSSPPPPPPPAARASPPNPHIRMRRGAAFRSYDDYLRHQLNKTLDPRLRRVWATRDWRRKVDAFARAFRALQAEGLLSNASRALCVGARLGQEVAALRLVGVPDAVGIDLAPAPPLVLRGDFHAQPFADGAFDFEFSNVFDHALYPDCFVADIERTLRPGGVAVLHVAV

SEQ ID NO: 111905 - protein, 154 aa, Triticum aestivum
  Clone ID: PAT_TA_6323.pep
FSIRPGLAPVAKRTGAAEAGKGGTREEPAPSPVLIDPTGVNMPSNVFLRPFWNSLYASLLIKLQNRRQPFDSNRVWSILIDKHTIHITLTLSVYRCVHYTPLCCSNIVFTLTLSVYRWEEAQLPTPPTMSRRLRVPSPMRGCHLLDLPKERADG

SEQ ID NO: 111906 - protein, 120 aa, Triticum aestivum
  Clone ID: PAT_TA_6324.pep
RRVRHPRAKRRRGVHEDHVAHADLPVSRRTRPSPSRKGHSTGRASLTTSRRGTPSHTLVVMLPNCFFQGINDDYLSALASLNSCRDRFIGPAMYTSPVYPLVWADRNKALLAYSLGKLLL

SEQ ID NO: 111907 - protein, 198 aa, Triticum aestivum
  Clone ID: PAT_TA_6325.pep
EAMIPRPVHALIFITPAPMWAHVRESDPGSKELTYNGSGPDEPVMWYRQTIGHACGLIALLHSVSNGTAKDFISPDSLLDKIVKETQDLKPLARANFLYNSVELEKAHMDAAVTGDSAAPTSQEPVGYHFISFVKGSDGHLYDLEGGWGEPVDCGILDEGNDLLSDQALEATVKRYTKVADGNLEFSIIALSTVPEED

SEQ ID NO: 111908 - protein, 134 aa, Triticum aestivum
  Clone ID: PAT_TA_6326.pep
MAAPRPQPLLLLLLVALLAASAPRRADAWGKEGHIMVCKIAERYLSEEAAAAVQDLLPESAGGELSTMCPWADTMRFRYHWASPLHYANTPNVCNFNFSRDCHNSRGEQGMCVVGAINNYTDQLYTYGDSPKSS

SEQ ID NO: 111909 - protein, 128 aa, Triticum aestivum
  Clone ID: PAT_TA_6327.pep
MAAPRPHPLLLLLLVALLAASAPRRADGWGKEGHIMVCKIAEKYLSEEAAAAVQELLPESAGGELSTMCPWADTMRFRYHWASPLHYANTPNVCNFKSSRDCHNSRGQQGMCVVGAINNYTDQLYTYG

SEQ ID NO: 111910 - protein, 63 aa, Triticum aestivum
  Clone ID: PAT_TA_6328.pep
KYAQQSALLASHAYEGVEQDDTLADEYYFKALPVVQKRLAQGGVRLAAILNRIFSGNGRLQSI

SEQ ID NO: 111911 - protein, 227 aa, Triticum aestivum
  Clone ID: PAT_TA_6329.pep
MGLLLLLQVLVAAAAARAPAAQAWGKEGHYMTCKIADGFLTSEASAAVKELLPSWANGELAEVCAWADKQRFRYRWSSPLHFADTPGDCNFSYARDCHDTKGNKDVCVVGAINNYTAALEDPSSPYDRTESLMFLAHFVGDVHQPLHCGHVDDLGGNTIKLRWYRRKSNLHHVWDSDVITQAMKDFYNRDQDTMIDAIQRNITDDWSSEEKQWEACGSKTKITCAEK

SEQ ID NO: 111912 - protein, 293 aa, Triticum aestivum
  unsure (1)..(293): unsure at all Xaa locations
  Clone ID: PAT_TA_6330.pep
MAAPRPQPLLLLLLVALLAASAPPDAWGKEGHIMVCKIAEVPGXRDLLPESAGGELSTMCPWADTMRFRYHWASPLHYANSPNVCNFNFSRDCHNSRGEQGMCVVGAINNYTDQLYTYGDSPKSSYNLTESLMFLAHFVGDVHQPLHVGYEEDEGGNTIMVRWYRRKANLHHVWDVSIIDTVMKDFYNKSLDTMVGALQTNLTEGWSDDVGHWENCANKKATCANDYAIESINLSCNYAYKDVVQNITLGDDYYFTRYPVVEKRLAQAGVRLALILNRIFDKKKADTMPLYIQ

SEQ ID NO: 111913 - protein, 229 aa, Triticum aestivum
  Clone ID: PAT_TA_6331.pep
PPAPRARSNTATGDAERERAKLEDDGTEHGGARAACRPARWRRRREPRRRRAGGTESPRHDLGDRRRCPGERGRLRGRERPSGRRGPTARWRERGAPWGRGRPAASRSPVAQAPSTSARHPAADCNGQARARGLATDTKRNKEPCAVVRGHQQLHRPPRPGLCPARISRRQESLMFLAGLRWADVHQPAALTAPRRRPRRCNTFELRMVQRGKCNLRKVWPCRRDHRRP

SEQ ID NO: 111914 - protein, 213 aa, Triticum aestivum
  unsure (1)..(213): unsure at all Xaa locations
  Clone ID: PAT_TA_6332.pep
MGVECRYELAQAAYVKLALHALKHPAAAVNGLLVGTLADPAASPAVVSVADAVPLSHQPHHLPLLPTLELALTLVEDHFQAQGLAVVGYYHANARRDDADLPAVAKRVGDHIFRYFPRAAVLLLDNVKLEEVVKGNSRDAVVQLYTRDSSKSWRQAGSDGSSQLKLKEPSXNVVLADHVTTKKWQQVVDFDDHFDDIRQGLGLNASMLGLKRF

SEQ ID NO: 111915 - protein, 377 aa, Triticum aestivum
  unsure (1)..(377): unsure at all Xaa locations
  Clone ID: PAT_TA_6333.pep
MLNRVNSAARVAILLALLCFCSATPSYSFPDDPACARASGMAMPGPGNLLTVDQSGKGDYRKIHEAIAAAPANSSARTVILIKPGVYREKIVVPVDKPNITLFGTSANTTVITWNERWVSSDTSPTVSVLASDFVASRLTFRNTLGTSAPAIAARVMGDRAAFYGCSFSSFQDTLLDDNGRHYYCGCYIEGGTDFICGNGRALFEKCHLHSTSPNGGAFTAQKRASELNHTGYSFVRCKLTXGVGVSTSILXGRPWEPYSRVVFALTYMSAAVSPRGWVDWNHTANQRTAFYGQYHCYGQGAKTDGRVKWARNLSPTEAAPFMTKAWIGGQQWLPKQPPSCPKALDRWTAVASAENCRWCGLSYIPDTYLCYLWVPW

SEQ ID NO: 111916 - protein, 99 aa, Triticum aestivum
  Clone ID: PAT_TA_6334.pep
TIIRIGRSTPILENSTMDKNPLATPSPDHTLDKTSHRRSSHDSGTSSSSSRVCFSFTCCTECGFSGHQSSSSSSFGLNSKRTTSAASCSCGRNSTSSSC

SEQ ID NO: 111917 - protein, 376 aa, Triticum aestivum
  unsure (1)..(376): unsure at all Xaa locations
  Clone ID: PAT_TA_6335.pep
MLQSADFQLXEMSAFALGRLAQDTHNQAGIAYNGGLLPLLKLLDSKNGSLQHNAAFALYGVADNEDYVSDFVKVGGVQKLQDGEFIVQATKDCVAKTLKRLEEKINGRVLKHLVYLMRVGEKSVQRRVALALAHLCAPEDQRTIFIDNNGLDLLLDLLVSVSSKHQQDGSVALYKLANKAAALSPMDAAPPSPTPQVYLGEQYVNSSTLSDVTFLVEGKRFYAHRIALLASSDAFRAMFDGGYREKDARDIEIPNIRWDVFELMMRFIYTGSVEVTNELAQDLLRAADQYLLEGLKRLCEYTIAQDVNLDNVSDMYDLSEAFHAMSLRHTCVLFILEQFDKICTRPGFSQLIQRVIPELRNFFAKALRPSHRSAQP

SEQ ID NO: 111918 - protein, 101 aa, Triticum aestivum
  Clone ID: PAT_TA_6336.pep
ETRRAHPVICSCAGRQEWSVRPQAGSTTAWPSPSRCRLRAGAESRGKEGRQGARPWPRDTWVPTREDRRRRLAGGGGLLRCSLLDCGRVWELGIGESQRCP

SEQ ID NO: 111919 - protein, 108 aa, Triticum aestivum
  unsure (1)..(108): unsure at all Xaa locations
  Clone ID: PAT_TA_6337.pep
PVHRSRRQPSERAVRLTNAHEGLPLAVPGGKPXRRCGWLLPLLVGAAFVGEIAFLGRLDMSKNVAAVESWTTSFYRLSSTWGADAPPGSGDDGDDCEERLEREDAVPY

SEQ ID NO: 111920 - protein, 370 aa, Triticum aestivum
  unsure (1)..(370): unsure at all Xaa locations
  Clone ID: PAT_TA_6338.pep
MESSSPSVPFPLLQAPVESTYRACTIPYRFPSDNPHKATPVEIQWIDLFLKSVPSFRQRAENDPTVPDAPAKAEKFAQRYTDMLEELKKNPESHGGPPDCILLCRLRELILRELGFHDIFKKVKDTETKDEENAKAMSLFEGVVQRNDEIEDGEKRAENLIRGILAGNIFDLGSAQLAEVFAKDGMSFLASCQNLLSRPWVIDDLDAFKSKWTKKSWXKAVIFVDNSGADIILGILPFARELLRRGTKVILAANDMPSINDITYLELVEIVNKLKDENGKLAGVDVSDLIVANSGNDLPVIDLSSVAPELAYMASDADLVILEGMGRGIETNLYAQMKCDSIKIGMVKHPEVAQFLGGRLYECVFKFNEA

SEQ ID NO: 111921 - protein, 588 aa, Triticum aestivum
  unsure (1)..(588): unsure at all Xaa locations
  Clone ID: PAT_TA_6339.pep
MGGDGRHLGRTMSFGIPDVALGLVMGCVEDPWDRDAISLVCRHWCKVDALSRKHVTVAMGYSTTPDRLFRRFPCLESLKLKAKXPRASMFNLIPEDWGGSASPWIRELSPSFHFLKGLLLRRIIASDHHLPVLVRAKGQMLVSLXLDRCSGFSNSSLGLLAGXWKKLETLFLEESSVAEKENDEWLRELATSNTVLETLNFFLTDLRASPAHLLLLVRNCRRLKTLKISDCFMSDLVDLFRTAETLQDFAGGSFDDQDQGGNYANYYFPPSVQRLSLLYMGTNEMQILFPYGATLKQVDLQFTFLTTEDHCQLVQRCPNLEVLEVRDVIGDRGLEVVARTCKKLQRLRVERGDDDQGGLEDEQGRVTQVGLMAVAEGCPDLEYWAVHVSDITNAALEAIGAFSKNLNDFRLVLLDREVHITELPLDNGVRALLRGCTKLRRFAFYVRPGALSDIGLSYVGEFSKTVRYMLLGNAGGSDDGLLAFARGCPSLQKLELRSCCFSERALAVAALQLKSLRYLWVQGYKASPTGTDLMAMVRPFWXNIEFIAPNQDEPCPEGQAQIVAYYSLAGARTDCPQSVIPLHPSVGS

SEQ ID NO: 111922 - protein, 132 aa, Triticum aestivum
  Clone ID: PAT_TA_6340.pep
VCISLTHTHVDGGRARREEVHARHTYTRFFPNHTRACTRWSSFLYEKGSPRGNFARVLVVHLVEGGLSTTGEQTNCDLTRYVKLKKEANHVGPTLEARRQGSIHWSTFDVSRQLTKRGEAFLVRRLPRPRAW

SEQ ID NO: 111923 - protein, 292 aa, Triticum aestivum
  unsure (1)..(292): unsure at all Xaa locations
  Clone ID: PAT_TA_6341.pep
MCKMRKPKKHLYIIFDDWELGFSIRKIDLDTDQLIPGGYKALEVALPAPSIRFRAKCSYPIYFSDAIGSKILAMHPKKENADRGAFCFDVHNRRLNCIPRHTDQFRSIYLPIGDKLFALGTXSLEILDLQPLVGLSSQLDASSWHKLKDVPIDSMSVISHAVLPDSRTIFVSSDIATHTTHSLHMGDDGSFKWTNHGEWILPFDGCGYFXLMLGTWVGLALYKEKPGHICSCSLASVTSKVRPAVKYTEECRSPDPADTAVQPSFTWDVQDYALWSEVTKISCMFLNDMFPK

SEQ ID NO: 111924 - protein, 172 aa, Triticum aestivum
  Clone ID: PAT_TA_6342.pep
VSRGRVLRAMDGCTYKAAAGGSLSNSLVALAWLGSSRASHCYSELRVAAGSVGSDPLGSFYRQKLHRANVQFLSKPVKDGTTGTVIVLTTPDAQRTMLAYQGTSSTLAYDSDLAEIVSKSNLLIVEGYLFEFSHTIEAIKQACEDAKKNGALIAVSASDVSCIKRCHSDFWD

SEQ ID NO: 111925 - protein, 157 aa, Triticum aestivum
  Clone ID: PAT_TA_6343.pep
AHTDGTQATHDNLTHTCVTLFTVVVIDRVAHSCKAAIYSRRDIDSLLFDAQQHEHNNAHRQREEPKYQQRNVRCSRRRRIGHVVRCKSYQQKSQDGLPNDQKYHATLPGIDIRCISSLCSRRRRIGRRHCRWIGHVVGGRRCRRSVHGVRARLQREW

SEQ ID NO: 111926 - protein, 174 aa, Triticum aestivum
  unsure (1)..(174): unsure at all Xaa locations
  Clone ID: PAT_TA_6344.pep
LSRIPAVHXWSVDGIISYVKAQPKLEDLPLSKMTVAELKKEGSKAMYKQDYKAALEIYNMAITLDHDNIDPVIIGNRGFCRLILHRDGALNDAQICRQIQPDCPHACWLEGYSYLLLQEFEKACDSFLDAVKLDPGHVGIEKALREALRLLTESDADKKNGVEGPGYRPVYLYH

SEQ ID NO: 111927 - protein, 199 aa, Triticum aestivum
  unsure (1)..(199): unsure at all Xaa locations
  Clone ID: PAT_TA_6345.pep
MAALLARQAAMALRARQTARLGPSATAMQGHLRTYMDAGAPKRFKEDEEKEQLAKELAKDWSAVFERSINTLFLTEMVRGLMLTLKYFFEXKVTINYPFEKGPLSPRFRGEHALXRRYDTGEERCIACKLCEAICPAQAITIEAEEREDGSRRXTTRYDIDMTKSHPSCGFCQEACPVDAIVEXAPNFEFSTETHEELL

SEQ ID NO: 111928 - protein, 170 aa, Triticum aestivum
  Clone ID: PAT_TA_6346.pep
SHPPTESGSNRRRGSGQGMIRKAEFEDFGEKEPAVEMRAQPHTAADSSSYPTSSRDQGMNRKAKSEDFGEKQVVAEIRAQPHPAADSSINRRSSSGQEMNQEADSNGLEKQPVVEMRAVAQQKPCDARISHGRRRPGDHSRANGAARQQGCIWVPKAAAVPVRTEVGNIP

SEQ ID NO: 111929 - protein, 209 aa, Triticum aestivum
  Clone ID: PAT_TA_6347.pep
MTPRQQSRRLVSSAAPATLLLLLLAGAADAVPPLVGVSPQDEAYFAPQVIACRDGSGSFPRSRLNDGYCDCTDGTDEPGTSACPEGKFYCTNIGDLPRILFSSFVNDNICDCCDGSDEYESGIHCPNTCKKRHDAAETDNGVSELSVAHLGGTDIISSKHTLDIEDLIQKLRGLRMAAVIELGLVVCIFVFYFARRSTRARRRQYILKR

SEQ ID NO: 111930 - protein, 61 aa, Triticum aestivum
  Clone ID: PAT_TA_6348.pep
FKLLLVIQKAEQELQCSFFSAHEQSSLSFTDEQSIRARRRASAQGFLALILSFLAMAAALA

SEQ ID NO: 111931 - protein, 286 aa, Triticum aestivum
  unsure (1)..(286): unsure at all Xaa locations
  Clone ID: PAT_TA_6349.pep
MQIFVKTLTGKTITLEVESSDTIDNVKAKIQDKQGIPPDQQRLIFAGKQLEDGRTLADYNIQKESTLHLVLRLRGGMQIFVKTLTGKTITLEVESSDTIDNVKAKIQDKEGIPPDQQRXFAGKQLEDGRTLADYNIQKESTLHLVLRLRGGMQIFVKTLTGKTITLXEVESSDTIDNVKAKIQDKEGIPPDQQRXFAGKQLEDGRTLADYNXQKXESTLHLVLRLXGGACKIFVKXTLTGRTITSGRVGALDTIGQCQXPRXXDXEGIPPXTSXRLIFAGKQLGGW

SEQ ID NO: 111932 - protein, 75 aa, Triticum aestivum
  Clone ID: PAT_TA_6350.pep
PYSHKHTRHFLPLLKPDALLRVKFVRVSMQRGYTTQSSQTSTHAKRSCYQQNGARTKSNRWFAPMSSSKLARRAS

SEQ ID NO: 111933 - protein, 249 aa, Triticum aestivum
  Clone ID: PAT_TA_6351.pep
QIPSSHESVLDDADIVKEKGEETMSEPTSHNTDAVSIVDAIEGKKEKEEVTPESTLDASLVHTIDNVKGKESEEPTSDLTAVDAGGNAGTILVADSSSHMNSTPQGTNDSKEEARDEKAAVDHARTDAVEEKKQKEETAAETNTKDSANDHPNEEITDKEMTIDSDKSHVSLKSLLSEKGIEFEVKEKKVSTKDRMLSFRRRSSKDNPSPAKPGSEQQDWNSPARLPAEKSPKGKKQQWMPFICCHSMN

SEQ ID NO: 111934 - protein, 186 aa, Triticum aestivum
  Clone ID: PAT_TA_6352.pep
GPHGPAPAGRSRRARPRRPVRAREPLLPVDPTTAPPSHPEGDEGGEEAVRPRLSGAPAEVEDEQLVIRYAPYARRDAYGPMGRGPLSAAQVARLVLAGVVLLPLRLVAGVLLVVAYYLVCRVCTLFVGGVGEGRPRLQGLRREAVLRAGRVLSRAMLFVFGFYWIPVSDRSFPNAEVSTRPSSVTL

SEQ ID NO: 111935 - protein, 211 aa, Triticum aestivum
  Clone ID: PAT_TA_6353.pep
MAGEKKKRWWRRRRRSRSSSSGTSIVFDPAKVPDIITEVSARYLVTGTMRSGAEKEDSNGTLTPKRKGLEAHENGNGEINHGPSNGKLENGSHSNGSHQVPNDGEPKMEYMFEINKTEIYPTEVDKDGHVTEAQPKVEEYDLEKILDQQETYELFCPNCTSCITRRVILKKRKRTVRTTPTDEPSKRPYIEGQVPPVTLPDRVEEESPEVF

SEQ ID NO: 111936 - protein, 187 aa, Triticum aestivum
  Clone ID: PAT_TA_6354.pep
SARGNAAEVQQTPQVVEKSQAAEKSEKKAELKPDEAKKLIEFMESKYDEHVAKVDSFDDFYHAIYELIQKFCEERGQVQYRIPPREKLQEVYTKHHKAGSGEVKREEFAKMSGELVKRDSFSFGKATTELLMFLFGAPMCALVAKRVLPGLGWLSDDTVIPLATSGAVAFLVHTKKLSIDHVSTEYC

SEQ ID NO: 111937 - protein, 136 aa, Triticum aestivum; identical to SEQ ID NO: 106789
  Clone ID: PAT_TA_6355.pep

SEQ ID NO: 111938 - protein, 330 aa, Triticum aestivum
  unsure (1)..(330): unsure at all Xaa locations
  Clone ID: PAT_TA_6356.pep
DVKPENLLLTSDGHIKIADFGSVKPTVDTPIKVLPNSTNERACTFVGTAAYVPPEVLNSAPATFGNDLWALGCTLFQMLSGSSPFKDASEWLIFQRIIARDLRFPEFFSDEARDLIDKLLDVDPTKRPGAGPDGYASLKKHPFFRGIDWKNIRKTRAPXPAVEANANEDEDNQDSDWLSHMGSAHANQNXXPVGNNGAASSSGEREXMKTGGNGRLHAHNFSTSERQDFLEPDESVVLISKLKKINKLSNKKVQLILTNKPQLICVDPAKMVTKGNISWSDDPSELNVQVANSSHFRISTPKKVFVFEDAKQRAWQWKNAIEDLQHCQKS

SEQ ID NO: 111939 - protein, 75 aa, Triticum aestivum
  Clone ID: PAT_TA_6357.pep
FCDLPFGGAAGTRLRATCLEHPSSFQRQRLQQPGTKLACFHLGCADNSDIFGVACPDSNSVHHKMAHCVDLTMSH

SEQ ID NO: 111940 - protein, 177 aa, Triticum aestivum
  Clone ID: PAT_TA_6358.pep
PSLRQAVAKAKQEAGRATQKHDKDGKAVANHNNAKEQLIEFMDNNYDAKLEPTKTFNEFYHAIFELIEQFCEQQGQLQYRMPPKDQLAEEYKALRGNRHGVNLTKGQFHTITENLVTVHSFSFGNAAFDVLVVLFGAPMCALLVKRVVPGLKSFSDDVVIPVATSGAVVYLAKTNKL

SEQ ID NO: 111941 - protein, 67 aa, Triticum aestivum
  unsure (1)..(67): unsure at all Xaa locations
  Clone ID: PAT_TA_6359.pep
ELAGTLHFISSTSTRKISFLIMPGDVSLFTSVFLLQSPGRSPVCRRRSPASRRRGXLREESAVGLVP

SEQ ID NO: 111942 - protein, 138 aa, Triticum aestivum
  Clone ID: PAT_TA_6360.pep
GAPSKRWRGREGALFPTESRHRRHAYVPFTPSHSEEHLPPPSYRGCWHGVSRGFFLESCHDRALDERALQAADPAILADGGVGEQLVRLLRSGGRWRNWPALAAARGVTRERERCAARGMDRWGIRRIRQLPKLRGKS

SEQ ID NO: 111943 - protein, 173 aa, Triticum aestivum
  Clone ID: PAT_TA_6361.pep
LECSRGYPSDIAANRIVNEATLPRGLRDDTTCIVVDILPPEKLAPSPPTKWQGKTVLNNMFRVDLKNNMFRRKNSDASFKIDREYAEPDVVEEIFEDGSAMLSRRLSTGYALRNMFEPSSCAICQFRLKSGQGISIHANPLQQEKMQGWQGPFLCQSCHEKKKAMEGKRRPID

SEQ ID NO: 111944 - protein, 148 aa, Triticum aestivum
  Clone ID: PAT_TA_6362.pep
MAADRRHPAVNDVYLTLVGASNTLADVQRRLDLEFRASYPDHANPAKLVGRVKRVQEEVAALKDLCRDLLAQKQELIDMMRTSLAAQRSATQRLLASSGLPLMTDDEEAACASLKQVIDEWTDQLKPMAGGPDGENEDTNQILFSAIL

SEQ ID NO: 111945 - protein, 331 aa, Triticum aestivum
  Clone ID: PAT_TA_6363.pep
MGGVTSSVAAKFAFFPPDPPSYGVVDEEPLPPGVAPAGSDAAALSRRVLMTGVLWREGVEARRLRTRRGTEIIAMYVGCPKASLTVLYSHGNAADLGKMYELFIEFSARLHVNIMGYDYSGYGRSSGKVIETFPPVKCPVLVIHGTSDDVVDFSHGKRIWELSQQKYEPLWIEGGDHCNLETFPVYIRHLKKFLSAVEKLPAGKEAAPESEKLLAGNEKPSDSVALSEAHLMTSQRLEPSRKSSRHEQPPRLSTERVDKHHRSTDVREKTRSITHKERSRRSVDTFDRTRDENEQTDKPRKSIDRLGEMIRSMGLCNVDCFKEPSRETEAC

SEQ ID NO: 111946 - protein, 55 aa, Triticum aestivum
  Clone ID: PAT_TA_6364.pep
LLLLLLLLQRTRKMCAERRGMGTSILQTWRTNCHGQAQIKNESSLIITRGKTWSN

SEQ ID NO: 111947 - protein, 155 aa, Triticum aestivum
  unsure (1)..(155): unsure at all Xaa locations
  Clone ID: PAT_TA_6365.pep
RDAGPRAEPPRAHRYHTTAPPSQRSPPSSETAPPSPSWRPPPLPGPPPRDLSFPSTVPPPXPPTYPPCPAGPAPPRLPQPRAGRPSRRTTWLSSPSPPLFAWFWLLLFRSLLSNLAGAQVHALWSYSSTLVATIRLPPLQWVQHAAVSYTRFGPE

SEQ ID NO: 111948 - protein, 101 aa, Triticum aestivum
  unsure (1)..(101): unsure at all Xaa locations
  Clone ID: PAT_TA_6366.pep
AXTCSTVLYHTEPRPCDMIRRKGARPPSFLFRTKPSCKIGCIAQLVEHWAFNLMVAGSSPAIPKTKKTTLVFVRMHSSLQRALFGLEKSPFLINISTSLVV

SEQ ID NO: 111949 - protein, 131 aa, Triticum aestivum
  unsure (1)..(131): unsure at all Xaa locations
  Clone ID: PAT_TA_6367.pep
QQQRKEIFSIAITKKLSSYEGYCSGGAALDCTVGDQSVVFVTTXQGGNFPHFLMGHRRYLLGGNAKLIKPNKRKLVLSFDDPNIRWSRFKHYMREIVHHXTEGASHSRKTNESKFTLPMHDCMCQARWNMI

SEQ ID NO: 111950 - protein, 321 aa, Triticum aestivum
  Clone ID: PAT_TA_6368.pep
MGTPHADSEKTEIGEIDTRAPFESVKAAVSLFGEVRFSSERSATRKAQAPQAERVLAKETELHLAQKELDKYKEQLSNAETTRLQALSELERAKKSVVDLTNKLDAVTKSKELNIRATENANIRTKELEGGSSSEAVGKDGPLKQELDNAREQYAIALADLDAAKQELRKMRKDFETSLDAKLLAAQQEAESVQSSESNKEKASQLRTEIAMVQESLTHAKAATEQAREEEANILAEKDAARRTCKESLEEAQRKLSNLRNDFDPVAFKGLQEKLDETYSEIASLQKKIEDARDRDLESVSAVSTELDDAKETLQKVAQEQ

SEQ ID NO: 111951 - protein, 273 aa, Triticum aestivum
  unsure (1)..(273): unsure at all Xaa locations
  Clone ID: PAT_TA_6369.pep
MASDVPMTPELQQMDGEIQDIFRALQNGFQKMDKIKDSNRQAKQLEDLTGKMKECKRLIKEFDRILKVEESKNPPEVNKQLNDRKQYMIKELNSYVTLRKTYQSSLGNNKRVELFDMGGTSSEPAADDNIQMASAMTNQQLVDSGRNQMDQTDEAIXRSKMVVAQTVEVGSQTATTLTQQTEQMKRIGNELDSVHFSLKKASQLVKEIGRQVATDKCIMGLLALIVFGVIAIIVVKIVNPHNKNIPDIPGMAPPAQNFQTNRRLLSAKAFRGL

SEQ ID NO: 111952 - protein, 99 aa, Triticum aestivum
  Clone ID: PAT_TA_6370.pep
FSLFLLRTLFPTGMKQLAAPSSSSRRRFVRLYLLPPLHWPRGRPLNRNWWCFASARSDVVDLLACAGCPRDFSPPFVLSPAAVADDLGISLDLLLRRWV

SEQ ID NO: 111953 - protein, 256 aa, Triticum aestivum
  Clone ID: PAT_TA_6371.pep
TRVGDGRRTTQALKTWNVTCTYSQFVAGRSPTCCVALSSFYNSTIVDCNTCSCGCQDNSTNPVSCVKPNSPYLASVVPGDSTNIPAPLVQCSPHMCPIRVHWHVKANYKDYWRVKITATNLNYLMNYSQWNLVAQHPNFNNLTTIFSFRYKDLNPYGTINDTGMMWGIKYYNDLLMTAQHNGNVQSELLFRKDPDTFTFQKGWAFPRRVYFNGENCVMPPPDAYPWLPNASHRLSASLTIPFITVWAALAFLLVHA

SEQ ID NO: 111954 - protein, 82 aa, Triticum aestivum
  Clone ID: PAT_TA_6372.pep
TIQKNCMYLYKVRTKCKRPQYTKKGRKPQTTTQDTKRPVLPHGNPRNELSNATRSQSFSLASASTCSMLQSIGVLNVVPSCR

SEQ ID NO: 111955 - protein, 127 aa, Triticum aestivum
  Clone ID: PAT_TA_6373.pep
FARGNLGNEDPLQLLASHLPALTYLSLNRVSSAGTLVLSAGCFCQLKTLVLRRMPNVKQLEIEEGAIPCVDGIYIVSLSELGMVPRGIESLGSLKKLWMLDLHKDFKADWDLNQMHDKMKHVPGLRA

SEQ ID NO: 111956 - protein, 238 aa, Triticum aestivum
  unsure (1)..(238): unsure at all Xaa locations
  Clone ID: PAT_TA_6374.pep
MEEVNDSQLPMEPLHYPAMATEAEQLPPMAAGSVQGQICAAEGGAVGDGEAEPQASEQSIGQIDPETPGWTRRVRIGAAAPGRAPCRGRISALEKAIRGFADQPGDMVIVPALGTSFDTLEEAYDFYNLYSREKGFGMXGSTKCKQEIVCGCAGKAGVEMSGPCRCECPALIMLLRSKDNGWYIAEHHEHHSHSLSTTYGQTIHWPSHEHIDIDKRDLVEQLRQNNVNLAKVYSIVGR

SEQ ID NO: 111957 - protein, 64 aa, Triticum aestivum
  Clone ID: PAT_TA_6375.pep
ERPTPPSIPAVKASSLMLLQVPFGYYIQSRVNISGQSGRPYHICALFDVFLVCAHAFEIVPIMS

SEQ ID NO: 111958 - protein, 217 aa, Triticum aestivum
  unsure (1)..(217): unsure at all Xaa locations
  Clone ID: PAT_TA_6376.pep
VYPSFLGKQRAQRAHWCPPSDLTDSFPNTTILVPAQNRRHVLAGLHTPGALAGPRPPGRRAGGGPKSRRPRGAKPKRPRTRPTXEARGGGPGGGHGGRRGRRAARRAGAGGRRPRRPRPPQAAAAAARGGGRCTARTPPPPAARRAQNRRGKGGGDAGGRRRAGGAEGGYRGGGRRHGEEKGLGAGADAERGWRCKENRGRGEKAAAREEGARPRAG

SEQ ID NO: 111959 - protein, 154 aa, Triticum aestivum
  Clone ID: PAT_TA_6377.pep
RVDAKVNAQSSAEARLSHDPRLNGNGTARHLHDEWLEEYEAGVFMKLKDLGDGTRELTRVRFSKRRFGEHQAENWWKENREKVYDRYNIRTSRRAPSAPLPHSAPSRTFLFLHAQTARPAINEQQQIVNETKGYVICVLGCRPAICDLYRLLIL

SEQ ID NO: 111960 - protein, 253 aa, Triticum aestivum
  Clone ID: PAT_TA_6378.pep
MTALVRLAGRAASWSRGASIAPPRGLGLLPQRRTAFQGARMANGGGKGGRGALIVLEGLDRSGKSSQCARLLSFLQGKGCATEGWRFPDRDTSVGKMISAYLANESQLDDRTIHLLFSANRWEKRSLMESKLLGGTTLVVDRYSYSGVAFSAAKGLDIGWCKAPEVGLLAPDLVIYLDVQPEKAAERGGYGGERYERVEFQKRVAEHYHSLRDSTWKVVDGSLPMETVEEQLRELAMNCISECQDKQLTNLPW

SEQ ID NO: 111961 - protein, 116 aa, Triticum aestivum
  unsure (1)..(116): unsure at all Xaa locations
  Clone ID: PAT_TA_6379.pep
PPPPRPPRLRPCTAAARGAELQRTGXGTLGGDLDRSTGCFHLSDLAQVKMTLKNYFRGQNDLYLLQIDTAKIADGLIYEAADGCNYFPHSYGPDRSFAPLQLSAVVKARQNRAGEQ

SEQ ID NO: 111962 - protein, 175 aa, Triticum aestivum
  Clone ID: PAT_TA_6380.pep
YWVPNTWRSVPLLLASSFLGNFVRSTPAFVLLGQVPSLLFACPKGVLHARISDVRQVVSFESIRQLFRRFGDGYVICAYERMVDGMYGVEAYIEFRSRWRAARARDALDGHAIYDGCCILAIDLVPPVYTTITMPADDGMAPSYFYNDTPYTEWTAALAAAERHDEAPATSSDDL

SEQ ID NO: 111963 - protein, 330 aa, Triticum aestivum
  unsure (1)..(330): unsure at all Xaa locations
  Clone ID: PAT_TA_6381.pep
LVPRASTHPPLPTPTAAPRAPEDGERPPSGGFVRGGVWAGGEVGSGSTGVALSTLQSGCAGEALLSGRVLVRVLPGSRCLLLGAAGSGQTTCLLGLAGVHIVGGEDVVRLLDVSAQHATQLVCSGDPSYWGNLCGRNVSSLGCCSTTVAISLLSTXYLELMELDPVRREXKLIDLLDIDLQWRMHKVSDGQRRRVQICMGLLHPYKVLLLDEITVDLDVVTRMDLLDFFKEECEQREATIVYATHIFDGLETWATDIAYIQEGELKKSAKYSDIEELKTAKNLLTVVESWLKSETKLPKKEPARVESQPRRSSPFDASPFRASRHMAYYR

SEQ ID NO: 111964 - protein, 193 aa, Triticum aestivum
  Clone ID: PAT_TA_6382.pep
PPLLFCHFPPSPPSRCSLGHSTGRVARLRGGRAAGGGGRRHRPGRRSRGAWRAGGGGTWAPARPPGATSRPTAPTNAALSLLALRPLGASRSGPLATSSTSSPRLTPTGDASPGDAANVPGVSSQTWVKVMGTVFLMKGEGVGQDHLASTLDGNDDGEDDSGGQPLRAPVSWWTPLTIIQSALRSLRSLTESL

SEQ ID NO: 111965 - protein, 97 aa, Triticum aestivum
  Clone ID: PAT_TA_6383.pep
RELFNNSSPRAQPCQRSQAQSSEQHLQVENLPDFLLEMRRPPVRRGEVGAAAGRRGEAEDRSLEARRPRRQGSRRQGWRIGGGRRSAVRLLLGLAPT

SEQ ID NO: 111966 - protein, 160 aa, Triticum aestivum
  Clone ID: PAT_TA_6384.pep
SYGLRQTTPYAPPGCGSHPPAPTPPIPGVPIPYAPPAGGSGPTPPDPPSPSFPRSSTPNARGQPTPPPRSSQPLPAPRRPAPPFLVNSSPASAFATTDGGPRRASPPVDMAPWSPLRVEDELRLNGRPPLCRRGGRYWTLRCSRQPTCRCPPPLAPPAAL

SEQ ID NO: 111967 - protein, 212 aa, Triticum aestivum
  unsure (1)..(212): unsure at all Xaa locations
  Clone ID: PAT_TA_6385.pep
MALNLTHQTGAAAIAATPAPGARASVFAAASPAAAAAAGSAVAPAQATSLRMQTQLVEPAQPQAPEMFQAMAPDQQQQGEAAHPDAGGEEARKVGVPVFVMMPLDTVRKDGSALNRRKAVQASLAALKSAGTAGIMVDVWWGIAESEGPGQYNFAGYIELMEMAKKAGLKVQAVMSFXHQCGGNVGDSVNIPLPKWVTEEMDKDQDLAYTDR

SEQ ID NO: 111968 - protein, 251 aa, Triticum aestivum
  Clone ID: PAT_TA_6386.pep
AAAVACSAGPAIPGSVVPWPEDTGFFRRDGGWNTDYGQFFMSWYSQMLIEHGERILSACSSVFTGSTGVKVSIKVAGIHWHYGTRSHAPELTAGYYNTRNHDGYLPIARMIARHGAVLNFTCVEMRNHEQPQDAQCMPEALVSQVAGAAKEAGVGLAGENALPRYDETAHDQVLATAAEKAEEDRMVAFTYLRMGPDLFQPDNWRRFAAFVKRMTETGVRDVSREQVEREAHNVAHATQGVIQEAAVALCN

SEQ ID NO: 111969 - protein, 303 aa, Triticum aestivum
  unsure (1)..(303): unsure at all Xaa locations
  Clone ID: PAT_TA_6387.pep
MNPEYDYLFKLLLIGDSGVGKSCLLLRFADDSYLESYISTIGVDFKIRTVEQDGKTMKLQIWDTAGQERFSASSAATIAGFLDRPVRSGSGRPPSRRRRRRARSPPHHPSRAGGPPPGDRSAPRDPDLAMNPEYDYLFKLLLIGDSGVGKSCLLLRFADDSYLESYISTIGVDFKIRTVEQDGKTMKLQIWDTAGQERFRTITSSYYRGAHGIIIVYDVTDQDSFNNVKQWLNEIDRYASENVNKLLVGNKSDLTDKRVVSYETAKAFADEIGIPFMETSAKNAXDVGHAFMAMAAWVKDRMA

SEQ ID NO: 111970 - protein, 144 aa, Triticum aestivum
  unsure (1)..(144): unsure at all Xaa locations
  Clone ID: PAT_TA_6388.pep
DTTGQERLRTITRSYXYRGAHGIIIXVYDVTDQXSFNXVKAVVEPKIDRYASENVNKLLVGNKSDLTDKRVVSYETAKAFADEIGIPFMETSAKNALNVEQAFMAMSASIKDRMASQPAANSARPATVQIRGQPVEQKTSCCSS

SEQ ID NO: 111971 - protein, 74 aa, Triticum aestivum
  Clone ID: PAT_TA_6389.pep
LSEHHSVDTNKLKFSYLDNTLIQCLIPNIKLSEPFTNILAVLSTKWPIAEFRRCSAWPGKMSTNHVNTGLPNEA

SEQ ID NO: 111972 - protein, 188 aa, Triticum aestivum
  unsure (1)..(188): unsure at all Xaa locations
  Clone ID: PAT_TA_6390.pep
ANSARGRGGISRRTWRRRRRGTRRRPQRRRRRRAARSAEPGSGSGKQEPSGEAGKPKPTPKKTKQQASDGAAKETPSKRKRDDAGEPQPQKAAKKADKATPTKKKQASSGGAEKATTPSKTPQKEAXAPRKAPAKPEKATPTKKQQASGGAEKATPSKRKHGDLESPNAAKSGQNGSSPAKKQKGKAA

SEQ ID NO: 111973 - protein, 254 aa, Triticum aestivum
  Clone ID: PAT_TA_6391.pep
MERGESILDAVLDEETLDFGGDDVEMADAEAEETPIPDPPAAGAGTAGGGAQAGGPAGKKKKKRKSGRSKNSGRPDGPPTKIGDINRFVLDTCRRLKEKKSYLVWNAIGCLGVSAVSDLVREVEAIQKCGGQTIADGSRFRTGGGILWNILKSREPKAYKEIMVKGRELEKQFMYTKGRPQMSRNEDASSQGSVLVDEEIEAHDDPEHLVDAEEAPPSVDKAEPRKPVADRIRVPVAYDDLFEDGEIHEEQPQN

SEQ ID NO: 111974 - protein, 69 aa, Triticum aestivum
  Clone ID: PAT_TA_6392.pep
TWPDYPPMAGLVASMKRTRSIGILIITHQHTVTYNGTSTYGGLILTGISHSHTSHKCQLKCQWYSNVLI

SEQ ID NO: 111975 - protein, 395 aa, Triticum aestivum
  unsure (1)..(395): unsure at all Xaa locations
  Clone ID: PAT_TA_6393.pep
MSPAIALRRAAAWLLRGAAGAGAGAPRAASSAALPGLGGALLSPARGLQGSEAAGFLGIWGGPAAGGSGGSWWFRCAASSVPRPGLLVEQLLVGGGRSFATGAAPEEVSFSPAAREADVSQPEKSVGTSDKTMLGDRSLKLVSGVCYLPHPDKEETGGEDAHFIWDEQAIGIADGVGGWASYGIDAGQYARDIMSNAVTAIEEEPKDSIDLTRVLEKAHSSTTVPGSSTACIIAITNQGIQAINLGDSGFIVIRDGCTLCRSPVQQHDFNFSYQLHSGXSSDLPNAAQVFKVAVASGDVNVAGQDGLFDNTYSNGRTPVVVGARDRGAGTPGSAEKEPADARLRAQDQNRPVPLPTPAPGAGYRHYGGKLDVITVVVSYVTAFGISKYSGLGEDC

SEQ ID NO: 111976 - protein, 157 aa, Triticum aestivum
  Clone ID: PAT_TA_6394.pep
MDPISIEKIRAMRKYRRNRKQQQLLLLPALAPYLVATCAVLCLLLTSPAWFPGVCSLLVSFLLTTLPDLATAFLLSPKCLFVVGNLIVAFLIAQSRLAPKSQPASVVDVDDVHEEHVKRNVAPTIAKAATRTTVMFSDHSASVEAVWEGEKEKEEEE

SEQ ID NO: 111977 - protein, 137 aa, Triticum aestivum
  Clone ID: PAT_TA_6395.pep
LQATSSKIDKTFLLARLIRALCQIINPRTRLTVVLALVPSYSTVTTNNYLLCHVPGGVSGACRQSMCRGRHHSVLWRRRVRLIGVVPRRRPRVLVQRAVKKQPGEARRLGEARVGGVGVAQFWSLHASSYACMGCMA

SEQ ID NO: 111978 - protein, 86 aa, Triticum aestivum
  Clone ID: PAT_TA_6396.pep
HVSNFGLLLYLKHMHCIWRFMHVNCVHSRGLVIMLFKRRSVLILSYLMALIKFSLTKKRLITLKMFYYVPSSCKRTWIRFLCLVPN

SEQ ID NO: 111979 - protein, 278 aa, Triticum aestivum
  Clone ID: PAT_TA_6397.pep
QLEAASPSEKRWVELEIQGADPQASARAAGKVFWPLDDDWYKGSITAYTELTKKHSVKYDDGEAEDLTLANERIQFSISSEEMKCLNLKFGTSNLDKKGYDELLALAVSFHDYQGLDPDDLVWAKITGHAMWPAVIVDEPNVHASRALKPIRLDQSILVQFFGTHDFARIKSKQAVPFLNGLLSSLHLKCKQARFSRGLEEAKEFLLTQQLPENMLQLRKSIENDGSDVNGQDDAIGSCDNLSEERAEENGEDAEMTQIELGNLRVSNLGRIVSDSNH

SEQ ID NO: 111980 - protein, 202 aa, Triticum aestivum
  Clone ID: PAT_TA_6398.pep
MASRRVLHLLTASRGISSTPHLASLGWINKIKDTFTGKKAADSPFPPSESFNLNMFADSMEMARKVGTFKNFVSGRCSEATVVAACEKHAAVLRYLATIDPTGEKLKTSDKISATKHCNCTIADVEHILAKYTWAKDAQKKIEKLKEEGKPVPKTFTEVQNLMGNTAFDLGRANLEKSGQISRNALCPCGSKKRYKKCCGAS

SEQ ID NO: 111981 - protein, 231 aa, Triticum aestivum
  Clone ID: PAT_TA_6399.pep
IYAVGAVGSLLGVVLYQSALKDYDFRSMLLWGQVLSSLTGMLDLALVTRLNTKVGIPDYVFAVIDCGVSVMVGKLQWMPVLVLCSKLCPPGIEGTFYALLMSIQNVGLLMSAWWGGLLLHTLNVTRSEFTNLWAVVLIRNVSRLLPLMLLFLVPQSDQKSTLLPAEMLHDDESTEAVKDGSGSVEFSVLVADGSGCHPSVEDVQDERITVTDDVRGDVELIPLMNTNRTVG

SEQ ID NO: 111982 - protein, 141 aa, Triticum aestivum
  Clone ID: PAT_TA_6400.pep
MLLKSKFKLATAVGIILSMLSLLVHLFLANYSAGGISKYSVDNVLPFGSKPRPRRLWGPLSTLDLLHPYAKPRQLYPAPAKDNGFIYAKIYGGFEKIQSSICDLVAVARLLNATLVIPEIQATTRARGISSNFKSFSYLYD

SEQ ID NO: 111983 - protein, 145 aa, Triticum aestivum
  Clone ID: PAT_TA_6401.pep
NDNTYYRLKNIWLSYRQNQVPACRYFVDVLLSLNSCISWVFVAFSVRPLSPGTWSFCGLRDDKCCRIWFRLLRPLYGAFSLLFVGLPAPLCLSGPARPCGAFTLTECPSTMALVSVAFHERSSKVRPSLFSASGAPFSSRAPRAE

SEQ ID NO: 111984 - protein, 195 aa, Triticum aestivum
  Clone ID: PAT_TA_6402.pep
PPLHTKLLLRPASRAPPPLPCAPPPPSIPLSASSPRSLPSLSHLHFCCRSISSWTPSVAHLRVARPAAGKRWRHLLRLRRIYTPATGLISPMLLISLNSLPFFSSRGRGGVDVGTTQGHGDATRRQSGDGSSAPFEDGDGSMGIPATAEQFGRRARRCSGRAGGACGQRKMRAFFFLTWSLYDESFFALMRGIGG

SEQ ID NO: 111985 - protein, 198 aa, Triticum aestivum
  Clone ID: PAT_TA_6403.pep
SARGADVAFGEEVITTTVTSSGAAVEDWVEEVYSMYAGCPNQILVGLDVEWRPSYSRVQNPAALLQLCIDQRCLIFQLLHADYIPDALSVFLMDNQFWFVGVGVAADANRLAQDYDLQVRNLEDLRGVAAEEMGIPELRQAGLKDLAPQVLGVTMQKPRRITMGPWDACCLSDEQIHYACTDAYVSSQIGLELFTGNY

SEQ ID NO: 111986 - protein, 76 aa, Triticum aestivum
  Clone ID: PAT_TA_6404.pep
ACGSSLDVTFGTNTMTSLELLKAYCSEGSSVKFSGLKNLVGLKEVLIKGCCDDMLKEDLQSQLNDHSEKPVLKLEE

SEQ ID NO: 111987 - protein, 95 aa, Triticum aestivum
  Clone ID: PAT_TA_6405.pep
SITCSPRHLRWIQEPRRGPGASLRGFACSPRRLRLLQEGLSSHCAGVDCVTGFFLSLLPVIGFFGEESITVFQYIMDAQPVCLHGTRMKINHSIY

SEQ ID NO: 111988 - protein, 158 aa, Triticum aestivum
  Clone ID: PAT_TA_6406.pep
TGTGEVKRWHRRRSWPSKGAPLPSRTTQAAAGNRSSCREQWWMLLLRESGRWTRRFAFYPRTKVVHVQQQGSASGVIARGTIGAVVPGATTWRSLQVDWDGSTSSTPAVNKWQVEPEGTRDAKRRRLSKTVPPVASTAQRGVKLFGKTLVPEGSGSRS

SEQ ID NO: 111989 - protein, 155 aa, Triticum aestivum
  unsure (1)..(155): unsure at all Xaa locations
  Clone ID: PAT_TA_6407.pep
DLQALRSAPLRGGGGPSQSLNPDGRIPELIFWHIPSTAYVKVAPKPKTEICKPRAGSRAPHGAPPLGALAGGGDAXCREPSCRALSPPRDGCCPGARPALCLARHSGPGRIQNRMHNANNLELAVRXTPPTPWIRMENGSTHSHITLYLSLIRLG

SEQ ID NO: 111990 - protein, 126 aa, Triticum aestivum
  Clone ID: PAT_TA_6408.pep
ACQSPSWLSVPSPTAGVVSLLGWLAYGDFKAGFEMGPWWQRLFNGYSITTWIVVFNLGSTGLRVPSLPTCSASVVEVFSTSLAVPSSLVLALALVTVCPALLLLLGFATSMASLLTLVLPVHLLVV

SEQ ID NO: 111991 - protein, 108 aa, Triticum aestivum
  unsure (1)..(108): unsure at all Xaa locations
  Clone ID: PAT_TA_6409.pep
SCFTFCTYENLQQFGTSSTLNHISEVFHLILLSLYISHVFFCYHARPGVPPILLLAALAPACRGPVAPLRRFLLSCALASPLLLGSCGCKHIIPLTXHTAFXXSMELV

SEQ ID NO: 111992 - protein, 127 aa, Triticum aestivum
  unsure (1)..(127): unsure at all Xaa locations
  Clone ID: PAT_TA_6410.pep
HPLAGCRRLQFPTAPATRPYHSVWAGSPLVATPWHVKKEVLDKLVLNFLTTCGSSPEDESRSRSSXRAKGIGMYFSKRCLPPEEAVNALASSPELRLKPRTVQGSNGVPGAPQVDLFPSQEVMVLTS

SEQ ID NO: 111993 - protein, 76 aa, Triticum aestivum
  Clone ID: PAT_TA_6411.pep
LASQDVATRCKELGITALHIKLRATGGNKTKTPGPGAQSALRALARSGMKIGRIEDVTPVPTDSTRRKGGRRGRRL

SEQ ID NO: 111994 - protein, 110 aa, Triticum aestivum
  Clone ID: PAT_TA_6412.pep
IHVTDLSGRETLVRITGGMKVKADRDESSPYAAMLASQDVATRCKELGITALHIKLRATGGNKTKTPGPGAQSALRALARSGMKIGRIEDVTPVPTDSTRRKGGRRGRRL

SEQ ID NO: 111995 - protein, 386 aa, Triticum aestivum
  Clone ID: PAT_TA_6413.pep
KTNSDGSFFAGPLYEDIGYEVEASKAGYHLKQTGPYSFACQKLGQILVHIYGENDTEMLPAVLLSLSGEGGYRKNSVSGSGGTFSFDNLFPRSYYLRALLKEYKFTPSTVAIDLNSGESRAVEFRATRVAFSAMGSVTLLTGQPKEGVFVEARSESRGYYEEATTDSFGRFRLRGLIPGSSYSIRVVAKDNLRLAALERASPESVSVDVDEEDISGIGFVVFERPEATILSCHVEGNDIDMLQPHLSVEIRSAVDPSRIESVVPVPLSYHVEVRNLPKGKHFVQLRSGLPSHTHIFESELVEVDLEKQPQIHVGPLKYKTEERHHKQELTPAPVFPLIVGVSVVTVVISMPRLKDLYQSAVGMTSLSSGNTPSRKEPRKTILRKRA

SEQ ID NO: 111996 - protein, 150 aa, Triticum aestivum
  Clone ID: PAT_TA_6414.pep
MSKRKTREPKEENVTLGPAVREGEHVFGVAHVFASFNDTFIHVTDLSGRETLVRITGGMKVKADRDESSPYAAMLASQDVATRCKELGITALHIKLRATGGNKTKTPGPGAQSALRALARSGMKIGRIEDVTPVPTDSTRRKGGRRGRRL

SEQ ID NO: 111997 - protein, 151 aa, Triticum aestivum
  Clone ID: PAT_TA_6415.pep
MSSKRKTREPKEENVTLGPAVREGEHVFGVAHIFASFNDTFIHVTDLSGRETLVRITGGMKVKADRDESSPYAAMLASQDVATRCKELGITALHIKLRATGGNKTKTPGPGAQSALRALARSGMKIGRIEDVTPVPTDSTRRKGGRRGRRL

SEQ ID NO: 111998 - protein, 125 aa, Triticum aestivum
  Clone ID: PAT_TA_6416.pep
QVPAMDARARAPSSSLHASPVGVAPVAASPSSVAAGDLRVEMPEFTPPCTCIVPLPSSALKQLQRRMSTSNPLVSLALTAPARGSRQAQRPFRPAGSSSTHRVRPTGPAFVSGLCLPPHLVATRR

SEQ ID NO: 111999 - protein, 200 aa, Triticum aestivum
  Clone ID: PAT_TA_6417.pep
RTNGRYRSSDSGDDRMDIASPKEHDDESEYFASWVVRKQLYPETVNWIPPVRIFRYTAIFEEAWGWDRLLPHTSVPIPTYLEYLTEYHKRNRMDYVAAAAGNSKPEDWPLKYRAVNNDTQFDPDASLVDAAQFCLKMEERFMLAWNNKRVRNVKHLSQLIQERARAIISTSEEFSETAAASLVCISNEAVLASELLHRWA

SEQ ID NO: 112000 - protein, 154 aa, Triticum aestivum
  Clone ID: PAT_TA_6418.pep
MDRYQRVERPRPESAIAENEIRITAQGLIRNYVSYATSLLQDRKIKEIVLKAMGQAISKSVAVTEIIKKRVPGLYQDTNISSVSITDVWEPIEEGLVPLEMTRHVSMISITLSPVELDQNSPGYQSPAYVDQPRQQQRLQQAPAPMRQPRQQAI

SEQ ID NO: 112001 - protein, 149 aa, Triticum aestivum
  Clone ID: PAT_TA_6419.pep
QGRNCCQDNGSGHLTSRKAKLIRPYQVPHHVYQRLLDSMRTPDHTMFKAPQMRIIGPRRRRHGCGYMMKCSFLRLRGAFFHGPFVSWRWPWWPCPAASAYRLRGTGSPETFPCRQRGRRRRALRRRHRPRSPPSTRAATSSGRSSRRLV

SEQ ID NO: 112002 - protein, 125 aa, Triticum aestivum
  Clone ID: PAT_TA_6420.pep
LQIRHEGFSAGGYQQQKQPYAPADPYYAQGYQAAPGYGPVVQGRPVRAAPRAGRRLPCCGLGMGWLLFIAGFFLAAIPWYIGAFVLICVRVHDHREKPGYVACTVAAIIAAIVIPLGVTKGTDSW

SEQ ID NO: 112003 - protein, 139 aa, Triticum aestivum
  Clone ID: PAT_TA_6421.pep
ANSARGPRKAMRREVVDDDEDSESGESEGEGVPLVTIAAAAKRKRARKLSDEFDRIAAAQLEGGAKKKPMAAAPAKASLRKKAAASAAAVPAPAAEAPAKKSLKRKAVAPAAGAEPRTSPKRKAPEVPAARRTSPRSKH

SEQ ID NO: 112004 - protein, 271 aa, Triticum aestivum
  Clone ID: PAT_TA_6422.pep
ASLLCAAAPAPRRHRPWRWRRRLLFPRRGGRRCPEATNRRKSRATSRRRRPWRRPNPTSVNHRLVAGGAEDGVDHISGLPDAVLGDIISLLPTREGARTQTLASRWRHLWRSAPLNLDYYDLPAEGDVLIRLISQILSAHAGSGRRLCVSAHHLYHHPATVDAWLRSAGLSNLQELEFCCAGDPLVLPAVTAPTFRFSSSLRLATFSQCRFPDSIVQTLHFPELKQLALEEVSISEGSLQRVIAGCPVLESMLLNHCIGFGCIRICSPNLR

SEQ ID NO: 112005 - protein, 159 aa, Triticum aestivum
  unsure (1)..(159): unsure at all Xaa locations
  Clone ID: PAT_TA_6423.pep
GGYMAPXFVMEGVFSVKSDVFSFGVLLIEILGGKRNGALYLEEHEQTLIQDAWKSWTEEKAAEFMDPALGRAYSKEEAWRCFHVGLLCVQDDPELRPTMSSVLLMLISDHMNLPAPARPPMFTRLRTFPAAMIPFSTKTESTFSPQSINDVSITVVEPR

SEQ ID NO: 112006 - protein, 144 aa, Triticum aestivum
  unsure (1)..(144): unsure at all Xaa locations
  Clone ID: PAT_TA_6424.pep
AHFDLSGAAFSRMAVAGAGAHLRDRGQLKVIYRRTACKYGGKNIAFHVNEGSTSFWLSLLVEFEDGEGDIGSMQLKQANSAKWLXMKHVWGATWCLYGGPTAGPFSVRLTTLSAPKTLTARDVIPRNWTPKGTYSSRLNFDASL

SEQ ID NO: 112007 - protein, 148 aa, Triticum aestivum
  Clone ID: PAT_TA_6425.pep
ARFGVTVVPFGFVGEDDILELVLDYNDQKNIPYLREWIESINKDGQRVRDSVKGEEGNQDMHIPAIVPKVPGRFYYLFGKPIKMEGMNNVLTDRESANKVYLHIKSEVENAMAYLQRKREEDPYRSIAQRAVYQATQGVSAQVPTFEP

SEQ ID NO: 112008 - protein, 88 aa, Triticum aestivum
  Clone ID: PAT_TA_6426.pep
VEPADEMSNGANLKPWNTGDDLAQVESLVISITVSGQKMSSSRLRSLGFPACLQPSKHAQQAWGHGAMLSSLMILGFALCAGLYLSWR

SEQ ID NO: 112009 - protein, 138 aa, Triticum aestivum
  unsure (1)..(138): unsure at all Xaa locations
  Clone ID: PAT_TA_6427.pep
AXVYHGAALCAEKXVELLAETNMPLGLLPLADIQEVGYNRASGFVWLRQKKALTHTFKQIGRQVSYATEVTAFVEDCKMKRMTGVKSKELLIWITLCDMYIDKDDPSKITFKTPTGLGRTFPVSAFGKEDCKEAAVAK

SEQ ID NO: 112010 - protein, 150 aa, Triticum aestivum
  Clone ID: PAT_TA_6428.pep
MASQVIEVNRNGAEVYHGAALCADKAVELLAETNMPLGLLPLADIEEVGYNRSTGFVWLRQKKALTHTFKQIGRLVSYATEVTAFVEDRKMKRITGVKSKELLIWVTVCDMYIDKNKHSKISFKTPTGLGRTFPVSAYGKEDDNKHDVAK

SEQ ID NO: 112011 - protein, 164 aa, Triticum aestivum
  unsure (1)..(164): unsure at all Xaa locations
  Clone ID: PAT_TA_6429.pep
MAQAIEAHREGAEVYHGAALCAEKAVELLAETNMPLGLLPLADIEEVGYNRATGFVWLRQKKALTHTFKQIGRQVSYCMSRTGTEVMPFVEDRKMKRMTGXKSKELLIWITLCDMYIEKDDXSKITFKTPTGLGRTFPVSAFEKQDDGKAKAAAADGKEAVVAK

SEQ ID NO: 112012 - protein, 85 aa, Triticum aestivum
  Clone ID: PAT_TA_6430.pep
LTIKMMRLVLCYLFTSLRGIGTSMCLEVQMQNLENKRSGTADKYVAGHAGICTRLISTMQHASRLGIRHFTFFSSTRKTIVRFWY

SEQ ID NO: 112013 - protein, 324 aa, Triticum aestivum
  unsure (1)..(324): unsure at all Xaa locations
  Clone ID: PAT_TA_6431.pep
AGTPHPHPSPIRSRRNLRSKRSQGSLVLLLKMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEGESSDTIGQRGGQDQDKXEGIPPGPEGLFFVGKRLVGGRPPWXTYNIXK

SEQ ID NO: 112014 - protein, 63 aa, Triticum aestivum
  Clone ID: PAT_TA_6432.pep
AHLSLLCFRTWSPFSTGLKIRVMHHVNNLLIGLNIFILEVRLIAYYVLVVLISCIYYQNCCMD

SEQ ID NO: 112015 - protein, 146 aa, Triticum aestivum
  Clone ID: PAT_TA_6433.pep
MAGRKGGDRKKAVTRSVKAGLQFPVGRIGRHLKKGRYAQRVGSGAPVYLAAVLEYLAAEVLELAGNAAKDNKKTRIIPRHLLLAVRNDQELGRLLAGVTIAHGGVIPNINSVLLPKKSPAAAEKEAKSPKKKTTTKSPKKKVAAKE

SEQ ID NO: 112016 - protein, 118 aa, Triticum aestivum
  Clone ID: PAT_TA_6434.pep
NTDVCVILELKKLQEKVPLFHYFEKYRYTFLNSTVHDRCSPRINGVFSSPRYLPPVGLRCCIAPTVHCHQPRPFNEAAPSRSMSQLRRLPPFPPSTALNLKKKANISPAGRRGGDFCI

SEQ ID NO: 112017 - protein, 165 aa, Triticum aestivum
  Clone ID: PAT_TA_6435.pep
MASLRILSVIAVVAIFALAGTAVANDLPDYIVQGRVYCDTCRAGFETNVTEYIKGAKVRLECKRFGTEKVERSIDGVTDETGTYKIELKDSHPEDICEMVLVQSPLPNCNEVQALRDRAEIVLSRNVGISDNIRMANPLGYLKDKPLPALPDLLKTFHPTTDDDH

SEQ ID NO: 112018 - protein, 146 aa, Triticum aestivum
  Clone ID: PAT_TA_6436.pep
FDHSRKNVVEVTIIQEILQNLRRACSKTMKKVTVGVICPYSAQVLAIQEKLRKMKFGPLSVKISSVDGFQGGEEDIIILSTVRSNSDGVVGFVSDRQRTNVALTRARHCLWILGNAATLSRSGSIWADLVRNAKERQCFFNAKSDG

SEQ ID NO: 112019 - protein, 139 aa, Triticum aestivum
  unsure (1)..(139): unsure at all Xaa locations
  Clone ID: PAT_TA_6437.pep
MAGGNLKNMAIAFLVPLPSVLFYLAFVRPQDGHSIVAAGPVSSWCAAHPLLLANALFLLNVDVLFWLIGHLLSNNWLIDLYWTVIPVMLLHYFRAHPAAVANAARSAPALALTWAWSARLTHNYFRREGWQWGKRXDGG

SEQ ID NO: 112020 - protein, 135 aa, Triticum aestivum
  Clone ID: PAT_TA_6438.pep
DELEKLCSRWPSSELAVSCDTHGCHSCRNQVMNSGGQRPATTCEKKAMWKTMPAVMSKSRQPSSILAVFCPPRLPWTPTPWSAFPRPAVASQTAPLPRPRLLPPAACPHPGLSRSGGATSRLPGIAARAQPCILV

SEQ ID NO: 112021 - protein, 74 aa, Triticum aestivum
  Clone ID: PAT_TA_6439.pep
SRNKVQQYQCVSAYEAASKATQKFFMRPPGHKKPGYHAVKITHSQKPFMLKVAGTHVLRETRDLAPSDKLQVNY

SEQ ID NO: 112022 - protein, 47 aa, Triticum aestivum
  Clone ID: PAT_TA_6440.pep
EGPAAGVSARGRIMVPHLSTTHIKILVYSFLTLFPVNKKLEPILNFP

SEQ ID NO: 112023 - protein, 119 aa, Triticum aestivum
  Clone ID: PAT_TA_6441.pep
GIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 112024 - protein, 236 aa, Triticum aestivum
  Clone ID: PAT_TA_6442.pep
MVMATATAISGRVSGEASAILAPSASSLPAPVRRAANSKGCFRAFPRVASSKLMLTPGRLCIERQSCPRISSACSALSRRDFSPVTQDMEGFLHSIVNMGFLDRLKLAWKIIFPAPTIHENTNASIAKQRLKMILFSDRCEVSDEAKKKIVENVVEALSEFVEIESRDNVQVDISTDAGLGTVYSVAVPVRRVKPEYQESEEQHRGKIVGVDFKDTGESSGNVDVTFDFYVPNVNH

SEQ ID NO: 112025 - protein, 88 aa, Triticum aestivum
  Clone ID: PAT_TA_6443.pep
LIDPTIIATRRLPYHEVIFFPHVHAKATHGQCKRKWPQIMSRIISTYISCLVILIALSAERKEKGLFLLAVEGPASDKWARLYCCPTQ

SEQ ID NO: 112026 - protein, 114 aa, Triticum aestivum
  unsure (1)..(114): unsure at all Xaa locations
  Clone ID: PAT_TA_6444.pep
KHEADGPDQEGEEEKTADHAQQLINNGSNVNKEGDFVNILECAIHATENRVPSPCGEVAPRCTSTVNKCGXSLLCEAQXASDPLGDVPKSARNEESVKSSDSIKDGAGNPKNLQ

SEQ ID NO: 112027 - protein, 198 aa, Triticum aestivum
  Clone ID: PAT_TA_6445.pep
MKVQQDATSREINPTAGSCAVSRRGDSSSRGCSVATARSVALCLGWQLDESRGAPCSPSSLIHSARPKPMAAGIAALVERLSVVSAAAIPLRARLLEQRRIGDRSAPPPSESSLLKKRRRLPSISPATLARRNHHTTTRGGPSPPPSSTWSRSEIRLPLAAREPLPPRRTQTSVSAPRHCATCGNRRQCLAGEKGRGG

SEQ ID NO: 112028 - protein, 286 aa, Triticum aestivum
  Clone ID: PAT_TA_6446.pep
SLSSELLSQPQQWQLLLLLALVSLVLLTRRLSNKGLKLPPGPARAPILGNLHQLGVLPHRSLRDLARKHGPVMQLQLGTVRTVVVSSAEAAREVMKTHDEDCCTRPVSPGMKRLSYGLKNVGFAPYGTYWHVMRKFFVVELFGVRHVEAAWHARQHQVEKLMSTLSGLAGEPVALKEHILSLADGIIGMLGFGDMYNSDKFPHHKNLEHVLEEAIHVQASFSAEDYFPNIIGRLIDRITGLTARRERIFKHLDAFFEIIIEQHLDPRRVKPQNGGGDLVDRLVDLW

SEQ ID NO: 112029 - protein, 280 aa, Triticum aestivum
  Clone ID: PAT_TA_6447.pep
RNPPRINEFPLPCCPAGARGHHRPSTEASAPPRPDPSGGMTGAASQAYGEAWYWDERYRKESGPFDWYQKYPALAPLLRLYVRPHQRLLLVGCGNSVFGENMVQDGYQDVVNIDISSVVIEQMKKKYHDKPQLKYTKMDVRNMSDFESGSFDAVIDKGTLDSIMCGQNSQEHAAKMLGEVNRILNDKGVYIMITYGDPSYRLNLLKDLQFWTVKLHVIDRWERSSKKTWDLTEPLPLQDDSTSIINLLGPKPDVHYIYVCIKDNDSARVDLKAEVNEADK

SEQ ID NO: 112030 - protein, 141 aa, Triticum aestivum
  Clone ID: PAT_TA_6448.pep
SSTLSSSSPPSLAARRPPSYSVYSSGTSPPSMGATSFRTNASTSSSSTCSSSAGHPHPRRGPPPPTAAPARPHRARGSTPLSSNSCSSSSTPSSSNSCSMSSFASGKPMITWPWRDLYARLCFLRGVNFGTWTGASTRSYQ

SEQ ID NO: 112031 - protein, 93 aa, Triticum aestivum
  Clone ID: PAT_TA_6449.pep
NDMKAAVFKAMLHFIYTDELPPLEDIALAAGDGVMTTAGDMLAAACRFKLDRMKDKCETLFGQSVSKQNASSMLKLARHHHCVKLKDYCLKFE

SEQ ID NO: 112032 - protein, 220 aa, Triticum aestivum
  unsure (1)..(220): unsure at all Xaa locations
  Clone ID: PAT_TA_6450.pep
MSGWFGGKTDAKDDEAAKTGPSVQDRAIEAKDQTISFIGEKKEAATTAASXDTADAGHEDGDGDAMGNGVEEAGQAITDRAIGRARTRTFGLLQVRTTEGRQVRSGRRDKARRRQAGSPPKARNSCVXENAATFTGEPAAPXEPTGGMFKGARVQAMGAATSARDGVRNTLDMRAAKAKVRSAKRRPPCANEVYPTFRFVIPSVFLYFRSKKLISTHASV

SEQ ID NO: 112033 - protein, 127 aa, Triticum aestivum
  Clone ID: PAT_TA_6451.pep
NISNHVSALVALAVATPLEQSPEIKFIEKGISGEGTTTRYWDCCKPSCSWRGNVHTPSGVPVASCDRSGVNRVDDNAKSGCEGGGSAYMCNSQQPWAVNSTLAYGFGAASFSNGVDVSLCCACFLLS

SEQ ID NO: 112034 - protein, 152 aa, Triticum aestivum
  Clone ID: PAT_TA_6452.pep
PQNGSNILGSHRLDGQLKCAAQAANCKDVKCHADSHGEGAARNATPSPSALLARRRCPEQSRSRPELVWRGSDPAGKGAPVKEGAPSAGREPCRDLSWSPWSRARGGGHRRELLEAGRPSLHGGASRREREQVGLMPVCGRGGRGGRRRRRP

SEQ ID NO: 112035 - protein, 164 aa, Triticum aestivum
  Clone ID: PAT_TA_6453.pep
MEATAPDYYARDKKGSDLFVVDDLLALPCDDEEEEEEGVGDAPFLPANAASAAAVVVKQEAGFGNASADSSTVTALDSCSNSFSGLADGDFSGGLCEPYDQLAELEWLSNYMGEGEESFATEDLHKLQLISGIPSGGFPSANGPPAPAATAATAQPGMFLPEGP

SEQ ID NO: 112036 - protein, 175 aa, Triticum aestivum
  unsure (1)..(175): unsure at all Xaa locations
  Clone ID: PAT_TA_6454.pep
RPRATCVAFLTLHAVCGNITWALQALKSLTLEFSAQSKLPEWVGELTSLEKLEIAXHDELEELLNNTRRLKQLQSLTLQECCSLRQLPLWCXRELTSLKKLVILNCSAIMTLPNSIQQLTNLQELAIYFRTNLKQWREAEENKTKLAHIEQKGMHPAMYVFLLTLHLERIPSSVV

SEQ ID NO: 112037 - protein, 122 aa, Triticum aestivum
  Clone ID: PAT_TA_6455.pep
RHEGGMVLSGFDLVLGGAVVAVGGADSAARCSVAVGGIGGVVSSLGSSVPGNTGAKSTATASCSTTATTALLHLTGYGVTAPSSRLWRRHGLHFFHFGGRSSIPNRRTSRATSLVVLGVRFP

SEQ ID NO: 112038 - protein, 529 aa, Triticum aestivum
  unsure (1)..(529): unsure at all Xaa locations
  Clone ID: PAT_TA_6456.pep
SARGPFQSLKLTTKEPAAVAAHTPRRTSKVAQEGGEILELENAEVEEEVVKEEARTNGNHDSEADRAGLAKDEGRSSAGEEPHRESKSSEASSMVHHVHVVEKSVVEEHSDAAAVPGKAYNDDIEVARGCRSQFEHAANSAANVSKVLEVGKMPYHHKTSGLKVSSSMIICGRPSVGEEFLQFVEDKATEHGNLSXTLQKLYMWEEKLLEELKTEEKMRVLYDKKCEELKVLYERGAEAHKLEDSETYIRKLSTKISVAIQVVNTISKKINKLRDEELWPQTNELIQGLMQMWHAMSECHKIQCHALAQAKSIDSTVAAPRFSEAHIDLIKHLELELLDLVASFAAWVNAQTSYIGTINDWLKKGIDYVPEVTDDGTPPFSPGRLGAPPIFIICNNWATGIARIPETGVVDAMQALASQVLHLWEKHXLEWRQGMMANGDMDRELXXMERDEAXXRKXLXXQNKXLVLVSNXXGVSLSXXXRAXXVIRPLKWXLQSCMNRFFEAMESFAAACANAYXXLHLARPAQEDS

SEQ ID NO: 112039 - protein, 132 aa, Triticum aestivum
  Clone ID: PAT_TA_6457.pep
MDASMAPTEGDVQPPLRILFFPFLLPGHLIPMADMAALFAARGVRCTILTTPLQASTIRSIVDRANTSLGSVDVVVVPFPDVGLPPSAESGTGLTSKDYKRQVPSDGGAAPGSPSRRFLSGHHAGVGALVSD

SEQ ID NO: 112040 - protein, 333 aa, Triticum aestivum
  Clone ID: PAT_TA_6458.pep
MGIGMSSGRQYFAGRTLPLLAVQMLLQYGPADASRPPLTAALVAANALVYFRPGAVDTHLPRLRHVMFNPHLIIKFGDLRRFFLSAFYHLSEGHFFMNMASLLRTGAKLETSTGSPEFACMVVSLLGLSQGFTLLLSKGLLSLGNDMAYYQYSAGFSGVLLGMNVVLNAREGDVVWHGVTVPAKYAALLELLLVHAFNPEAHLICNVGGILAGLAYLLLRHGPERLAPMFSGIADVVSQPARFAKKLLRPAAHIRGSSVRRHVAPAQEEVGQGMRWRCITCSCDNSRYTDVCEMCSTPHPDHAFSRRRHLQDDGNNELSVEEIRRRRLERFGG

SEQ ID NO: 112041 - protein, 289 aa, Triticum aestivum
  Clone ID: PAT_TA_6459.pep
SARGAGLLYGFLAPIMATFDAVGEGKENTFVHCFVDGTWSTITGSCTVVRDLKDMLFHSYFSIMDDLRLQTPPGGKPYEIRLLDIPGALLSAACGLILDVIMFTLIAIYKCPVMLFKGWKRLIQDLIGREGPFLETACVPFAGLAILLWPFAVLGAVLASILSSIPLGLFGAVVAYQESSVVMGLSYAVSSVSIFDEYTNDVLDMAPGSCFPRLKYRKQKNEDSSHGGQLSKPGSFDKENQEGKKPLNRVTSFKNSMDEFNPFKMLDHLFAECKRQGEVLVNEGVITMK

SEQ ID NO: 112042 - protein, 86 aa, Triticum aestivum
  Clone ID: PAT_TA_6460.pep
AQCFQHMYTAMTQHPDVLITGPSLLPAWISNRAKEASKRCSIELLSWSSHKGMVHYTILGGVWIEAYQAGLYSGRDLSLRPPKSDA

SEQ ID NO: 112043 - protein, 175 aa, Triticum aestivum
  Clone ID: PAT_TA_6461.pep
MKALRRSSTSSSSSSSSSPRTPSSPPPSSSRIHRRSLLLVASSASSLAALGKSAAAASASASPLLAADSSSLSPPDSDRGAIKSPWSRRKRKQALSCQNWSRLFSVNGKFRDGGRKFLKKVRSGGIEPGIRAEVWPFLLGVYDLNSSEEERNIIKTKKRNEYKKLRRKCHQILNC

SEQ ID NO: 112044 - protein, 304 aa, Triticum aestivum
  Clone ID: PAT_TA_6462.pep
RGENAAAAGAGAAGGAAAAAEPGGLGGGRGTVDEASMERSKSFVKALQELKNLRPQLYSASEYCEKSYLNTHQKQMVLDNLKDYAVRAVVNAVDHLGTVAYKLTDLFEQQASEISTFELKLARLNQQVFTCQIYVDKEGSRQQQMMGASMKHHKHYILPSTGYKRTQAVAHLGTDTNQESQPRPYPSAKTLSWHLASDNSPSANRAHKPTFILDDTIPSKLASDGPHLLGKELPASPVRRPLQLNRNIKSDVAQKVGAKDLSAFSSFDRPTGREIQKAPASTKSVLASLFIKHKSAKMKSISAR

SEQ ID NO: 112045 - protein, 93 aa, Triticum aestivum
  unsure (1)..(93): unsure at all Xaa locations
  Clone ID: PAT_TA_6463.pep
NDHRASSDPRAIKADSRLLCSRVIGPRSYSPASQKRCNHSAQPLDLMIWILGVVVSTPAAGEGDGKERDRDFSTKRRGXIEGQQVPXAXFLXX

SEQ ID NO: 112046 - protein, 127 aa, Triticum aestivum
  unsure (1)..(127): unsure at all Xaa locations
  Clone ID: PAT_TA_6464.pep
MVAVSWPPAGGQLDLRGTRLPAWPTSSPSRHSARHSLAAVGPACGAQVGSRATATSSPDLSFRPTATPTPAPSIHRPLPPXRLTPRGPPVASPGPESRAAPGASPAWPAARSALPARASPWLPRLLC

SEQ ID NO: 112047 - protein, 40 aa, Triticum aestivum
  Clone ID: PAT_TA_6465.pep
LPIALAVLSEHKRAQLVKHIIVVSVLARDHVLNLQTFICL

SEQ ID NO: 112048 - protein, 611 aa, Triticum aestivum
  unsure (1)..(611): unsure at all Xaa locations
  Clone ID: PAT_TA_6466.pep
MDFMKAFDQTVREIKREVNLKVLKVPELEQKVLDATSDEPWGPHGSALSELAQATKKYSECQMVMGVLWARLGERDANWRHVYKALTIIEYLIANGSDRAVDDILDHYSKISVLSSFEFVEPNGKDSGINVRKKVETLVGIINDKERIKAVREKAASNRDKYVGLSSTGSYRSSSASGGSNYSSGERYGSFGGTREADSFSNSYRDKEPVKTSSSNTGRRRSGSKIRKDADHDRSSSKSPSNTKGNEDEFDDFDPRGSSSNGAANTKTAEVDLLGPNLMDDFLDEPAATPSAKSAVEPQVDLFADADFQSAIPGAETTAHQDVQETVDLFSGNATFASAFPPQTGFIPPPTSGTPSNANTSVSKNTVPEPFDPFGDIPLSSFGGSDPFGDFSSSSAPPPPVHSSTGNISTSSQNLEAASDFGAFESNTVDTAKDPFDFSSTGNFGKADVAPLAAPKTDASDFGAFVANTVEATKDPFDLSSSINGRADQTPLAAPKPNTKKENFQVKSGIWADSLSRGLIDLNITGPKKVNLADVGVVGGLSDGFDDKAQPSWNMGAGGSGQPSWNMGAGGXWPRNVWNSSVYARRWHRELGKLQQVSVWWLQMSSIGEHF

SEQ ID NO: 112049 - protein, 329 aa, Triticum aestivum
  Clone ID: PAT_TA_6467.pep
EYWLTLDLLASSSAAPCGPAARVADSRDADVIFVPFFASLSYNRHSKAVPPEKVSRDMYLQEKLVRYLVAQPEWKRSGGADHVVVAHHPNSLLHARSALFPTVFVLSDFGRYHPRVASLEKDLIAPYRHMAKTFVNDTAGFDDRPTLLYFRGAIYRKEGGNIRQELYNMLKDENDVFFSFGSVQDHGVSKASQGMHSSKFCLNIAGDTPSSNRLFDAIVSHCVPVIISDDIELPYEDILDYSKFSIFVRSSDAIKKGYLMRLIKGINKHRWTRMWKRLKEVDKHFEYQFPSHKDDAVQMIWQALARKVPSIRLKAHRFRRSSRSERGSK

SEQ ID NO: 112050 - protein, 159 aa, Triticum aestivum
  Clone ID: PAT_TA_6468.pep
QPPAPRVPPPRPSPRRRCRRPSPSSWPSPGGTRSSRGRVCLATFVALIFVHCALRWVLCSAFLALVSWRALPWLIFTFPPPPGPLTLFASTSLCSSPPSRKSTTAPAETLRQVAQMTLKRPLIGLALLLRVLPSRIHLIMLRWGVWWVWKDLRGNGLVQ

SEQ ID NO: 112051 - protein, 55 aa, Triticum aestivum
  Clone ID: PAT_TA_6469.pep
RNSRGQFAAEEISSMELVKMRETAEAYLGTTVKDAVITVPVYFNDSQRPLLQKQL

SEQ ID NO: 112052 - protein, 98 aa, Triticum aestivum
  Clone ID: PAT_TA_6470.pep
SRARLEMASCLESAKEACIKFSKQKCNAPFRDARIASEGLLENTDFAVWDAGRNKTASASLSVANSRCSSNPGLGGTSYKGSDLLDSLATEGNSNSGR

SEQ ID NO: 112053 - protein, 221 aa, Triticum aestivum
  Clone ID: PAT_TA_6471.pep
RHEGQTLTPLMSSQFPELGMNPYHCNEMPWIKSIPFIHLGKEASLVDLLNRNNTFKPFAEYKSDYVYQPFPKPVWEQIFGWLTKPGGGMMIMDPYGATISATPEAATPFPHRQGVLFNIQYVNYWFAEAAAAAPLQWSKDMYNFMEPYVSKNPRQAYANYRDIDLGRNEVVNDISTYSSGKVWGEKYFKGNFQRLAITKGKVDPQDYFRNEQSIPPLIEKY

SEQ ID NO: 112054 - protein, 272 aa, Triticum aestivum
  Clone ID: PAT_TA_6472.pep
ARRRAWGSPSPPPPAGATRRTPPASPSPRPGQPTQELILFDISTPAQTDSYLVPPDLFVYTAAGSSPSVQRLPPCTERGKKPFLMDNLATGILRLKAEDRYIVADLNVYSEEAGLRAELCVFDSYLNKWEITPKIAFDDHINGGQFTNLWSTHHVFAFAGRFLCWIDYFSGVLLCDFSMTDSPVLRFVPFPGEKEYHDKVRVENYLPERFRSVSISQGKMRFVHIDNDFHDRLHDPSQWIQLPERKSHEQHQPPQKITIWTLNSQVRVGPTS

SEQ ID NO: 112055 - protein, 210 aa, Triticum aestivum
  unsure (1)..(210): unsure at all Xaa locations
  Clone ID: PAT_TA_6473.pep
TRXRTRRHHRHGRPCRRAPRRPRRQGACPKASSASDASTTRIGSSRAPLHRGDRAHLQPLLATVRRVDPRISDSPRPRRALPKIRLDPEADDALVIDYVDDDTSSFSAELPVTRDPMAAAAAAPVMKPATINTNTIAPCCPSGGRVTSASTTTPICTTVLPTEKVTSISVRASAAWMMTPSSGECSTMGLMTTLIERDRPNTRLPRVTAK

SEQ ID NO: 112056 - protein, 340 aa, Triticum aestivum
  unsure (1)..(340): unsure at all Xaa locations
  Clone ID: PAT_TA_6474.pep
GKTRXELVAASGDEEEENPEEVENETQEDPEEAGMEALKEKKGEEVKVEVPADEKIAEEAGKSEPRVRTKATGXSXKEGEKGALGQVEAHLFLQMVAAFGLKDKFDGEFLKSLFVANRRRKELARFAFILGFEETVADVVQELVTSGNVIEAIYIAHEACLLERFPPAPLLNSYIKDSTEKAQAILSSGRRSSSSVEESKTLECNACKAIIRCVESCQLVSVFNIDHLKKKVARMDREKADRKRLGSGNRFQNKRARGAAGPQSFPASKSARASGSGPGYGPSFQNPVSRSFGYAARAGYVNPAAAAQPYYAPGSMAARRGGVLYGGPGAAFGAQQPYHR

SEQ ID NO: 112057 - protein, 385 aa, Triticum aestivum
  unsure (1)..(385): unsure at all Xaa locations
  Clone ID: PAT_TA_6475.pep
MLLSADGEDPDADGLLLLDPSPPGGADDFLHSDAGDKSDYDWLLTPPGTPLFPSHEAAPKRSPVSQTGSPKTRQNSLKSRLANHPDPPSRTTHPLRTTSSNSLNSAATTRRPTSSGGPTSNSSRPSTPTGRAASTAASKGSRPSSSTPTSRSTLPSTRSALPSSRSTTPSRTSGPATATRTSXLLLLPXTSGPAAATRTSGPATATRTSVPSGRASAPASRSSTPTSRSSMPATRSTTPLSRPSLPAQSKPASRSSTPTRRSSAPPTHAQHSNLPGPVRSSSISRPGPTMPKSSALPATTTAPAPSRGSSPTVKSRPWKPSEMPGFSLDAPPNLRTSLPERPTSATRGRPGAPSSRSSSVEPGPAARPKRQSCSPSRGRTSNGSV

SEQ ID NO: 112058 - protein, 102 aa, Triticum aestivum
  unsure (1)..(102): unsure at all Xaa locations
  Clone ID: PAT_TA_6476.pep
AELDGVRLALPAATRXLCGRWLCAKTTLERRHQFCTLACNLTTVSSLRAPVPSDLDLFSFYELLGQCKIIGISFLQLAVGEYIPNKQLMFVTPRRQYYLERE

SEQ ID NO: 112059 - protein, 170 aa, Triticum aestivum
  Clone ID: PAT_TA_6477.pep
GYGCEKTTGIDGPAPENLHGQDLICTDEHGLVPCTESSDFNASEECEEAPIALSCGAPSTFDEKLDSVLSQPYDQNEYKELMRKATDQKPVSRQRQLRSGSKRYATGFVGLSYLDHYPDLAKQIDTADTNERRLNLLRKFFFWLENLCHDGAHMPWIPKALACNPIATDD

SEQ ID NO: 112060 - protein, 144 aa, Triticum aestivum
  Clone ID: PAT_TA_6478.pep
GPDNLEPPPSTPPNTATPPQATATSTPPNPATPNPPASNPTMSSPNPNPVPAPAPAPPVVLPPLPPAPVSFAPSFRPLGAPPPPQVQQYGAIRNPGYLMGQPMQPPGVHHVMRPPTMYAPQPGPYMQQGRRRSSRCAVILDHTL

SEQ ID NO: 112061 - protein, 295 aa, Triticum aestivum
  unsure (1)..(295): unsure at all Xaa locations
  Clone ID: PAT_TA_6479.pep
LQIRHEAGTNSTPATAPPSRXITSIPPMRYTYPTPGETVEDKTAETLQIVSLKIVSINDDSLRWPLQVFGMVAVRDILDHKRNIIFQRQRNNCQIINKNDPYLALTGPSRAVAVSMEPSHIEVSLKVKGTTKSDDKDLSELVLNFRSGCVLSDVYPSRISTIEFKYGHIMCAVEATIRIKVTGGSWPDGFRGMFTAYNTGADDLKVKLLDFGDGGLPVGADGMVKLSRSVVSVDLEEMLKVSAMAYPINDDEVADSSEVALKPEMAGITPPGFVLTVGSCSMEVSVAWSLFRRGF

SEQ ID NO: 112062 - protein, 117 aa, Triticum aestivum
  unsure (1)..(117): unsure at all Xaa locations
  Clone ID: PAT_TA_6480.pep
ASSNESKDVPIAGIDNMTSSFLSISAHRQFQCCFLVRLHLPLVRSFPHPIPSCPATRSFRTHLLYGRTSVCLCFVGRICCNHGILGLHLEDRTTPSSRHGKAPIDXRGRRGQIAGAA

SEQ ID NO: 112063 - protein, 135 aa, Triticum aestivum
  Clone ID: PAT_TA_6481.pep
PYLLNLSLNYRLKQRPSPASMHPSDPAGHTVNPLLISFPGLDGISPASKAAVSFALLLDRIKVWSRSVAPRRIRLDLSLICSHSLPLKRPNSWPPPGFEFLCPDGFASVDAAVSPAIAAKIALAIVGGFPRFFFC

SEQ ID NO: 112064 - protein, 323 aa, Triticum aestivum
  unsure (1)..(323): unsure at all Xaa locations
  Clone ID: PAT_TA_6482.pep
MVKAIRVHELGGPEALRWEEVEVGEPGDGEIRIRNTAIGVNFIDVYFRKGVYPAPLPFTPGMEAVGVVTAVXGPGLTGRKVGDVVAYAGKPMGSYAEEQIIPADVAVPVPPSVNHKTAAAIMLKGMTVHMLVRRIFKVETGHTVLVHAAAGGVGSLLCQWANALGATVIGTVSNEEKASHAHFDGCHHVIIYTKEDVATRVKEITGGKGVNVVYDSVGKDTHKASLERLANRGSRVTCGQXSPAPERISTCQVAAKCLSRTRPRVLYWPGTRCELPXATGDVSAKLANRTRHSRLHHTSPAARRRRPAGPRSWSRGTQHAPYC

SEQ ID NO: 112065 - protein, 150 aa, Triticum aestivum
  Clone ID: PAT_TA_6483.pep
ATTYRVHVQSELPSPSQVTTLPSLKNSLYYYLFSISKTQSVPYVPSLAGTKLLLPLLSNTTANCTDNSTELHHSDTGVVLVPRPRAGGTACNEVASCMFRGHRTAPLGRRRGHVLLVGTARIAHHDQRAARLRRCLSSYFFARLAGVVPQ

SEQ ID NO: 112066 - protein, 197 aa, Triticum aestivum
  unsure (1)..(197): unsure at all Xaa locations
  Clone ID: PAT_TA_6484.pep
MVLQAKMIVYSSKSSKGTLFPVRSMLVFFIALFGFYVCYFSFTQIALENEEGEMNGAEERTSILCKRPSEIPYDQMQYVHFPRPMSYDRGECACTPVRFFVIVSMQRSGSGXXFETLLNSHPNVSSNGEIFSVRERREDIASTLWTLDKLYDLDWRTSAAKNECTAAFGLKWMLNQGLMDYPDEIVDYLIKKGVMVI

SEQ ID NO: 112067 - protein, 280 aa, Triticum aestivum
  unsure (1)..(280): unsure at all Xaa locations
  Clone ID: PAT_TA_6485.pep
NSARGPPENPKQKKPLSSSAAAAASAAMDVMVKRGADQPKLARSLVMLLVNLTQVESGISALLQVGDEKVQGLYVAKLVRSFCRSSCDSEDEDIFEHIASILVNISKVEAGRRILMEPKRGLLKQIIGQFDSTNQLRKKGVAGTIRNCCFEADTQIQNXLLSIAEYXWPALLLPVAGKKIYSEEDRSKMPPELANALSHEREAVDDSEIRERALEAIYMIVMQDDGRKAFWSVNGPRILQVGYEDEEDLKVMGAYELIGSLLVGKGEIEQDQEQGEDKPQ

SEQ ID NO: 112068 - protein, 86 aa, Triticum aestivum
  Clone ID: PAT_TA_6486.pep
MVCTKCEKKLGKVIVPDKWKEGARNTDEGGGRKINETTLLTKKSRWTPYGNTKCIISKQQVHQDGNYCYTCAYSKGVCAMCQKAKC

SEQ ID NO: 112069 - protein, 137 aa, Triticum aestivum
  Clone ID: PAT_TA_6487.pep
IKEGFQARHGGRWVGVQLSRGNFPRRLFYMPLASLPSAIASPWRVRDEPSDTVVVSGAGEGVKEESFANVEPRRTSTAQNGSGRQHRRPIEARLSDRQNGAEERARGGAKVVGQLGVVWHRRGGERDGGGGSDTVEA

SEQ ID NO: 112070 - protein, 68 aa, Triticum aestivum
  unsure (1)..(68): unsure at all Xaa locations
  Clone ID: PAT_TA_6488.pep
TIIPPCTEWISLSYKSRLHPXRGTYVEITHFGQLKTTRKEKMSPLFPSEPRRRRRPAATAAAXRDRES

SEQ ID NO: 112071 - protein, 54 aa, Triticum aestivum
  Clone ID: PAT_TA_6489.pep
QASNHSTKPSSLVLQVSCMWEDRPGTNVTLICIKTGRSGRLLIILYGCYCEPIG

SEQ ID NO: 112072 - protein, 43 aa, Triticum aestivum
  Clone ID: PAT_TA_6490.pep
SRYIAIQNGNPKNPTSDFRHGKSKVFMPIYVVAGIAIFYSLRS

SEQ ID NO: 112073 - protein, 127 aa, Triticum aestivum
  Clone ID: PAT_TA_6491.pep
PISDSQKRKEKVVTWISSPLCELLSQDCVAKFLQVIRHERKRIRASVHLTILGGQDESEDDRAWQLSTNGSNTPSQSFGCSKTHLPRSITGITPSSASTGGWPLFVKRNRATSFRSSHDRCATRTPS

SEQ ID NO: 112074 - protein, 219 aa, Triticum aestivum
  Clone ID: PAT_TA_6492.pep
TTVLVTLNNPLQVELVHAQLKRAKERVDMPDDEFYNDLLSLYNKTYDPSAELAILERLSEKLHLMTITDLTQESLALHEMVASGGGQDPGEHIEKLSMLLKKIKDFVQTNNPEMGPPMASKIMDTSGDQKSVIVPDEFRCPISLELMKDPVIVATGQTYERSCIEKWLASGHHTCPTTQQRMANTTLTPNYVLRSLISQWCETNGIEAPKRSSQPNKPM

SEQ ID NO: 112075 - protein, 117 aa, Triticum aestivum
  Clone ID: PAT_TA_6493.pep
MSVQEYLEKHLLPRKIEEAVNAAVRAKAADPVLFISTHMRRAAPAVITRVCARQILDSRGAPAVEVDLHTNKAVHRASAAGPGAPEGAAVDATRDVEKRRLLAKAVADSVRLINGKV

SEQ ID NO: 112076 - protein, 132 aa, Triticum aestivum
  Clone ID: PAT_TA_6494.pep
ARGFTPRKDIKNHAEPISREPELVFNNFEAHLGYRLQRLISSLFPQADFNKRQVFTFELKQQHILFRNHSIENSEDQNSVVQVCIVNANLWSYEMALRARNYIDPLHDEARLRNTRKWEWVWFYTLPRTVGG

SEQ ID NO: 112077 - protein, 85 aa, Triticum aestivum
  Clone ID: PAT_TA_6495.pep
PRVRPRGRPRVEWNPEEYLGPAALLHANRWIQDSRDEFTKERLDSINDEFKLYRCHTIKNCTHACPKGLNPAKQIDTIKKLQLGA

SEQ ID NO: 112078 - protein, 285 aa, Triticum aestivum
  unsure (1)..(285): unsure at all Xaa locations
  Clone ID: PAT_TA_6496.pep
MAAAALLRRSPAARALLSPALSSRLVASKPHSSSPAPPPPSSKPASTKTFSIYRWDPXDSPSTKPHLKDYKVXLSDCGPMVLDALLKIKNEQDPSLTFXRRSCREGICGSCAMNIDGDNGLACLTKISSXAAGASTISPLPHMFVVKDLVVDMTNFYNQYKSVEPWLKRKDPPSAGGKEIYQSKADRAKLDGMYECILCACCSTXSCPSYWWNPXEEYLGPAALLHANRWIQDSRDEFTKERLDSINDEFKLYRCHTIKNCTHACPKGLNPAKQIDTIKKLQLGA

SEQ ID NO: 112079 - protein, 238 aa, Triticum aestivum
  unsure (1)..(238): unsure at all Xaa locations
  Clone ID: PAT_TA_6497.pep
FWTFAFPGTLPLSLPRCGALSWTGPEPNLSSDPGVPSILPIEGNYSRGNLMLQRIKSYIACLEPSREQLPAVACPRHFVFTDSDMAVVEDLGHIFTSYPNWHLALTFRNNKGQPLNSGFIAVRGARDGISKAIEFFTEVLKAYNLKYMKASRXLXINXHCMGXEAYLSSAFGKFLGMKHYWXSNGASVLXLXWEVYNWTHLXGAGQFMGCLGCXGGHLKGQKAFDLEAWDXTNSFNGL

SEQ ID NO: 112080 - protein, 455 aa, Triticum aestivum
  Clone ID: PAT_TA_6498.pep
TRPIHLNLARFPARRWPASVASTGHLRVYGPALPHEGTLSWEEREQDTSLLLLRIGHHRDEASRLLASHPDLLRFLDAATCVGLLDPVSNIVVSAMLAAAADPVGGASALVGVADMDMKQRSLDGLVAFLTCFFPHLTDWEAVRYLVLAEADPLVAARIVLAARRTKCFRPGSAATNGALRLALKCATVAAKHPCPSELAGALCSSQDSNDVVVALLSALQHNQSSDISHKLVKQIASLPFPAPGSSNLLEPWELAARRRKHTTKVTHQYSWSLRRVLLHTIHGFYLQALARMPGGELRSRYHRSMLKAGHCYGPFDPVTNIIVNTIWYEVTFPPLSQLDELDILGTLNLMRIEAQSFYGLVSFLCTRDKDLNSDQAIRFLLDTDLDLAATKHCSTVQDEQEAFRAAATAAWHPIPDAPVAFLKLLPRRLQSSHCSDNGGQQQALLQMCPAPCHA

SEQ ID NO: 112081 - protein, 197 aa, Triticum aestivum
  unsure (1)..(197): unsure at all Xaa locations
  Clone ID: PAT_TA_6499.pep
RQLPRPPPRSPRPPPPPLSPPPPPSAAXPAERIAAGGAEVGLLRPRPRSSGRRPXHSPPPAPQVPGAGGVRARRPPAGLGAPCVASWLSVLAGASLVCLSSDFRSPFGRPTGGAGMRVVQAAQLVCPNHHASRPGSVLAESPAACLLRRRAFALADQDLLLVLGSPAADSLLLFLLLVMCWHLLRSTIIYQLISGLH

SEQ ID NO: 112082 - protein, 142 aa, Triticum aestivum
  unsure (1)..(142): unsure at all Xaa locations
  Clone ID: PAT_TA_6500.pep
SARGLSRICVDVRRRPPPXISSYHPPPPGCHPLRVDPVLSEVPPGRRNTGLSRQRLEEQNWGEDSQHQDKLVAPHLTNSSRARWRQRIRAPAQFMVWRGSPINRCHPPSPLPKPTPQAPMWTTPLMPLSCHPLPFLLPMAFR

SEQ ID NO: 112083 - protein, 59 aa, Triticum aestivum
  Clone ID: PAT_TA_6501.pep
WLQSLHKTEEEHGNLKLNTSCWLVITYPSGLAVERIPRHIWVVHRYRLLALRLRQITYF

SEQ ID NO: 112084 - protein, 124 aa, Triticum aestivum
  Clone ID: PAT_TA_6502.pep
KIYGHKDHIHIPNMLYEQQLILDVSQDSMHEPNHISHPTFTLNKYKEESKQHIDARKPIFREPTQFVRTRGRTRGATGAAWGSGDDGNSSWFGWWIEKTGGGGSIQGRLWEMRRAGAGVGVEAA

SEQ ID NO: 112085 - protein, 161 aa, Triticum aestivum
  Clone ID: PAT_TA_6503.pep
PASAFRSEASPPISRCFYTHTGAGAPHLPNPSLDRPASSSLLYQPSEPRAVSVISTSPSRPCRWRFHRDVHDDGRLRDPSEVSDEFGGDLRKPPGDFSSVQSTQSTLAPASLFTMATALAGCAWPSVPSKLYAPFTLRCLWCAPAMSEKTLLGHGEWCEME

SEQ ID NO: 112086 - protein, 88 aa, Triticum aestivum
  Clone ID: PAT_TA_6504.pep
ILKCPYLRRCVFCELKGSISSIHPRYGHFSIYLIHPRVLLQQRGGSAGARGSSGKRRGRTPPKVGTAGGEDWRRGDGRGPEQGDAGRG

SEQ ID NO: 112087 - protein, 122 aa, Triticum aestivum
  Clone ID: PAT_TA_6505.pep
MNKGKIFKLAKGFRGRAKNCIRIARERVEKALQYSYRDRRNKKRDMRSLWIERINAGTRLHGVNYGNFMHGLMKENVQLNRKVLSELSMHEPYSFKALVDVSRTAFPGNRPAAKKEGRASIL

SEQ ID NO: 112088 - protein, 81 aa, Triticum aestivum
  Clone ID: PAT_TA_6506.pep
KLNGAKPHILSTMTTRRSVARGAVGVVTIVSLCHTRTRQPSRRHGNEQNDLQYKEQKKHFHVAPRSHGKLKAVAPRGETGG

SEQ ID NO: 112089 - protein, 279 aa, Triticum aestivum
  unsure (1)..(279): unsure at all Xaa locations
  Clone ID: PAT_TA_6507.pep
LAKQIIEAKYQESSEGNDNPDLKESIFREVTSPILATAKRHEGYQTLWQICYDISDTVLLRNLMHDSIGPQGGFSFYVFKQLINSRSSAKLLRLGEEFQEELANFLKDRSDLLWLHEICLNQFSTASETLHTCALLSSPGEDADLTSTRKSLSFVERRRLLYLSKIAATAGKDVDYEVKVAQIDADIRILNLQEEIVQHDPEYAQGKHASKLLPPSELIEMCMKRGRELSLKAFEVFAWTGSSFRSSNXXLLXXCWTNAADQDDWVKLSXXSVSXXWSX

SEQ ID NO: 112090 - protein, 158 aa, Triticum aestivum
  Clone ID: PAT_TA_6508.pep
RSFDNYYFVKAKDEFVCFSTLPLKFDENDKVSGKGIYLRRYSADGAPAVYKQVVAWTVALNREQPKISVLSSEGYWIELDLLKPRKIYWKFARSALTTVQMLHFVKRQPRKPMISLSVHLREVFSKFETEEMEDALGKHHHIIKRCAERDPALMRSKV

SEQ ID NO: 112091 - protein, 118 aa, Triticum aestivum
  Clone ID: PAT_TA_6509.pep
MDFGTELKGCVCRINNCAIELFSMKEDLEIEDEDSWDLVGRDLRLKATFLYIDLSRVISSCESDERKKMLTGLANKFFYFMDELGNAVKDRSAPLVQVCYSDTTHVLREVVAALVPSH

SEQ ID NO: 112092 - protein, 198 aa, Triticum aestivum
  Clone ID: PAT_TA_6510.pep
LPRLEVMLWEALTGWANAWHQLKIDLHFFAQTRSISRVHPIPDLPRHRATNTIRFTGSTRYIPHHTHAYVARNRDDTWKMCRSLCCCLSVALPTGVLAPVTGHRRAREHRQPPLRQEDDARAGILSVRHACMADLGGGGLGDLPRQEDRSDPAPPELLEMEEAGAGRLTSRQRRAGRPRRGGRGGPGAGGSRPSGCCA

SEQ ID NO: 112093 - protein, 127 aa, Triticum aestivum
  Clone ID: PAT_TA_6511.pep
SVAEELSRPVTEDAAPTRRRGAVSWWLPRQWEQGRRRRGFRRSVQWCRTEPARRLVKLSIGGWGLPRAGLLLPTRRHKATAVPWRHYGWRRSLNRSIGRVKAIVDSGYGVSLWRFERIQAVIRPAKC

SEQ ID NO: 112094 - protein, 134 aa, Triticum aestivum
  Clone ID: PAT_TA_6512.pep
WRPWPSAWGQRPWRPPGLQRGRRGGALACRRRRAPGCRFPSPRRPVPQPRPSCRSAPTLAVDAFRRRTLVRPAHAPPTFLLLLVPTLHSQRRVSFRRRNRPRRTVYACDFFCNLNAHSRPMATYDCRWGMATPV

SEQ ID NO: 112095 - protein, 142 aa, Triticum aestivum
  unsure (1)..(142): unsure at all Xaa locations
  Clone ID: PAT_TA_6513.pep
CRFGTRRRCVEGLTLIERVIQSKSFQNFTYPYFSLEELLNITAEFPVNLLPRHDNDSKSLEQFCKDTVMTIWHYHGGCQVGRVVDAEYRVLGVDALRVIDGSTFXASPGTNPQATVMMLGRYMGVKMRDERVRAEGLRRRKL

SEQ ID NO: 112096 - protein, 146 aa, Triticum aestivum
  Clone ID: PAT_TA_6514.pep
DFKAIKHFRRAKCVSYATARSVWPPLTVSDRVHTVLHIQHSTWPDHGVPDDSSTVRKILKRLYYLPKEHPVVAHCSAGIGRTGAYITIHNTVERILRGEQAATNLVETVGKFRSQRPGMVQTEEQYKFCYHAIADELKDLIRNSKS

SEQ ID NO: 112097 - protein, 129 aa, Triticum aestivum
  unsure (1)..(129): unsure at all Xaa locations
  Clone ID: PAT_TA_6515.pep
QIRHEGRSLDITKFSSYYELRGELEHLFGLEGXLEDPVRSGWQLVFVDRENDILLVGDDPWQEFVNSVGCIKILSQQEVQQMVRGGGEGLLSSAPGARMAQGNVCDGYSGGHDLQNLTGNMASVPPLDY

SEQ ID NO: 112098 - protein, 188 aa, Triticum aestivum
  Clone ID: PAT_TA_6516.pep
MDRKTKMLIYAAAAQWFINMITLVVQSRKRKRREAITYAPIDERDRMRREYFDNKIWKNDTTCVNMLRLRREPFFRFCQLFRDRNLLKDTIHLTIEQQVAMFLHTVGHNIRNRVIGANFGRSGEVVSRYFQRVLHAIGELRDDLIRKPSLETQTKIEGNYRWDPYFKDCIGAIDGTHVRASVTPDMEA

SEQ ID NO: 112099 - protein, 288 aa, Triticum aestivum
  unsure (1)..(288): unsure at all Xaa locations
  Clone ID: PAT_TA_6517.pep
MAGRYDRNPFDEDDVNPFAGGGVPPASNSRMPPLPHEPAGFYNDRAATVDIPLGSSKDLKQKEKELQSKEAELNKRERELKRREEAAARAGIVIETKNWPPFMPIIHHDISNEIPIHLQRMQYLAFCSLLGLTLCLFWNIIATTAAWIKGAGVVIWLLAIIYFISGVPGAYVLWYRPLYNAMRTESALKFGWFFLLYLIHIIFCIWSAVGTFPFKGKSIAGFLPAIDVIGSNVIVGIFYFVGXFGLFCLEALLSIVVIXQQVYMYFRGSGKAAQMRQEAARGAMRSAF

SEQ ID NO: 112100 - protein, 314 aa, Triticum aestivum
  unsure (1)..(314): unsure at all Xaa locations
  Clone ID: PAT_TA_6518.pep
MLDSRGGGLLRSEIALILCGCEGRRRYCDAKVPIAEEQGVSTGHVYKRKRQKLVITRGKRPADIGSNEEEPVGDVNEADVTQDAEQKKKRRKVTENEGPRNRSSPTRLFKLNKDLVKDQKSIIRGIDFGGLLDITTTSMPGDLRQWIMKHYDPEKSQIVIPDRGKIPVDAESVRRIWGLPNSGRKVCFEMNPDVIREFNSIFKIEGKMPXTLTSWCKMIVKMNGASDDIFLHAWLAVAFSCFLAPTTSLSISPRCYTAILHTSAIKDTKICDFVIDQLRLAFMGFGDKKKVVCYCVFHLVVSMRKLISNMFSFP

SEQ ID NO: 112101 - protein, 173 aa, Triticum aestivum
  Clone ID: PAT_TA_6519.pep
DAWVRLLASLPRASSAGPRPPQPASSLPHLPLPSLFPLSLIPPQPLLLRSSALAPWMPSPRAHLGGSNAATGPPPARSGAWLPGSARPSPPLPDLAPHPPSHEAPRAVGRLLPHPGSIRAGGHRMPPNPISSPPAASSPFTAPEARAGRSTRRRPRGRQRMGRCAVLEKSGLE

SEQ ID NO: 112102 - protein, 214 aa, Triticum aestivum
  unsure (1)..(214): unsure at all Xaa locations
  Clone ID: PAT_TA_6520.pep
SPTKTTGSTTTAARRLPTRRRRSTGAVAPPSCATILLRREGGEAEAGEGEEPLQLVPPLNFAMVDQGVYRSGFPDASNLPFLETLRLRSVLCLCPEPYPEANQEFLRAHGIRLFQLGIDGSKEPFVSIPEDRIREALKVILDTRNHPVLIHCKRGKHRTGCVVGCLRKLXRWCLTSVFDEYQRFAAAKARVSDLRFIELFDVSSLKHLPASFSC

SEQ ID NO: 112103 - protein, 326 aa, Triticum aestivum
  Clone ID: PAT_TA_6521.pep
MARRRVLLYLKPFDVYPPRPLSGASSLTFPPPPPPPRAANPKILSYLDHRCRVHKDTINLCKSVLQRKPLDWISVQRNHLSNPIHDVDLVITVGGDGTLLRASHFLDSSIPILGVNSDPTCSDEVEELTEEFDARRSTGYLCAATARNFEQILDATLAGSRHYSELSRISVKLNGSQLPTYALNDILVSHPCPASVSRFSLRKRSNGETSCLINSRSSGLRVATATGSTAAMLSAGGFMMPISSRELQYMIREPISPTDADKPLLHGLVKQEQHMLVVWYNQEGAVYIDGSHVTYPIQHGDTLEISSDAPVLKVILPEYLLKQASL

SEQ ID NO: 112104 - protein, 193 aa, Triticum aestivum
  unsure (1)..(193): unsure at all Xaa locations
  Clone ID: PAT_TA_6522.pep
GEEEEEDGSEDRDEEEGLFKVSRLRTTDEPRTSDDLQAPDVWPPPDDRHYHTRAKTDGHPTPYGRPTPGRPDRTTDRRQPEPNLRTSDRHRTSGPSRASGRPVTSGRPTHVHRFMLGRSPCTPSPPSSALGLYILHLVQLSRVSKGLAHISCESFAHPLGYLLLGDSSLHRRRSPNRIQDPFREELKTSXRXK

SEQ ID NO: 112105 - protein, 63 aa, Triticum aestivum
  Clone ID: PAT_TA_6523.pep
WLQHDLELLCVPGIQLAALKMYCSILNPPVLFCVNKTFKACICATSALHVMMHTDFFIKKKKK

SEQ ID NO: 112106 - protein, 112 aa, Triticum aestivum
  Clone ID: PAT_TA_6524.pep
QNIAHEVRRSGRVWIYPWVQDYVHTLSTSNRVGFGAAHGRKSVSKPYPFGLDIHGYPCPWIKLPSLLLYHCRVLIKCMNSLEGVGNKSNYFLLIGAEGKCTSSLINLMQVRI

SEQ ID NO: 112107 - protein, 256 aa, Triticum aestivum
  unsure (1)..(256): unsure at all Xaa locations
  Clone ID: PAT_TA_6525.pep
ASSGPTRARRGVGRGTATATASERQGGGRRGRGKVAMRRIGSRIRRRASFANRRNGLPRKSSELSGRCDAEVAPIIFSTRGRLFQLCTSSYMYNTLVRCRSCNFNSQETATQETEQSNXLEYLKLKTRVEFLQTTQRNHLGEDLGPLNMKELEQLENQIEISLKHIRATKSQQSLDQLFELKRKEQQLQDVNKDLRKKIQETSVENVLQMSCQDVGPSGSSGHANQANQQEYFHHDCDPSLHIGYQRNFLDQLNKE

SEQ ID NO: 112108 - protein, 112 aa, Triticum aestivum
  Clone ID: PAT_TA_6526.pep
LGRPWKDHATVVYMLCTIDDIIHADGWVAWNKTNPKERVKGGVTPGHEGHLFFGEFANHGAGANVDHRVDWHGFHRLNEAQARLYAPGRFIQGGAWLPQTGVPHYLGLRDGE

SEQ ID NO: 112109 - protein, 227 aa, Triticum aestivum
  Clone ID: PAT_TA_6527.pep
MEFPEAFQRLVCNVALYLNGHNKVPDETASVQRLRVLEGLSVYLQSVEFLKGPARRKNLRRLGMVLIYYHCGRDWEANLKQAQSSVCELGKAGLESLHLYIDEEVVEIFEMDSWFSVPPYALRELVIEGKSVTRVPTWMASLDNLEKLHLRIYKMPEEEVKILGGLPSLRHLCIEWADFDYDGMFDDPPMEVVEAAVRKAMEDHPNRPTLVWTTEWDPLPSFLQLRS

SEQ ID NO: 112110 - protein, 203 aa, Triticum aestivum
  Clone ID: PAT_TA_6528.pep
MLQCVFLLSDSGEVMVEKQMTAHRVDRAICGWFWEYVLAHAAGDPSKVLQVVVSPTHYLFQVYRSGVTFLACTQVEMPPLMAIEFLSRVADVLTDYLGDINEDTIKDNFVIVYQILDEMMDNGFPLTTEPNILKELVAQPNMVSKMLNVMTGKSSTIGSKLPDATASFVPWRTTIVKDASNEVYVNIVEELDACVNREGVLVK

SEQ ID NO: 112111 - protein, 65 aa, Triticum aestivum
  Clone ID: PAT_TA_6529.pep
RRPVSLEEIKKAAAAGEVEGLKDFALIRQARLSVMPVAVEVWDWICEMGGGFVEDGKVEEDEAEG

SEQ ID NO: 112112 - protein, 231 aa, Triticum aestivum
  Clone ID: PAT_TA_6530.pep
MVLCPRPPPPSRLPRPAALLRPPAPGARGPAASPPPAAGHVTRPPLPGSLQLPLATWAGGRLAFGAKIATKCANENTRAEELNSRSDQAGELVEAVEDVTPQKRSAKIHDFCFGIPFGGLLFCMGLLGYFFSRSTVSLVLGVAPGLATLLLGTLSLNFWRSGRSSFLFILGQAAISAVLAWKYSHAYLLTNRILPWGFYASLSTAMACFYAYVLLAGGNPPPKKLAPAPSS

SEQ ID NO: 112113 - protein, 232 aa, Triticum aestivum
  Clone ID: PAT_TA_6531.pep
MSFPAPRGSISILAPMVKKVRWHCDLSGASVDFNLWAIQQLTLQTAEGQGHLPSLHIHATARFYISLDEEDIMTPEIEKHMVAEFSALELHLKTNGHVFGAFAFHLLGMNRICSAMQRLKVVLQRSEVEETCSPHCPCDSTDWRSQTISLAALEEVEIDGFGGDHHEIDFLKLIFTCAPLLKRVTVKLSNEASSSDNGCTNIYNIFKAHSSVELYVYPSSDYKSELISISLL

SEQ ID NO: 112114 - protein, 257 aa, Triticum aestivum
  Clone ID: PAT_TA_6532.pep
MAMASALPLLLGPRPIISPRPTATGRFLSSSAHLSTAPAPVEPLKGGGRLARLQTLHAASCCNSAPAAASGGVEAARAKGLQLVAWYLLSLDKHPVATKAVTSAVLTLAGDLICQLVIDKVPELDLKRTFVFTLLGLVLVGPTLHFWYLYLSKLVTISGTSGVISRLLLDQFIFSPVFIGVFMSLLVTLEGKPSLVVPKLKQEWFSSLIANWQLWIPFQFLNFYFVPQKLQVLAANFVALAWNVILSYKAHKKVIAE

SEQ ID NO: 112115 - protein, 280 aa, Triticum aestivum
  Clone ID: PAT_TA_6533.pep
HASGDDEISRGWGPKKLEAAPAVRDHGAVLGALTRALASTEAAYLDMTDQSMGSHPELAVTGACLLVALVRDDDVYVMNLGDGRATGQGPVGYPMIGLEALQLSIDHSTSIEEEVQRIKRDHPDDDQCIVNDRVSARFEVARPWGAGYLPQAKLNNGLLEMFRNEYIGDAPYISCIPSLCHHKLTSRDQFLVLSSDGLYQYLSNEEVVLHVENFMERFPEGDPAQSLIEELLSRAAKKAGMDFYELLDIPQGDRRKYHDDVTVMVVSLEGRIWKSSGTYV

SEQ ID NO: 112116 - protein, 152 aa, Triticum aestivum
  Clone ID: PAT_TA_6534.pep
MLHAKETLRKMYSVAKGYYCGGLAAPNPFPAAWDLRLSLNPSRKAPGFVNPCRARSYPHIAESSAGQEIVIALGSNVGDRISSFDRALRLMKDSGIKFPAPACLDAPAPEYVTDQPRFLNSAVRGTTKLGPHDLLKKLKEIERDIGRTAGIR

SEQ ID NO: 112117 - protein, 131 aa, Triticum aestivum
  Clone ID: PAT_TA_6535.pep
MFVKKLVEKASKKQHSGGTGGLRAEDVSPRLAFHYGVPADAALLAYDPLLHVLAVATRNGQIKLLGRDNTQALLQSPSPIRSKFLQFADGQGVLLSVNTQNQIEVWDIDTKRLCYLHPFEKQITAFTVLQK

SEQ ID NO: 112118 - protein, 188 aa, Triticum aestivum
  Clone ID: PAT_TA_6536.pep
ATRLKLRYLRAPPPPTRRSGRVASLPKQPDYRDKKAPRRGLPPDRVYATDEARDYAFTKAKELNNQLSSAHPSFIKPMTRSYATGHLLTIPQQFKKSYLPWFDEMIFLVDEEDGEFPMPYMAQHGAIGSGWNLFAIGHKLADGDCLVFQQVQRTKFKCLAGWKYMTEAKINGSLAVLKFNLLTWNEEW

SEQ ID NO: 112119 - protein, 89 aa, Triticum aestivum
  Clone ID: PAT_TA_6537.pep
RLGDRGRRFAWRFLDVLQGGFGILVVSCPGSVFIDRSRSVGRFVSCVVCYLGFCSNVIWVHLLFKCYLGVRLVSVKKYWSKSVLAFVWM

SEQ ID NO: 112120 - protein, 77 aa, Triticum aestivum
  Clone ID: PAT_TA_6538.pep
FFLLSVGYENSFWHQDKCAIDSTSNGSVSLSPLLAKNWFFYCIQDAKYPSKDNSNNSRRLFWIALMILSCSEGRCPL

SEQ ID NO: 112121 - protein, 141 aa, Triticum aestivum
  Clone ID: PAT_TA_6539.pep
MGSASKPSPTAAAPSRRKVALCLTLLTLQYGAQPLISKRCVGQGVIVTSLVLAIEFLKVICAVILLVAEGSLKAQFSNWSLVGSLTASGLPAAIYALQNSLLQISYKNLDSLTFSILNQTKLLFTAFFTYLILGQKQSPKQ

SEQ ID NO: 112122 - protein, 76 aa, Triticum aestivum
  unsure (1)..(76): unsure at all Xaa locations
  Clone ID: PAT_TA_6540.pep
PKLHSYTKESCYWESSRILPDFLIADFVNAVQILVQCVCISPSFNSIFSFVIIEEVLGCXLVSKAIITIQLICQKK

SEQ ID NO: 112123 - protein, 76 aa, Triticum aestivum
  Clone ID: PAT_TA_6541.pep
MSSTDATAPGGLFVEESKSWPEVVGKSIKEAREIILKDKPEADIVVVPAGAPVTLDLRPNRVRNFVDTVAETPFTG

SEQ ID NO: 112124 - protein, 140 aa, Triticum aestivum
  Clone ID: PAT_TA_6542.pep
VRAPSLPPPATGYAGLPWQLVGQSPHTTPSSPFPPSGVHQAPAHPPITSTAPVPTNPRLLLPRRSPSSRPSGVGTGRGRCCNRCHLKLESTGVAPASPGRCAGTAATSCYDGQTRCWNGPWRELQSAAFFATTVLLFCWN

SEQ ID NO: 112125 - protein, 219 aa, Triticum aestivum
  unsure (1)..(219): unsure at all Xaa locations
  Clone ID: PAT_TA_6543.pep
SRSTPHLRSRPLALAGRXGWPXSSVSGGGGGRPPLFATEKPKRVLAYRLYAGTIFAGILLIWFYRATHIPARGGSSLGWRAGLGLLVAELWFGLYWVLTLSVRWNPVRRATFKDRLSERYDDDQLPGVDIFVCTADPALEPPMLVISTVLSVMAYDYPPEKLNIYLSDDAGSAVTFYALHEASEFAKHWIPFCKNYKVEPMSPAAYFAEGATPHDACSP

SEQ ID NO: 112126 - protein, 151 aa, Triticum aestivum
  Clone ID: PAT_TA_6544.pep
MVEAKVILTTRPLRIVMSLPSMIIKLTLGLLWCIIHLAISLLSLCSHLIFNLECSLISSGLLWKYRNLQLGRLKYLAIVVDSREAKNTVKINQLLYWLKTLGVKYVCLYDIDGVLKKLFAPGMNGSRDNNPGDYLDASANIKALDWCQKQM

SEQ ID NO: 112127 - protein, 313 aa, Triticum aestivum
  unsure (1)..(313): unsure at all Xaa locations
  Clone ID: PAT_TA_6545.pep
MAATMTVEEVRKAQRAEGPATVLAIGTATPANCVYQADYPDYYFKITKSDHMADLKEKFKRMCDKSQIRKRYMHLTEEILQENPNMCAYMAPSLDARQDIVVVEVPKLGKAAAQKAIKEWGQPRSKITHLVFCTTSGVDMPGADYQLTKMLGLRPSVKRLMMYQQGCFAGGTVLRLAKDLAENNRGARVLVVCSEITAVTFRGPHESHLDTLVARARXMRPCSRGAWGAHPRGAGVPDLVQAKVHRPNARIGATGHVLSEYGNMSSACVPFIMDEMRKRPAEDGHATTGEGIDWGRLLGIGPGLTVESPVLHG

SEQ ID NO: 112128 - protein, 220 aa, Triticum aestivum
  unsure (1)..(220): unsure at all Xaa locations
  Clone ID: PAT_TA_6546.pep
KNLGEWTLKYEKLKEEHESFRDISDRMIEEKEREIAKLLNANKDLHHSLEAKAAVSKRDNQSPGYIKQDALSIELAEQQILLLARQQAQREEELSQSHRHILALQQEVEDLERENRLHDQQEAMLKAELRNMERSQKREGVDMTYLKNVILKLLETGXWGPCCLWLRCYYSSALTSSINANMASSQMSLPYQLQHCQMVDRHQTHSLEDSHSNTGARCWF

SEQ ID NO: 112129 - protein, 209 aa, Triticum aestivum
  Clone ID: PAT_TA_6547.pep
HLAGAKKLKQQPLHPCRLHHSPGDPPPSEERAQALKAPSVPHLAEAEPVAATSSPASPYTGVSVFIPAPPPLPGVPALPPLPGFPGMAGAPSPSPSQQLASCLGPLGRVITCAPYLTDSVPAPPSTCCDGFRSLVGSSARICLCHAIIGNLSTLARGEIDQLRLLVLPLTCSTIVPPDLLLMCILSPVPPIMPQHYGADVRERLGALGG

SEQ ID NO: 112130 - protein, 114 aa, Triticum aestivum
  Clone ID: PAT_TA_6548.pep
LLSNLSYMHNESKLNMQIHGIKIKSNIHPLILILLSSTQITHNHLPRLCSAKTTPPCLTLQLHHAAPSISTCMFFSGITPLVTYISPPSSQQLTLGMASHHPKHHRQLASHLSS

SEQ ID NO: 112131 - protein, 119 aa, Triticum aestivum
  Clone ID: PAT_TA_6549.pep
SNPRFGDKKTYQMNPANYREALIETAADEAEGADILLVKPGLPYLDIIRLLRDNSALPIAAYQVSGEYSMIKAGGVLKMVDEEKVMMESLLCLRRAGADIILTYFARQAANVLCGSKRP

SEQ ID NO: 112132 - protein, 305 aa, Triticum aestivum
  Clone ID: PAT_TA_6550.pep
MAAASSGRAEVDTSRAFRSVKEAVAVFGERILATEAQFRPGAHANHRVVRERSSWRDSVAIASSKEKLEGSSDLIKGSHSTNPNAIAVAIAKHEGNSSEPARIVMPVSNAQPMCLVPLSPRSQASSSPSLAHGDGYDKQDGKEANLMIMSSIKKVEEEAAKTRLEAVQVKRRLADLELAMANLKAKLHRALSRLAYMEADKAAAARANIQQRDINTSALTVWAEAKTERHPLRHLLSLDDADEEVKHGPEREMTTTTTKRKMQKQKPIMPLVVPLISEVLFSKKKRMNDKESLYLKELYSLLRLS

SEQ ID NO: 112133 - protein, 74 aa, Triticum aestivum
  Clone ID: PAT_TA_6551.pep
TGNMHNKLFSILTTSSTETRNRAPGNLATHYTETTHGGVRTLQAKLNFYLARKVGVQWNDVAAHRWLNRQRRPL

SEQ ID NO: 112134 - protein, 163 aa, Triticum aestivum
  Clone ID: PAT_TA_6552.pep
MAAAAHCARATMRSTAFQCAAATGYRTVKLARRKRRVSSEQKGIRRLDGPIQHRGLVSPRPSFRTLACTGRPSGDMDERWAHICSSALSAKQGDMMGQVQDDCPPSNLELGSAYPGGLSEKEIERRRKISAANKGKAPWTKGRKLTQEHRQRIKQGTIEALRD

SEQ ID NO: 112135 - protein, 218 aa, Triticum aestivum
  Clone ID: PAT_TA_6553.pep
MAAGTQQQTVEVRESVELTEEEERIFARLLDVVRHFGLGTQLRVAGGWVRDKLLGKGSADIDIALDNMTGQNFCERVNEYSKFMGEEQKGIGVIQCNPDQSKHLETARMLIYGIWIDFVNLRSEKYAENSRIPTVEIGTAKEDALRRDLTINSLFFNINTKSVEDLTGRGLEDLKKGLIDTPLPAKSTFLDDPLRGLRAIRVAARFSFTLAEDLKEAA

SEQ ID NO: 112136 - protein, 86 aa, Triticum aestivum
  Clone ID: PAT_TA_6554.pep
SSQHDSSPLSQRATPTLCRRWEHRSGRTTSIHRAPTPARESHISAVSAMTSASYNSSGRWKKRRREVMAGRKIWKERAMVPCAHLR

SEQ ID NO: 112137 - protein, 49 aa, Triticum aestivum
  Clone ID: PAT_TA_6555.pep
HCTVGTDIVCMTHRCSHVGSSTPPPLNYSIYISKPIHGSMSCQGRRRPF

SEQ ID NO: 112138 - protein, 110 aa, Triticum aestivum
  Clone ID: PAT_TA_6556.pep
HKMAMFTYVLIAALLFFPPSESFTPYPHQHHINFEIATGKFEELMASMDQIVSSNVALGALGATGRRALALKDRRLLGSTLVTFFTTLAVEVEAGRISLARSDIGEEASA

SEQ ID NO: 112139 - protein, 148 aa, Triticum aestivum
  Clone ID: PAT_TA_6557.pep
ERERERERERERERERERERERETHMLLLPAASSPHHGSPSASSPHHGSPRSLHLRYDLALPATLPVSPVSTLPPVSNLSDDASLPDAAPGRGGLERRGIEACSGCQAAAQPALGVPYDTRLKGLDDDRGTKGLTQDASKSHFKRSTG

SEQ ID NO: 112140 - protein, 83 aa, Triticum aestivum
  unsure (1)..(83): unsure at all Xaa locations
  Clone ID: PAT_TA_6558.pep
XKLLSLNSEEKEPTVMLGLAEYNNAVVVQTVAGHFMVQLVSLQFKKMSETSSWHFHQPFESVYTGETSIGGGGHNGAELLHNA

SEQ ID NO: 112141 - protein, 337 aa, Triticum aestivum
  Clone ID: PAT_TA_6559.pep
MSAATAALRPTEPFPLPSGLSLARRLKLLLSFSRADLSVSPVDEWQLKSALLAFLRNPPLSLSLLQDSDLSVSRLPDLQKRRRDDPVASGILYVRDLSFLRPSNRTGDDEAEKMTPEQEEKKYSQWRSSLIEKLDGIELNHKGVMYRMSAEIPASDDFMAMKKSWEDFYASELFSTRNPVRKIAKRPDTILVRGVPSRWFAETRISSKASTLVTHTIFSALGKIRTLNISNDDELDEKKDETNKGLISGLNCKVWVQFENYDDFHNAMKALCGRSLEKEGSRLKVNYDVTWDREGFFRNTQYEPAHNKLEEIDAPVHGRKKHYTSRIESDHRKRFRD

SEQ ID NO: 112142 - protein, 66 aa, Triticum aestivum
  unsure (1)..(66): unsure at all Xaa locations
  Clone ID: PAT_TA_6560.pep
FFLSVETISHHISFWCHXRNKHAVSCRSCMRYSYYVHYITRDHTRLSAYHQLIKYQHTHARTPIEP

SEQ ID NO: 112143 - protein, 136 aa, Triticum aestivum
  unsure (1)..(136): unsure at all Xaa locations
  Clone ID: PAT_TA_6561.pep
PLPLPVSPPPPIRPAPPRASPLHHSPPPPXMELSRPAFLPPSFLLRRSPPPPSLSSPXLPMSPCLHLRRPPPPRPSVPAAPLPPSLVGDVPAGRPVAPPGGALLELGVGCAPQPPPPASAPASRPKTTSITPSPPW

SEQ ID NO: 112144 - protein, 169 aa, Triticum aestivum
  unsure (1)..(169): unsure at all Xaa locations
  Clone ID: PAT_TA_6562.pep
GPXIGGHRLLDMRTQPQKLTRRCEVTAILVLYGLXPRLLTGSILAHELMHGWLRLKGYRNLSPEVEEGICQVMSYLWLESEILPASTRHAQPSTSYASSSSSSSYRPPSSKKGGISHTEKKLGEFFMHQIANDTSTAYGDGFRTAYKAVNKYGLRQTLNHIRLTGGFPV

SEQ ID NO: 112145 - protein, 187 aa, Triticum aestivum
  Clone ID: PAT_TA_6563.pep
DTTCLDPADRLTASSALRSDFFTTEPYACEPSSLPKYPPSKEMDAKRRDEEARRSRAAGGRPNGDGASKARTRDRPRGAAAPEANAELQVNIDKRRIASHANAKSKSEKFPPPHQDGAVGFPLGSSNQMDPLYEPPDPTSFSTVFSHEKSSVPTWSGPLVNSSAVGNQKRKHKSSRSSKQPSTARAR

SEQ ID NO: 112146 - protein, 56 aa, Triticum aestivum
  Clone ID: PAT_TA_6564.pep
IIYFIYFFSGQLVAALAVDIIINSLLNIYFFLKKYIGHSYYQSSSLREIATSVCHN

SEQ ID NO: 112147 - protein, 482 aa, Triticum aestivum
  Clone ID: PAT_TA_6565.pep
MGSRFPSHQLSNGLYVSGRPEQPKEKAPVVCSAAMPYTGGDIKKSGELGKMFDLHAEKSRKSGPLGNQPSRNTSFGGAASNSGPVSSAASRSNYSGSISAAVPGTGGSARAKSNSGPLNKHGEPTKRSSGPQSGGVTPMARQNSGHLPPILPTTGLITSGPISSGQLNSSGALRKVSGTLDSTVSMKMRATSSAYNPAVTNINEQNSYSIKASLPKPILWAAILLFAMGFIAGGFILAAVHNSILLVVVVVIFGFVAALLVWNICWGTRGMTRFVSRYPDADLRIAKDGEYVKVTGVVTCGNFPLESSFQRVPRCVYTSSCLYEYRGWDSKAANTQHRRFTWGLRSIERHAVDFYISDFQSGLRALVKIGYGARLIPYVDEAVVIDINPENKDMSPEFLRWLRERNLSSDDRIMRLKEGYVKEGNTVSVIGVVQRNDNVLMIVPPPEPFNTGCQWGKCLLPTSLDGLVLRCEDTSNGDVIPV

SEQ ID NO: 112148 - protein, 124 aa, Triticum aestivum
  Clone ID: PAT_TA_6566.pep
AQTASFVHSEPILLESPIQPPDRHPHGHSDSRRLANMNKIHTWSDLRVDPVPEPCAGKVGVRGRGRGRGRAVGDGEALRRCAGVLGRLWGVSSRQVVLDGIFYGVTVLTGKLRTGICRLLHLLF

SEQ ID NO: 112149 - protein, 216 aa, Triticum aestivum
  Clone ID: PAT_TA_6567.pep
MSDAPGAAASAMGSGRELANPPSDGISNLRFSNHSDHLLVSSWDKTVRLYDAEASLLKGEFAHPGPVLDCCFHDDSSGFSAGADHTVRRLSFTSSKEDVLGRHDAPVRCVEYSYAAGQVITGSWDKTIKCWDPRGVSGPERTLVGTYAQPERVYSMSLVGNRLVVATAGRHVSIYDLRNMSQPEQKRESSLKYQTRCVRCFPNGTGYALSSSRTMS

SEQ ID NO: 112150 - protein, 160 aa, Triticum aestivum
  Clone ID: PAT_TA_6568.pep
MEIDADLLVTRAEITDAAAATFADSTVIPDRYARPDEVGDGVVVGDDESHELPLVDMARLLDSESSEAEAAKLGSACRDWGFFQLTNHGLDESAVQDMKNNAVQFFRLPLEKKNAVAIEAGRLEGFGHHFAGASCDKLDWAESLILATQENEQTNMELWP

SEQ ID NO: 112151 - protein, 194 aa, Triticum aestivum
  unsure (1)..(194): unsure at all Xaa locations
  Clone ID: PAT_TA_6569.pep
MASPETSRAHQPLPHPPLRLPVPSIRSRGPSSPLSXPPWPPPRPSQIRTSXPLPSLSPPPPAHPSSGEFPHPLPSSPEQPRRRTHRSPNQPSATFNIPFILVLSGERDSSSWVRHSAPFISVVGAPPEVDRAAGTGAGAKLPPLHHGRWRMKPMTWRSRPVHPLSPIRQPDGGIDLGSACVLSGGVLCVYVFYK

SEQ ID NO: 112152 - protein, 274 aa, Triticum aestivum
  Clone ID: PAT_TA_6570.pep
TRTKPDARVKLIPAEDITYVRHGKPFGRTVGSAKLQKRHCRRSVTPPPSSRKISLARSTPLTHKSTTPFTPKAMPPLNHKASAPLTHKAATPLTHKPMTPPHPVASCLSPKRVETAHKALRPLSPKPTTPPLPVASCLSPKRVETAHRALGPLSPKPTTPPLPVASCLSPKRVEKAHKASRPLSPKPTTPPLPVASCLSPKRVETAHKASGPLSPKPSTPPLPVASCLSPKRVETAHKASGPLSPKPTTPPLPVASCLSPKRVETVENRQFFSL

SEQ ID NO: 112153 - protein, 45 aa, Triticum aestivum
  Clone ID: PAT_TA_6571.pep
RQLVQQSLQSNMRRIVRRARLPQDLAPPDGLKALTSSSTSKSLPF

SEQ ID NO: 112154 - protein, 135 aa, Triticum aestivum
  Clone ID: PAT_TA_6572.pep
MAQPLTRRPPLLRPPLRRRLLPLPLLALLLAAPDQPATAAASRAGRTGTTTTAHGSMRASSRSLLQQQPPPRLDCPKVCLGRCANNWKNEMCNDKCNVCCQRCNCVPPGTGQDTRHICPCYDQMTNPHNGKLKCP

SEQ ID NO: 112155 - protein, 249 aa, Triticum aestivum
  Clone ID: PAT_TA_6573.pep
RPGNCIVHDMFGHEVVEKIKEEYCDAFLTAHFEVPGEMFSLSMEAKTRGMGVVGSTQNILDFIKYHLKQALDRNVDDHLQFVLGTESGMITSIVAAVRQLFDSYESSKEGASIEVEIVFPVSSDAISKTSIDDSHHFGSSVANDLEQINIVPGVFSGEGCSIHGGCASCPYMKMNSLESLLKICQQLPGEDNSLSVYQASRLNLKTSLGMLVARAACSPSSRTRTFHARERSPPKPVHQVIHGNGGEPL

SEQ ID NO: 112156 - protein, 510 aa, Triticum aestivum
  unsure (1)..(510): unsure at all Xaa locations
  Clone ID: PAT_TA_6574.pep
SFSCSSSCLPRAPLLAPARPRGSSGRPEPWSTPVGARPHRPSAPRLAFVPGPEAGSPPADPSPELLGFRGIGPRRRRDLGFRAQEGWKFPKARSILNLIVTTADEYQTIMKAPEQRRKPTDTEAKAKLGGDKLHCLKPGKYTHKSSGNIGAKCRREDAQSFTSSKIALKGGSFMEVPFNNSTNLPAQPPNYSKKMKLQFFPIDEAIQKVLQQEVNTILTWXLTLAPRKKMSSIVQHLNTKWGRSSCAKGDLMLFPYSATPDSIASSKKWTLNDSCTAADVYVAVGSPSTFRLRYGWFKPNLKQQTSEASLAPVHSAEKTLGDKPSHPFEFPSKFASPSVECNTEKTVVDNNQSKATPLSWIDSISNISFGALLSQAVPSQDSKQPPLQNXSIFQQQIPATCDSFDAAIASLIARQQTSNQPKVSNPSPWEADETCHAFPPPRNQNLSRVPSCGPGNSSAIITSTILGSIAESGTDGDHQQHWLPALYRRHERGTKAPSDTTRPGAMMMMM

SEQ ID NO: 112157 - protein, 62 aa, Triticum aestivum
  Clone ID: PAT_TA_6575.pep
PSVRVYEAEILAIDGRKINRGVAICHLDTSDWSPGHGAFVALGGKPGEMEVCHWIFQGDMVW

SEQ ID NO: 112158 - protein, 311 aa, Triticum aestivum
  Clone ID: PAT_TA_6576.pep
RNSARGADGREIAVKLLTNAARQGIREFLNEVALLSRIHHRNLVTFLGYSQQDGKNILVYEFMHNGTLKEHLRGGPNDVKITSWVKRLEIAEDAAKGIEYLHTGCSPTIIHRDVKSSNILLDKNMRAKVADFGLSKPAVDGSHVSSIVRGTVGYLDPEYYISQQLTEKSDIYSFGVILLELISGHEPISSDNFGLNCRNIVAWARSHIESGNIDAIIDASLDTGYDLQSVWKIAEVGIMCVKPKGAQRPTISEVLKEIQDAIAIEVQREAPQVQQLMSKRSMGSVSINTDNSVDLEQNASFDEMLMRPGLR

SEQ ID NO: 112159 - protein, 65 aa, Triticum aestivum
  Clone ID: PAT_TA_6577.pep
SSEYHRLCGREGRTQVEFEDCTNYEKQMELQIIYKKIENISKILKTMRRLCLEHLSLHCFHFFLD

SEQ ID NO: 112160 - protein, 204 aa, Triticum aestivum
  unsure (1)..(204): unsure at all Xaa locations
  Clone ID: PAT_TA_6578.pep
LKPELRGLIWKGACLAINVDKWYACLEEIRACHSLPAPSEDEKLPVGTGSNPVFIVSDNVIKINAEGGLGYSAHGLGTELEFYDLLRKVGSPLVNHIPEIIASGFLVYEDGVYRTVPWNGKGMPRCFGLNTILWSFLTQTSCFPLGLWSKQQFGMDGSAESSNXXIWPYMGTRKCKGXIFAHGRDTLSKADLLNLASSLGVQMR

SEQ ID NO: 112161 - protein, 142 aa, Triticum aestivum
  Clone ID: PAT_TA_6579.pep
MQATGSVTWVVGAQASVLGRCSGGVPYPSSSSSASSGRSQGLGTVRCCVQAQEKKPRVRKTKEERREMVESFVDTYRVSNNGKFPSVNLTHKEVGGSYYIVREIMRDIIQENRVLGPGDLNAKTLSFEDCPDSSELSNRHEL

SEQ ID NO: 112162 - protein, 167 aa, Triticum aestivum
  Clone ID: PAT_TA_6580.pep
RSSGEYIPSAKVGSRLPHMLVRPLSASSEGVFSTLDLVSGDKIEFVIIIAPLKESYKLAQAMLRIADEFELSAKVCVMWPQGSRDVEAKGSIAELAPWTNYVDVEEIPRATVNSSWWEMCQVSNRSVILVRPDEHIAWRTEPDMVRDAYSDVRRVFSQILSLNRPQV

SEQ ID NO: 112163 - protein, 66 aa, Triticum aestivum
  Clone ID: PAT_TA_6581.pep
FDLNLKTSSRQQQAACKISITGIPQLVNFKLHWSCRVEVGTEASVLMISRGSEDIACRNVLCPWTR

SEQ ID NO: 112164 - protein, 86 aa, Triticum aestivum
  Clone ID: PAT_TA_6582.pep
NYLSCWLCSYGSVSSELGRVRRSFSPVTASHVARAAIDHGCRRSPGWVSSLSDLHGRLVYYRHCNLECKNALLSCKGLIDYSVACS

SEQ ID NO: 112165 - protein, 83 aa, Triticum aestivum
  Clone ID: PAT_TA_6583.pep
PNKSIFNPDPARLPSGEDERNQDVDFPLEIESYIGSDDVRNQDVVLSLSLSFCNLVLLIKIKRRGRRRREIWISPAPLPLFNS

SEQ ID NO: 112166 - protein, 142 aa, Triticum aestivum
  unsure (1)..(142): unsure at all Xaa locations
  Clone ID: PAT_TA_6584.pep
EAAATAPAGVVSFXEALPRPLALPLFELRGKPLVWLPRPDGDGVSTSSSFLKVLSSLLAVSLVLVQVMLEFLLVRHCHSWFGLGGFSCDVSSVRAEHPLSLCSGNHIHACLRSCHVLYPYVLILLLLSIKRYASFAYSRKKK

SEQ ID NO: 112167 - protein, 209 aa, Triticum aestivum
  Clone ID: PAT_TA_6585.pep
MAAAAASLVIRLSALAVVLVVLCPAASAVPLGKRYRVGGPEGWRVPPPQDKEMFYVKWASPITFFVEDSIEFVYKNDSVIKVSKVGYYHCNETAGIGTGAVPRDGSTLFLLDAPGFAYFASADLGHCNAGERLVINVRAASPPAPASASSPAQAPTAPSSSRPPSSSPFSPAPGPAPSMEYSSAAGGPFVASLARAMAQAVTLVLACFI

SEQ ID NO: 112168 - protein, 305 aa, Triticum aestivum
  Clone ID: PAT_TA_6586.pep
GTRRLALDLLRALPLPPDLLDPLLLSSLRSDLSFPDPDVAASSIASFPSLPSHLLPTLLSSAHADIAAALSSPAESLRLAAVTSLSSLLPRDDLALMCSTNPSLMGHATTWWGRLTELALDSADAVAAAAFEALARLFQELDARRMSRLAGDKLVDGEGALAVRAQWAADAIDFIWSRRNMLIARSMVMPVESFRVTVYPLVHAAKMVASGAVNTLRQIAKPGDTTIADTVEASAEKLVGVSDIVSHLLPFLSSLEPPLVFEVGINMLSLADAPGGKPEWASAAIIAILTLWDRQEFSSMRETIV

SEQ ID NO: 112169 - protein, 166 aa, Triticum aestivum
  unsure (1)..(166): unsure at all Xaa locations
  Clone ID: PAT_TA_6587.pep
MTSAHSKLYSDDVSLVVVVVDTNPFFWAGAALPFADFLSHLIHFVNSLLLLSNLNHVVIIAAGVSSCAYVFDSGNAYAGGTADVAEPLAGEPKXEESLADARRLQHGTVLMACRSCFCALSLSGYIQRXFRSGTRHPQPRILCLQGSPDGPEQYVAVMNSIFSAQR

SEQ ID NO: 112170 - protein, 81 aa, Triticum aestivum
  Clone ID: PAT_TA_6588.pep
RCWTATRKNGRGPAHRRPARRPGILLRRRLFLFDVGAGVGLLIIYLTRGYICFTLGRHLSIFQGITFSFVTCYWYSLNPDR

SEQ ID NO: 112171 - protein, 250 aa, Triticum aestivum
  unsure (1)..(250): unsure at all Xaa locations
  Clone ID: PAT_TA_6589.pep
MVAKADHPAWLLTAAEGYVGDRSNERTARGITSKGLSIKASFFPNRPPQPSKLWVHCPEAAVVQTPRVLYIAGDLILFRVPISSDPVPENRFFWPLDSDYFVYRADPNLRELKLLTDVHIRNFEDCQVGILPRGFHDYTIAALVXCPLTIDRFILHLFHSETSSWTSIVPPVVEPQEGFNIVIPTNTDLHRHDTSNVITIGGEYGTMGWVDLWRGILFCDVLCEKPTLRGIPLPLPMYHITGGDGMGLYL

SEQ ID NO: 112172 - protein, 267 aa, Triticum aestivum
  unsure (1)..(267): unsure at all Xaa locations
  Clone ID: PAT_TA_6590.pep
MAAATMSLSSSTFAGKAVKNVPSLALFGEARVTMRKTAAKAKQVSXPGSPWYGADRVLYLGPLSGEPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRIAGGPLGEIVDPLYPGGSFDPLGLADDPEAFAELKVKEIKNGRLAMYSMFGFFVQAIVTGKGPLENLADHLADPVNNNAWAFATNFVPGK

SEQ ID NO: 112173 - protein, 319 aa, Triticum aestivum
  Clone ID: PAT_TA_6591.pep
VARPQWCQVWRGCLVQGWLPDTKEDIAVKRLDKEGFQGNREFLVEVLMLSLLSHPNLVNLIGYSTDLDQRILVYEYMPNGSLEDHLLDLPENAKALPWQTRMRIAVGAAKGIEYLHEVANPPVIYRDLKASNILLDKDFNSKLSDFGLAKLGPLGDESHVSTRVMGTYGYCAPEYAMTGKLTKMSDIYSFGVVLLELITGRRAIDPTKPTEEQVLIHWAAPLIRDRKMFVRLADPLLGKDFPVKGLYQALAIASMCMQEDPSKRPKIGDVVDALTFLAEQKYYPQRDREAAQAKGGDCSTPPKKDMVSEIKADDDMKQR

SEQ ID NO: 112174 - protein, 345 aa, Triticum aestivum
  unsure (1)..(345): unsure at all Xaa locations
  Clone ID: PAT_TA_6592.pep
GRSGGRRVSTPTLILGEHIEPPSIRLWPPPRQRLRYHQYAFPRNLIPPPTMPLSPPPFAGKAVKNVPSSXLFGEARVTMRKTAAKAKQVAAAGPERVLGRPAYLGPLSREPPRYLAGEXLPGDCRWDSAGPSADPEPXPRNVRPWWRVWRXRWAMRWGAWSCGFPALLAGCGGGFGEAVWFQAGCPSXSQGGLDCLGNPSLVHAQGILAVWACHVVLVGAVAGXRVAGGPLGEIVDPLPPGGRADPQPPALRHSPMAMLKRLVKETRAIFSMLGFVVQAIVPGKGTAQTPAAAHANPSTTTTNTLPTTLVTAFGREHDSLFDGVFMRARGAVRCAVMSLISRILA

SEQ ID NO: 112175 - protein, 76 aa, Triticum aestivum
  Clone ID: PAT_TA_6593.pep
PAPPSADLVNTTPTHTETNQPQNQEYKSLISLDPAVPIIRQILFLSPEQSRWMLDLDLLGACPSPLPHMGKDAPLA

SEQ ID NO: 112176 - protein, 375 aa, Triticum aestivum
  unsure (1)..(375): unsure at all Xaa locations
  Clone ID: PAT_TA_6594.pep
DGKPESXKPLLDYLLTLNYRGEKLMVNDTIDTVNKLQTALLLAEVFVSGLPKFTPYLKFEQRFQEWGLEKGWGENAETCKETLNFLSEVLQAPDPINMEKFFSRVPAISTRVVFSIXGYFGQEKVLGLPDTGGQVVYILDQVRSMEEELLQRIKLQGLHITPKILVLTRLIPDSKGTKCNVELEPVENTKYSHILRVPFKTEDGKDLRQWVSRFDIYPYLERYAQDASAKILDILEGKPDLIIGNYTDGNLVASLMSSKLGVTQGTIAHALEKTKYEDSDAKWRELDQKYHFSCQFTADMIAMNTTDFIITSTYQEIAGSKEKPGQYEHHYAFTMPGLCRYATGINVFDPKFNIAAPGADQSVYFPFTQKQKRLT

SEQ ID NO: 112177 - protein, 236 aa, Triticum aestivum
  unsure (1)..(236): unsure at all Xaa locations
  Clone ID: PAT_TA_6595.pep
MAGGQESSAVAADLDPVYEWVDGDGSYLLRLNLPEXDFRVHVDPAGRLNILGHKTADGGAGNVRLHKVFQLPSTSDLDAITGRYDANLLTLTVPKLPSAPAKDVGDKPTDEKSKVIREAERLIEAARARLQLGRHREETAKEPPATKVDDRKQEPKATEKVVKGDDGQDHKEKLEYETATETETQREKKGCWKERAAEEGFKWADTIGKNKEVIAATAVAAFTLGVFVSHRLFSRN

SEQ ID NO: 112178 - protein, 61 aa, Triticum aestivum
  Clone ID: PAT_TA_6596.pep
QASYSRCKDVQVYLLLYEDDDSCMLIVLQGVINMGRRAVQMADGVCDLLMLVSFSEGTNFL

SEQ ID NO: 112179 - protein, 135 aa, Triticum aestivum
  Clone ID: PAT_TA_6597.pep
CMRLPISATATTLTKMPNTSIDRIVLARSLRIQRYSDRGSPPSSPCAPEYPGRRHNRDATSLTRRPRTVPRPVAVTQLSSHQLTPPPEERRSAETSSSSVCSYGDGEHGKDAAKRELVQVGGARGREREGAWVRA

SEQ ID NO: 112180 - protein, 129 aa, Triticum aestivum
  Clone ID: PAT_TA_6598.pep
NPNPLARTPDATPLPGSLLELSSSPVFMKPPTPSSASPLRMTMTALGRPEEEGHGDSAGCVRKQHRVMEWSESTFRHSSHSLRPVDAYVYFSWVYQGGNLLYFKSKAFNAFLSVFHVPMIICKSELCHC

SEQ ID NO: 112181 - protein, 202 aa, Triticum aestivum
  Clone ID: PAT_TA_6599.pep
VRPRVRGRVGTVPNPILSPGRPDPPQPPHNPSPFPLDPHSPSLLLALRHGLCTRSLSMASYPSPHHHRCTQTVDPCRRRAAPVMVGCIYAEDEGGPPPVFASSLRPCCSSSSLSPHLAVQQPGQGEGAARPGSIPLLHAGELDEQVAREAATASGGAAQERPPPGFYYCYGQKKAKAGKDNNVRSQPRSKMPRSRVYFPSSP

SEQ ID NO: 112182 - protein, 103 aa, Triticum aestivum
  Clone ID: PAT_TA_6600.pep
MEAVERDAAAIAESYASLFASLRITLSNVTSTSADNMECLGEVVGRLQESALEASSRGNKYIHSCLRLNEEMRGLESLSMQLKIMRKIVDSLDLAVDRLLHLP

SEQ ID NO: 112183 - protein, 127 aa, Triticum aestivum
  Clone ID: PAT_TA_6601.pep
MRGERLGSWVVSYTGMSADNIKGLLLAVSSSLFIGASFIVKKKGLKKAGASGVRAGVGGYSYLLEPLWWIGLITMVVGEIANFAAYAFAPAILVTPLGALSIIISAVLARFFGRAHLLVSGCFLFVG

SEQ ID NO: 112184 - protein, 103 aa, Triticum aestivum; identical to SEQ ID NO: 107316
  Clone ID: PAT_TA_6602.pep

SEQ ID NO: 112185 - protein, 129 aa, Triticum aestivum
  Clone ID: PAT_TA_6603.pep
FFLCRSNGPLFLFIFFFLLVLGHGTASSALHFISANNHGLAAAAASLQPKDYWYMQHHPPSLAMNKVNLPPPFLSQKEYEHQAESRPRNFTNNDNYSAYTLPRGEKGGCRGSNATDGGAFSRFVVFSFF

SEQ ID NO: 112186 - protein, 195 aa, Triticum aestivum
  Clone ID: PAT_TA_6604.pep
HRRQRHLRLLLGHSTPTAAQKQMFTANLVSQYKSHVKALFGLGARKLAVIDVPPIGCCPYPRSLHPLGACIDVLNELTRGLNKGVKDAMHGLSVSLGGLKYSIGSSHAVVQSIMKHPQRLGFKEVTTACCGSGKFNGKSGCTPNATLCDNRHEYLFWDLLHPTHATSKLAAAAIYNGSLHFAAPVNFRQLAEDQC

SEQ ID NO: 112187 - protein, 152 aa, Triticum aestivum
  Clone ID: PAT_TA_6605.pep
ASRWRPRARKRRRRGAGEGLFGGRDNYDKRLQYLSKEAAVVRARADALPDPVLRPQHHRPLYHRRGTLFIEFWTRSGDFSRAPPPRAAVVGVIRAGFDQPTIFCYREMLGFWLVNFSFSSSLARRVYVGKFVCTGPLGVWMSSDLLKFLWLH

SEQ ID NO: 112188 - protein, 248 aa, Triticum aestivum
  unsure (1)..(248): unsure at all Xaa locations
  Clone ID: PAT_TA_6606.pep
FHLGIPPDPFHPIRSQRAPLLSFPIRPSRSSSQSSPSSPRPCLLCSISPAQRLLNPPSPAGALPRSPRREPGRGAPCVRPPRAVPAVXPPQPAAKLRRPPSLLAAPPLSLPLXPRFPFHGPTEQESCHGRPNPAAASRCRRGLISTTRPGRPSSPLPVPGRIPSAGPRPRCRRPRPARPGPPFTSPSCRPRLNPLPRVGSRLPRLSWTGSXVVGSRMRPPPRSSSFGSSSSSALPRRCCPMRLLCLAR

SEQ ID NO: 112189 - protein, 124 aa, Triticum aestivum
  Clone ID: PAT_TA_6607.pep
MGILLVSGRFLARRPPLALAPRCSRGSPDKRGRDEGDTSSTDWDKAWSTFKKKGKKTLFSEFSPNKYVTWNPRRSEYPLSEEVDPIKRAERSNLMLWTSPRFTLVGAIIIVSALLIYTLVVPPK

SEQ ID NO: 112190 - protein, 165 aa, Triticum aestivum
  Clone ID: PAT_TA_6608.pep
QVRQSGTRFLPLARGGSIHPAGHLSSLWGAMSEHAAPELPKRCHHCAGPLSKDMETSSWTVTPLVRDSFSMIGSAVGGTAGAFYAFNHAMPVVRRYIKGPMWMHFLVGAPPVVVFSSACAGLAAGTIPALAQLVSSSCHAAMSSPSFARPASPDDMHKSRGSSPL

SEQ ID NO: 112191 - protein, 141 aa, Triticum aestivum
  Clone ID: PAT_TA_6609.pep
ISAPPLPCSSYLAPQLRPAPLPCSHLLARPMWILPLVWALIQGTRVGCSRLRVSPSASARQLRCRRRPPLPRATVLASSRCMMASGSAQWSALPKGRPLDLLQTPAAPAGVQAPPAATARRPRWFRSPTSRIFSSPTLQGR

SEQ ID NO: 112192 - protein, 206 aa, Triticum aestivum
  unsure (1)..(206): unsure at all Xaa locations
  Clone ID: PAT_TA_6610.pep
MSARRLCDALAAAGFDSGGXLDPESLDWAFLQGDDSSRVLAWIAARLRRANVLSASDLELYDQLELEGKLLEGKDLDSAFDSISAFSETGENHEYTFLSEESLGDIRDSKLALRAEVSDLEKKLASLEWQLDLLTAQATTITQGKKSRTSAKTSATGKLARFDEELAKRSLEMNAVLGKLVATIQELSYYHSEADIAPAVNVIQHI

SEQ ID NO: 112193 - protein, 164 aa, Triticum aestivum
  Clone ID: PAT_TA_6611.pep
VPFVGPARPGIPNAPLSGRPTQDLLLAASPPGHDSPLSRRGPGTRHRWPMAMLSAGLAQSAWPLAAWPVRGRARGRPAVACRCMPGLRLSTPSSGPAFSQEWAAVGPCPVSTYHRRLLSNEWMTSVPTMSRHVFPPANDDFTRGKSPLVGAVNGLSDPKPDPIA

SEQ ID NO: 112194 - protein, 91 aa, Triticum aestivum
  Clone ID: PAT_TA_6612.pep
EAFQHCSALYSIQRESALYPRHPLGAAWGLSPPQPTIAHSGLSHHPCLQHNPQCSLNLSLDHMPFFCNETCHASHAGPGSHNRHPLGQRGA

SEQ ID NO: 112195 - protein, 313 aa, Triticum aestivum
  Clone ID: PAT_TA_6613.pep
GGLLKPCKGILLFGPPGTGKTMLAKALANESGASFLNISLSTIMSKYYGDAEKTIRALFSLATKLAPAIIFVDEVDSLLGQRDRRNENELPRRIKNEFMTHWDGLLSKSNERILVLAATNRPFDLDEAIVRRFEHRIMVGLPTLESRELILKKLLSKEKVEEGIDFKELATSTEGYSGSDLKNLCVTAAYRPVRELIQKEQQKVKDKKENAVQVKDPEAQPKSQRGAAQSSESKKGEDVMLETKQGVTEKGVKGATEETVTLRPLTMEDLRLAKDQVGASLASEGSIMTALKEWNELYGKGGSRKKEQLSYFL

SEQ ID NO: 112196 - protein, 134 aa, Triticum aestivum
  Clone ID: PAT_TA_6614.pep
YLQTDNAEICPSAREKQDATKLLIGYLDDDDDLLRVDGRRRAAAGVALGPAEDGLGEHGADLLLDARPLFLRLHLGELPVLALGQLHQPRALVHRVLEVRRRWRLLLRHRRRRSLVLLHQVPKTEHRLTENSCT

SEQ ID NO: 112197 - protein, 58 aa, Triticum aestivum
  Clone ID: PAT_TA_6615.pep
TYFLLIARYLREFCIFKTVHNLLGCLPFSMHRVFRQMFYEQTFSLNLDLISVENRRGY

SEQ ID NO: 112198 - protein, 129 aa, Triticum aestivum
  unsure (1)..(129): unsure at all Xaa locations
  Clone ID: PAT_TA_6616.pep
MACLAPHFKWAPSSFSTTHAYRHPSSSSSSSNSGRCSGRRPFRVQCAVTSAAAAVVDADHAAGGPLHLVYSSPDSAPVLQRNFESTLASETVLNKEAVVTAAAAEAVALARAAAXEAAQEVVHMVQKSS

SEQ ID NO: 112199 - protein, 171 aa, Triticum aestivum
  Clone ID: PAT_TA_6617.pep
MGLQILSSTPEHSAQHSTGASTATTESGAAGRLPTPLGLPVAIPDEAVTSRSASASAQSASSRFKGVVPQPNGRWGAQIYDRHARVWIGTFPDEDAAARAYDVAALRYRGLDAGTNFPRTAGSTELAFLAAHSKAEIVDMLRKHTYSDELRRGLRRGRGIGGRAEPTPSWA

SEQ ID NO: 112200 - protein, 341 aa, Triticum aestivum
  Clone ID: PAT_TA_6618.pep
MPSLPSPFAAGDCSADKFDPDYLYFLRHLRTEGSSYVLELPPGGASPAPVIRYESPIAISDGECVSDPSPGGASANRRAEEWDSSVETPPSWIDSIVDIDEDYRIFLHHTCVVNNRLKLQMGGVVVDYEPDPDAAQSGGSSGVEEQSEKDAAVASSEGEEQVVDSDVPVVIMPEPNAYDWRADPAPRQRMQGQEDIGHKDAQPRVASSHRSDVIWPPHINRRPDSDFKRRLMDALQKPFSRKEYIKLFDMASIRTPLVKLRQVRNDAKFYPTEEMGNSYFDHYPDLVEQVTNTSFSKGLALMRGFFFWLQNSAHEDQFRPWTDDLKDQEVIPLMDLDYPLP

SEQ ID NO: 112201 - protein, 102 aa, Triticum aestivum
  Clone ID: PAT_TA_6619.pep
VEPGCPLPLVAPPRLVAFTMLVGIAIPFFSGLLGFFGGFAFAPTTYFLPCIMWLAIKKPSRFSMSWCINWICIIIGMLLSVLAPIGGLRSIIINYKTYQFFS

SEQ ID NO: 112202 - protein, 117 aa, Triticum aestivum
  unsure (1)..(117): unsure at all Xaa locations
  Clone ID: PAT_TA_6620.pep
LFPGRADRGGLPLPQARPSSAAGEHGGTREVYEEKLRSGAHLHRDPTINPGLGXSARCPRCLSLLNPATSSGKXRDWAITSVLHDATAVTGFRRPARCSSGVRPVPPLALPPLPDAW

SEQ ID NO: 112203 - protein, 83 aa, Triticum aestivum
  Clone ID: PAT_TA_6621.pep
QGCLQSNNKTFFSYSTPMVIPISCLRNWCCSPVRAREDSPSTCLVGALHILSSDQVAGGRPEVGGPEGPRGPAAGGGPSRARS

SEQ ID NO: 112204 - protein, 369 aa, Triticum aestivum
  unsure (1)..(369): unsure at all Xaa locations
  Clone ID: PAT_TA_6622.pep
MPAGEPLPGRGASSRPAAPATAYSGVAKKLPLALLVFFSALLYNQIQPPPPKVPGSPGGPPITANRTKLRDGRHLAYLESGVPKDQAKYKIIFVHGFFCCRYDVLNVSQGLLQELGIYLLSFDRPGYCESDAHPAXTEESIAVDIAELADNLQLGPQFHLMGFSMGGDIMWSCLKHIPHSLAGGAILAPVRGPVGNYWWSGLPSNVSWDAWYQQLPRDQWAVWVSHHLPWLTYWWNTQKLFPASSVIAYNPALLSEEDAKLMEKFGMRTYMTMIRQQGEYYCLHRDMMVGFGKWGWSPLNLKDPFAGGEGKVHLWHGAEDRIVPVILSRYISEGLPWVVYHELPKSGHLFPVVQEMADAIVKSLLLGEQ

SEQ ID NO: 112205 - protein, 99 aa, Triticum aestivum
  Clone ID: PAT_TA_6623.pep
DGRGGRREASWMPDPAPAGEATTLSPSSDPSMAGTDTPHRKTASLKLTVARVGRRLAGKQIRWPELTVARVGRRPSGQAPIAVGERERGRKLNGGRRDG

SEQ ID NO: 112206 - protein, 56 aa, Triticum aestivum
  Clone ID: PAT_TA_6624.pep
AHRCSIFGYKTLSIKKNARRRAAVSAHGLSCDGWHVPEPLVKRLANGVDDEPDVPE

SEQ ID NO: 112207 - protein, 64 aa, Triticum aestivum
  Clone ID: PAT_TA_6625.pep
SPWVIRHKTSYVVALANSFRGVAGRLHIPRVDYASGSRHLHKQEVKCSSSPPVTSKAGRLCAHP

SEQ ID NO: 112208 - protein, 207 aa, Triticum aestivum
  Clone ID: PAT_TA_6626.pep
VRSAALWPWRPAPHAPLICLFAPAEDGGEGQRGAVVLPPQRVRQRRTRKPSSPSCRRRRPLLPRSGFSSPFPHGGAWILLPLRFHGGTRTCRIFLIVSPRERSGSSHTRLVRVAWCPRCVRPVLCRCLSHPSTAEGGEDWMPTDLEEEADTRTKSTARCLVTSLDRLRGGGRFVVEGTASAAGCIMRHSRGRVACSAGARRVSQRGT

SEQ ID NO: 112209 - protein, 123 aa, Triticum aestivum
  Clone ID: PAT_TA_6627.pep
MASSTLKPGVPITLQELEPSSEMFKQGASIRVTGTLQSYDVDSAVAVIRDGSATLRIDTQHLREIGFRSGSMFQFIGELLIRPNNDAILQARVGRNVDGLDLNLYQQSLIIRRQHKARLLRRD

SEQ ID NO: 112210 - protein, 101 aa, Triticum aestivum
  Clone ID: PAT_TA_6628.pep
RLLISWSASVTSAMFLFIASPRLGHYCRFELAAFSRQWRVSSSCSSHSNHPRPANSNPSGIPLQNHLHHNRHPHNHHFHKFLILNSTHCHLHHRHFAYSPS

SEQ ID NO: 112211 - protein, 88 aa, Triticum aestivum
  Clone ID: PAT_TA_6629.pep
CYHNNHEKQTRLVSLPSLAALFLSAHSWTEVGERRHWTQGFFRPAYERRRGRTHVLIFSLFPMATSRQLWILSRHCTLVPRQDLCVSH

SEQ ID NO: 112212 - protein, 118 aa, Triticum aestivum
  Clone ID: PAT_TA_6630.pep
MVKKQKKALENINSRLRLVMKSGKYNLGYRQTLRMLRQGKAKLVILASNCPSLRKSEIEYYAMLAKTGVHHYTGNNIELGTACGKYFRVCTLSITDPGDSDIIRSMPAPSAGAGTGGD

SEQ ID NO: 112213 - protein, 219 aa, Triticum aestivum
  unsure (1)..(219): unsure at all Xaa locations
  Clone ID: PAT_TA_6631.pep
MAAAAGDELETVEVKLRAVGPSRPTTIRLPPLISVADLRRTVALDRRLPQDRLRLVLRGTTLPWGDDTPLVLRRGGGRLVVAVAPKPPAKHLRGDDDDDDDDDEEELKFKIPQTTTXWKKRIFIFLRRKXCRLPDTLLMALFSASMVASLCFPLAPLARTYGAGPLGRLATGSCIRLLDHTSRPWEDDSKVILVHAQFSMKPAAFNAERIDRDPRAGQL

SEQ ID NO: 112214 - protein, 712 aa, Triticum aestivum
  unsure (1)..(712): unsure at all Xaa locations
  Clone ID: PAT_TA_6632.pep
MPTATATPTPKAVIHQRYGAKAVYRVDEVREAVDGVCPGLALPQSTRCVYRCQLDIPGVLSVSTPGTFVRKKDAEQAAAQIAIEKLGIQPTSNIPNTPEEAWEELISRISYFFTDENFPTSSHPLVGHLSVTLRRTGDFLGKIPISAIVACDVKVQTLCKIIDPKAEFDPLLVLSMIYNAAKQSPGVSVSNRNFWIQSQRPYSSEAVDLALQCWSGISDPIRVEAVLIPCAMEDEPKMVSLNISENEHYMGDIALKLSATDSSHVLVSRTVDKASSEMRFYFPAPDVQFVSDLSKQLVDDRGDRNMNCLINKRASYISGQTIYGDAVLANVGYTRRDTELQTDHVNLCTYYRILLRKLPDGIYKISKDSILVAELPCVYTRTSWKGPSPRDLLCSFCRLQRLSEPYFAANRVSASCNVLGSAVGSEEMGSPKATAGNQCANDGRIAKENPDMFKCSVKIYSKKRDLLLEYSTDCSWSKETDAIQNSALKVLIWFNRYFKQLNTPVEKLNLPKSTDGFTIYPNIFLQEFAMCLSVYGKTSGGDSRTCSAVGYFSMDTSYQQLESSAFLTDIDGQDSGVFPSHGSLACISYSAHLFMKDSRKRYLLEVNNEFEFEIGAGAVRNQLESCATQLSVNQSACFVDQLSDRDLSLAAACELSLDLSKICRDSCVLEFSVKVLQVTEPLEDRMEKALFNPXLSKQRVEFAVRHINQLHA

SEQ ID NO: 112215 - protein, 264 aa, Triticum aestivum
  Clone ID: PAT_TA_6633.pep
IPPHLLRPRTARLLAPPPSRSRTGRAPAAPEEIGAGPGRGSSSTSLETSALTWAGRIGARLLSDSRVELRARHLFDGMLSKTAASGKGHFGDLPDDLLRHVLSFLPAADALQTCVLDTGWRDHWRRTTSLPLIFDQSSFPSSERFKQLVNLFIHLRGDSPLDKCKIVGCLDDEDDERTYTNTMLLIQYALKCQVKELLLSVAAEGDDDIDVDPLLLDVPLISQHLKTLHLKWVYLKRSTLNFSRCSVLEELEMHNAHEHQDSNH

SEQ ID NO: 112216 - protein, 326 aa, Triticum aestivum
  Clone ID: PAT_TA_6634.pep
MAGASSPPPTPKSPKLQPPLLERAKGPSGLDKIVLRDPRGFTAEVRLYGGQVTSWKNEQGDELLFVSSKAIFKSPGAIRGGIPICFPQFGTHGNLEKHGFARNRLWLVDDNPPPLPVNSGIKTYADLILKPSEEDLKIWPHRFEFRLRVALGPKGDLFLTSRIRNTNTDGKPFSFTFAYHTYFSVSDISEVRIEGLETMDYFDNLKGKERFTEQGDALVFESEIDKVYLDTPPKIAIIDHEKKRTFVLRKDGLPDAVVWNPWERRSKTILDFGDEEYKHMLCVEPAAVEKPITLKPGEEWKGRLELSAVPSSYYSGQLDPDKVLHG

SEQ ID NO: 112217 - protein, 63 aa, Triticum aestivum
  Clone ID: PAT_TA_6635.pep
FLTSVKNRHILICSLAYSVGSNLCWFLHNLAECSDSMDSHGHKQKPLCSALPWLSTRNGYSEL

SEQ ID NO: 112218 - protein, 330 aa, Triticum aestivum
  Clone ID: PAT_TA_6636.pep
RASASDFTPLVWFPVRAMPGSLPPSVSYRSPEGQSIVQHERMIALADEFGAFHNQIFENTFAVHFTNPFHVSTRVVDKCNDGTLLLQVILHSEVKATLHVKDVSLDLQAGFEHLGKGDGRPPSSLFPLVIAPSSKAGILFVIRLSGTKDLDELEQADSMLHIKYGISGDRATGAHSPVPVKPDDSEELLFKISLKLKRPVLDPCLAVGFLPFSTDCLRVGQLVNMKWRVERLKDLEEASLSDDEILYQVDANPQNWMVAGRKSGHISFSETQGSRIEIAVTCVPLVSGYVHPPQLGLPDVGDANISCNPAGPHLVCVLPPTLSTSYCIPA

SEQ ID NO: 112219 - protein, 270 aa, Triticum aestivum
  Clone ID: PAT_TA_6637.pep
MYKQGAAGGAGPDRKRISDALDKHLEKAAASPSTSRGSAGARGNHNRVVVPSSIPKGRCSEGESESDSEASDVSGSDGEDTSWISWYCNLRGNEFFCEVDDDYIQDDFNLCGLSSQVPYYDYALDLILDIESSHGDIFTEEQNELVESAAEMLYGLIHARYILTSKGLAAMLEKYKNYDFGRCPRVYCCGQPCLPVGQSDIHRSSTVKIYCPKCEDIYYPRSKYQDIDGAYFGTTFPHLFLMTYDHLKPQKPSQRYVPRVFGFKLHNHKP

SEQ ID NO: 112220 - protein, 70 aa, Triticum aestivum
  Clone ID: PAT_TA_6638.pep
YFYHRTLGGDVEVSDGLGFLFEDTFIVDYYSLFLCNLRSVNIFFKYYCNFEICSHVSAHLYLVFTACYPV

SEQ ID NO: 112221 - protein, 163 aa, Triticum aestivum
  Clone ID: PAT_TA_6639.pep
MRMNMPQGLTPAPASMTIPMSHSSRPTLGFPLGTALLLLVIFSLSGIFSCCYHWDRLRSLLWSRHPGMLQDGPHTVISVGSAPSKAASEHKSEKAGKECGLPVIMPGDNIAKFYARPAPHEACLSAATAERAKSRCKSRCSVSVRPSVSVYEIVVSCSATYDG

SEQ ID NO: 112222 - protein, 267 aa, Triticum aestivum
  unsure (1)..(267): unsure at all Xaa locations
  Clone ID: PAT_TA_6640.pep
MPRRSQSSAPIDLDEEDECKTKRSRASIRPAPKVPGSSNRIASSRRDKENQDKLDTRIFDLYMENLWKRTDEDQKNACAYLDPLWFNSYVNGDKEQKSRILRWTKKLKIFSRKCVFVPIVRWGHWNLLVLCHFDETDCSDAKKGPRMLLLDSLNTTDPKRVGXEIRGFIRGIYEIEEREESVHFIKKIRLEFPKVPQQNGEECGIYVLYFIHCFLQNGKLAQVLENKTLEEDFSQLFDDGTFDPEELENFRKDVHAFQVERSTETGQ

SEQ ID NO: 112223 - protein, 131 aa, Triticum aestivum
  Clone ID: PAT_TA_6641.pep
RNSDEEWTEASRGTYNKGDSVARSTVQVYPGAWTAVLVSLDNVGFWNVRSQKLDSWYLGQEVYVRVVNPEDGANKTEMAVPHNALYCGQLHKYQKEQTPHHKTAAAVRPLAAQRQIVALVMLVVGALVFAS

SEQ ID NO: 112224 - protein, 287 aa, Triticum aestivum
  unsure (1)..(287): unsure at all Xaa locations
  Clone ID: PAT_TA_6642.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLXEVESSDTVDNVKAKIQDKEGIPPDQQRLIFAGKQLEDGRTLADYNIQXKESTLHLVLRLXGGMQIXFVKTLPGKTITLXKXESXDTIXDNVKAKIQDKXGHFFGPXGXLFFAGKQLGGW

SEQ ID NO: 112225 - protein, 60 aa, Triticum aestivum
  Clone ID: PAT_TA_6643.pep
NTIMFSNGFVVSWWLGQMFTVRRFLCESMLILLINTQLQSYFKSINRLHSIHGVYNASVL

SEQ ID NO: 112226 - protein, 375 aa, Triticum aestivum
  unsure (1)..(375): unsure at all Xaa locations
  Clone ID: PAT_TA_6644.pep
PNRVSPYPPSSQPPIPSPSFPPSVPPPATRSAQGPRQSPDPVGNRQRARPDPPEQSRMGEQKECAKREVARSRDNYMSWSDDCTKYMLEWYIEKQRDKPPTFKWKAQHHLQCANDLNDKXGITATAKQVDRHFRSFKEKWKWIKLAKGRSGYGFDKVLNKFNIDKSEKSPSKLGKIKFNYLTHSIKFYHLLEELFSDSSHADGSLAIDVNNAKXNVESDGSSETSSHTXTAEQGLSDSDMIAPNSPAEGTSSNLKRKHVKAPHKKKPKVKARRARVLDDDVAASIVSLAETVKSAAPIQPIAATDPNANLWKHIESLTLPANEKIELATYLAKPEQEVFRGFLNCASDQTFNAWVLDYFAHKYDGKDPATADPSI

SEQ ID NO: 112227 - protein, 90 aa, Triticum aestivum
  Clone ID: PAT_TA_6645.pep
KLGSDVQIQCKSSLDTKVALTRLACVACVLLSVTGRQGGKHVAYFFAQTPSIFFIFHTAALVDVGIFSFFASMTNRSRLSRQYLELERKI

SEQ ID NO: 112228 - protein, 133 aa, Triticum aestivum
  unsure (1)..(133): unsure at all Xaa locations
  Clone ID: PAT_TA_6646.pep
LGKARPDRSGFXGAWTKDPLKFDNSYFIELLKGDSNGLLKLPTDKVLVEDADFRRFVELYAKDEDAFFRDYAXESHKKLPELGFTPSPRYPTGVGVQETKPRGLXTRTTAVFAVAVAVIACAYICESKRRLWG

SEQ ID NO: 112229 - protein, 91 aa, Triticum aestivum
  Clone ID: PAT_TA_6647.pep
RDNLQNVLTGENHLKQSTYRGHGLGRNLVNATLGGDEVTMGNSVLFRLLDTGPIGKGAGEEAREVCPRPAPSASVLCSGNAKLPQPSPGQR

SEQ ID NO: 112230 - protein, 313 aa, Triticum aestivum
  unsure (1)..(313): unsure at all Xaa locations
  Clone ID: PAT_TA_6648.pep
NRFAKXSNILGEGGYGVVYKGRLMNGTEVAVKKILNNVGQAEKEFRVEVEAIGHVRHKNLVRLLGYCVEGIHRMLVYEYVNNGNLEQWLHGAMGQHGILSWESRTKILLGTAKALAYLHEAXIDPKVVHRXIKSSNILIDTEFNSKVSDFGLAKLLDSDASHINTRVMGTYGYVAPEYANSGMLNEKSDIYSFGVVLLECITARDPVDYSKPADESNLVEWLKMMVSTKRAEEVVDPGLEVKPPKRALKRAILVGLKCVDPDADKRPKMSHVVQMLEAVQKAYQEDEKKHSQMGSIDLESQQSAEELSNSADV

SEQ ID NO: 112231 - protein, 210 aa, Triticum aestivum
  Clone ID: PAT_TA_6649.pep
AASASPIDVNVSTGAFGWQPSASERSNAASASPIDVNVSTGAFGWQPSADERSNAGAAWSTGYNPNMYSSYGAAAGAAPSVRTSQQAAAAPSVRSSQQAPVKQEYTEPAAAACAAARTLCGASLGSFARSSTAPAGVAHRGCPRPDRHARPRGACRRGSAVCPCRGTGGFSPGRPSPPPPCGRREREGGVFLPRERVPQLPAHVTSFLQE

SEQ ID NO: 112232 - protein, 309 aa, Triticum aestivum
  unsure (1)..(309): unsure at all Xaa locations
  Clone ID: PAT_TA_6650.pep
RTDHSWDLDQESRMKNFXWTVLRSQAQYRYFGDVISLDVMYLQHSRASLPLATLLGVNNHGHLVLLGCGLLSKDSKENYVWLLEGCRAWMNGKPPEAITTCYSDVVAEAVSEVLPDARHRFCFWHILKKLQENVGRTHEKEAISLRFKEVVYDTVTLTDFEKEWEAMVEHYKLKDNEWFSALYSCRKQWAPGYVNHSFWAGTSAIRKVEKPDPYFDGVVTSKTTLPVFLEQYETTLRGKLEREAYDDLRSYYSRLTLLSGLXLEEQLRELFPVPVSKAFRGVFGQVGLVICKEVDRSGNSITYMVSELI

SEQ ID NO: 112233 - protein, 235 aa, Triticum aestivum
  Clone ID: PAT_TA_6651.pep
MVAVNWELRGCCQHNQVVFIAAVGVSTVVILALWRTFLLTPFKLITVFLHETSHALACKLTCGDVEGMQVHANEGGVTQTRGGIYWIILPAGYLGSSFWGMVFILSSTHLLATRIAAGCFILALIIVLFVAKNWFLRWLCIGFIIFIAVVWVIQEFTTFHVLKYVILFIGVMNSLFSVYDIYDDTISRRVNSSDAEKFAEICPCPCNGVGWGVIWGFISFIFLCASIYLGLVILS

SEQ ID NO: 112234 - protein, 178 aa, Triticum aestivum
  Clone ID: PAT_TA_6652.pep
ARGTAEHPAVSEVDSFRRQVDDLASKTDVLERRVNEVVGFYDGKKHGSGGRRASGSSRYAANGARDSNCKGMPDLTRQLTGIIRQITSHEWSAPFLQPVDVVGLQLDDYHKIITKPMDFSTIQNKMEAKDGTKYRSVREIYSDVRLIFTNAMTYNDEHHDVHIMAKLLLEKFEEKWLQ

SEQ ID NO: 112235 - protein, 59 aa, Triticum aestivum
  Clone ID: PAT_TA_6653.pep
GTTGGPYDHQGHPGVTGTGAHGTTATGGAYNQQGHAGVTGTGEKKGIMGKIKEKLPGQH

SEQ ID NO: 112236 - protein, 211 aa, Triticum aestivum
  unsure (1)..(211): unsure at all Xaa locations
  Clone ID: PAT_TA_6654.pep
AGGRPPTLLLLRPLASAPEMSGSAAXRVGTPLADAEGSPKRPRSSRHPSLSPSPSQARSQAPSPSQSRSPPRSRSRLLLARTSPPPYIGSPSYAPYDDRESQPAATARSRRRSRSRRVKRKTDGNGAGRSGGPHSYKGAQRRARGRRSTASASATNEPPSSSAPAASPSAPPRPPRVRTGVPPARGAVTTSGTTAATTVRPMAACAAAPSR

SEQ ID NO: 112237 - protein, 368 aa, Triticum aestivum
  unsure (1)..(368): unsure at all Xaa locations
  Clone ID: PAT_TA_6655.pep
SARGLLRVLEAATEEPSVILREHKIFTSRFLPSLSILYKGNKDCDARFLCLKILSDVMIVIFSDSSLTADEQCLADLKTISHKYFLPMYPSFAEDEDPIPMYAQKLLVMLMEHDCVKVSDILNEATVARGFEFLLGDLSNANVSNVKLCFALASAPDMDSNILSQLQVVRRIGNLLEFVTAKDMDDFLEPTLELCRAFIIRGTGSNRSIVLSKEPALLVDSAFSMSIAVDQQSCIMDICDLGGSMGIFLEVVGNSDPQISDLASDCVVLLLKAAPRXATMGLLTNLPKLSALLDSLKHGVPLPLTRLLYSLAFSCRQYLTQGMILSISVPALMRVEALVSSFKASRDSCLADAASCVGAELQRLPRCG

SEQ ID NO: 112238 - protein, 142 aa, Triticum aestivum
  Clone ID: PAT_TA_6656.pep
LDACPVLENFILGVLQTRVKHELISAGDSSMRRIPGHQYRNMKNVSIMGFCSAKSMVELTCHILENATSLECLMLDTVYDNREDTDGCCVKGSSGECRPIGRSMIMHAHKGLWAIEKYVAEKVPSTAKLNVKKLCSRCHKIT

SEQ ID NO: 112239 - protein, 89 aa, Triticum aestivum
  Clone ID: PAT_TA_6657.pep
LLEPNPGWLLGTLDLYKLCCYYFAHSRRIYKDARHVVSTGRVDVRGPATGSSGWLHRLLGAPFGHDPRVPEDLLRGELRETSRHIMRRI

SEQ ID NO: 112240 - protein, 41 aa, Triticum aestivum
  Clone ID: PAT_TA_6658.pep
YQYIAHMHSRITMRYSCVLFHMTMLPVALLPYGEELQLLNL

SEQ ID NO: 112241 - protein, 175 aa, Triticum aestivum
  unsure (1)..(175): unsure at all Xaa locations
  Clone ID: PAT_TA_6659.pep
MVFYFKARPDAGDYTIFMGLDKHENEDLIKYGFPEDIWFHVDKMSSAHVYVRLNRGQTMDDISEGLLEDCAQLVKANSIQGNKVNNVDVVYTPWYNLKKTPSMDVGQVGFHNSKLVRTVQVEKRSNEVVNRLNKTKVERTPDLKAEREAVSAAEKAERKLQLRDKKRKEEMERLX

SEQ ID NO: 112242 - protein, 41 aa, Triticum aestivum
  Clone ID: PAT_TA_6660.pep
SLCNQIGGTFSLRTRKGLLEGLFSLVPGTKKCLVPCNQTPP

SEQ ID NO: 112243 - protein, 286 aa, Triticum aestivum
  unsure (1)..(286): unsure at all Xaa locations
  Clone ID: PAT_TA_6661.pep
ALPGFIIMYVWHYCTVKRYEFEMHSKVSMAWILGLGPSLGLVRVPGIGFVYTELASGVPHIFSHFITNLPAIHSVVVFVCVKYLPVYTVPVEERFLVRRIGPKNFHIFRCIARYGYKDLHKKDDDFEKMLFDCLTLFIRLESMMDGYSDSDEFSLPEQRTEGSINTAFLADKTVNTMCSNGDLSYSSQDSIVPARAPPGANRPVXFSRLTLPSGTGFLPGLIRCRDAGVVHILGNTIVRARRDSGIIKKISVDYLYAFMRRICRENSVMFNIPHESLLNVGQIYYI

SEQ ID NO: 112244 - protein, 263 aa, Triticum aestivum
  unsure (1)..(263): unsure at all Xaa locations
  Clone ID: PAT_TA_6662.pep
AFSSALNEKQQENQDLLIXVCIAQHLGFAGNRPVAACIIYKCLLHWRSFEVERTSVFDRIIQTIGHAIETQDNNEVLAYWLSNASTLLLLLQRTLKASGSTGMAPQRRRSSSATLFGRMTQSFRGTPQGVNLALINGSMVSGVETLRQVEAKYPALLFKQQLTAYVEKIYGMIRDNLKKEISPLLGLCIQAPRTSRASMMKGSSRSNTNTAAQQALIAHXQGIVKSLGXFLNILKVNNVPPFLGRKVFTSDFSFXNVPLFNSL

SEQ ID NO: 112245 - protein, 53 aa, Triticum aestivum
  unsure (1)..(53): unsure at all Xaa locations
  Clone ID: PAT_TA_6663.pep
TCVPMGCCAFYSRVVVVVFTRLSECWFFLVVCYVVLISWAVGLVITCNAXRGV

SEQ ID NO: 112246 - protein, 196 aa, Triticum aestivum
  unsure (1)..(196): unsure at all Xaa locations
  Clone ID: PAT_TA_6664.pep
THASAHASGGLRGLGLMPDILACRSTQPLEENVKLKLSQFCQVPVSNIVNLHDVTNIWHIPLLLRDQRARGAILKVLGLWCVGKVPQEPKLSEWTERASRFDKLKSPVRIAMVGKYTGISDSYLSILKALLHASVALDRKLVVDWVPSCDLEDSAAVETPDAYEKAWGLLKGANGVLVPGGFXDRGVQRKILAAKH

SEQ ID NO: 112247 - protein, 342 aa, Triticum aestivum
  unsure (1)..(342): unsure at all Xaa locations
  Clone ID: PAT_TA_6665.pep
LHVALLCQDQIPSIVKLPDLTSIWHNPSLFWLQRPHEATLXVSGPVGSREGASSNLFCLECLRKLPHEPKLSEWSERASRVNKLTSPVTIGMVGKLTGIPGSHRTGNWACLDSSPAMYRKLVVYWLLLSIKEHGVDXKDASGVLVPGGSRDGCVQRKSSATKQARESNGTNLGSXLCMQIAVIEYPQFCDQACLMHNSTRFXDAALRKPCVTFFPQAAKTHRGASMPLGSRRTFFAVNNCKSTKLYANANYVDERHRHRYEVNPDMVSEFEKAGLSFVGRDESGRRMEIIELPTHKFFVGTQFHPEFNSRXPGKPSPLFLGLIAASSGQLEHLLQRTSGAVS

SEQ ID NO: 112248 - protein, 175 aa, Triticum aestivum
  Clone ID: PAT_TA_6666.pep
RDIVVPMIDYEKNGLNWTRKLRSTFADWNTSLQTIITWSPYGTEAELLEQFSSIKEQGTRVIIYNLWEDDQGDLELDFDADVNDIQLRGGNRDEKNIEMAKRFPNSKHFLTYRHSLRSYASILYLRLSDAFQIFLRGKEIEHHNIVTDMMLKKDVTYRPVATNGLPKDSNMVADV

SEQ ID NO: 112249 - protein, 152 aa, Triticum aestivum
  unsure (1)..(152): unsure at all Xaa locations
  Clone ID: PAT_TA_6667.pep
LRRKRARDDRAPARTPPAGRRGAAGDRRAGCPVADATRGGAGGGERRDGRRRRPQGAARTAADRPRGPSAGAAGPAXGRRAAAPRTAAASGGRPEYAGRSPGGRRPEPGGQHEGASTPTGPAGRGGRRPARSQPGREEQRRARGAQRRQPVP

SEQ ID NO: 112250 - protein, 87 aa, Triticum aestivum
  Clone ID: PAT_TA_6668.pep
SAECREKANKAWAKAITTYFLIQRKSTWPANNARNIAAAAQFTTLSCRLHFSLRCADASSISLISLQSRASFSGTQADSPYAFCGPG

SEQ ID NO: 112251 - protein, 285 aa, Triticum aestivum
  Clone ID: PAT_TA_6669.pep
MTIMRMFLALCALGFVAGVVEDGSSFDVSAYPVKWDEDPSVGSGDVAAPPSPGTEAPAPPPKHHMMVKKGMLFLERDLFAGALLPANTRLGYVRRTSSPGPVISSTTSPVPPFRYSSFEKILKFYNVTHGSKQAGRISETLQFCEEAGDKEPHACATSVAAARDFAATVLGTKEPRAVTSILHGRTQPLRYVVAPNGIASVGGDAVVPCHPLAYPVEVFYCHNPSNVQALRVQLVGQEDPSVGATAIAVCHKDTSYWDEAYFMMLNGSRGEPICHFMPANYLLWL

SEQ ID NO: 112252 - protein, 315 aa, Triticum aestivum
  unsure (1)..(315): unsure at all Xaa locations
  Clone ID: PAT_TA_6670.pep
SPGAHIDRCKCRAYQAIICTYKVNYNKFLSRDWSWWFWSRLPGISHGDEWQIRYKMIKGICHGLQYLHKERITHLDLKPDNVLLDAYVEPKIXXFGLSRLFDEGQSRVFTKNVPGTRGYIAPEVIDKGEISFKSDIFALGIVVSKLLVGQNNYDIENWHESLDVDCTQAKSCIQIAQSCMEADQHKRPTAEEIIKKLNEMESLGSSIYRTNSSDSENLIQVEPLELHFHLEPNTHISVTQKLKLANITDDYVAFNAMEWSSMAKYGFSWSGPSRGILLPWSTHELGLIREAHEMSPLSVQCNDVLIVRSTVVSEG

SEQ ID NO: 112253 - protein, 143 aa, Triticum aestivum
  unsure (1)..(143): unsure at all Xaa locations
  Clone ID: PAT_TA_6671.pep
MGKRQVLPALLLALLALASSGGGAHPATPVKAPFSRHSFPKGFVFGTGSAAYQYEGAVKEGGRGPTVWDKFAHTPGKIADGGNGDVALDFYHRYKEDLKLVLDMNMDAFRFSIAWSRILPTGSMSGGVNKDGIAFYNRLINXR

SEQ ID NO: 112254 - protein, 307 aa, Triticum aestivum
  unsure (1)..(307): unsure at all Xaa locations
  Clone ID: PAT_TA_6672.pep
MGKRQVLPALLLALLALASSGGGAHASAGGGAHPATPVKAPFSRHSFPKGFVFGTGSAAYQGEGAVKEGGRGPTVWDKFAHTPGKIADGGNGDVALDFYHRVMDVLMVAVGFSIAACRFPPAGSRSRPAGSLGGAVYKGRIAEVIAKGLKPYVTLHHWDTPLGLEDKYGGFLSEKIVXVSLALGVACALHSGARAWPWTSVNVPCTSCPHGYATGVFAPGRCSPHVSASCGARDSAREPYIVTHNILLAHAATVELYRRKYQKAQGGEVGITLVCHWYLPYTNSTADKEAAKRRVEFMLGWFMDPIV

SEQ ID NO: 112255 - protein, 273 aa, Triticum aestivum
  Clone ID: PAT_TA_6673.pep
PLAARPCMRSRDLELYWVVWAGVLAGKRACATAGICRPSQRGYQQSITRRLSIAATSVASFAYFPCVRAAVSPGPSGLARVSVPPPGKPRGPSVVRGGPVPSPPPQAAYLFPSRCTVLLVPPSPSGPVSRVAVLQFSGLAMPLRALYLDNDPFLQAWYAFRGAELQLPKHLFPNVISFPYRVDYDDVNAIHIHPEILREVYEYFVTYQTTAVELALEDEVMEHTIDGQTYKDTVFFLIGECQRFFELLELTWNAFALPPSGFLLSEIPYANLL

SEQ ID NO: 112256 - protein, 111 aa, Triticum aestivum
  Clone ID: PAT_TA_6674.pep
NTLKMVPMATVLVNLKNYTIPALLADLHVLISSSKACVCVGIIVPPLSCIYSCLRLLLQCCVPNLPRSIQVAQAKRPVLVCNCKDVLRHSHPDILLRPPCLPDRASCQIPA

SEQ ID NO: 112257 - protein, 95 aa, Triticum aestivum
  Clone ID: PAT_TA_6675.pep
MICCFLPISLTILFCLLYLVASSSSCFFPLCQSCSVTLLMLLRCPNKSFVWADNFLLTTNRKKLKLTDLGLAREETITEMMTTETGTYRYGHRVR

SEQ ID NO: 112258 - protein, 415 aa, Triticum aestivum
  unsure (1)..(415): unsure at all Xaa locations
  Clone ID: PAT_TA_6676.pep
GLASFAAPSGPRGHAAPRFAALVVFAEHRYYGESMPFGSKDKAYNNSRSMAYLTAEQALADYAVLLTDLKRNLSSESSPVVLLGGSFILMEWAGXESQACTEMVMPMSSSEGLSMFPPXEFDSVFYALVSVDFXGVGLGLLPSLQGLVAMILVRCGKGLGGLLHLRQSFHPCLARGSTGPLWTWLDTCCCHWWLHYGAHHTKPAPRYQGKTMNWVLSLRESKPEGSSRLDRSYPAGNRGANYTGTVDCFDLDDDPHGMGGWDWQACTEMVMPMSSSEGLSMFLPDEFDYALYADDCVKNFGVRPRPRWISTEFGGHNISSVLEKFGSNIIFFNGLLDPWSGGGVLKNISESVVAIVAPLGAHHIDLRPATKEDPDWLVSLRESELEIISGWLSDHYGARGGALFQRATNKDSAAS

SEQ ID NO: 112259 - protein, 384 aa, Triticum aestivum
  unsure (1)..(384): unsure at all Xaa locations
  Clone ID: PAT_TA_6677.pep
GLLDWLGGVGRRLASAAVEEVAEEEEDQGADVDLVVYDGAKWVAGAVEEKEWSRREGRGEGSEAGGEPAEKRGTRQGHGLHHRARSQGGARRLHPVFPQGTSPSSTSTRSRLSLQCDTLIVSTRDEFAARTTLQTSSSVSIVSSDAGFPVDVYGRVIARDSIDYKCIYLFHRNRDDCQRVNEDGMLILTGPYRGLVLVDFIYLEIDLKIREEGVPDRPFSKGLISIDGRVLSREKDVMVRSETLESWLSTTEVRFTTVLNAVECTFEIKLTEGLFKGNITVGIADEARKLDNEQTIVIHDSTADGVVTSDESGVIKLRRSVITICLERTVMFHINNEADGVCAERNFDFTPRRTGADEQLMXEITCGAGKFRFRVVWSLMDFRL

SEQ ID NO: 112260 - protein, 104 aa, Triticum aestivum
  unsure (1)..(104): unsure at all Xaa locations
  Clone ID: PAT_TA_6678.pep
SSILQXPNNRGQNIAKHMLRAKYINPFCRDQHKMNTRTKQPKANRQPTTNFQDQQHKWPVQLHFTIFGISQQDEGLQVSIPTKRETLHLPPARLXLAXWQQRFC

SEQ ID NO: 112261 - protein, 131 aa, Triticum aestivum
  unsure (1)..(131): unsure at all Xaa locations
  Clone ID: PAT_TA_6679.pep
LPDQHPPRRRPPGGVLAAPSSPWWTTPPSXPLPRPXPAPSPSPCPPPCPAGPGCPSRETAPPRGLRSRWRSAPRRSLPPLVPPSAPAPPSPIPGLCRLLHPSWRCPSTMFLFWSTTYSSFFGIVRDNIYLS

SEQ ID NO: 112262 - protein, 215 aa, Triticum aestivum
  Clone ID: PAT_TA_6680.pep
FEIPQGSFIIFQMLALTLWIPMYDRFVVPALRRFTGREGGITLLQRIGVGLALSVVTMLVSAAVERRRRRIGSLMPCGRVGGRVGGRVGSEAFGAIGQIEFYYRQFPENMRSVAGAVSFLGIAVASYASGLMVTVVHRATRRRDGRPDWLAQDLNEGRVDLFYLVTAAIAAVNLVYFVACARWYKFKKASDDTHASDEVELDESPKKVASNMTQV

SEQ ID NO: 112263 - protein, 100 aa, Triticum aestivum
  Clone ID: PAT_TA_6681.pep
MKGVGNPTLCRTKWRKVAYGGMQPGYDDNYTDDSFLEEMVMNANVVKRDFLRVMVDSVSISQYLCIVALVVSTWTHTLNLPCREITLLKFDIGLLLVGFL

SEQ ID NO: 112264 - protein, 92 aa, Triticum aestivum
  Clone ID: PAT_TA_6682.pep
LMKSTSSLYPGLNGTGLTTMSICISSRKLRRATMCSALPSFTIFCGICPCTCPRLEFLTHPIPRWTVLLHRPCYFPCSSLLLSYHALPSCRI

SEQ ID NO: 112265 - protein, 191 aa, Triticum aestivum
  Clone ID: PAT_TA_6683.pep
MIHDIRETEGINGKTSNACEHSFRQIVPYSEDDMLGIEPLELHFPFELNKQMSCALQLTNETNSYIAFNIQNTSPLSYCTKPQKDIMPPRSKCTVEMTMQLQGKAPGYMHRANELTVWSTKLNDSLAVEDITTNMFINEAVNTVDEVNLDVAFDARPQSELLDVHPPELGPSLESRKFVVISSAARQELPL

SEQ ID NO: 112266 - protein, 265 aa, Triticum aestivum
  unsure (1)..(265): unsure at all Xaa locations
  Clone ID: PAT_TA_6684.pep
KTVLHRXIYGKFMGNRPFIRKAVSNIFYRFVSEADHHNGISELLEVFGSVISGFAKPLKEEHKLFLWKALIPLHKPKTVGVYLPRRSFCFTLFSPLVPMLAGSVIRGLWMSWPLSYRRSGLFLVRELVALLVSCGLAPCQLCRVPFFRRIAACPFPALWQVAERALFLWNNEHLFDMISQNRQVIVPIVYPALXERNARLHWKQSVLNVTMNVRKMFFXMDERLLLTSRATSSRRESRSGGAKVEQERPTLNPTKPSSPKSHKNV

SEQ ID NO: 112267 - protein, 208 aa, Triticum aestivum
  unsure (1)..(208): unsure at all Xaa locations
  Clone ID: PAT_TA_6685.pep
LRATKEMFPRMSTSEMVGSGDTAAAAAVSTERLKKRLQQEGVSDAAIADSERIVREEFEALHKQLVLLKQKQALXLDTLRHLETEKVDLENTLVDESQRQSKEYGSASRPRNEKLSGXSEEKEEKITRRLAXSFFLFPCNFPFIGNSKDLLTFLPFISSGADFHGSEAGSDDEDDYPMDGIDPSMKSVGINYPYVRRRKKLPDPVEKE

SEQ ID NO: 112268 - protein, 127 aa, Triticum aestivum
  Clone ID: PAT_TA_6686.pep
AAFFGRQEQRGIVSAGPGFPESSWFAEFAEMARRVWLLHCLFYAVDGGEEEDGASIFQVRTGARFAEVYMESVNEGRTEDAFCTAAEDRTVGFTVVPAASAGPPGTRRRGSLARPRPPPGAASCAPS

SEQ ID NO: 112269 - protein, 97 aa, Triticum aestivum
  Clone ID: PAT_TA_6687.pep
KIMVTTSNIRYINVLIYGSQPRRTEMQTSKSARVSSHLLAIGCNMCIHHIQYMSGPFITHLVTCPFHTIYVFPMQDGSGLPPPCSSKHAPEPPHRPP

SEQ ID NO: 112270 - protein, 170 aa, Triticum aestivum
  Clone ID: PAT_TA_6688.pep
KCVAMAQDAVALNGLNYESHMQFRRSVVPILIYRRQQKEEQEHEGEEEQEPEPEPEPEQANPNDPISVVPGIVTVAGETFCHIIANKRLLFTRRRGRYRFEIAFPNMNLDLDNLNVERHGLLAAFYCPVPAGIVDAVHFSNQTAQNQKLKMYGYQISASGQVQRDLIMAI

SEQ ID NO: 112271 - protein, 128 aa, Triticum aestivum
  unsure (1)..(128): unsure at all Xaa locations
  Clone ID: PAT_TA_6689.pep
APRRAHGGTTYKGYTIPHNKRWHTIAGRRDCPTLCFWIMYIPTEEGXRSVLLGMRHPWDGHXDDHAHGFCFCTRNMRLHPSCIAVPLSSTLKAGWTETLTRRMFRCKSLLIKNNHNYHYSPLLFASFF

SEQ ID NO: 112272 - protein, 192 aa, Triticum aestivum
  Clone ID: PAT_TA_6690.pep
MAGFSHLPQQMEYGLANAGSFLLCHGNPEDAAASLEGSSGVLDTPLVATASVEKKRKPKEDTASLNSAHSKETKESTRKRGGKKQGKEMDEEEEEPKGYIHVRARRGQATDSHSLSERVRRERISERMRMLQSLVPGCDKVTGKALILDEIINYVQSLQNQVEFLSMRIASLSPVVYGFGMESGAAFSDQSQ

SEQ ID NO: 112273 - protein, 118 aa, Triticum aestivum
  Clone ID: PAT_TA_6691.pep
NFYAIDTESKPSGLSLSSTITMSPIRTTLTARLSAGPDAAGEVAWSPWCTDGLETRLYGWILSTFLTRTTPSTGSSLPVLVLVATILLLPPPRNIAELCYSNMWIYIDLISGINVDRS

SEQ ID NO: 112274 - protein, 151 aa, Triticum aestivum
  Clone ID: PAT_TA_6692.pep
GRGILLRTALPSVLRLLQIHRLFRCTCSTDTTGRGILLAALRRIPPTESSVHHINSKILTRESSPYRLHGVLPEPECQGRARPRFLLDGELHCPNSLSVQMDGDEDEGGMWCKEKLQRPARVWGWVLGRGAPGWSRAPSALQSARALAALP

SEQ ID NO: 112275 - protein, 116 aa, Triticum aestivum
  Clone ID: PAT_TA_6693.pep
RTHTVVVQKKGNLVVITAKWNQQMRTQQPSIRLAYMHACMHARLHAAPTNQLTRPPHQGQRGLHPQESPAAVSTTTTLAPWRRRHWPADGGSRRRFPVLAGEEKRGTCHWYRREER

SEQ ID NO: 112276 - protein, 317 aa, Triticum aestivum
  Clone ID: PAT_TA_6694.pep
MDFARRKAAALAALSSPAPDKSPKGGVDAPIAPLLDALNSHADLFTTSSCSGRISVLAQPSPQSQAADPKPKKKARGGGWLYISHDPADPDAVVELLFGGTGCGERGGGDELVFRFEPMIVAVECRDAAAAAALVAAAIGAGFRESGITSLQRRAMVAIRCSIRMEVPLGLTNELVVSPEYIRYLVRIANCKMEANKKRMDGFLDVLQSKGLPGISRLQVHTKKDDRSLGSEVQASLNQSVQTHDELLVTEKRRGSYNCDAGTKGDCEIGENSIEGSYYENRDAVRNNIAKHGFGNAERHVLITLLFSICSIFIISI

SEQ ID NO: 112277 - protein, 103 aa, Triticum aestivum; identical to SEQ ID NO: 107316
  Clone ID: PAT_TA_6695.pep

SEQ ID NO: 112278 - protein, 345 aa, Triticum aestivum
  Clone ID: PAT_TA_6696.pep
MDYDPLALDADDEETNCPGKKFPVAAAAKVDDIWSRIYTRRNIEYQKKCEEIEASEDENATFPSYPLKILPEATGLCVLRGFCHHREYKTHDTSTARSSLGLRDPRLMLQIFAMHLSISESYSYPVSVYGIVAVRDALEPLRNLVFNRPCRDDAFTVDQDSLTLPLCSPRRGMYLVRDRALLEVDLWVKEEGDGSSDKQLLSLYAEFEGMYELDEMLDGEVSSDLGSLVIDYLLLDESVEAVIQVSAKIDCPHHMRFTAFTSGFDGEIVLFDDKFSGNGKLFQYVVAVKAEGKLDICLKMEESLFWWTFQEGAVGAVRFPDDSVLNYGQFEVTVLFAPKKFTMDD

SEQ ID NO: 112279 - protein, 140 aa, Triticum aestivum
  Clone ID: PAT_TA_6697.pep
AVLVYFLLFSGFFINRDRIPDYWIWFHYISLVKYPYQAVLQNEFGDATRCFARGTQMFDGTPIGGMPEAIKMKVLGAIGNALGTRMTSHTCVLTGADVLAQQAVTDLGKWMCLLVTAGFGFFFRALFYVVLLVGSKNKRK

SEQ ID NO: 112280 - protein, 95 aa, Triticum aestivum
  unsure (1)..(95): unsure at all Xaa locations
  Clone ID: PAT_TA_6698.pep
RLPSSPPHTTPRPRPESQTLTPLPSPPIGLPPPPPPTAADPAATSLPLPPXSRSSSPLWPTTCSRRSSPRACSSSPSPLTTRSATTSSPPPPPRS

SEQ ID NO: 112281 - protein, 88 aa, Triticum aestivum
  Clone ID: PAT_TA_6699.pep
MGGGGPRPGPGRESPWGLPEGDKRQPKAHRCNDRVEDVSRASPWRPSMRVRSRPFLVLSRPCGRACPGDLARVPLSHLLPCPPILGGA

SEQ ID NO: 112282 - protein, 136 aa, Triticum aestivum
  Clone ID: PAT_TA_6700.pep
FFYPGAQTPPAARPTRCPLGELAGCHSLPPPAGHFLHSFAPSSLARYKTDPSTCQPPPQHFVTPTHSCTRPLISTNSCTHAPHRPLSHDRATNPLATCMQLDNYLIHALQDSATPPDAPLVAAAGLAANGNHAHQD

SEQ ID NO: 112283 - protein, 48 aa, Triticum aestivum
  Clone ID: PAT_TA_6701.pep
ANDQKKGSFHLNGLKIQIRPGHARRYPLNQPPSKPCPRGRSNGTPPSH

SEQ ID NO: 112284 - protein, 116 aa, Triticum aestivum
  unsure (1)..(116): unsure at all Xaa locations
  Clone ID: PAT_TA_6702.pep
PPPEGKGKGSKARRRGRRTLALARRALARGAPIPRAALGPRAARGAAGPPPPPSPLPGPRPXGGAPPPPPPPPPPRRPWPRRCSSAPCPLFSARAARGPPPPVAPPLNQPTSFAFT

SEQ ID NO: 112285 - protein, 143 aa, Triticum aestivum
  Clone ID: PAT_TA_6703.pep
KTDVFGFGVLLVELITGQKALDFGRLANQKGGVLDLVKKLHQEKQLNMMVDKDLGSNYDRVELEEMVQVALLCTQYYPSHRPGMSEVIRMLEGDGLAEKWEASQNVDTPKSVSSELLPLKFTDFAGADESSVGLEAMELSGPR

SEQ ID NO: 112286 - protein, 303 aa, Triticum aestivum
  unsure (1)..(303): unsure at all Xaa locations
  Clone ID: PAT_TA_6704.pep
MAPTADSVDLKGQKKAKKSNSKDERKHRKDKYERPAADEASPRNEAKRKHKGGQEGKEHGKKPKKEKKAGAEAEATGAGAAEVKRGDEKMKRAMEDERFAAARTDPRFRPMRRKEAKVALDSRFNGMLTNPMFASSEAPVDKRGRRRKKGAKENPMLHYYLKQEEGDEKEKDKEKVKLVQEDDDDEVEEEDEQVEEESSSSDDEEEEEEEEEEDDDECSVGSDIAHYLMARHDDTPMIDKETHRLAVVNMDWDHIKAVDLYMVMTSCIPXXGRVLSVSIYPSEFGLKCMNIEXTQGPSTLLGI

SEQ ID NO: 112287 - protein, 78 aa, Triticum aestivum
  Clone ID: PAT_TA_6705.pep
LQCNYNGNSRSEILNLATAAATRSRCRAFIPIRPAFPAVSGSRRDEPPVVADQLTGVRPQACLGRPQRRWSGDSGKDS

SEQ ID NO: 112288 - protein, 177 aa, Triticum aestivum
  unsure (1)..(177): unsure at all Xaa locations
  Clone ID: PAT_TA_6706.pep
SSGLPVLLSSTFGSGQISLERAHGSSPPSLRPALPGRSPSPSPPPRRFRSPRRFSPRRGYVSPXVRRRSPFAPRRMTPPMRMRSPPRRLPPPYRRSRSPIRRPIRSLSRSISPVRGRAAPVRRGRSSSSFSESPTPPRRGAGRVLRSRSPQRSPXRGRRRSASSFSNSSGSSSPIRR

SEQ ID NO: 112289 - protein, 119 aa, Triticum aestivum
  unsure (1)..(119): unsure at all Xaa locations
  Clone ID: PAT_TA_6707.pep
MKEATASGGGATATANDPRQPATARPYAPPKLSSQDLPVDYAGFLAVVFGVVGVMLHYKVCSWIAIIFCAQSLANMKNFENDLKQLSMAFMXCCHGFGDELFRASPRRHKTLICTPCAI

SEQ ID NO: 112290 - protein, 184 aa, Triticum aestivum
  Clone ID: PAT_TA_6708.pep
EWSAAVLEILRGSDMESLTEYKVRTAAAERLGIDLDLPLHKRFVRRLVEDYLKSLAEEEDEKQKGGSRKEGKKKQQRQEEEEQEEDEEKEGEEEEVGGADVPGLRMCAFDDNGDLILCRLSKSRRVTLQEFKGKTLVSIREYYFKDGKELPTSKGMSMTVEQWETFSKSVPAIEDAIKTLGESD

SEQ ID NO: 112291 - protein, 267 aa, Triticum aestivum
  Clone ID: PAT_TA_6709.pep
GRRRVTPPPSQALQLHSSSSPGAAASLLLLLRRRSFTPPPQAPPRHRFFVRRAISSQSPMDITRGAAAAFSRGALFAVRSHARIGFYGGLFMVVSSVAGKVVVHSFPHLGDRLMRCSKYCSLVFSSITTTSVVASSIIRYTMPDPDIIFVNPLPLPPARFNALADPDPGFKHAFGERLLFIETLDLNNIPWLIHPWIDADARGDIINIDVDQATSPFEAFEIWQFICQLPEAWPSFLARKHCPILMSKVKEHLDGHLWAPVLQGDWD

SEQ ID NO: 112292 - protein, 443 aa, Triticum aestivum
  Clone ID: PAT_TA_6710.pep
RWGSSPSLLHLFDGNWNDAITRLTECDPHNSKFVVNSETPQEVEVGKDIIFTYDVRFEESEIKWASRWDTYLLMSDDQIHWFSIVNSLMIVLFLSGMVAMIMMRTLYRDISRYNQLETQEEAQEETGWKLVHGDVFRPPVNSDLLCVFVGTGVQFFGMLLVTMIFAVLGFLSPSNRGGLMTAMLLVWVLMGLIAGYSSSRLYKMFKGAEWKQITLRTAFLFPGIAFVIFFILNALIWGEKSSGAVPFTTMFALVLLWFGISVPLVFVGSYLGFKKPAMEPPVKTNKIPRQIPEQAWYMNPLFTILIGGILPFGAVFIELFFILTSIWLHQFYYIFGFLFLVFVILIITCAEITIVLCYFQLCSEDYNWWWRSYLTSGSSALYLFLYAGFYFWTKLQISKLVSGILYFGYMLLASFSFFVLTGTIGFCACFWFTRMIYSSVKID

SEQ ID NO: 112293 - protein, 69 aa, Triticum aestivum
  Clone ID: PAT_TA_6711.pep
VQLLCLYILEDPLTLTMVSGVPSCKNPWMFTMHFQTEAIDYKNMYLLSKGQKRTHATSEHIMITGASIC

SEQ ID NO: 112294 - protein, 154 aa, Triticum aestivum
  Clone ID: PAT_TA_6712.pep
APSRAIPSPAPSPLPHLRSVTWGGDACTSAEDVSTWDVYLGPQRHAAPSLPRGRSRRVVDVASAWVGQARTPRAASLNLPVDSRRRELHDGERTPTVSSPIFSATSPSSPLLPACSGCAWSRACTASVLLPAVSALDVRSFYVVILYWVVLSTL

SEQ ID NO: 112295 - protein, 178 aa, Triticum aestivum
  Clone ID: PAT_TA_6713.pep
RRIRVRFRRGSLRNGYHIQGRQQARKLPNPAVPGNTAALPGPAPIAPMSASASTSDDGSRLPRSGRAPSTRAGAAEFLGRRPSVPLFHLPSSVAGAARPWACSALRLLVQCRSGIRQDCSFVVVATCHSDFLVILYFTRLGCSSRAHPMQRAGPIWRFHGPPLPTASPFPAAYCKHGE

SEQ ID NO: 112296 - protein, 98 aa, Triticum aestivum
  Clone ID: PAT_TA_6714.pep
SAQGGHGGSRPSGGGDGSGRGGCAGEEAEEDRDHQGGGRRRQGQGQEVAVNEEAIVVVERRRPGGRGRRGGPGTEAAAEVGAPAEDAGGEPEGAVQHQ

SEQ ID NO: 112297 - protein, 141 aa, Triticum aestivum
  Clone ID: PAT_TA_6715.pep
MADAVDARRVCGMPEKAQLHVAMLALQFGYAGFHVVSRLALNMGISKLVFPVYRNIIALFLLVPFAYFLEKKDRPRLTLGLAVHFFFLALCGITANQGFYLLGLDNTSPTFASAIQNSVPAITFGMAAALRIEKVRLDRRD

SEQ ID NO: 112298 - protein, 278 aa, Triticum aestivum
  unsure (1)..(278): unsure at all Xaa locations
  Clone ID: PAT_TA_6716.pep
AAQQRPWXANTLLHYTNVFDAVVDAAYFAMAYLNVTNVPVMVTETGWPHKGDASAEPDANNDNADTYNSNLIRHVMNVTGTPKHPGVAVPTFIYELYDEDTRPGTASEKYWGLFDMNGIPAYALHLTGSGVLLANDTTNQTYCVAREGADEKMLQAALDWACGPGKVDCSVLAQGKPCYDPDTVEDHATYAFNAYYHGMGMGSGTCYFSGVAVITTTDPSHGSCVYGGKNGSALLNGTSLAPSSNSTADSGSRRAVGDVTSFVRIVVTALLLSVVALL

SEQ ID NO: 112299 - protein, 272 aa, Triticum aestivum
  Clone ID: PAT_TA_6717.pep
MPGANIVTQNDLLIVGPGVLGRLVAEKWLKEHPGCKVYGQTASTDHHSELTDIGIIPSLKGSTISQKAPYVIFCAPPSRSDDYPGDLRVAASNWNGEGSFLFTSSTALYDCSDNRLCNEDCPSIPVGRGPRTDVLLRAENVVLEAGGCVLRLAGLYKIDRGAHYFWLRKGTLDSRPDHIINQIHYEDAASLAIAIMKKRPRGRIFLGCDNKPLSRQEIMDAVNKSGKFDTEFHGFTGTDGPLGKRMENSKTRADIGWEPKYPSFTEFLGVDS

SEQ ID NO: 112300 - protein, 62 aa, Triticum aestivum
  Clone ID: PAT_TA_6718.pep
HWVPLELLNSVDLSLLCKHAWLPCMAASGQRLTITVVFCNVSSNIFITTIVVWLLIWIVDYR

SEQ ID NO: 112301 - protein, 144 aa, Triticum aestivum
  Clone ID: PAT_TA_6719.pep
VSALSPLLTPPASREMVGGVSCYLHVWWSTATTSTTGLRQSNSVSPRPLCLCFFTHALTHGCNSLCAHCVMSYVYVLRGPDEHRMGMDIHQVWTWTQIFTHGFFHWWAETVFMDMDMNLIFFNPIQTRPIAILSPNVFKLRTTL

SEQ ID NO: 112302 - protein, 112 aa, Triticum aestivum
  Clone ID: PAT_TA_6720.pep
ICREHSSQDPTKKTSEEEELRIWIGHLMLVDGVSGELGEERALCLIMAVDSAAPAGSLPPRAARPQSPFSCGVLSFPLLPASSRWLVLVLVTWSLELNRAAQKRDGVRPRAE

SEQ ID NO: 112303 - protein, 106 aa, Triticum aestivum
  unsure (1)..(106): unsure at all Xaa locations
  Clone ID: PAT_TA_6721.pep
ATRPSPATWPTGGPSSSPPPPPXPPLPPPPPLRPPPPPPPXPPPPAWPPRRPTASPPAPTGAAPPSGASPPSPXPATAPGPVRPGLHSGGRRPLSPSPPPGREPPR

SEQ ID NO: 112304 - protein, 206 aa, Triticum aestivum
  Clone ID: PAT_TA_6722.pep
VEAAVNRKDRHPRSHLLPNLEWGGGHGINWATLMWCEARDEMAHLVQRDRSDHDCYYGAYLQRIIWWQRPDLFQLPPEPGASHAQQALGSDQSASDEIQTLRSELLLKIHQVEVRSRQIDLALEKIDAASKAIDATSKKFDEISKQLDGRLKQLDARSEQLGVIPEPNIEHEGDAHALKQALAAKEKKRNDDLQDAWNARKVLMLA

SEQ ID NO: 112305 - protein, 278 aa, Triticum aestivum
  Clone ID: PAT_TA_6723.pep
MAQQLLLLLPAPSGTFSKPLPSPAPSMPRRHVPSISITRRLVAGVAAARRDLLRCGMRRSDLVSELELAKDKKQQGGSANAIFWILLLNFGLYVADHLLQIRQIKALYLYHAFPSWYQFVTSTFCHANWNHLSSNLFFVYIFGKLVEEEEGNFALWMSYILTGAGANLISWLVLPTSSVSLGASGAVFGLVAAGVLVKMSWDWRKILEVLILGQFVVDKVMEAARATTITGAALQVNNIAHVSGALIGAALVFVINRIPLSSIDDNPKASKDNKDKRS

SEQ ID NO: 112306 - protein, 76 aa, Triticum aestivum
  unsure (1)..(76): unsure at all Xaa locations
  Clone ID: PAT_TA_6724.pep
EWLVGLACRCMMWISVGESHWLCXRAESNRGGYVHLIDSGHGDGSIRLVMCIEASILKEFKRLLYAKFESMVYSKF

SEQ ID NO: 112307 - protein, 202 aa, Triticum aestivum
  unsure (1)..(202): unsure at all Xaa locations
  Clone ID: PAT_TA_6725.pep
MATKQPPPSSSTSGAAVSMKDYLKRYQSGPAAAGDQKKAKKKKKNPKPSAGGVLIVDEDPVWQKPVLRPEGGPSAGDEXPQVDEDIEVKRMRRMEAIRAARPYNSIANDGSGWVTLPVPEPAGSGSPRRRRNDTPSPERGGGAAGRKEDLSPPRRRQRRDTPSSKRGGAEGSDXSPXRXRQRRXDTPSPDGKGTGEGGDVTA

SEQ ID NO: 112308 - protein, 147 aa, Triticum aestivum
  Clone ID: PAT_TA_6726.pep
HASEAVKPTQGHTTAGLLVLVHRAKEENVLGSPSLPATTFLLPHPPSSPHKQTNQQTFLLLPLLLRRHHWSSTSLPHLLLPGPGRSIPSLSRDLGRKNPGVIRRVGLVRYHSYPKVRRPFFSASPEVAGISPLLLTSGCAISCRLSA

SEQ ID NO: 112309 - protein, 144 aa, Triticum aestivum
  Clone ID: PAT_TA_6727.pep
IHDKVSHPLPPFTREAYMAPTLLALLASVSCIGTVLPNKAAITLTCCSRRRESSKSLSSWTATSSTVRSSGTKPSALSSTFSTGVAFVVQVGADRFVARVVRLGVKGSDYGRSVAACTSFSRGGASFFTMLEQKLLSRANAKAS

SEQ ID NO: 112310 - protein, 101 aa, Triticum aestivum
  Clone ID: PAT_TA_6728.pep
SFVHPVPRSSCPGPNCHIMHHCTLNVALLISCSSFLAGSDYSMASIPQVLQASRTNTICPIFNFRFAVTGNLLHALLHGLLLLHKVQLVTLQSSMNSKTWM

SEQ ID NO: 112311 - protein, 70 aa, Triticum aestivum
  Clone ID: PAT_TA_6729.pep
YGLLVRSNGSRELLNILQKNHSRVLKLHARTTTPQMPSDLRSNGTEARTTVAYEDRYHLIVSLLWSSVER

SEQ ID NO: 112312 - protein, 88 aa, Triticum aestivum
  Clone ID: PAT_TA_6730.pep
MSGRRSRGSVSEEEINELISRLQTLLPTARRRGSSSRQASTTKMLKETCSYIKSLHREVDDLSDRLSDLMSTMDNNSPAAEIIRSLLR

SEQ ID NO: 112313 - protein, 303 aa, Triticum aestivum
  unsure (1)..(303): unsure at all Xaa locations
  Clone ID: PAT_TA_6731.pep
MRLPRRGARPGLALLALALALALAARGADASIHEYSGGGFAPRANSFFFHGGSEGLYASESSSNSSNSFIRFDIVTFRRSQEXQAAXHEEMQQKTGLVEAIIVEIQDRDKIGGSYLHSDALCCTPELDKEKSCKVGEVIIRPNPDNPDWPKRIQTFFDGKNEETTMGTQSVSINKTGMYYLYFMFCDPQLRGLKITGRTVWRNPHGYIPGKMAPMMTFFGFMSLAYLALGLLWFLQFVRCWKDILQLHYHITAVIALGMCEMAFWYFEYANFNSTGTRPMGITLWAXTFTAVKXXVSRVLXXX

SEQ ID NO: 112314 - protein, 157 aa, Triticum aestivum
  Clone ID: PAT_TA_6732.pep
MNPGLKTATRDDENVKKVLVTGGAGYLGSTMVPMLLDEGYDVVVYDIFKWGVYPLTPVVGNPRLTVINADILDTDKLEKALKDVDAVIHLAAIVGYPACSKEPEVARQVNVKGTRNVVNALLPHQRVIYASTGSCYGAVDGTCTEETPISPITLYGK

SEQ ID NO: 112315 - protein, 153 aa, Triticum aestivum
  Clone ID: PAT_TA_6733.pep
MTSMISTDDAAATSHVDAPVQVATRDHGEAADVDGKGAASAEEQEQAAARRDVFLLAGIRKLIKSFRSLSHIFELYKDEEDEDDDIQIGFPTDVEHVAHIGLDGSSSVASLRGMDGARELLSLSTNISLQQFEFAMASIAAHDDRSAAIAASP

SEQ ID NO: 112316 - protein, 126 aa, Triticum aestivum
  Clone ID: PAT_TA_6734.pep
RGHQPHPHSDSQRQATSMAKITFALLLLLLCPLLAQSHATTTFKEISFQLQNQSFVELDESLQRALPLRQPPPPRSAVLDAEADAVKEGVLILVQALAEGLNGRRGLLSFHNNGEDEPMAASQTVA

SEQ ID NO: 112317 - protein, 142 aa, Triticum aestivum
  Clone ID: PAT_TA_6735.pep
TMSVHGVFLAAPATVLGQSTMSMTLISGPSAAMHMTLAMVTRTRRRHWDRPAADAAYGSDCHANVQPARLHCTSCREDGSGCGCPASYGHGYGCPATARQHQEARVCWARFGPPGQRVAPEHVNLELAAMSLRSTGLVDPEA

SEQ ID NO: 112318 - protein, 110 aa, Triticum aestivum
  Clone ID: PAT_TA_6736.pep
VSCLAYTLSAVLNYGANSLSKYPETEHQPARKAAWGTQDRRSTRRPNGTCRSSKSHHEMIGPLAEQAPPRAGRVMRMIKPETTVHHRKDPAAYSIKCLPLLLSVFINQTV

SEQ ID NO: 112319 - protein, 92 aa, Triticum aestivum
  Clone ID: PAT_TA_6737.pep
RKRDKRSYSRENCRLSIQDHTAYSRFHKLSVLRRSKHEHHLGLPLTSFYSSTNLFCCLPFTVQQQQQQQRTSPSSCMPVLLILSLRWLSVPL

SEQ ID NO: 112320 - protein, 142 aa, Triticum aestivum
  Clone ID: PAT_TA_6738.pep
ERNAPQHGTARTTPVLNSTYKRELKLQYQMPNHHHVLNTIPHELESPSSFHSLLVSPDDHQINVHHAQHHHVQLIDHAVDDQAATDWRVLDKFVASQLSNDAAKGVDYAHEGDILQLNEKAQELATDYASTSTSSSQVDPWK

SEQ ID NO: 112321 - protein, 85 aa, Triticum aestivum
  Clone ID: PAT_TA_6739.pep
PRVRPNIVVMVGESGDSDYEELLGGLHRTIILKGDFNIAANRIHTVRRYPLQDVVALDSSNIIEVQGCTTEDIKSALRQIGVPTQ

SEQ ID NO: 112322 - protein, 500 aa, Triticum aestivum
  Clone ID: PAT_TA_6740.pep
MRRGCSARSVRLQIPAMGHALGHYRAGRHRGGRRQNIPSPEVPLAGCRCTGRLLTSVLTRMDEYDLYGQVAYPKHHKHSEVPDIYCLATRTKGAFVNVAYFEQFGVTLIEDAMNGLPVIATKNGAPVEIHQVLNNGLLVDPHDQNAIADALYKLLSEKQLWSRCRENGLKNIHQFSWPEHCKNHLSRILTLGMRSPAVGSEEERSKAPISGRKHIIVISVDSVNKENLVRIIRNAIEAAHTENTPASTGFVLSTSLTISEICSLLVSVGMHPAGFDAFICNSGSSIYYPSYSARAPSNSKVTHVIDRNHQSHIEYRWGGEGLRKYLVKWATSVVERKGRIERQMIFEDSEHSSTYCLAFKVVNPNHLPPLKELRKLMRIQSLRCNALYNHSATRLSVTPIHASRSQAIRYLFVRWGIELPNVVFTGGDWGVCLYGELLGARHRPIILKGDFNIPANRIHTVRRYPLQDVVALDSSNIIEVQGCTTEDIKSALRQIGVPTQ

SEQ ID NO: 112323 - protein, 252 aa, Triticum aestivum
  Clone ID: PAT_TA_6741.pep
MAAAAAARKTAGVLALFDVDGTLTAPRKEVTPEMLEFMKRLRENVTVGVVGGSDLVKISEQLGKSVITDYDYVFSENGLVAHKDGKLIGTQSLKTYLGDDQLKEFINFTLHYIADLDIPIKRGTFIEFRSGMINVSPIGRNCSQEERDDFEKYDKVHNVRPKMVSVLREKFAHLNLTFSIGGQISFDVFPQGWDKTYCLRYLEEFKEIHFFGDKTYKGGNDHEIFESDRTVGHTVTSPNDTVQQCKSIFLSE

SEQ ID NO: 112324 - protein, 159 aa, Triticum aestivum
  Clone ID: PAT_TA_6742.pep
NTQIRSLSLCCGREKPALLCWRSQTRDLDKGNKLGVAGRRSRRVACAGGVRHARSSQSSDRFNPKAPDWTKRLRLGSAPPDRMPCPSRMSAQEKSIRKYSEEPTQSVITPELGISFDSLGDGYDFYTLYSCEIGLGVRYGKNRLNAERTKSAREIVCGC

SEQ ID NO: 112325 - protein, 217 aa, Triticum aestivum
  Clone ID: PAT_TA_6743.pep
MGVSPVSPGGSAGYECSFKILLIGDSGVGKSSLLVSFVAAANLDDDIAPTIGVDFKIKFLTVGGKKLKLTIWDTAGQERFRTITSSYYRGAQGIILVYDVAKRESFTNLGDVWTKEIDSNSSNKDCIKMLVGNKVDKDDERTVTREEGLAFAQESGCLFLESSAKTRENVENCFEELVLKILEVPSLLEEGSSSVVKRNILKKQQESHAKYGGRCCQ

SEQ ID NO: 112326 - protein, 138 aa, Triticum aestivum
  Clone ID: PAT_TA_6744.pep
MSWCCLPRAKKQQQEKNLYFHRQQENLNSQTSISGISAEKNIRLFSYAQLKLATNNFDRNNKVGRGGFGTVYKGTLPNKQDVAVKVLSAESRQGIREFLTEIDVISNVKHPNLVELIGCCVEEENRILVYEYLENSSL

SEQ ID NO: 112327 - protein, 239 aa, Triticum aestivum
  Clone ID: PAT_TA_6745.pep
GEGPPGEIEAPVPPPSRPPPPPPPFPPRPPPPAPPSAGGRRGPPCAAAPSGPPPGSAAAPPPSPPKRSSSLSTHSGEVALPGGKADEGDADDAATALREAKEEIGMDPCLVTVVTSLEHFLSKHLLVVVPIVGILSDIEGFKPVLNIDEVDDIFDVPLEMFLKDENRRSEERERMGQVFTIQYFDYEKENRKYVIWGLTARILIHAASIVYQRPPDFVERRLQFNLPKYSISSSGSATS

SEQ ID NO: 112328 - protein, 60 aa, Triticum aestivum
  Clone ID: PAT_TA_6746.pep
ALDLQGAKILSASKGLRFSQLIKLNHMTSLCLLLPKKSHLALPLLFFWICSTKRASYDFS

SEQ ID NO: 112329 - protein, 630 aa, Triticum aestivum
  unsure (1)..(630): unsure at all Xaa locations
  Clone ID: PAT_TA_6747.pep
SGEPREHHRQAAGAPLRPAPALHQESASCSSGSVPHLVSLLDSILQGELPCDVXKTNSTYSILALLRVLEGLNQLSPRLRAQAASVDFAEGKIATLDELYETGTKVPSEEFVNSKLTPKLTRQMQDVLALCSGSLPSWCNQITKACPFLFPFETRRQYFHSTAFGLSRALNRLQQQQGDNPNNTGSEREVRFGRLQRQKVRVSRNRILDSAAKVMEMFSSQRAVLEVEYFGEVGTGLGPTLEFYTLLGHELQSARLGLWRSSSPYDYSEMEIDKNGVIHVDSDDDLPAPQELNSSEDARNLIQAPLGLFPRPWPSNADTSEGSRFFKVVEYFRLVGRVVAKVLQDGRLLDLPLSTAFYKLILGQELDLFDIISFDAELGKTLQELQVLVERKRFLESTCGKDQLEVADLRFRGAPIEDLCLDFTLPGFPDYILKEGEQNTIVNIHNLEEYVSLVVDATVKSGIMKQVEAFRSGFSQVFDISSLQIFSPQELDYLICGRQEIWEAESLVDNIKFDHGFTAKSPAIINLLEIMSEFTPDQQHAFCQFVTGASRLPTGGLAALSPKLTIVRKHPSSGVSTLNTSGVTDAADDDLPSVMTCANYLKLPPYSTKEVMRKKLLYAILEGRGSFDLS

SEQ ID NO: 112330 - protein, 219 aa, Triticum aestivum
  unsure (1)..(219): unsure at all Xaa locations
  Clone ID: PAT_TA_6748.pep
RHEVKVERAAVEXATAEARERAIEKAKAAADAKERIEKARVPFKDSFKVTNQDNQFQKTASNDHGRSTDSCNQASEFESALRHKARSERHQRTAERAEKALAEKNMRDMLAQREQTEKHRLAEFLDPEIKRWSNGKEGNLRALLSTLQYILGSDSGWQSVPLTDLITAAAVKKAYRKATLCVHPDKLQQRGATIRQKYICEKVFDLLKEAWNKFNSAER

SEQ ID NO: 112331 - protein, 247 aa, Triticum aestivum
  unsure (1)..(247): unsure at all Xaa locations
  Clone ID: PAT_TA_6749.pep
ARSNVRKHITDWRVWNSSKVVFQYLKTLSSNVATFQLKRGLQWSHLTHLKLTHAKDNHLVVVTKNQSHLGNLMVMIKKQRHLDHLMVMVVMTSRGIIMMVKKTTRMIMIATPYQVKLVLIGPSRAMSAYADGWLIEVDVPPESSLLPENHATKKIAGGVFKMSLDLDDDFLDKPRTSIIFARGGFVHFTYVVFNNAVKASVTFMLHARCQDNLQFVCHCKVQGELTLHVGNLPIGCTVFINQVRXSR

SEQ ID NO: 112332 - protein, 235 aa, Triticum aestivum
  unsure (1)..(235): unsure at all Xaa locations
  Clone ID: PAT_TA_6750.pep
SARGNSXMIPNXSYLGQANKLGNMPCPMFARIYLENANAVAKNRKEDDYLILIPQASIFALVLQALKLPPAIYRRKICLGNMHCVTVTFNSSLELFDGLLVPTSISGMISNNYEDAEDSVAIEAIRYMENAYGKEITDYNYNHAKKLQNQVTHLLRLPANKTIKKIRRGWHYAVRYMDSYSAQIQNTAAARRFRGQDNTRGVMKKALASIGKLAKRLRYIGMKSEQRLETTNSIW

SEQ ID NO: 112333 - protein, 104 aa, Triticum aestivum
  Clone ID: PAT_TA_6751.pep
GRIGDSPLIGAGTYAGGHCAVSCTGEGEAIIRSTLARDVAAVMEYKGLPLQEAVDFCVKERLDEGFAGLIAVSGTGEVAYGFNCTGMFRGCATEDGFMEVGIWD

SEQ ID NO: 112334 - protein, 105 aa, Triticum aestivum
  Clone ID: PAT_TA_6752.pep
FFFLAIINKLFFLLKKGSTTHEQIRSPGSGSSSSTHTHPCRRRARAMGTVTQLHRDRGRRRGRRPDQTRRTLRYTRPDQTRAQAGICFRPSPLPFPKPPPPHRPA

SEQ ID NO: 112335 - protein, 75 aa, Triticum aestivum
  Clone ID: PAT_TA_6753.pep
TTGTGTASVDTGSRASPSVPMPPVPKQSHNLPVLLYCYACVHDSWNHLYHWSSYIFCLTSTSCVRRKNITVVLPP

SEQ ID NO: 112336 - protein, 198 aa, Triticum aestivum
  Clone ID: PAT_TA_6754.pep
MAKARKQKPEGGAGGGPTVLHQKLCLSIDMENQLIYGYTEMKVLLAENDSFALHADSMTIRNILVDGEAAEFEYSPHWRSVDDQSSWLSVSCLKTAADAACSAYVSSLTSEAVPNLIISSERSVKSTTELPGNENCEKHEGIGGKHVQFSDDKAVKICNGSTEENGKEEEKENKTEDGKDNDKEEKTEMEVETEKEKE

SEQ ID NO: 112337 - protein, 216 aa, Triticum aestivum
  unsure (1)..(216): unsure at all Xaa locations
  Clone ID: PAT_TA_6755.pep
SVLLCIAGTIIVSLADSGSTLNAVATNPLLGDFLSIVSAGLYAVXYITLIRKKLPDEKEGQGQVSMAQFLGFLGLSARGFFLPVALVLNFAKLEPFHTLTWEQVGLIVGKGLLDNVLSDYLWAKAILLTTTTVATAGLTIQVPIAALVDTLTGHAPQLLNYIGAAAVLVGFAGINIPSNVLQPSHHQQDQQEAPIVSIVDDSHHSPSDRNSTDAVS

SEQ ID NO: 112338 - protein, 124 aa, Triticum aestivum
  Clone ID: PAT_TA_6756.pep
NLEPRVPPSPLSPPALPRAATASPSPLSPPRPESFAPPLRSGSTTATASPSPLSPPRPESFAPPLRSGSTTARMRDRGGRGDAGQPHASPPARVEALDSGKKEPSLCFFLSSPQAALLDRARDS

SEQ ID NO: 112339 - protein, 343 aa, Triticum aestivum
  Clone ID: PAT_TA_6757.pep
LPIYQSMVPAIPAYNTPKCSGELLVRVVCPGDKIGLVIGKGGMTIRNIRKESGASVDVDDAKNDKEESIITISSTEATDDVKSAAVEAVLLLQAKINDETEDRMHLRLLVPGNVIGCLIGKGGSIINDMRSKSKAIIHISKGTKPRKASSSDELVEVFGEVDKLRDALVQIVLRLREEVLKDSVGRQNSAKDGKLTVATTEPMYSSSFPMPALLPYSQQVTPLRHDQRGEAERGSNVLPRSSLYHGYSPRQAVDDGFGVRSSYTSKPYGRRVPDMEMFIPSSGLSKVMGKHGTNLDNIRKISGADIEIIESKSSRHEHVANIFGTPEQRQSAENLIKAFIMST

SEQ ID NO: 112340 - protein, 216 aa, Triticum aestivum
  unsure (1)..(216): unsure at all Xaa locations
  Clone ID: PAT_TA_6758.pep
AKLKPXLVASEKSFGCGNAKVPDNISSQMAHKKLEHGGAQKHISLHAAPQTMLKQPNKTSSTVKAPKQHKFEDFRKATVQPAAPQSKLKQPNRAASERQKTRSKTKSCAGKKEYVCFSLWQNFYEPECSSGSDEPLVNKRSVRRKRERERAIQITYSRSRKRGTSGISSIKAKLDEEISSGHLEVIVIDDEVMTEAPGEQCKATSSMHERSCRPAD

SEQ ID NO: 112341 - protein, 104 aa, Triticum aestivum
  Clone ID: PAT_TA_6759.pep
MKGSGTAVVLILSLAVLLVLGAAVADDAIIRLHSDAVTEETRPWDCCDHPVCTKRSWCGCKDVVDQCFPTCKNCKPAKRADESAPSGYMCRETYHGSPGPKCML

SEQ ID NO: 112342 - protein, 52 aa, Triticum aestivum
  Clone ID: PAT_TA_6760.pep
LELQHALTCCKAVGPQHLTPLNRTILLLKCFERCSPSSSAADRGSHLASSIR

SEQ ID NO: 112343 - protein, 220 aa, Triticum aestivum
  Clone ID: PAT_TA_6761.pep
HEDVQYVLLHSAAYGRYLGATDAPAPRGHSGRRVEQRDYEPWEEMAIRWQAVRIGSGDDVLLRHVAGRLRANGRHLSVDAFNSAGPMMHWVVERIPAREDTPRLAAPTGLRLPRSLTFLLPWRVIQYEQAGADEPNANFAWPSLLFRGRSVFHLRKKLARRLDAAMDASNLVMCVRAGTHGRPTPLLVDLPHRDETLDIIVVMAGTPAHAELRYPDVNAE

SEQ ID NO: 112344 - protein, 97 aa, Triticum aestivum
  Clone ID: PAT_TA_6762.pep
DQVADELSLLILGANRLQAMLPLHDDKLQYLMVEWRPIGVLVMAGSFLSSRLLYQKGGSYVASTWRFKTLPPAARRWCSSHPSALVSSPAAAGLGQS

SEQ ID NO: 112345 - protein, 156 aa, Triticum aestivum
  unsure (1)..(156): unsure at all Xaa locations
  Clone ID: PAT_TA_6763.pep
RRRGRGIPSLATIEEDPGSRGEVRRDLEGKEALPNPPPRPSATPWPSPAAPDPASRPPRDPWPQPXPPPPHAPAPRAATMPAPPPTLPGRAPPAPERPALPPASRIEPPHTQDPKPDPPPTNPPDHACALTTHPRTMPEICPWPQSRQRRKEGEEV

SEQ ID NO: 112346 - protein, 217 aa, Triticum aestivum
  Clone ID: PAT_TA_6764.pep
GPPPPPPPRERARLPSFPPPPPPPPPPPPPPARPTFFDPKLWLPWRHSDHARDTPPEPALTKPPATAERKPWAPPAIVPGPRTAEPEPGPPPLPPPKQSTATLPQPKSPPLSDIPIGVSSPSPPPPPPPPRPPSHRLPEAKARTKKKHRKVQDEDGKVRLPLLEEMTKQEEKKMEGKKAREAANGGRQPAEHNMEVSPKLLPASEDPGTTPATELVT

SEQ ID NO: 112347 - protein, 110 aa, Triticum aestivum
  Clone ID: PAT_TA_6765.pep
RHEASRLSERDKLAITLYNEKPRYSTDVPRLCYANWVTEALLKREEEKGSVSVLELVLRVWMDFLFYTANRCSRESHAKKLSSGGELTTILWLMADYFHKHTVLNAPEEV

SEQ ID NO: 112348 - protein, 243 aa, Triticum aestivum
  Clone ID: PAT_TA_6766.pep
NRITSFFSLSCSSHMPRWHRRGRGWPLDTTASERQKRTAWGNHQTSQATSPKSLVGEKQPDRRKKIAAARLHQAFLDGVRAGGWIPVDGAGATAIVGGGRRAPGCRRHLIRGVRCIWPEEGAGGRCLAKEVGRSASGTHGLQGKEGSSSGPEREGLRSAGSVPHRWRPSSSAATEVKYVAAHVAAVGGGGWEAWGSSPVLLSQESGGDRWWHRPDPLSVPRWSPAGSEAERPPGSEVGVGDEG

SEQ ID NO: 112349 - protein, 72 aa, Triticum aestivum
  Clone ID: PAT_TA_6767.pep
NDRCRHMRHQELPMISELQESLHDIARVPIPPTLPHWLFSWRSLFSDKLMSWIKLVHRLMTVSHGDEKERYQ

SEQ ID NO: 112350 - protein, 166 aa, Triticum aestivum
  Clone ID: PAT_TA_6768.pep
RNSARGGRHESPPLPLKLARRLPTSLAAARGAPPLLQRHLHADSALPPQAPPPFASRILQSEESPDPSTDLEHAQPAPDPVLDEFLARLVTALRPTLAAAFPTHTRPVLDEMLRLIAEAVLNRLSGADPGPDTVELSDDLWAAVWEVSASVREAMRRDQVRADLRN

SEQ ID NO: 112351 - protein, 90 aa, Triticum aestivum
  Clone ID: PAT_TA_6769.pep
FFFNKESSCFKSCIDAHIPPPLPKQLVLSLMLEPRASWTCGNYNLFSILCSSPADHLRGRRAPAGRGDAGLRCGMGRRRREWWWRQSNDR

SEQ ID NO: 112352 - protein, 87 aa, Triticum aestivum
  unsure (1)..(87): unsure at all Xaa locations
  Clone ID: PAT_TA_6770.pep
XAXNSARGRRLHPYMXILFRCCLLVSTVSRRGRNLTEQHCILLRSEEQKTGSFRFQPCRLLLAKSLVEEIHIGENTLWTMVVITPDK

SEQ ID NO: 112353 - protein, 80 aa, Triticum aestivum
  unsure (1)..(80): unsure at all Xaa locations
  Clone ID: PAT_TA_6771.pep
RHEAXIRAVATARMGSRAPAIWQGWSDDAWCIVLNVVVCTQHRYVWAQTSWRNGDVKHNRGESVQDSNVPSVQVRYDCSC

SEQ ID NO: 112354 - protein, 79 aa, Triticum aestivum
  Clone ID: PAT_TA_6772.pep
EAKALPRQSTPSGCTASEQQWLMRVAATIGSAPATRKRRTAQTAVTMTPKKMEVSEVSKSMRMRSSFGISHSFSFLRFS

SEQ ID NO: 112355 - protein, 213 aa, Triticum aestivum
  unsure (1)..(213): unsure at all Xaa locations
  Clone ID: PAT_TA_6773.pep
PRVRQLSFLHSFILSYPRPLSGMGNFASCTLARIPGAAKGARVVLPDGGLRLVRPPATAAELMLEAPGHFLADARALQAGRRIEALAADDDLELRGVYAAFPMKRLGSKAAPTDLARLARRFREGSSWAETASAKVAAIVVAPPEVASVAAEADSPRWRXRLDEMALTTKQLPRSLGTKQRITGXRXPSGNDLENIHXESTRISKAKVKWQLT

SEQ ID NO: 112356 - protein, 154 aa, Triticum aestivum
  Clone ID: PAT_TA_6774.pep
DIRDKMPPRAFLPRDIARKIPFELNAVSEVFRVPLDTAMGKAVASTVAECERAPSQGETKRCATSAEDIVDFAVEMLGSDIVVHSTASTAGSGADIRLGNVTGVHGRKVTRPVSCHQSLFPYLVYYCHSVPKARVYEADITAADSGQNTGRAAT

SEQ ID NO: 112357 - protein, 68 aa, Triticum aestivum
  unsure (1)..(68): unsure at all Xaa locations
  Clone ID: PAT_TA_6775.pep
KKTGLFESFKSDLTLICLNNIWHIISVPQYKPGREIPGTAKQSLKQLDTIXSESSPPSSTLVPNXLQP

SEQ ID NO: 112358 - protein, 229 aa, Triticum aestivum
  unsure (1)..(229): unsure at all Xaa locations
  Clone ID: PAT_TA_6776.pep
AGVLYTTIPDAGGFRHHLAGAYAEGLDLDTSLTFLPHTEYRYFGLEHACNGLLLCSYYPDAGSQVRFVVCNPATRRWAELPPGPQPRPNTCGFHCQFHLAFDPAVSSHFHVFDFERTDDVGLTGVSIYSSRTGXWTRRDTGLLDNVVLEHHSVLLHGMLHVVGNRRRTNSNNTWEDTTVLVAVDMEGKVWKTISMPRGQFYYRVGWSQGCLHYATISPVPLTASNDDDE

SEQ ID NO: 112359 - protein, 165 aa, Triticum aestivum
  Clone ID: PAT_TA_6777.pep
MPVCPSCPDLLPSSRFFGPTKQRPKPNAPAPAPTTFVPPAKPARWSPHATASQTPGVPPSASISSSAVRDRGASSAHHPPLRSSCAVHSEEPPAVLLPPPATRVPPDLNRFKGHGMLAPFTAGWQSNGVHLLVIERSKGSYVYDINGNKYPDSLAGLWCTTLAAE

SEQ ID NO: 112360 - protein, 163 aa, Triticum aestivum
  Clone ID: PAT_TA_6778.pep
IWLVVYFQWYGFRRPRAVQSEEEQGAGEGSRHCRLWSFATHIVVRIKDLVLWIENLRRFVDSYPISFLHAGLQIPLLEGVDESPTPIHLDVHGAVVLGAVADSHPSPFSSGDQAPSSALSAEAQIWKEERGERVRCEGSPQASELFTGKMNPHAPGWAKRCVQ

SEQ ID NO: 112361 - protein, 106 aa, Triticum aestivum
  Clone ID: PAT_TA_6779.pep
ILTTSHGSSSPSFRPVFKSSSYYWPFATSITNPAVRTSFRSSSPPSHSIKNSLICVTGTAYTDACEAPASTPTTLSIRGKIRGEPDAPCLDVQLQVSDTSSGSVVI

SEQ ID NO: 112362 - protein, 179 aa, Triticum aestivum
  unsure (1)..(179): unsure at all Xaa locations
  Clone ID: PAT_TA_6780.pep
RRRPAGAASSAPPSPSSSSSPAPGPRARSPPRLRGLLKALVAPGALGLRAALWAAGATPRSRRWLMGTCSVNSVTLPNGKSLXVFVEKCKYLEESKCLGICINTCKLPTQTFFNDHMGVDLYMEPNFEDYSCQFNFGVPPPPIDTDKALKEPCLDICTNARRRRELGSSGGPDGLCPQV

SEQ ID NO: 112363 - protein, 51 aa, Triticum aestivum
  Clone ID: PAT_TA_6781.pep
GSGLRSGTLVMFSLTTAFDHICLTETWLRCEEDSAFWSSFVSSCSYIMFWI

SEQ ID NO: 112364 - protein, 232 aa, Triticum aestivum
  unsure (1)..(232): unsure at all Xaa locations
  Clone ID: PAT_TA_6782.pep
RSGARQPPMPFQLHLLPSRIGLFSSISAMSSSRRASRLTRASRPELSPAESAREVKREPGVSFDYSKSEMNSVKRKRLNRVLEVKEDLPKKQVGIVPDIEEFRYVKTGAKMSVTAKRVPASLNKNSSPGVKEVKCEPSVSFDYSKSEMNSVERKRLNRVLEVKEEHPKEVGAVPDIDDFRYVKTEARTSVSTKRVPASSNKNSSPVRLEKKIRVSSVVKVEVAAXENWEAVL

SEQ ID NO: 112365 - protein, 128 aa, Triticum aestivum
  unsure (1)..(128): unsure at all Xaa locations
  Clone ID: PAT_TA_6783.pep
FFFDTNKKKHILFPSIYTSALASPWXISHALHPAXASLPLAMGSIALQDLDQTLVPPARTTPRSPFRVAPALYLTRLKAKLCLSHPLSISPSPPYAWHGMGCVAAGXPPAAPLLAPRCLFPGIPFHFP

SEQ ID NO: 112366 - protein, 226 aa, Triticum aestivum
  unsure (1)..(226): unsure at all Xaa locations
  Clone ID: PAT_TA_6784.pep
ALVLRRLRPTPFSHPRSLRPLSTPSPRSSSARPALHPSPGEGEPGGASATAPWMAPSTSSRXSSRGARAPRPRHLASVPARPRRSPAPQPEQDPVALSFLCPSIFPPLQLTSSSLPLSVRTDAAMDPAPEQRRLRPRAPSXFPRLRQPXPPASAPSHKGAPPGSPSRCNALVSSPSPLLHLVPGAGKTAVTPWPSSSHALLLVGDHDQPRPPATLPSLNVPGQEQF

SEQ ID NO: 112367 - protein, 76 aa, Triticum aestivum
  unsure (1)..(76): unsure at all Xaa locations
  Clone ID: PAT_TA_6785.pep
NQYGQDPDLTSLLPASLSLAHRGIKLVAFGSASRVCHSLPNPLQCHPPPPRSPSMVAAGIPRNRELDRAPIXVIAA

SEQ ID NO: 112368 - protein, 95 aa, Triticum aestivum
  unsure (1)..(95): unsure at all Xaa locations
  Clone ID: PAT_TA_6786.pep
NLEFARRCQAHLLTTLRLKHGLVGGFDGVALHCRWFSEEYEGATNNHILVIGQXLCRRITXLQPXLRLPFVHXSEQSIVXLMXGTMHVCSRSSNQ

SEQ ID NO: 112369 - protein, 44 aa, Triticum aestivum
  unsure (1)..(44): unsure at all Xaa locations
  Clone ID: PAT_TA_6787.pep
VLSTRTETYALMHIPXRWPWGYXLEATVFLMCSLDGLELLLFLS

SEQ ID NO: 112370 - protein, 99 aa, Triticum aestivum
  Clone ID: PAT_TA_6788.pep
HNPPVGRSPSLWVRLDFGPKGAISGATDGKLGWHQYLETAVAYFQDPWRLYTVMDVHISRERRGLALFAVYRLEVPCIYKEIRVMRLPSLLNKGEFLVS

SEQ ID NO: 112371 - protein, 159 aa, Triticum aestivum
  Clone ID: PAT_TA_6789.pep
SLARGGQGGRGAEAPPPDGPPRRKPSASSPRPVLYYAVLAASYFQEPQGQGGGRATAASIPVPRRARRWARRPGRAPARGGRGGRPGCRRASGRRRGRGGRPARGRRPTARRGRASRRRGPACASGELLSPPMSCSVLGGAAGGRAGAAGTPSARGPCR

SEQ ID NO: 112372 - protein, 273 aa, Triticum aestivum
  unsure (1)..(273): unsure at all Xaa locations
  Clone ID: PAT_TA_6790.pep
XXSXXGRRKQIGGAGGGRGRTDRLGLRVWSSARAPINMGPEAPELQPNPVDPAGRLVLEHSSMAIADVNMGLQAPELLSYHINRARPFYDEKWKSMNVGKKKTKKMIFRVPQHELDDILSYQVPAWPKVDKRYPSAAIEMEKMKEYFLAGREKMRREYEAHGYATFEAEVTDDEKEEDAAATTPHEEKDDNAAATSFHDKNDDAAATHIHEEKDDVPATSFHDKNDDAAATPTHEEKDYAAETSSPWIIPRGRGRRRFRPGVVKQASGVKKIT

SEQ ID NO: 112373 - protein, 159 aa, Triticum aestivum
  unsure (1)..(159): unsure at all Xaa locations
  Clone ID: PAT_TA_6791.pep
PDEVRGEIGPHFNDRSAITEEQGEKLAKPRNKVVDPANKQFIRKGLTPKWGDLDVNQHVNNVKYIGWILESAPISILEKHELASMTLDYRKECCRDSVLQSLTNVSGECVDGSPDSAIQCDHLLQLESGADVVKAHTTWRPKRAHGEXGNLGLFPVESA

SEQ ID NO: 112374 - protein, 313 aa, Triticum aestivum
  Clone ID: PAT_TA_6792.pep
TPYLRPLALLRVQSTKELGTKSKATTQQEATPSRPHTLRGGPQRPKPKRKRATRRAERRKPPARRPETSGPAFSHTRPPARDGATNTHVPTQVGAAGGMRPRLRTVHAPQTGRGDQSPQGGARSHRHRDAAARMHGRSAQTRRASQQLREEGKETEPPPPHGAEASCFHFYYLEVSRLHIVLLGADDPRPPQRLAGHAPGRALAGPQGVGDLGLRMSWRFAAATQASPSSLRVKGDGLGVGSSQVSNSANPSQLKICSSPETEPCSLGGEAVPLEAEEELRVNDISADQAFKAEGLKRVLEAAVEPGGGSTLM

SEQ ID NO: 112375 - protein, 126 aa, Triticum aestivum
  unsure (1)..(126): unsure at all Xaa locations
  Clone ID: PAT_TA_6793.pep
RXSPAESSFLNLMTSPVKRLSFEFDDSEEEDLYLQGICKMFLDLIISNQALEATGDGEAVLIDAAIPSESYKTPESKPLLTGIADTCPDAPLRPSLKMIKLSPGICRKLDFGSVSPKTLFAEDNKS

SEQ ID NO: 112376 - protein, 327 aa, Triticum aestivum
  unsure (1)..(327): unsure at all Xaa locations
  Clone ID: PAT_TA_6794.pep
MLCSGRMLACSGLSPGRLRPPRAYADRLRPPLPARRWRVAASAAAPGGSPDLPSSSSTPPPFGAGDDQAAAAAAAAPSSSSGFCIIEGPETVQDFDKLDLQEILDNIRSRRNKIFLHMEEIRRLRIQQRIKNAELGISNEEPEGELPDFPSFIPFLPPLSAANLKVYYATCFSLIAAIMVFGGFRGPILGLKLGIGGTSYADFIRNVHLPMQLSQVDPIVASFSGGAVGVISALMVVEINNVKQQEHKRCKYCLGTGYLACXRCSSTGAVVLTEPVSTFSDGDQPLSAPKTERCPNCSGAGKVMCPTCLCTGMAMASEHDPRIDPFD

SEQ ID NO: 112377 - protein, 254 aa, Triticum aestivum
  Clone ID: PAT_TA_6795.pep
PRVRIICFVALAQQFTYIILQTLTMDCHLGTHFEIPAGSVISISLIALTAFLPIYGRILVPIARRFTGVESGITLLQRQGIGLVISPISMVVAGLVEHKRRNSALSNGGKSPMSVMWLAPQLILMGIAEAFNAVGQIEFYNKQFPEQMLTLAGSLFFVTLAGANYLSTALANITRKVTTRDGHTSWLTDDINLGKLDYYFYFIALIGVLNLFYFLICSHYYQYKSMSLHAEESIKVHTKEEAEAEADANTAPKK

SEQ ID NO: 112378 - protein, 169 aa, Triticum aestivum
  unsure (1)..(169): unsure at all Xaa locations
  Clone ID: PAT_TA_6796.pep
QHCKLHQLPRRLGFKPHLLLGQSILKVRKEKLGDRITALHQIVSPFGKTDTASVLQEXLGYIGFLLGQIEALSYPYLGTWHWSIRYQDAQDGEGKKSDLRSRGMCLVPVSCFTSRLGADGAPAVSPPPPPLNAAIPPPAQPPVYSPRACVRKYIPLISIHVSIVDILHI

SEQ ID NO: 112379 - protein, 90 aa, Triticum aestivum
  Clone ID: PAT_TA_6797.pep
MCIVRSHISSSFLLLIFFPLTYYIYFLQIERILKILVHSFLLSKLKKESARTTSCVHFLFNFLPRESWFCKHSSSFKRAQKVQCILCQKK

SEQ ID NO: 112380 - protein, 109 aa, Triticum aestivum
  Clone ID: PAT_TA_6798.pep
TLDCDEFVTVSLHLKKMTNEKYLAAAFRYFDKDGSGFIEIDELRQELGPNEQAILEIIRDVDTDRDGRISYQEFELMMKSGADWRTRQFSRANFSTLSRKLCKEETSSS

SEQ ID NO: 112381 - protein, 474 aa, Triticum aestivum
  Clone ID: PAT_TA_6799.pep
MNYGPSDSSGTDDDLPPPYPNNPNNRSIRGSGRASGNGRAIVPVSGNGRAIAPASSYPRAQTDMETQIQQLEQEAYCAVLRAFKAQSDALTWEKEGLITELRKELRVSDKEHREVLNRVNGDDIIRSIREWRSTGGLQASLPNNPQPIHHDPAPSPTTSGRKRQKTSQSVPPLPVPSPPVMHPQQMATPTQPSSSAAKKGFLPGTKGKKTKPGQKIPGGPAVKSMPPSAGPSGRGPHMNRNFPGRPAAPEPSQGQHHLNPLIGRKVMSRWPEDNNFYEATITDYNAEKDVYALVYDINTANETWEWVDFKEIKPEDIIWQGEDPGLYQGGRGAPGSGGKKSTSRVMPTPGTGRGRGFPKNVSKKDFPRSQNGVGKRSSDDIDILHTESLIKEVERVFSVSHPDPLEVDKAKKALKEQEQSLIDAIARLAEASDGESDERNRGRRMGPYGGHPHQGNYADAMAVDGDHMVGGAAT

SEQ ID NO: 112382 - protein, 166 aa, Triticum aestivum
  Clone ID: PAT_TA_6800.pep
NEVKVSFQYCFQEKSLHSFTPDSLSYLKRSKNCHDQKTNSDNLNHRAKLTCQIAQSCCDRDNNLFLLELIFLWDRPKLLLRPGDSEPLFLLRSDKVAANGRVRADGLESKGFSDVCLSLCALYLSALSVPLLFLIFLLTKTRSVSIGTLSLPLCSLSLSSSSSIKP

SEQ ID NO: 112383 - protein, 159 aa, Triticum aestivum
  Clone ID: PAT_TA_6801.pep
MNPQAVLFDKVNHDGLPSEKKLKRPGFVSAGESYIVKANHFKLTYNETLCRYHVLIDPKPTSAGDVMIQLAKLYGQSRLGGRLPAYDGKKSLYTSRPFPFTCEAFKVTLPDQENILCGLPRGKRHFRVQITLDKVLFGRIDGEEFYQAFNTILHELFLG

SEQ ID NO: 112384 - protein, 167 aa, Triticum aestivum
  unsure (1)..(167): unsure at all Xaa locations
  Clone ID: PAT_TA_6802.pep
MLAGLSDLTLDSRPEVRHCALEVLFDLLNERGHKFSSPFWESIFHRVLFPIFDHVRHAGRDGLSSSGDDWLRDTSIHSLQLICNLFNTFYKEVSFMLPPLLGLLLECAKKTDQTVVSIXLGALVHPIEVGGHQFXSDGDWGNTTKXSLRDASYTTQPLELLNSLGFP

SEQ ID NO: 112385 - protein, 176 aa, Triticum aestivum
  Clone ID: PAT_TA_6803.pep
APPSRTRHPPPPSPEPAAAANPARAPPGEDPAGEDPAGDEAADGAAAAREPHGVHRRPPRSTDSGPDDGEEKTGGREDGREPKKNVATYKTHIFQVLIQVHLHIDLSYQAMSIVTSFINDISDTLAAEAAHLARYNTNPTLPSRELQTPVRLVLPGEHAKHAVSEVTNAVTKVSSS

SEQ ID NO: 112386 - protein, 208 aa, Triticum aestivum
  unsure (1)..(208): unsure at all Xaa locations
  Clone ID: PAT_TA_6804.pep
EQELARAAFRLADQMDRHPEPPAAPACQFHEESSVPACETMSCQNEQIRLTLLFCWTISALLHRILLPSSLSRRGVCSSGRRHAEAYSLQKARCAILETSYAVITFTKTGNSDPIARTFSLTFSSCCTSFVAPAWGTIIPGREPPRACLSSPLLEPSPVVRRARYWGSARACLLLGAARRLGKPNSNWSLPCGATXLEDGEPSCRIAC

SEQ ID NO: 112387 - protein, 150 aa, Triticum aestivum
  Clone ID: PAT_TA_6805.pep
EAKMRMVKTHSSEHGLAGESNEFIVVGWFQRIRCPTLHPLAQTRQAGRLCLPPAPTAIPRGAMLLPPPSMLRVAEPGMVRTRSWDHGLAGESIEFIVRAAARAGRCATLDVLVQNRHAGGLFFPQEDTIIPCGKIDQDTNCMLLLSEPEM

SEQ ID NO: 112388 - protein, 200 aa, Triticum aestivum
  Clone ID: PAT_TA_6806.pep
MTSVPELQATQAEMGSAGDEFTPLSQLQYGMDNCKVRVRISWLWESFNPKDDTLFGLDCLLIDDQGNTMQARVEPGDIERFEHRLVEGQVYVLSDFHVDSQRDYYMSCSNEWTMYIRRQTVVTEIEGDIDSIPLYSFEGVKFGERRSRCGSVCSSTDVLGHIVYVGELEEVSKKSRVIEICNARIRDLRGRALSVTLFGD

SEQ ID NO: 112389 - protein, 224 aa, Triticum aestivum
  Clone ID: PAT_TA_6807.pep
RHEGVMFHAKQDIIVSNSEDKSIRIWDATKRTGIQTFRREHDRFWILAAHPEMNLLAAGHDSGMIVFKLERERPAFSVSADTVFYVKDRFLRFFEYSTQKEVQVAPIRRPGSVSLNQSPRTLSYSPTENAVLICSDVDGGSYDLYIVPKDSAGRADYLQEAKKGAGGSAVFVARNRFAVLEKSSNQVLVKNLKNEIVKKSPLPIATDAIYYAGTGNLLCKAEDR

SEQ ID NO: 112390 - protein, 306 aa, Triticum aestivum
  unsure (1)..(306): unsure at all Xaa locations
  Clone ID: PAT_TA_6808.pep
MSGGEEGEGRKVSREDIQLVQNLIERCLQLYMNQKEVVETLSFQAKIEPSFTELVWQKLEEENPEFFKAYYVRLMLKNQINVFNKLLAHQCRLMNKDPSGALSITPTAPNGSDSSTLNQNTCFLQDTTSTAIPDSFLHNGNSSGVINGAPATDQFIYGGKVVHGLPSGMDASVSLLSAHNSXVRQFNGDNGTTIKAESSFSSNPEFAFCNENTYLEPCQSIGDASGGSFSSSELNGQPLGDTILDMDTSSYGSVRLLPRSSSFPRFIRAVLSYSEFLHLGQFPSPAGTTLSPRLPLTPPMGRSFAP

SEQ ID NO: 112391 - protein, 160 aa, Triticum aestivum
  Clone ID: PAT_TA_6809.pep
RLDSLNNQTGKTKAAAGSMAEEDWIPVGMEQEYFPFQPQTEEELLNEMQPDEFPFQPRAAEDFLIELQQVFEQRAEEDFPIVKQQDERPFEFELMTMEELPELLPQDQLDSYLEHMMEGLPQDVIDSLQQEFPALFGQATVEIPQCQRADPAEEPCPPLI

SEQ ID NO: 112392 - protein, 291 aa, Triticum aestivum
  unsure (1)..(291): unsure at all Xaa locations
  Clone ID: PAT_TA_6810.pep
DFIYFXFAVRYSNVYQTESTRVITSRLQTVDSLSAYLSSVQEDVASVIIGKRTVLRARTASDALDMRLTIDERIKDIALKFGTQVPKSKLYRFPKELSSLPECLFHLRRGPLLGSIIGHEDERSVLRSLFLNASFDLSLRMLAPRCIMHREGGTFEELPAYDLTMQSNCAVVLDHGTDIFIWLGAELATQEGQTAAALAACRTLAEELSELRFPAPRILSFREGSSQARYFVSRLIPAHKDPTYEQESRFPQLRTLAPELRARLKSSFIHFDDPSFCEWMRSLKLVPPEPS

SEQ ID NO: 112393 - protein, 241 aa, Triticum aestivum
  Clone ID: PAT_TA_6811.pep
MAVAEPSRTGPPPRVFLLVFAILLTATDEAVAAGGLSIGINYGQIADNLPSPSRVSMLLRSMQVSKVKLYDADQNVLSAFLDTGVEFVIGIGNENVSAMVDPAAARAWVQQHVRPYLPSTRITCITVGNEVFKGNDTDLKDSLLPAMKSVYQALGALGLQGQVNVTTAHSLDIMGSSYPPSAGAFRPDVVPYIQPLLDFLSAARSPFLINCYPYFAYKDDPTGVPLEYVLFQPNAGVTDPT

SEQ ID NO: 112394 - protein, 186 aa, Triticum aestivum
  unsure (1)..(186): unsure at all Xaa locations
  Clone ID: PAT_TA_6812.pep
PPRSPPSPRRRRRRLLPFFPALHRAASSSSSLPSPAAAKNGGARSDLLKRKDERGRETTKERREKDRGKRRPRCXRRIREGDRKERDDLQTKGGGGAARFDLRDREDEREREKEEHERREKERGKRRGGRRPTGEDHRKECRRLVVFHRRRRPAPVRSGETLLPGRLDHSLQNSKNEGFGGCSVLE

SEQ ID NO: 112395 - protein, 289 aa, Triticum aestivum
  unsure (1)..(289): unsure at all Xaa locations
  Clone ID: PAT_TA_6813.pep
TRANXGASGNLPLPLHPSHACNPPLAAPLLQSPAPEILTLEEAAAMMRRRKMPKEQKVDALHFAPNPTLKEHGEEAMIATTKKKKGKCIQQILSSPSTSIAAETPIQEQEEKVTKKQKQRMGLEASSNMPLPLHTGDVSEPLLAAPFLQAAAPEILTLKEAAVMMRKRKMHKEEKVDALPFAQNPTLEEEQLEEAMMVTKKKNHKRVEQILSPPSSSVTAETPIQEQEVKKQKQRRRQEPSGKSDLPSGNSPLPLHPGHAFNPLFAAPFLQSPAXEILTLGGGRGGRDH

SEQ ID NO: 112396 - protein, 65 aa, Triticum aestivum
  Clone ID: PAT_TA_6814.pep
ASLDHLTIATPSMDATVASWTVCPETRAMCLVLWHVNGCWPLPLCFKSLLKWSEALTNPKLCQRI

SEQ ID NO: 112397 - protein, 160 aa, Triticum aestivum
  Clone ID: PAT_TA_6815.pep
PRRPRPLASAAMRAAAAQIDPSPSPSPAALAKSRLKRLFERQVLRVSPAERLPPVSAGGEKDKEKDDLEPSSVCLDGMVRSFLEDGGGAVGERAPTARCCNCFNGGDASDDEDGPAAAEASAISDAAETIKASSVRVDCRALNLLPDRGASSRGEAACRR

SEQ ID NO: 112398 - protein, 125 aa, Triticum aestivum
  Clone ID: PAT_TA_6816.pep
ARRLIHSTTPIEDVHMGKPICVRAPIKIQDQACPSIYENQSMEIWPWRSTSTDGFTPPKPSAGYRAPWRSRAQQQTSSLEEPFAYVARAPRYFYIQEPDYHGCELGGEISGGGEARWEDLIIGWA

SEQ ID NO: 112399 - protein, 79 aa, Triticum aestivum
  Clone ID: PAT_TA_6817.pep
MPPRPQPPPAAYKHFCRVCNKGFTCGSALGGHMRAHAVADDSPGADDDDDDPVSSARGGEDGPSTAGAATTHVYALRAN

SEQ ID NO: 112400 - protein, 117 aa, Triticum aestivum
  Clone ID: PAT_TA_6818.pep
RHRERDEKEGPVHPGEEQGGGGIADAQEALPAHGAEEAQGAQEDSPRCPGRGRRRAAPADRRVHLHPGAQGGRPAEALRHLRCVTDAAPPSQYGPPTAMPMVRGFEPQSGCNCTLVG

SEQ ID NO: 112401 - protein, 55 aa, Triticum aestivum
  unsure (1)..(55): unsure at all Xaa locations
  Clone ID: PAT_TA_6819.pep
FFLTTFGPVWIVVFFSNTPVKNTNLGSLFCFLPRIAERPVKHSRKIRTRXREREP

SEQ ID NO: 112402 - protein, 127 aa, Triticum aestivum
  unsure (1)..(127): unsure at all Xaa locations
  Clone ID: PAT_TA_6820.pep
VVGAGSMLLATATXGPPLTPACSTSCRGRPATVSFHQWQRRCFCGCYGSSRKRVSRASLETGRRRDDEGGDGAHNHGVHRRSIAATGGRCAPWSRRQGLRQVYLSTAWYYDGGGCKGRGEVGDYCRA

SEQ ID NO: 112403 - protein, 153 aa, Triticum aestivum
  Clone ID: PAT_TA_6821.pep
MKRIVGSPGPGDMERHGAAGVAAASVFAMFSAYGFSNYSAYFYLNFASVLQFLWSLPLACLDIFSLRNEKDLQAPARLLLIVIIDWAVAVLMFSGVCAAACLTIFFMKDVNFCEGFSWLGCNQFALSVTLAFITWSLQAASSFSGLWLLVSFF

SEQ ID NO: 112404 - protein, 205 aa, Triticum aestivum
  unsure (1)..(205): unsure at all Xaa locations
  Clone ID: PAT_TA_6822.pep
LDALPRHAARWAGADVLILNTGHWWNLHKTIKSGNYFMVGNRFNMTTDIKEAFRRSLHTVKDWALTNPRLSKSSYIFFRSYSPSHYGNGTWDTGGSCADQWDPLTRITSESDQQEHLWINTMMSSVARSMRRRHGMNKDAVFLNITYMTGLRRDGHPSRHREPETPSDAPEDCSHWCLPGVPDMWXQMMYGHLVSMGFDMRSIKR

SEQ ID NO: 112405 - protein, 255 aa, Triticum aestivum
  unsure (1)..(255): unsure at all Xaa locations
  Clone ID: PAT_TA_6823.pep
YVDGYSTFRTATVAVGGKGGTARDVTFEXNTAGPAKHQAVALRCDSDLSVFYRCAFEGHQDTLYAHSLRQFYRDCNVAGTVDFVFGNAAAVFQNCHLLARAPLPGQKNSVTAQGRFNASMNSGFAFQFCNVSAHDDLLRAQVNQTDKAVATQTFLGRPWKAYSRVVFMQSYIGTVVRPEGWLAWDDNQSTLGTXYYGEYMNTGPGAGVGGRVRWPGYHVTMSPAEASNFTVAQFIEGNMWLPTTGVRFTSGLLAS

SEQ ID NO: 112406 - protein, 79 aa, Triticum aestivum
  Clone ID: PAT_TA_6824.pep
FRMVIGFTAKIKQSPSLVPYISELSMHTQVSTSARQRCGVVAEGVFSGGGDGRRHGSVLDRGAALLLEKEPHSCQRLYI

SEQ ID NO: 112407 - protein, 96 aa, Triticum aestivum
  Clone ID: PAT_TA_6825.pep
GAAHEWILKAKASGENALSPKHEAFMIGTTRSPNNKGFDLFITTAPIPDLNGKIILFGRVIKGEDIVQEIEEIDTDEHYQPKTPIGIINISLIQEL

SEQ ID NO: 112408 - protein, 144 aa, Triticum aestivum
  Clone ID: PAT_TA_6826.pep
MSALPIIVKQNSPSVGLFTHIRVITKMANVSCPPRSRPGDLNYPSFSVVFRKKPTHAVRYRRELTNVGPAMAVYDVKVSGPASAGVTVTPARLVFKKVGQKQRYYVTFESKAAGPGRAKPDFGWISWASDEHVVRSPVAYTWKM

SEQ ID NO: 112409 - protein, 87 aa, Triticum aestivum
  Clone ID: PAT_TA_6827.pep
FFLKKESNLFISELHEMFLNRSGPPIVGGDFNPVRKQEDTSSGRMIMCRLDQENNRQVHLVHNSTTFRQDQCNNPLAIARSLMGFFW

SEQ ID NO: 112410 - protein, 149 aa, Triticum aestivum
  unsure (1)..(149): unsure at all Xaa locations
  Clone ID: PAT_TA_6828.pep
MGISRDSMHKRRATGGKQKAWRKKRKYELXGRQPANTKLSSNKTVRRVRVXRGGNVKWRVFRLGYWVTTHGESEAVTPQRPLSSDVXVYNASXNNDXVRTQTLVEDAMCKXDAAPFKQWDSLHYGVDIGRKKKPCCKEGMLKDKRFRNN

SEQ ID NO: 112411 - protein, 213 aa, Triticum aestivum
  Clone ID: PAT_TA_6829.pep
ATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEAAEGQEAEVAAAATEEAKKSHNVHRKLEKRQQGRTLDSHIEGAVNGGRLLACISSRPGQWGRTDGYLLEGKELEFYLRKLPKKKGKGAPT

SEQ ID NO: 112412 - protein, 200 aa, Triticum aestivum
  unsure (1)..(200): unsure at all Xaa locations
  Clone ID: PAT_TA_6830.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEPAEGQEAEGAGCATEETKKNHIVQRKLXEKRQQGRTLELSHLGTILIGGKVDCPAFILPPGTGWE

SEQ ID NO: 112413 - protein, 203 aa, Triticum aestivum
  Clone ID: PAT_TA_6831.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKDAGEGQESEGAAAATREAKKSNNVQRKLGERQQGRTLDSHIAEPFRVVKLAVPPPGPRSPRPYQLDQGW

SEQ ID NO: 112414 - protein, 249 aa, Triticum aestivum
  unsure (1)..(249): unsure at all Xaa locations
  Clone ID: PAT_TA_6832.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKDAAEGQESEVAAAATEEAKKSNNVQRKLEKRQQGRSLDSHIEEQXXGGKLLACISSRPGQCGKTDGYILEGKELEFYMKKLQKRKAVPQLKLKNLCIVTCGNFLNVASLSLLQNY

SEQ ID NO: 112415 - protein, 237 aa, Triticum aestivum
  unsure (1)..(237): unsure at all Xaa locations
  Clone ID: PAT_TA_6833.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKDAAEGQESEVAAAATEEXKKSHNVQRKLEKRXQGRTLDXSHEEQXTGGRLLACNFARPGPGGXADGYIPGGARSLKFLPEETFKRRKGQGSHTLGLKSFLLGT

SEQ ID NO: 112416 - protein, 188 aa, Triticum aestivum
  Clone ID: PAT_TA_6834.pep
SADAWASVASNMGATALHHAAGIGHIEIMKILLGKGVDVESESESGTPLVWAAGHGQLDAVKLLLEHNAKPDTETADGITSLLSAVAASSLPCLEVLIQAGANPNVTAGGATPLHIAADSGNLEMIKCLLQAGGDPNTSDDDGFKPIEVAALRDNLEVVEHLLPLTSPIPGVSNWTVDGIVKYVSSKM

SEQ ID NO: 112417 - protein, 163 aa, Triticum aestivum
  Clone ID: PAT_TA_6835.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKDAAEGQESEVAAAATEEAKKEQTMSKRKA

SEQ ID NO: 112418 - protein, 262 aa, Triticum aestivum
  unsure (1)..(262): unsure at all Xaa locations
  Clone ID: PAT_TA_6836.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEPAEGQEAEVAAAATEEAKKSNNVQKESLKKAXQQGRTLDSHIEGQVNGGRXLLACNSSRPGQCGKXDGYNLEGKEAGVYMRKLQKKKARVPPLKLENLLHVTSWIFLEVGPWHGWRHTVTHFLGNRF

SEQ ID NO: 112419 - protein, 216 aa, Triticum aestivum
  unsure (1)..(216): unsure at all Xaa locations
  Clone ID: PAT_TA_6837.pep
MGISRDSMHKRRATGGKQKAWRKKRKYELGRQPANTKLSSNKTVRRVRVRGGNVKWRALRLDTXGNYSWGSEAVTRKTRILDVXVYNASNNELVRTQTLVKSAIVQVDAAPFKQWXYLTHYGVDIGRKKKXPAAKKDNAEGQEVEAAAEETKKSNHVTRKLEKRKEGRELDAHIEEQFGSGRLLACISSRPGQCGRADGYILEGKELEFYMKKLQR

SEQ ID NO: 112420 - protein, 226 aa, Triticum aestivum
  unsure (1)..(226): unsure at all Xaa locations
  Clone ID: PAT_TA_6838.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWXLTQLWXVEIGRKKKAAAAAKKDAAEGQESEVAAAATEEAKKSNNVQRKLEKRQQGRTLDSHNGEQFTGGRLLACISSRPGQCARLDGYNPEGKELEFYMRKLQKKKGKGATT

SEQ ID NO: 112421 - protein, 225 aa, Triticum aestivum
  Clone ID: PAT_TA_6839.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKDAAEGQESEVAAAATEEAKKSNNVQRKLEKRQQGRTLDSHIEEQFSGGRLLACISSRPGQCGRADGYILEGKELEFYMRKLQKKKGKGATA

SEQ ID NO: 112422 - protein, 225 aa, Triticum aestivum
  Clone ID: PAT_TA_6840.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEPAEGQEAEVAAAATEEAKKSNNVQRKLEKRQQGRTLDSHIEEQFSGGRLLACISSRPGQCGRADGYILEGKELEFYMRKLQKKKGKGATA

SEQ ID NO: 112423 - protein, 225 aa, Triticum aestivum
  Clone ID: PAT_TA_6841.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEAAEGQEAEVAAAATEEAKKSNNVQRKLEKRQQGRTLDSHIEEQFSGGRLLACISSRPGQCGRADGYILEGKELEFYMRKLQKKKGKGATA

SEQ ID NO: 112424 - protein, 83 aa, Triticum aestivum
  Clone ID: PAT_TA_6842.pep
TSTFPHVPYGYFLQEICSKKNSGLTRTTGYLKYAAHCFALVTTCCPISLYLHTYLVHYVTAVRMIACLSIVRSKVSDLYEWLH

SEQ ID NO: 112425 - protein, 213 aa, Triticum aestivum
  Clone ID: PAT_TA_6843.pep
LPFPILASPAPSLHSRRSQVRPPLPFVTIAGPSFAATDLPPLHVESGHGSDRGGPRAWHARASSRRRPRRTLRRGPHTPLLCHAPSSNPVVELLEKALELGMFAGDARPLPPPDAPDVAAMSLSILSRVIVRVQCSEENECQMKSKRNETFGSDLFGTNVIQGIWSGREPTEEAATRVPGAPFERPPTYFFLLYIPMCPETIEEHHEKLFSPS

SEQ ID NO: 112426 - protein, 63 aa, Triticum aestivum
  unsure (1)..(63): unsure at all Xaa locations
  Clone ID: PAT_TA_6844.pep
LHYGKIDVVVKTASHWQARWHNHGSHMHVVVRRSMIARTSSSCTSLACTVQVLXWTIMCSLVP

SEQ ID NO: 112427 - protein, 81 aa, Triticum aestivum
  Clone ID: PAT_TA_6845.pep
YHRFQFVRVCCPIASGSCSIFRCTIKSDPTLLNHCLGRRESRLRTPTASATRTAMKQRYTASSPAPSVASSLIPLAGSLVP

SEQ ID NO: 112428 - protein, 67 aa, Triticum aestivum
  Clone ID: PAT_TA_6846.pep
GPNGETICPLISKLASDGEPFPVSRRPVGALRLPFLLLAGALGLLQLFHLGWVAGLVAVELAGAPLQ

SEQ ID NO: 112429 - protein, 141 aa, Triticum aestivum
  Clone ID: PAT_TA_6847.pep
ASMDFLIEPSPEFQVRSARNHLQPPSALVHRCPAKHTPSRRRVDLHRPSPPSRRPPDLPGFLPSLHTITPRTHQVPLHQAPPLPRHIECTHTRGVKGVDRAPAWLDHQRLPARSPARLLAWLGSNLGSGSLLPPQLRLHSH

SEQ ID NO: 112430 - protein, 355 aa, Triticum aestivum
  Clone ID: PAT_TA_6848.pep
AGEKIISRVGLRESGQGQHQTYALGIKEVWEIEEGKHKPGSVVHTVGWPLDMKTYGGSFLYHLDDRQLAIGLVVALNYRNPFLSPYDEFQKFKQHPAIRTLLEGGTVLQYGARTLNEGGFQSIPNPVFPGGAIIGCSAGFLNVPKIKGSHTAMKSGMLAAEATFKALVEGSSMDLYWENLKKSWIWDELYRARNYRPAFEYGFIPGMALSAVERYIFKGKSPFTLKHGKPDHEATEMANLHLPISYPKPDGQVSFDVPSSLYRSNTNHEHDQPPHLRLRDPAVPESVNLPQYAGPESRYCPARVYEYVSDENGDPKLHINAQNCLHCKACDIKDPKQNIEWTVPEGGGGPGYTVM

SEQ ID NO: 112431 - protein, 82 aa, Triticum aestivum
  Clone ID: PAT_TA_6849.pep
SSLLARVLENISSACFHPLDSTYWYWICSPWYSTTMPCHHVGFAFVTARGSSSECWECLLRFSYGTACLVLSCSRVLLLLNG

SEQ ID NO: 112432 - protein, 131 aa, Triticum aestivum
  Clone ID: PAT_TA_6850.pep
GAIRPHSSGGDSGEGRGLQTRDARSDQVINVPPLPPHPRGPPLPAAPPHTPASGRGPHPLPAPAPRRPVPRRAPPSLRFAGRLSHLPPQQRPPPRPPPSSLRRPAWSYGPTRRPPWATPSAKGTATFSPSS

SEQ ID NO: 112433 - protein, 117 aa, Triticum aestivum
  Clone ID: PAT_TA_6851.pep
RRRKEIEKKTEKTKEETIIKGKRWMVSHPPKWPNRFAHATIAQHVAGSILLVPPILPRRIPPLLPVVPPHCPVLPVCALPCAARLRSCFSGCLTTPQRPAAAAQCPIGPVRRQKLSY

SEQ ID NO: 112434 - protein, 199 aa, Triticum aestivum
  Clone ID: PAT_TA_6852.pep
MPNLANLICRTHNKPCVYYYSGSCVPMRRGCALLPLVCASFQVPTCVLPVWWRCRRSVSVINGFINDLSSAATEVQKEAKELKLLDIHDGRGLIRRRLLNDRLLLAERSFLHAEGLQGRTWYKHLMYSPPEDYESELSFFPGIADAISRRGNQSTRQRQAAVRQELWRVAMAIQRAANVLRGEFGAHNKPINFSVSMAP

SEQ ID NO: 112435 - protein, 231 aa, Triticum aestivum
  unsure (1)..(231): unsure at all Xaa locations
  Clone ID: PAT_TA_6853.pep
FLIDLGLASXWRDSSGQHVDYDQRPDIFRGTIRYASAHAHLGRTAHASDDLESLAYTLIFLIKGGLPWQGYQGDTKSFLVCKKKMVTSPDMLCSFCPPPFKQFLESVTNMKFDEEPNYAKLISLFESLIESPASRPIRIDGALKVGQKRGRLLVNHEEDDQPKKKVRLGSPASQWISVYNARRPMKQRYHYNVADNRLXQHIEKGNEDGLYISCVASSANHGRMVLLSGME

SEQ ID NO: 112436 - protein, 148 aa, Triticum aestivum
  Clone ID: PAT_TA_6854.pep
MQRPSKLPAASLPGRPTFFGPQGWADLPDGLLHSIVDRLGSFRDLLGFATTCPSWRSAFSSYPSKSTFLTKLPPLLIQTHIRAQGPLLPWTSGCRELYPCKVVDPANRNAALRCWVPQDTLEKMTFIGSSHGKLIYYGNGYCRIIVVL

SEQ ID NO: 112437 - protein, 218 aa, Triticum aestivum
  unsure (1)..(218): unsure at all Xaa locations
  Clone ID: PAT_TA_6855.pep
PPPTARALATAPRPRHRPPTPPPATSIAVRAPPHRAPAVPPPPARSLGRPVRGASPPASGGPARAHPARRLRPPPAGQSVRAARPTPCRRGGRLAARPGPFAPPANSRQSGPRRTPKDTMYDLHPEISMLYGEDNGAVAAPSKEQGIGKAIETLPLADASIAYRYNEPRIKVIGVXGGAGSNAVNRMIESSMKGVEFWIVNTDFQAVGAPPIDPANXX

SEQ ID NO: 112438 - protein, 88 aa, Triticum aestivum
  unsure (1)..(88): unsure at all Xaa locations
  Clone ID: PAT_TA_6856.pep
FFXCGPNPDSASLEKLIPRRYLFQLLILKLKETRSTTLPAIAGYNLNTQDNLGMGKPYPWLTSYAGYSLDTEDKIISQSVQALSLAVP

SEQ ID NO: 112439 - protein, 124 aa, Triticum aestivum
  Clone ID: PAT_TA_6857.pep
PRHRHPPRPRPHPRHRRPPQGRSSGPGPAPLPPVPPRSRGGGPALHVARQRRGRAVQQPPAAPPTAAAAAAEVAAQFRSLVSAEDVGSIEQAQHFILGRLQDSNAGPRPFLPGALEQCFAEVSK

SEQ ID NO: 112440 - protein, 371 aa, Triticum aestivum
  unsure (1)..(371): unsure at all Xaa locations
  Clone ID: PAT_TA_6858.pep
STLLVWLQDNGWWGLGFAIPTVLMALGLAVFVGGSRVYRFRKLRASPFTSICQVLVAAVRKWHVQLPDDTSPLYEPTRSSSAPESSHNIQHTNQFRFLDKAAAVLPPLDKTCTALPMCSWSLCTVTQVEELKILLRMFPVWASFVVFYSVAGQTASTFIEQGMVMDNHVGQFAIPPASLSIVSVFSVLIGVFIYESVLVPLARRYTGKAKGFSQTQRLGIGFALSMLTMVYSAMLEMKRLAIAQASGLADQNVPVPVSILWQVPAYVMQGTAGVFAGIGMVEFFYDEAPYTVKSLCAAFSQLAVASAAYFNALVFXVVAVATTHGGAPGWIPDNLNEGHLDYFFWMMAAPSLLNLAQFVHYSMRHREKTTS

SEQ ID NO: 112441 - protein, 129 aa, Triticum aestivum
  Clone ID: PAT_TA_6859.pep
MASRLASCFPCLSTRKKEVPPSPPAYPRSRNPSAPQTFSFEEIAAATSNFSDDCPVVGLEGLYKGYLKSINQVVAIRLQPVIDPNASADQEIMEFLGHVLKISALRHPNLLSLIGFCAVGDHRILVHEY

SEQ ID NO: 112442 - protein, 216 aa, Triticum aestivum
  unsure (1)..(216): unsure at all Xaa locations
  Clone ID: PAT_TA_6860.pep
MIISTLPSDILVNILDRLDVREAVRTSILSRRWSQLSCKLSRLIIXLSLDGVSSSNISDGDLVRINAAVVEATKSLLTRRCPGEDTIRLLSYXFYLRGDAPISIGHAVGSAMXTHKLEEAEFTVLTVKNRRQCTLDDVLNYGTQFVSFFTECLNAFTGLTRLYMENLRFAESDFVSNIFVTCKRLKYLGFLNCDTQKHLTLQVEHAQLSELSMVNC

SEQ ID NO: 112443 - protein, 215 aa, Triticum aestivum
  unsure (1)..(215): unsure at all Xaa locations
  Clone ID: PAT_TA_6861.pep
APPAWRPRREGLRRRHLGAVKEVGEGDSGDLGAASAPLRHHPEQEVPRCWLAAALTADAGSQLRHRSQSVRGRRPTQMGRRHTPAAGSLDAAPARCTAWGDFDLVLDSGWIQRRRSPELERRCSPLAVDLVCLPRRAPASSPLTSSWTRETHETLTSAPSASVTGRCNGVMLILPHQHLQRAPSVRSDVNMHLATDQCFLKTVSTVLAVFLKKIX

SEQ ID NO: 112444 - protein, 222 aa, Triticum aestivum
  Clone ID: PAT_TA_6862.pep
QRYGIDYEDTFSPMVKDATIRLHGKSLRQLDVHNVFLHGVLEEDVYTRQPPGFESKNTPSYVCKLDKALYGLKQAPRAWYSRLCHKMQKLGFVPSKSDTSLFIYNKSNTCIFVLIYVDDIIVTSSSDEAIRGLLKDLSVEFALKDIGDLHFFLGIEVKKHHNGLHLSQAKYAADLVKRAGLQGCKPSLTPLSSSENFSLVEGKILSQEDSTKYRSLLGALQY

SEQ ID NO: 112445 - protein, 130 aa, Triticum aestivum
  Clone ID: PAT_TA_6863.pep
MTPKNVIRFILVLIHVSSCLGRSGKMFSPSFISVAKSLSSWPIFSAGISVTVALVLSLFLTFEHLCAYHQPEEQKFLIGLIMMVPVYAVQSFFSLLNSKVAFICEMMRDCYEAFAMYCFERYLIACLGLR

SEQ ID NO: 112446 - protein, 92 aa, Triticum aestivum
  Clone ID: PAT_TA_6864.pep
HKRGRAKLGGFTKNNKQNIHEDENSARFGTTRREHKRKHLGPAGGLGEPTSAAGGKENREDKIKIEWWNSSESPLSSASLLRRSSSLPRRYR

SEQ ID NO: 112447 - protein, 228 aa, Triticum aestivum
  Clone ID: PAT_TA_6865.pep
MAWGGLFLSLSRPTPEQQKSCLAAAGGFNYDADLHGATHPKSPAALTTAEDSDRALADRGFSVNRSRVLVGSGADTFRHAKSALLSWKHLALGWAEAEPGTPVKIGARFCICYKEVVPWVMFPLQIAYVTDDKYNGGKRGKGGVFAFGSGTLQGHLLAGEERFSVEVDAEERVWYEVVSFSKPAHPLSALCYPYVRLRQRHFARESGKAVLRHVAAACSSSRTPPPTQ

SEQ ID NO: 112448 - protein, 133 aa, Triticum aestivum
  Clone ID: PAT_TA_6866.pep
MATTGASSSSKSSAACRECHQVSHGKPDCPSLPCYNCGGAFHTRGKCVSTKRVPHTGPRCPRCGGFQHSESNCPVTEADSRPPVCPRCATEHRQRDCPHPDRPIIYSGWTGYGKCTLCGDSNHVYRDCPSKYW

SEQ ID NO: 112449 - protein, 121 aa, Triticum aestivum
  Clone ID: PAT_TA_6867.pep
SARGAVEMANNLAVDAIFVYTKHGHMASLPARGRPNPPIFAFTDDSNTRKSMNLYWGVIPLQLPLSNSMDDNFKQTIKLLKSKGSVKPGDSVLVVADSDLNQPCAAATSSVYQSIQVRLVD

SEQ ID NO: 112450 - protein, 52 aa, Triticum aestivum
  Clone ID: PAT_TA_6868.pep
MMEKPASSSDTLPSKLAVKLAFTLPASSYATMAIRELLKDSTSVAYQKTLDC

SEQ ID NO: 112451 - protein, 221 aa, Triticum aestivum
  Clone ID: PAT_TA_6869.pep
RQLLMELAILLLQRANGATNGSPCPDAPNSAQKRRNKKPAAAYFANPAELRVKFLDGTMVPTKEELLSEFRRFGVLVESECDISEERRDARVVFGKSTEAEAAYTKAEIPGIFGQFGPPWATLGLNYLEAITLAPARPAKPPLARADMRKNVENMISSLKNGRSLPLNVGAAAFPAAPAPAPGAGAAPVSASLLAEMQRLLSKLDKTQPPPGPSGSAPPSS

SEQ ID NO: 112452 - protein, 86 aa, Triticum aestivum
  Clone ID: PAT_TA_6870.pep
KLSGTHRLITAKDSCSLRHPMTELEAVAIATTTRGTHSRSLLDYWCWYHSFWRFPSAISQQAWYRATSACFPSVVQKKHGSKTICS

SEQ ID NO: 112453 - protein, 262 aa, Triticum aestivum
  Clone ID: PAT_TA_6871.pep
WRDRPLVLNRKVQFSGYAVLGDDSFIVSDAATSSFLLFDLHSERWSVLHRALPGSQLLNGRSVFVDGFIYTCTSGGILAYELVDKQGNRKGLRDPPIFLPFSWQLSECRAWEAERMCFDCVDKDKISDAIIFCVVQGEYCYSANLPGSLSHSHDVHITTVQVKTERACRGKRKPERIDHVDIGTCFIEHDAALVLTQKLFCSWVLTSDAPLSCLMCFAMLFILFKTHYITKLSCTACGVSNMCIMETSFWSRERIWILIDSQ

SEQ ID NO: 112454 - protein, 100 aa, Triticum aestivum
  Clone ID: PAT_TA_6872.pep
RHEDEIGNVPTLIGSAAGAISSTATFPLEVARKHMQVGAVGGRKVYKNMLHALLTILEDEGVGGLYRGLGPSCMKLVPAAGISFMCYEACKKILIEEEDE

SEQ ID NO: 112455 - protein, 287 aa, Triticum aestivum
  Clone ID: PAT_TA_6873.pep
MGMSGAASGGAGCGRGEYMRIPEDVDAIKEAVKEEGECPRLLRCRAIRWWAKVAVLGIFLAGAAAAAVVFLGPLVIKKVVVPIIDWQSRTFSRPVILLICFGAIALFPSVLIPSSPFMWIAGMTFGYGYGFLIITTAMSIGMSLPFCIGSAFHSRIHRWLEKWPKKAAFVRLAGEGDWFHQFRAVALLRISPFPYIVFNYASVATNVKYCPYIAGSMAGTIHETLLAIYSGKLVQSLAAATSQGSFLSVDQIIYNGIGFTVAAVSTAAITIYAKKALQKLQAEDELC

SEQ ID NO: 112456 - protein, 262 aa, Triticum aestivum
  unsure (1)..(262): unsure at all Xaa locations
  Clone ID: PAT_TA_6874.pep
NSARGNKAXMNNVQDLAKAFSNYKDEVLVKREELLEYTRNVISGLKRNADIMRIDAETLELWRKLDGKEKSRSQSTEGQDKASEKIAVANIEALKEALTEVRFCSRAEELLLKKKSIAPGDSMEIHSQKVDKLKVLSDSLSTSSSKAEQRIMDHRRQKEDALNFRVKKENEVNAAEKGLLAEITELEKQRDDLEAQLKKVNISINAAAVRLKTTREERDQFDEANNQIIFSLKTKEDDLSKSIATCNVEANVVKTWLIPKGG

SEQ ID NO: 112457 - protein, 85 aa, Triticum aestivum
  unsure (1)..(85): unsure at all Xaa locations
  Clone ID: PAT_TA_6875.pep
IPANNDAQXSHTIGVADEHIGAVVGRAGRNITEIIQASGARIKISDRGDFIPGTSDRKVTITGTSEAIQAAEAMIMQRVTASQER

SEQ ID NO: 112458 - protein, 286 aa, Triticum aestivum
  Clone ID: PAT_TA_6876.pep
MQALGSLTTIAQLRVFPWVQMSETSWSLALFDEVSQGQGVGFVGETLILRGKNRLKREARPNFRLVVPNSSCGGIIGKGGATIKSFIEDSHAGIKISPQDNNFVGLHDRLVTITGPLNSQMRAIHLILSKLSEDVHYPPNLSSPFPYAGLGFPSYPAAVPVGYMIPQVPYNNAVNYGPNGYAGGGGGGGRYQNNKPGTPVRSPANNDAQESHTIGVADEHIGAVVGRAGRNITEIIQASGARIKISDRGDFIAGTSDRKVTITGTSEAIQAAEAMIMQRVTASQER

SEQ ID NO: 112459 - protein, 208 aa, Triticum aestivum
  unsure (1)..(208): unsure at all Xaa locations
  Clone ID: PAT_TA_6877.pep
MMASPAFLLLLLLAVSIRGSEAEWCVCRSDANETALQETLDYACGQGADCAPVATGGSCHSPDSVVAHCSYAVNSYYQRSSQTKGATCDFGGTATLSSADPSSGTCKYPATASAXRDEHRERHGDRHGHRHQLFFPGLNKPSYPRHGRELHHADRQRVRPYGEHHRPREQRFRCRRGRLCWRPRPPRRSRGLRPRFLGAVLIMKQRET

SEQ ID NO: 112460 - protein, 410 aa, Triticum aestivum
  Clone ID: PAT_TA_6878.pep
STHASGQNVHGKIKAMEQTLGRIKRMHDGCSGAVNRLRTSLHSTEERLQSHRKDANYLAQLPARSSPVGPRGRPLRLTNEYYSSNSNNKDFPNTEKLEDPELHHYAVFSDNVLAAAVVVNSTLVHAKKPANHVFHIVTDRLNYAAMKMWFLANPLGEAAVQVQNIEEFTWLNSSYSPVLKQLESSSMIDYYFGSGKARPGENPKFRNPKYLSILNHLRFYLPEIFPKLNKVLFLDDDTVVQQDLSALWSMDLKGKVNGAVETCGESFHRFDKYLNFSNPLIASNFNPHACGWAYGMNMFDLSEWRKQNITDVYHTWQNLNEDRLLWKLGSLPAGLVTFWNRTFPLDRSWHLLGLGYNPNVNEKEIRRASVIHYNGNLKPWLEIGLSKYRKYWSRHVNYDQVFIRECNINP

SEQ ID NO: 112461 - protein, 138 aa, Triticum aestivum
  Clone ID: PAT_TA_6879.pep
QDLTPFILPATKELPKQCIKHGSSTRYAKRRQVGVRMPDDPICQAILQNLEEPLICTSVKYLAEDEWILDPVTIADIYEPLGLDFIVDGGARIADPSTVVDMTGSYPTIIRQGKGAKLDWMVTGTDQEAQSTYSREAA

SEQ ID NO: 112462 - protein, 145 aa, Triticum aestivum
  Clone ID: PAT_TA_6880.pep
ASIYTKLEAWNDSNICLDKAKSIDFLSPKCWHVKGLILEAQSLHQEALEAFSFSLSINPDYVPSMVSMASILRTLGAKSSSIARTFLRSATRLEPTNHQAWMGLGLVLKSEGSVLEAADCFQAAYELLELSPIQDFSEQLPILLQ

SEQ ID NO: 112463 - protein, 121 aa, Triticum aestivum
  Clone ID: PAT_TA_6881.pep
PCRPHRRRSSISNLSRDAGSSRRHHGFSRHAPIDGPHGQPSPVTYTAMPNGPLPVTAAPQMSINSIIFLRLTRFYVANSSTSMPQMHMKRLTTLNLRSSLSPASLPCKCGKGVLITLLPYT

SEQ ID NO: 112464 - protein, 144 aa, Triticum aestivum
  Clone ID: PAT_TA_6882.pep
MEASAAGAVAKAKKYVVGRKLGGGPRKQAVARSVKAGLQFPVGRIGRFLKKGRYAQRVGMGAPVYLASVLEYLAAELLELAGNAAKDNKKSRIIPRHLLLAIRNDQELGRLLAGVTIAHGGVLPNINPVLLPKKAADKEPKSPK

SEQ ID NO: 112465 - protein, 296 aa, Triticum aestivum
  unsure (1)..(296): unsure at all Xaa locations
  Clone ID: PAT_TA_6883.pep
RIRHEDRPIAALLFCGPTGVGKTELTKALASTYFGSESAMCRLDMSEYMERHAVSKLIGSPPGYMGFGEGGTLTEAVRRKPFTVVLFDEIEKAHPDIFNILLQVFEDGHLTDSQGRRVSFKNTLIVMTSNVGSTSISKGTMSMGFQTQNDTEENTYAVMKSLVMEELKAFFRPELLNRMDEVVVFRPLEKTEMLAILNIILEEVKGRLLALGIGLVVSDAMKNMVSQQGYDKSYGAXRPLRRAVTXLVEDVISEAILSGQYKRGDTLRMDTDGKGQPCWSRLNGQTVQVSDPTPTL

SEQ ID NO: 112466 - protein, 91 aa, Triticum aestivum
  Clone ID: PAT_TA_6884.pep
MADRLTRIAIVNDDRCKPKKCRQECKKSCPVVKTGKLCIEVGPASKVSFISEELCIGCGICVKKCPFDAIEIINLPKDLEKDTTHRYGPNT

SEQ ID NO: 112467 - protein, 87 aa, Triticum aestivum
  Clone ID: PAT_TA_6885.pep
YSNANTRKLIIVLPTAQTNKKYSFNTCASLKPKHHTRCASLLWPIRTSHGRTSWQLLVSLAHDPERIRNIIDVQQESTKEPKKKQTH

SEQ ID NO: 112468 - protein, 604 aa, Triticum aestivum
  unsure (1)..(604): unsure at all Xaa locations
  Clone ID: PAT_TA_6886.pep
MADRLTRIAIVSEDKCKPKKCRQECKKSCPVVKTGKLCIEVSPAAKLAFISEELCIGCGICVKKCPFDAIEIINLPKDLEKDTTHRYGPNTFKLHRLPVPRPGQVLGLVGTNGIGKSTALKVLAGKLKPNLGRFKNPPDWQEILTYFRGSELQNYFTRILEDNLKAIIKPQYVDHIPKAVQGNVGQVLEQKDERDMKNELCVDLELNQVIDRNVGDLSGGELQRFAIAVVAVQSAEIYMFDEPSSYLDVKQRLKAARVIRSLLRSNSYVIVVEHDLSVLDYLSDFICCLYGKPGAYGVVTLPFSVREGINIFLAGFVPTENLRFRDESLTFKIAETQESAEEVATYQRYKYPTMSKTQGNFKLSVVEGEFTDSQIVVMLGENGTGKTTFIRMLAGLLKPDTMEGSEVEIPELNVSYKPQKISPKFQHPVRHLLHSKIRXSYTHPQFVSDVMKPLQIEQLMDQEVINLSGGELQRVALCLCLGKPADIYLIDEPSAYLDSEQRIVASKVIKRFILHAKKTAFIVEHDFIMATYLADKVIVYEGLASIDCTANAPQSLVSGMNKFLSHLDITFRRDPTNYRPRINKLESTKDREQKNAGSYYYLDD

SEQ ID NO: 112469 - protein, 186 aa, Triticum aestivum
  unsure (1)..(186): unsure at all Xaa locations
  Clone ID: PAT_TA_6887.pep
RRCRSTSAFFDRNKXGVIHPSXETYEGFRAXIGCGVALSAFQRPSSSTGTRSGPKTIPENMKVGAFKFPIYVKNIHKGKHGSDSGVYDANGRFVPEKYEEIFKKHAHTRPDALTGKELNELLQANREPNDLKGRVGGFTEWKVLYSLCKDKEGFLHKETVRAGYDGSLFVKLEQERKQAKEYAKKK

SEQ ID NO: 112470 - protein, 224 aa, Triticum aestivum
  unsure (1)..(224): unsure at all Xaa locations
  Clone ID: PAT_TA_6888.pep
GRVCGWTVAAARCLILTPTISSPSAALRLPRIARRRPLSCSASPLAVFATMDSPPEGYRTNVGICLADPSLTKIFSASRIDIPTAWQMPQGGIDPGEEPRAAAVRELXKETGVRSAEIVAEAVSXAPQLFPADVKDKLNARWGTNWKGQAQKWFLFRLTGGRLRGXDEEINLXGDGSEKPEFSEWAWMTPQQVIEKAVDFKKPVYEETLKHFAPYLQSDPTASS

SEQ ID NO: 112471 - protein, 148 aa, Triticum aestivum
  Clone ID: PAT_TA_6889.pep
MAGKELSDEQVASMREAFSLFDTDGDGRIAPSELGVLMRSLGGNPTQAQLRDITAQEKLTAPFDFKRFLELMRAHLRPEPFDRPLRDAFRVLDKDASGTVSVADLRHVLTSIGEKLEPHEFDEWIREVDVAADGTIRYDDFIRRIVAK

SEQ ID NO: 112472 - protein, 94 aa, Triticum aestivum
  Clone ID: PAT_TA_6890.pep
SLHILRGNLGAIRSIRYTSDGQFLSMAEPADFVHIFDVKSDYNKRQELDFFGEISGMSFSPDTDTLFVGVWDRTYGSLLQYGRLYNYSYLDSLF

SEQ ID NO: 112473 - protein, 127 aa, Triticum aestivum
  unsure (1)..(127): unsure at all Xaa locations
  Clone ID: PAT_TA_6891.pep
RLSSEVSQWICLSDGCLSGNACTYFKEKICMGTQEGECVPLLYEKKCTQLRTXDANGAEPFTIERTRATIRNLRTKLNITVAFVKDVSRRVVVXLRLLQMLARMWRVIGDVHRVMKRIVDEVSELLP

SEQ ID NO: 112474 - protein, 119 aa, Triticum aestivum
  Clone ID: PAT_TA_6892.pep
KLVPARPAHLPRPPSGGGGPRPRRPASRWASPRPPRLAPPPAPAGAGAGPGACPLRRPPPPAPAAAPAPPPRRPSSPSSLGPPPCPPSPSPSSGSPACPPSPSSPGAPQSPPSPSSSSW

SEQ ID NO: 112475 - protein, 80 aa, Triticum aestivum
  unsure (1)..(80): unsure at all Xaa locations
  Clone ID: PAT_TA_6893.pep
CFVLPCLLNYVLLLIRVRGKRKKKRRKKKNRFQCLLFSRCSWLILGCKNAPGIRRRGGETRNVCVIFEKVERKRSDACCX

SEQ ID NO: 112476 - protein, 158 aa, Triticum aestivum
  Clone ID: PAT_TA_6894.pep
MRDGNVELKETIKNHDGVKALYVENLMQLERTMEKNAHLERSLSAATTEVAGLRQNKATLEESCKQLSSKINGYQSERAMFIARIEGISHTMEKLSEKNVFLENLLSENYTELENHRMKLKDLEESAQALRNQNSLLRSDKRTLVQEVDSINGALLDL

SEQ ID NO: 112477 - protein, 71 aa, Triticum aestivum
  Clone ID: PAT_TA_6895.pep
PCCLVTGEYGWTALLTSGFSLDDPNTFAARIHRMLKLGLNIDDQADAEEEDADMPALEEEGAEESKMEEVD

SEQ ID NO: 112478 - protein, 266 aa, Triticum aestivum
  Clone ID: PAT_TA_6896.pep
IIRMYNLDSEMTSRIFQAPLSDLCSLKSSGNAPGSVQGDAVEPSGVPDESLQSSLEKPSDTEVSDGNAQSTTAQPIVIGAPEPATDEHLNQGDIPIDIEAPEPADEHLNQGGISMPDCKGSNGNSIAPKAPRAGKAPSPERMKYWGEHGFSSLIVAAPGHEVESVVADLLPLLSYSAPFAIYHQYLQPLATCMHSLQVSKMAIGLQITEPWLREYQVLPSRSHPHMQMNAFGGYILSGIRVHKPDPSGARVQEKSSGATESMLVSL

SEQ ID NO: 112479 - protein, 99 aa, Triticum aestivum
  Clone ID: PAT_TA_6897.pep
ICGSYGVTFAAVGGLYIGVEQIVQSQRKKRDFVNGAIGAFVSGATVYGYRGKSIKSALIGGSSLAFTSAILDVGGNTTRVDNGKAYHAYTTEKKPEPAH

SEQ ID NO: 112480 - protein, 170 aa, Triticum aestivum
  unsure (1)..(170): unsure at all Xaa locations
  Clone ID: PAT_TA_6898.pep
MEDDSPATKTVKGAVTGLAAGTIWGTIVATWYDVPRVEXRHVALPGLVRTLKMCGSYGVTFAAVGGLYIGVEQIVQSQRKKRDFVNGAIGAFVSGATVYGYRGKSIKSALIGGSSLAFTSAILDVGGNTTRVDNGKAYHAYTTEKKPEPAQCPTVRLLVAQIMQTSSVNF

SEQ ID NO: 112481 - protein, 193 aa, Triticum aestivum
  Clone ID: PAT_TA_6899.pep
KKRRLGDGKKKAGGFTKLCSISPALQEFVGASECARTEVVKKLWAYIRENNLQDPSNRRKILCDDNLKKIFNVNSIDMFQMNKALTKHIWPLDSDGPVSPKEKSTPKEKSTPKGKPQKRDRSEGNKQKGGSSGSTSGLLAPLVLSDDLAKFIGTGESMVSRSEVERRMWDYDLKMKKLQNPSEPEENSLRRRS

SEQ ID NO: 112482 - protein, 664 aa, Triticum aestivum
  unsure (1)..(664): unsure at all Xaa locations
  Clone ID: PAT_TA_6900.pep
TRIARRIEAEETGLDTAEMVVTSTKQEIEEQWGLYDGFDLMVERKLRVRQRRGVSSLGRYMPRMAVIPPGMDFSFVDTQDTADGDGADLQMLIDPVKANKALPPIWSEVLRFFTNPHKPMILALSRPDPKKNVTTLLKAYGESRKLRELANLTLILGNRDDIDDMAGGGGTVLTAVLKLIDRYDLYGQVAYPKHHKQTDVPHIYRLAAKTKGVFINPALVEPFGLTIIEAAAYGLPVVATKNGGPVDILKALHNGLLVDPHSAEAITGALLSLLADKGQWLESRRNGLRNIHRFSWPHHCRLYLSHVAAYCDHPSPHQRLRVPGVPSASASMGGDDSLSDSLRGLSLQISVDASNDLNAGDSAALIMDALRRRPAXRQARGSGKALGSAPGKSKRLLVVAVDCYGDDGKPDVEQLKKPLAAARSAGGGPGGRPRGVLPAARPIPGTPEAPKACGADPAGFDALICSSGAEICYPWKELTADEEYSGHVAFRWPGDHVKTVVPRLGKAEDAQASDLAVDVSAGSVHCHAYAATDASKVKKVDSIRQALRMRGFRCNLVYTRACTRLNVIPLSASRPRALRYLSIQWGIDLAKVAVLVGETGDTDREKLLPGLHRTLILPGMVSRGSEQLVRGEDGYATQDVVAMDSPNIVTLAQGQAVSDLLKAM

SEQ ID NO: 112483 - protein, 214 aa, Triticum aestivum
  Clone ID: PAT_TA_6901.pep
GGKTSRCGDSERQPQTASAALKGEPMRKRGHARRRRREQGRLNYERLTLEACKDLLLQRPPKLRTPCLSSKAHAMLTSMEWGVMCWCLKYEKLTVEVCKDPLWQRTPKLQTHCLLWKAHLMLMLSRERGSMCRCLNYKKLTLKRRKDLLSQLLPELQTPCWSSTTMTMLRRVTVRQGGGGAGVGAGAAEVAEPGKRGGEGGVRGGEGPEYVAGW

SEQ ID NO: 112484 - protein, 236 aa, Triticum aestivum
  unsure (1)..(236): unsure at all Xaa locations
  Clone ID: PAT_TA_6902.pep
ESQAPEDPQTSRFTWTIENFTRVSGKKHYSDVFVVGGFKWRVLIWGXGNNVDHLSMYLDVGXGGNLPYGWSRYAQFSLXIVNQIHQKYTARKDTQHQFNARESDWGFTSFMPLSELYDPSRGYLVNDTVVVEAEVAVRKMIDYWTYDSKKETGYVGLKNQGATCYMNSLLQTLYHIPYFRKAVYHMPTTENDMPSGSIPLALQSLFYKLQYSDNSVATKELTKSFGWDTYDSFMQH

SEQ ID NO: 112485 - protein, 111 aa, Triticum aestivum
  Clone ID: PAT_TA_6903.pep
MGPQPAPVLVALSPPAIAVGNLAAAGAMVKRTVKNVGSPCKYKAMVRQPAGVHVTVSPDVMEFGKKGEEKTFEVKFETKNAKLAKNYAFGALIWSNGVQFVKSPIVVKTAA

SEQ ID NO: 112486 - protein, 175 aa, Triticum aestivum
  unsure (1)..(175): unsure at all Xaa locations
  Clone ID: PAT_TA_6904.pep
MGCHRYDDSYGLSFKGFPTLFPMVVHTVKTLSISVLPLCVDMVIDLMSCFPCLEKLYILIRSSGRKSLWCRKHQSHIRCLDIRLKKVVLANYRGIMSEVNFAMLFVLNAKMLELLQFEVQGWCCEKFIERQHRLLQLGNRASRGAQFVFTKDKCXXKLEDIKHVRDLSVADPFEC

SEQ ID NO: 112487 - protein, 252 aa, Triticum aestivum
  Clone ID: PAT_TA_6905.pep
MSAGDPAGDAGPSSRGGGRAARPRRFPTAAQPEVMRAAEKDDSYAAHVTEACRDAFRHLFGTRVAVAYQNEIKLLGQSLYYLLTTGSGQQTLGEEYCDISQVATSHGLPPTPARRMLFILYQTTVPYLAERISSRIVSRGIYMDDTQLDNHHESDNPSRGITESSTNTNESSRSLSFSMLSRLRSKAHAFWLWVVQKWPSMLPLGQDFIQLAIRTNLMFFYFEGLYYHFSKRGAGIHYVFIGKPMNQRPRYQ

SEQ ID NO: 112488 - protein, 125 aa, Triticum aestivum
  Clone ID: PAT_TA_6906.pep
GLSKAEIQKMVQEAEVHSHKDQERKALIDVRNAADTTVYSVEKSLGEYRDKVPAEVVSEIEAAVAELRAEMASDDAEKIKAKMDAANRAVSKIGQHMSGGGEPGSQQGGGGGGEAPEAEYEEVKK

SEQ ID NO: 112489 - protein, 178 aa, Triticum aestivum
  unsure (1)..(178): unsure at all Xaa locations
  Clone ID: PAT_TA_6907.pep
TISEPVSSASIYMDSSWSEDADEQQSTTYFGADGDGKDRDHSADNLSRPLRESERSEVIFKNHFFTILFPPDRFGELGPSSRTFFSNGGFTREQVLDHIYNFYXQENMSTDEINVALHTDSRHADRLRSLYASAECAERGFVVAFKRIDFLGSRRSFEALKRLSRENNSNVYELVIRA

SEQ ID NO: 112490 - protein, 134 aa, Triticum aestivum
  Clone ID: PAT_TA_6908.pep
DLMSDKSVILMVSRVTPSTGVPAHRDPASATARRGGTHGSPSSRSSMAHAPSRIPGTSSCPRTAPVRPLLADSSIWASSFCASAALSSPSSPSPSVRLRPGRPWWARLPPLCRRPGRSQLATSPGCGRCSGRRG

SEQ ID NO: 112491 - protein, 181 aa, Triticum aestivum
  unsure (1)..(181): unsure at all Xaa locations
  Clone ID: PAT_TA_6909.pep
LVASDIENGLQVPVFLYAAAHXPARVVSAVRRELGYYGPNHNGIQWTGQVLPDTLPVKPDVGPAHVSSKRGATMVGAKPFVESYNVPIFCKDVPTVRRITRRVTGRSGGFPTVQALALFHGDNCTEIACLLDPDHVGADQVQWLVEQIAEEQGLEVDKGYFTDLSKDMMLERYFEMVSAAD

SEQ ID NO: 112492 - protein, 119 aa, Triticum aestivum
  Clone ID: PAT_TA_6910.pep
MRPIRAGEAMVAVGHGAHPAFWRTPTPYLLLGFALMMGIIAVALLVLVCTDSKPSGSSSRRGSAGEDASARGMAPLDREPKVVVIMAGDDLPSFLASARPFAFPAVNADAGEPRNADAS

SEQ ID NO: 112493 - protein, 304 aa, Triticum aestivum
  Clone ID: PAT_TA_6911.pep
MHSKVICCKLYISESQNAAVVDAISRIGQKDPEVVLLNKFEDEYYNRVRYTLVSYITNESSTGGAVFSPIRKVLLAMIEAAFSAINLEVHCGTHPRIGVVDDISFHPLNQADTIEDAAQLAKLVASDIGNGLQVPVFLYAAAHPTSKSVSAVRRELGYFRPNHKGVQWAGQVLPDTLPMKPDVGPVHVPRERGATMVGAQPLVESYNVPIFCKDVPTVRRITRRVTGRSGGLPSVQALALFHGGNCTEIGCFRLEPDHVGAGRVQWLGEESAEEQGGEVDTDDVSGLFKTMLVQMHSGVWSAAV

SEQ ID NO: 112494 - protein, 166 aa, Triticum aestivum
  Clone ID: PAT_TA_6912.pep
LSPLSTCVHSHSSPAAPLAACAIHSMRDEVLLLDGRRVQKKDCASQYAGVVVMQLGDARDAVRSLCACITASAISSHWSVDHGRAARRCSPCGSGLVCVQSGERHLHLFPCGPSTMVVQLGDARRAVQGSCLCSPARAISSPVVRRPWHAVCGRFAMQNRAHPRAI

SEQ ID NO: 112495 - protein, 161 aa, Triticum aestivum
  unsure (1)..(161): unsure at all Xaa locations
  Clone ID: PAT_TA_6913.pep
AYAMYISDDSPKSIFEIPXAKEVAMETASFSKYAGFTGVRLGWTVVAKELLKTAGXIGCTSFQGARPHSQAGGLGCLSPEGLKAMQDVVGFYKENTKIIVDTVESLGFNVYGATNAPYVWGHFSGRNSWDLFGQILVEGIVRTPCEGGFGSGGERFVRVCP

SEQ ID NO: 112496 - protein, 173 aa, Triticum aestivum
  Clone ID: PAT_TA_6914.pep
EAANLRFMPECLCYLYHHMAFELYGVLAGNVSPTTGENVRPSYGGEEEAFLKKVVTPICKIVEMDEAERSGTTKSKHMRRRNYDDLNAYFWSRGCFRLGWPMRADADFFKKRSNLCELCSSSTPQVCVRVCFILATVRSWAQRSRRRWWWSGGGSPEFMWLSTFSDGSVSQRR

SEQ ID NO: 112497 - protein, 82 aa, Triticum aestivum
  Clone ID: PAT_TA_6915.pep
ELATRSRQGDEMEACSLLLCCSLHFQGLREHRLTDDLFLNKLVVECIVGSTPMSFILRIHHSPPCRQIVADRHCHLYILNVV

SEQ ID NO: 112498 - protein, 118 aa, Triticum aestivum
  Clone ID: PAT_TA_6916.pep
APRSRGPLKPVEMVINGIDFDISRIPTPVCSCTGAPQQCYRWGAGGWQSACCTTSISTYPLPMNTKRRGARIAGRKMSQGAFKKVLEKLAGEGYNLNNPIDLKTFWAKHGTNKFVTIR

SEQ ID NO: 112499 - protein, 168 aa, Triticum aestivum
  unsure (1)..(168): unsure at all Xaa locations
  Clone ID: PAT_TA_6917.pep
RWGVLPGAPERTGVVDAMQAFASQVLHLWEKQRLEWRQGMMANREMDXELRVMERDQVSMRKALEAQNKKLVLVSNQGGVSLSAQAVQDGDPPSEVGLQSCMNKFFEAMESFAAACANAYKDLHLRCEEERTRPCPGDRQSFLVAFSDIACTVRSNRPCGLDEQQRCT

SEQ ID NO: 112500 - protein, 68 aa, Triticum aestivum
  Clone ID: PAT_TA_6918.pep
WQEDHGRVHHQAHHGEHPPPHSGKKSRCLVCNRCRRSSMLKNITLVELVKYHVIELVEHVTMTSTIVC

SEQ ID NO: 112501 - protein, 63 aa, Triticum aestivum
  Clone ID: PAT_TA_6919.pep
MAMGHLRALLVFLLVQVCLFLMMAASAKVQGRAVPGVPACCSYRPECCERLTAEAPLAAAVNP

SEQ ID NO: 112502 - protein, 186 aa, Triticum aestivum
  unsure (1)..(186): unsure at all Xaa locations
  Clone ID: PAT_TA_6920.pep
MGHHSCCNKQKVRRGLWSPEEDEKLVKYITAHGHGCWSSVPRQAGLQRCGKSCRLRWINYLRPDLKRGSFSQEEEALIVDLHRVLGNRWAQIAKHLPGRXDNECXKNFWNSTXHRRSSYRXAVGQPPXAGFPSPALLACFLPVGAGLGIAAAGCASLNALDNAAQAVATQSPPSSAAWLNFTSQPL

SEQ ID NO: 112503 - protein, 104 aa, Triticum aestivum
  Clone ID: PAT_TA_6921.pep
MANKLLHFLFYCSKEARKQLAEERPGVNNATLSALISVKWKDLSGAEKKVWSEKAAQGMAAYKREMEEYTKERASGPRAGGVPAGGGRVQPRWPQGHLLARGDR

SEQ ID NO: 112504 - protein, 138 aa, Triticum aestivum
  Clone ID: PAT_TA_6922.pep
MANASSGAGIHDDCKLRFVELKSKRMHRFITYRLENQKEVIVDQTGEREATYEDFTKTLPENDCRFAVFDFDFTTPEDVPKSRIFYIFWSPDTAKVRSKMTYASTNEKFKRTLDGIQIEMQATDPSEMSLDVIKERAH

SEQ ID NO: 112505 - protein, 149 aa, Triticum aestivum
  unsure (1)..(149): unsure at all Xaa locations
  Clone ID: PAT_TA_6923.pep
LLRPRSRSSAKATTTSEAEHQDNFYLSFVEVTSKRNTADVTYGLDNQKGRQVHRARERDPTYEDFTQXLPEKDCRFAVFDFDFTTPEXMCQRARIFYIFWSPDTAKVRSKMTYASTNEKFKRTLDGIQIEMQATDPSEISLDVIKERAH

SEQ ID NO: 112506 - protein, 182 aa, Triticum aestivum
  unsure (1)..(182): unsure at all Xaa locations
  Clone ID: PAT_TA_6924.pep
KPVLEAXSHGHAMVAFVNKKLVGCGHGTKMNKASHASEPIEVKVGINHISILSSTLGLQDSGSYLERRQAGLHSVTIQGLNTGTLDLTSNGWGHIVGLDGERKQAFTDKGGEVQWKPAVFDQPLTWYRRRFDMPTGEDPVVIDMNPMGKGILFVNGEGLGRYWSSYKHALGRPSQYLYHVPA

SEQ ID NO: 112507 - protein, 378 aa, Triticum aestivum
  unsure (1)..(378): unsure at all Xaa locations
  Clone ID: PAT_TA_6925.pep
IRHEGISWAGXRKSMVISDMSKKRTAYHEAGHALVAILTDGANTVHKATIVPMGNALGKVTQLPGEDSHLTRKQMLARLDVAMGGRVADELIFGEAGITTGASSDLGKATRYAKDMVVRYGMSKRVGLVSYGNDINAARGKAMAMSGRTIGLVDEEVKALLDNAYRNAKKILTEHNKEFHALANALLEHETLTGDQIRKLVLTGRQGVGRSSSQQNQGTPSLIGDQIKKRVSTGRQEDGRSNSQQNQGTPSLTGDQIKKRVSTGRQGDDRSSSQQNQVTPPLAGDEITKLVSPDQQVDGGNNSDQGTSSLSGDESTKSMSTEEQGDGPNSSQHNQGAPSITGEEATKLVLTEQQADSYSGSQQDQGTPSVTRNESANQ

SEQ ID NO: 112508 - protein, 147 aa, Triticum aestivum
  Clone ID: PAT_TA_6926.pep
EVFRDVKQYPHAKSVPNILVLQLGSPIYFVNAGYLRERILRWVEDEEHICKGHGQDLQCLVLDLGGVTSIDNTGIGMLGEVHKGLDRKGIMIALRPPRLQVTEKLVVSGYIKDTIGEESVFLTITDAIASCRYGLRRFRGKEGCSEV

SEQ ID NO: 112509 - protein, 152 aa, Triticum aestivum
  Clone ID: PAT_TA_6927.pep
MAPKAEKKLAAKKPAEEEPTTEKAEKAPAAKKPKAEKRLPAGKTASKEGGEKRGRKKGKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 112510 - protein, 169 aa, Triticum aestivum
  Clone ID: PAT_TA_6928.pep
RLVDCAMAGVTIQHREACKSILCFLSDTFDLAKSAAGGKSRGVIAAEVLQRGATLARLMIASLTGALPSGRLEEVSYVLLSLSRAFGGNMLNWTRDCIALIPPQALTDSERSRFLTIISDASSGSSLGSLTDRFAEISEVCRRNKAVQDIVQAALQPHDLAFTVAPRHS

SEQ ID NO: 112511 - protein, 108 aa, Triticum aestivum
  unsure (1)..(108): unsure at all Xaa locations
  Clone ID: PAT_TA_6929.pep
SSFNTSLKAKSIRPHEHGLDGEQKFTXQACRLGQAGLCPALVGGGTKVGAGECASPLRHVISIGHHQTISGDNEAMVASGFASSRAPCYRSRATLIPSPVLLAGHRRN

SEQ ID NO: 112512 - protein, 194 aa, Triticum aestivum
  unsure (1)..(194): unsure at all Xaa locations
  Clone ID: PAT_TA_6930.pep
RHEDRNPPFDIGLYGEQILDTXXSSRTDTGIASFSEIVSSKPKXYEVARTFSALLQLVNGRSVDLDKGQATNDLVCYTGXNPFHVKLIGPNRRPEMEARFARKRVKSPQRSCGEEGEPSRVQPNSSKKQPPKNGAAAGKAADGKRRGGTGRRQPAHQLEPSRRECSRGGAWPSQSTLALVRARAKGAARRSMAG

SEQ ID NO: 112513 - protein, 102 aa, Triticum aestivum
  Clone ID: PAT_TA_6931.pep
ATEQDSLHQDIIAILGMDELSEDDKLTVARARKIQRFLSQPFHVAEVFTGAPGKYVELKEGVQSFQGVLDGKYDDLSEQAFYMVGGIEEVIAKAEKIAKENA

SEQ ID NO: 112514 - protein, 250 aa, Triticum aestivum
  Clone ID: PAT_TA_6932.pep
AAFIAQVSSQWDTNPDLATVGSCCLVAARHDRTLFVANLGDSRAVLGKKVGRSGQIVAEQLSTEHNANHEAVRQELMAQHPDDPQIVALKHGVWRVKGIIQVSRSLGDAYLKDAKYNTERIKPKFRVSEPFSRPIMSAEPTIVSRSLEPSDCFVIFASDGLWEHLTNQEAVEIVHNNQRAGSAKRLIKAALQEAARKREMRYSDLMRIDKKVRRHFHDDITVIVLFINHELLAKGNAQVPPLSIRSALDH

SEQ ID NO: 112515 - protein, 65 aa, Triticum aestivum
  Clone ID: PAT_TA_6933.pep
FSMRSCYLLPLPAALASSLNPFTTAPTHGPDKTPSQGSLIPCVPLLSVLLLLSLFLLLFSEFSVS

SEQ ID NO: 112516 - protein, 132 aa, Triticum aestivum
  unsure (1)..(132): unsure at all Xaa locations
  Clone ID: PAT_TA_6934.pep
MLKKPLCSPLALSVGSDSNGSGAVALLKIARIFSQIYSSLKTRSKFNLLFGLTSGXPYNXNGTSKVINFFYSGXSFDQHVRDIIDYAIYLSIISSXSNDLWMHVSKPPEKPYIKQIFEDFSDVSKEMGISVA

SEQ ID NO: 112517 - protein, 556 aa, Triticum aestivum
  unsure (1)..(556): unsure at all Xaa locations
  Clone ID: PAT_TA_6935.pep
VADGLACPTLGVRLGILDGVELGNAVATAPGYRLIQHGFAGAPPGSRDAALSRLTAAFVALKKELSDRTTVVAPQNGRPCSYVREXRSKKKQLGGLLILLLRNISSKYVEGNNDDKGEPKNVLAELEKLLMHEEVPFPVYFAFHEDNLDNLLAXDIRKIASSGQPAFATTGGLRCLXAILPKPKRPGHLRPTQSSLGMVXPGHVLERGDSLSCTQGILTVICCPFFVFFISGYCEVEGLSAXIVVPVGYAGMYGXIAPLCTPRGVLGHRVGLPSGGPHNYNGTSKWLRSFDQRVRESIDYAICLNSVGSWSNDLWMHVSKPPENPYIKQIFEDFSDVSKEMGISVGIKHKKINVSNSRVAWEHEQFSRFRVTALTLSELSTPPEFLESTGGLYDTRESVDVESVMRTVKLVSEILARQIYGLRGRNIDVFADNSSLAISPHYIRSWLDLFSRTPRVAPFLQKNDPFIVALKKELSEHTTDVHVQNDVLDGMFTFYDATKSTLNVYQVASVTFDLLFLLVLGSYLIVLFSFLVITTRGLDDLINIFRRPPSRKVKGA

SEQ ID NO: 112518 - protein, 202 aa, Triticum aestivum
  Clone ID: PAT_TA_6936.pep
ECVGEELISALLLHQTRCISSSLDLLLQFPFDSVWLHRLGHLELRSLTHTLSKASKNYATTNKTKTSQSPVARLLDCNYLTPLRVTWSRLDLCGENLEHISVSRGRRGIGIGVGDEIVQLLLLLLDLRCRVPFLQGTGGSRMLLGVDEPAKPLARRTEDPRRRRAKGSRHRRRPCRSDLLVVRVRVPRCSPSAAEEAKKETP

SEQ ID NO: 112519 - protein, 87 aa, Triticum aestivum
  Clone ID: PAT_TA_6937.pep
AITTARTRGKGCDKGGRELLLCTALSAWFSPHLFTNFRQTARLIWISGLQYNGEDIPLTITRRVDTSNLLPPAFQHPSQYSVPQSIH

SEQ ID NO: 112520 - protein, 142 aa, Triticum aestivum
  unsure (1)..(142): unsure at all Xaa locations
  Clone ID: PAT_TA_6938.pep
PGERLRARREGGGARALATRALQQGAARRRGGVTGSLSQLLTTLSLMAPCDLERTNKQLSRLRXMNQRVTAEYSNSGDVASGLPVCGDQLNGKNQRFDGFTTQIDAIDQQVSGFVAVVPWLHKLVSMLASKVKSAYPLAPTL

SEQ ID NO: 112521 - protein, 171 aa, Triticum aestivum
  Clone ID: PAT_TA_6939.pep
CSRPLLPLPTQPLGLNLSFHGFGGGGVAGEDAKNNTASNSFDPPPLLQQPSPASSYSVYSSPPATTMASQDVASATVENTSPSLHRVLDEEEMAAIYSVGERHDIEWSDTLNLATSAWWSTLLDDGAAVGHQTDSVDIPGMHLGDVYYGEDVSFPRMEIGEMGGWDEEWLS

SEQ ID NO: 112522 - protein, 271 aa, Triticum aestivum
  unsure (1)..(271): unsure at all Xaa locations
  Clone ID: PAT_TA_6940.pep
VVPSRRARRVARVSTDRRSPVASSNGHIKDVRHYRAGDQAPESELAYDFGDESVWAPASAGRRAPGGPCLPSRLGVHDSSPTKKGTYSDQGGSESVFGDNYGDDTTWNSDDQDTESVWGLNAMSEPGLLRSPCLRRPTGKPLFQVRLGNXSKGESAAGFDSSLCXDSVPPARVYSSGLSPKFGETRDDSSSYNFGKVRILHDPYDGAVPXRARLSILGSQCSTPKRDSAAGFDSXPSSSRSFGRFDSFDEADPFGSTGPFKASGARSPPKF

SEQ ID NO: 112523 - protein, 109 aa, Triticum aestivum
  Clone ID: PAT_TA_6941.pep
RSGISCISKGREQLVHLCDALLPVVPSKLSLSLRGPAFVDYLSSTCQISQLENLRLTDSEVANKQRRCRQSRHYLSSAALSMSPEGIELLAQSSRFGDRREKVIDQTIA

SEQ ID NO: 112524 - protein, 379 aa, Triticum aestivum
  unsure (1)..(379): unsure at all Xaa locations
  Clone ID: PAT_TA_6942.pep
KEEQGRPRSMEPIPLMTPYQMGPFEFSHRVVLAPMTRSRSYGNFPQPHAIRYYTQRATEGGLLISEATGVSADAQGMSAIPHTPGIWTKDQVQAWRPIVDAVHAKGATFFCQIWHVGRASDMQQEPISSTDKPIERTPQNYSMDFSTPRSLTEEEIPDVVNQFRIAARNALEAGFDGVELHAGNGYLLDQFMKDGVNDRADGYGGSLENRCRFTLEVVDAVSNQIGPYCVGVRLSPYSGLXGCRDSDPDELAVYMARELNRRDILYLNVVEPEMAWEYDGGALGVGHHRLQAMRDTFDGTLMVGGGYGREEGNCAIAEEYADLVAYGRLFLANPDLPERFRRNAPLNKYNRATFYTDDPVVGYTDYPFLGQTSKGNGVI

SEQ ID NO: 112525 - protein, 318 aa, Triticum aestivum
  unsure (1)..(318): unsure at all Xaa locations
  Clone ID: PAT_TA_6943.pep
MAADPGVVETRIMRELPPCLSRFAFFILRTLKRSPGRSAQLLSETAKEIHRQQPDAXLNAFQVDLSSHXSIKKFEASLNQXWFRDSNLEPSIQLFDSIMLGLLAKSHRVTDDGDSLKGDCMPTLHLVQFILTSILLPPLKNSPVPSRVVNLTSFTHRCVSEIDVSEEALQGVKFGQHSVGGSYPLASTYEYTKFCLLVFSYELHRQLHISSGISVMAADPGVIETRIMRELPPCLSQFAFFILRTLNLLQQPDTGIGAVLDAALAPPEASGKYFFGGKGRTIRSSVLSYDIEVAKKLWAASSALLQELRLRDCELRTG

SEQ ID NO: 112526 - protein, 90 aa, Triticum aestivum
  Clone ID: PAT_TA_6944.pep
GEMLLFFTLQAAFHVAERWARVAGLWRPPKAAAYLVGTTFMVVTISELFFGPFIRAGIDVRMIQEAAEAVELVRAVAKRLIVRLFGAGSS

SEQ ID NO: 112527 - protein, 135 aa, Triticum aestivum
  Clone ID: PAT_TA_6945.pep
KVSSAKKIRIKIFRGATGSSSSLLQSMWVCHRGTPCLEHTRRSARQPCARNHRRPPDHRRLHTPGSHFRLQHLHRRPPRSHILLLLLSPGLPAAPPLALLCLHRLQLLQYCHQQEKGHRRRTSAPPPGEPSRRIR

SEQ ID NO: 112528 - protein, 123 aa, Triticum aestivum
  Clone ID: PAT_TA_6946.pep
EATETTSHKSRRTTSQDLSLPTNDDMPRSKRTWTPRRRPKESDDAMRRRRRDRRNDQGFSSGALTRKEGPRRRPQEGDDTHRHRRRRHRSAELSLGASPMPHRGILITKPVVTKSSLHITMRE

SEQ ID NO: 112529 - protein, 214 aa, Triticum aestivum
  Clone ID: PAT_TA_6947.pep
MMPTTEPEMLPMNLGWVLPALTDAKIPEKGCLLKLVCMLLGYSGAAAPAAEKLPQLLRILLRASVRGRRIASVAPAPIREPVALAFCSHKGLPLSASAELALPVAEAMFLFAIIYYYSPPMGSITLVSAFLDCALAPILVTGRLVPLVSKLLDSSLLATFSSVKLPQILKNLKNGSVGGLSLPSSVLDFVGSPVILFTCIHEELPLRDFIGLAL

SEQ ID NO: 112530 - protein, 138 aa, Triticum aestivum
  Clone ID: PAT_TA_6948.pep
QICTGCIPPLSYKQLQNFSGFRGHEHYRAPSRGYTIHSGKRSVELNKLAGLNATLLGATPGRTDRSHAEDSAAPSATCTRLYADSARCQRAMHTLRRGSLPPFLLPFAPTTSTSNNSPRRPVFCRPGISYAGRQRALE

SEQ ID NO: 112531 - protein, 205 aa, Triticum aestivum
  Clone ID: PAT_TA_6949.pep
MENAGVPNGPAAPAPTQATPVVREQDRLMPIANVIRIMRRALPAHAKISDDAKEAIQECVSEFISFVTGEANERCRMQHRKTVNAEDIVWALNRLGFDDYVVPLSVFLHRMRDPGGNRWCRCRRQARCDKCTSPRGPARAPRHAAACSDAASDVRASGSSAGSESDAAANLRAPSSDAGSESGAVAHVRSPASGASSDAAGRLRA

SEQ ID NO: 112532 - protein, 187 aa, Triticum aestivum
  Clone ID: PAT_TA_6950.pep
RQRRKGRRNRRDTPTAVMFPPGSVEGRQQPQERRSSLPVKIRSSKTKQRMALSLSQPVDQVGGRFSALVDCLVRKGHLPICLTLRSLMRVQRLTTQTMFWPGEIPVCLHQFMSEWIVQEFFYTYPTLGDKPLQSLEEVGSAVDSYACPNGPNSNVMSDKMLSKKERAVQEHLYFPNGTSKVYTQGLK

SEQ ID NO: 112533 - protein, 221 aa, Triticum aestivum
  unsure (1)..(221): unsure at all Xaa locations
  Clone ID: PAT_TA_6951.pep
DGDPAVRVAPVRDVSVAGLPAAPLQLVLPPSASRPPHVVLGPHIDLALVAFCQLEKQEQCSYNVIAYKDKPRLRTALGDAXTTQEIESRLQEVSLPIIILXHGEADLVTDPGVSKDLYEKAKTSDKTLRLYKDAYHAILEGEPDEGIFKVLDDIISWXLDQHAAKETPSVVSCTDHFLSFVRAPQVTVGDSILGFTLYTRLFPVDCEYVPSNKKKSSSVGV

SEQ ID NO: 112534 - protein, 92 aa, Triticum aestivum
  Clone ID: PAT_TA_6952.pep
LIYLTETPLASPWPKGIDGDHHMRARLDGRLCPHFFSSFFVGRNTGFFLGGAGFFLNDVGFFNGVRLDDAFTFLERSPAGGMMRSASLFFFP

SEQ ID NO: 112535 - protein, 267 aa, Triticum aestivum
  unsure (1)..(267): unsure at all Xaa locations
  Clone ID: PAT_TA_6953.pep
MPLSNSTSSVPAVTVPAAEELLRQGLRXQSLPRHVALVMDGNSRGPAPRARPPPAGPGPGCPPRRRPGRPPPPGGSPGPPPFGFSXETGNRPKAEVDFLMALIERFINRQPRRFLEGNGTRLRXSGDRSRLPISVQKTARXAEEATRNNSQLDLVLAISYSGRMDIVQACRNLAQKVDAKLLRPEDIDESLFADELQTSETSCPDLLIRTSGELRLSNFLLWQSAYSELFFTDTLWPDFGEAQYLQAMMAFQSRDRRFGRRKNNAAL

SEQ ID NO: 112536 - protein, 349 aa, Triticum aestivum
  unsure (1)..(349): unsure at all Xaa locations
  Clone ID: PAT_TA_6954.pep
ARPGQRGPNPSQLAARNPPQISPSSPHPPGPLALPPLPASPASSSRASRARIGVTKHGGGRGRGCCFCGGARLVGDGRPRRGHEPPAPLLLLLLLRWRGAKGLLLARPRRRPPGRRAAGRRGSSSGPTIAAQVDQFLXEALEKPRXRLQVLRMEQDILKFLRDPGQTQFEFQGLPTSYLRLAAHRLAQHYFLISIALPDNSLPDGTSSRIILRKTSAECRLPAVRLADIPVNLPQEESSAVATKVAIKQRPQKNQHGGAGAGANSNRGNLQKSVEERKEEYNRARARIFNSSSGSTSPVDGRPADEVVLPNTLHRSTSLELNSNTRFGELTEATLERSLTSTASSSRSN

SEQ ID NO: 112537 - protein, 166 aa, Triticum aestivum
  Clone ID: PAT_TA_6955.pep
LPRRAAAPQNSRRTTPPIPWRPRPPAELSPRAVSGGRHPSSPLARLPSISDGPTAPSAPPGGGSGPATNPSSPATDCLQYPPLFSLYRQPWRPWRPRGWKGSRGPEIARGAAVPAVTPQEDRSVVLCSMDSSTMEFIVFAFLFHIFYVQKYNSVQFFLLFEFWFSG

SEQ ID NO: 112538 - protein, 248 aa, Triticum aestivum
  Clone ID: PAT_TA_6956.pep
LWVGNTINMIRIIPTQAIELGTFEYVKRGMKSAQEKWKEDGCPKIQLGNMKIDIPLHLLSPVAIAGAAAGIAGTLMCHPLEVIKDRLTVDRVTYPSISIAFSKIYRTEGIRGLYSGLFPTLIGMLPYSTCYYFMYDTIKTSYCRLHKKKSLSRPELLIIGALTGLTASTISFPLEVARKRLMVGALQGKCPPNMVAALSEVIQEEGLLGIYRGWGASCLKVMPNSGITWMFYEAWKDILLAEKDKHLD

SEQ ID NO: 112539 - protein, 84 aa, Triticum aestivum
  Clone ID: PAT_TA_6957.pep
SESQGVAPGGVWPSSLTLGQTEDLTRFGLYVLPSAMVPRPWRISADGYPMQGPPATKEDLRAHPGGTTTRRTAAIFVTASGSTT

SEQ ID NO: 112540 - protein, 126 aa, Triticum aestivum
  Clone ID: PAT_TA_6958.pep
MAGPPPAGDFYVNFSAGDIGRDSKIWKDPDEFLPERFLTGGDGEGIGPLPGPKQIRMMPFGAGHRFCPGVGMAMVNMKCFLAALVREFEWAPPTGTIAIDLTELDSFFKVMKKPLSARVTRRTKSI

SEQ ID NO: 112541 - protein, 111 aa, Triticum aestivum
  Clone ID: PAT_TA_6959.pep
SARGPLQQFDTILDMEKDDLAPEIEEEEEGEIEYVEGDDIQMGDMDDMEDFEGFGDEDDDGDEDDDLDEPATKKPKLPGSDSRSKIGRKSTKVITEVEEDEDRGSRQRTRM

SEQ ID NO: 112542 - protein, 73 aa, Triticum aestivum
  Clone ID: PAT_TA_6960.pep
VDVLCEANVADGLEECEEWLKAHGAVLAVDENSGELQIDTKVSSASLYMPEPDNAVSHGDASLAVDDFLARAS

SEQ ID NO: 112543 - protein, 261 aa, Triticum aestivum
  Clone ID: PAT_TA_6961.pep
TPSAASRALGRRSSTAPPPSTESPSTPSPPPTPPPSSAWCTSRAAPATGSFATPPASLPWRTSTSPSSSSASASSPSSTTTPPASQRFGSSSTTSATCAGISMSSDPATCPSTSPTPPASPPQVRLTPRTPPASPPQVRLTPRTPPASPPQVRLTPRTPPASPPQVRLTPRTPPASPPQVRLTPRTPPASPPQVRLTPRTPPASPPQVRLTPRTPPASPPQVRLMPRTPPASPPQVRLRHRYMVFACVPYERENSGLTSCC

SEQ ID NO: 112544 - protein, 141 aa, Triticum aestivum
  Clone ID: PAT_TA_6962.pep
LKHAGYNPKLIYHHRTDVAGQHTQEPRSRPDSHTYKENKQQSRAQQHQTHYKNTRANTDDVARHGVPTACAGTSLMQSGVHHVAGVVLGHLPLRRRRVHLGVRGGARHASARRRARLGLAQERGALRRAPLVGEAGDAVAL

SEQ ID NO: 112545 - protein, 120 aa, Triticum aestivum
  Clone ID: PAT_TA_6963.pep
SPYPPAHTGHRTDSTPSTRHFVEPAGGSCVGDQQPLHLSHTRDSLRILRAPCLVGVANVDESPYPPDHRARISVRTYRTDDFVESEGKCLVVSKQWMQVYKIRDFIRTLDAPCLVGVVYI

SEQ ID NO: 112546 - protein, 176 aa, Triticum aestivum
  Clone ID: PAT_TA_6964.pep
MSDSDEYVDLPVSDEEEDEWEGGDEADEEEVQGSSKKKAKQHVDQLKRLQEKDPEFFKYLEECDKELLEFNDDDIADDQESDEEPKSVPKEEPKESVKPITMEMVDSWCKGAEDGKIGSIRSILQAFRRACHYGEDSGDNSAPKFSVMSGSVLDKVMHYVLKNMDSILRQLLGAPS

SEQ ID NO: 112547 - protein, 148 aa, Triticum aestivum
  Clone ID: PAT_TA_6965.pep
SSLFLSMYCASAWAWTCFLFRTFEKCSTPLVVLGTFPAGLALFIEKKSRRTEISLYCLARAIESFFTCMTDAGLCPPILQIKRADVVVFSMATSIIMHCYAQEREVFRSKYLNVLDWVFGVPLPSEDDSKHHSSTSSDGIKKGIFSIG

SEQ ID NO: 112548 - protein, 396 aa, Triticum aestivum
  Clone ID: PAT_TA_6966.pep
PARADPKYLGCWPEGSTGLEGHCGGRGWATAQAQRGASIAGQLAVPWLHSRPPRAVPLAGRAPWFLQLLGGTGDKAGSRPPGNRSQSSGPSGVAVPPFGSTVISGADRRQLEQLTGEFYTVIPHDFGFNKMCEFLIDTPQKLKAKLEMVEALGEIEIATKLLEDDSSDQEDPLYARYKQLHCDFTPLEVHSKEYSMIKTYLTNTHGKTHSGYTIDILQMFKVSRHGETERFQKFASAGNRMLLWHGSRLSNWAGIFSQGLRIAPPEAPVTGYMFGKGVYFADMFSKSANYCYASQTSRSGVLLLCEVALGDMNELLNAKYDADNLPKGKLSTKGVGQMAPAESKVTEDGVVVPLGKPKEEPSKRGSLLYNEYIVYNVEQIRMRYVLHVSFNFKGGR

SEQ ID NO: 112549 - protein, 189 aa, Triticum aestivum
  Clone ID: PAT_TA_6967.pep
ACELEPLHPTTPATAAVGARGCSPVRQSRPASARRISREARTPPASPPLSPTTVLRTPPAPKRDEAHAAAVASQVLSPVLIELCLPATMQRPLLDISPLRPPGFEASPTPPLQCNGNLQRTPTPPRARPHDAGHDLPAGLAELIVPCLELPATLFCPRQPALLPSAATQPPPEVPLASPRPSPPAARRK

SEQ ID NO: 112550 - protein, 345 aa, Triticum aestivum
  Clone ID: PAT_TA_6968.pep
SRDSTQSSSSSMQMSLVDIAFLAPLKTRAHKLLLALLYFACLLLLRPALDVLLPLILLLLLLDVHCPLPVLPLLRMLLLPLLILLHALFNQLGVVVHLLPSRAPCCHIPGHLGGLFRILLCPLHPLSLLQLLLLVLDPPLLPPPCFLWINQHIAIHDIWCLLFPFLLVLLPILTLSIHRRIRLFPRFSLLRAFLSCAGPWMFSFRLFCFCFFLMSTVLCLSFHSSARHPRRLIPCLLLPFINLGLSRTVPVAAGAVGGCQAVGVAASGSCVALRLRLARPRPLVGDGLLEKVQGGGRRGRRDAAGSAGSGAIGAGPSLRGRPGGPGEAPVVGANIIVGAEFVARG

SEQ ID NO: 112551 - protein, 159 aa, Triticum aestivum
  Clone ID: PAT_TA_6969.pep
MPCAAELVNGEGGAIKVGTTGTIGSLMTRELEAIKVTPQGAATPRLRRQSSPVSVPCGASPRKIIPRKSSSSVSSSSNGRADRVSAEEACKTRRSSQRNKSSSPMLHSDGVLVDRSPNFEKAKKKGNVHGVEVVDVRCGNPMSSRLRKLGFSKLSETFA

SEQ ID NO: 112552 - protein, 175 aa, Triticum aestivum
  Clone ID: PAT_TA_6970.pep
MKFRVVCRKLYDYVRYDLKEIAFPSSLPDPPGTKRRPKLTLKEKWCILKEATRLYGASWVRDIGPELRPNDYKKVKEESEPNSTKDGKTKSEPSLLEDLAVAAKGGAETLKPALRRIYMTRASTYTSAVKNYVETYQEGLKDVLDEKVAGKDHQQGNEPRGPSTPPPPPPPPSSS

SEQ ID NO: 112553 - protein, 40 aa, Triticum aestivum
  Clone ID: PAT_TA_6971.pep
HLTGEQLSHVASLPKITRSTIFMSSGLSTRTIPSDPSTPR

SEQ ID NO: 112554 - protein, 256 aa, Triticum aestivum
  Clone ID: PAT_TA_6972.pep
MGFLEDFQASVETLPAMLHKNYSLMRELDKSLQGVQLENEQRCQQEIEDIKHGLESGSITTYEPAKLKFSDEAIEEQKHCVRIADEKVALATQTYDLVDAHIQQLDQYMRKLEELRLEKEAAAAAAAAAADTAVAATSAAPAGAGSLRSAAADPAPKTGRAGERSRGGRKKAKVPMEMPTEMPVEQPAIDLELPVDPNEPTYCFCNQVSYGEMVACDNPDCKIEWFHFGCVGLKEQPRGKWYCLSCSAFQKKRKGR

SEQ ID NO: 112555 - protein, 121 aa, Triticum aestivum
  unsure (1)..(121): unsure at all Xaa locations
  Clone ID: PAT_TA_6973.pep
MQPPLELSPPAPAPREVVVAEWPSKKICHCLVSTSASSEQRVWADLPDSLLHLIIALLSSFHDLLAFTXTCHSWRAAVFSFPSXIYAFVFPPLHLKAGLRRANRHCDTWYYLLIELQMASL

SEQ ID NO: 112556 - protein, 126 aa, Triticum aestivum
  Clone ID: PAT_TA_6974.pep
AQVSGGCCSHSIIAAASRHWKHIPHVSEGWANCVTSAVEEDGCRKTTLLKASGDRKEITAAGIERPYREVGCFALGVDASSPCIQGGQREMIVLIPCGHCRWILSQVTWGSCWELSRLLLEMRIAN

SEQ ID NO: 112557 - protein, 133 aa, Triticum aestivum
  Clone ID: PAT_TA_6975.pep
FGTRLVSTGELRIPKFDVSVRLEATQILRDLGLDLPFRLTPAGESFSEMLALDEHDSKMPMAVSSVVHQCSVNINEHGTVAAAATEMEILGFCLPEEKVVDFVADHPFLFFIIKEEDNNGVILFAGQVVNPLS

SEQ ID NO: 112558 - protein, 218 aa, Triticum aestivum
  Clone ID: PAT_TA_6976.pep
MVKLTMIARVTDGLPLAEGLDDGRDQKDSDFYKQQAKLLFKNLSKGQHEASRMSIETGSYFFHYIIEGRVCYLTMCDRSYPKKLAFQYLEDLKNEFERVNGSQIETAARPYAFIKFDTYIQKTKKLYLDTRTQRNIAKLNDELYEVHQIMTRNVQEVLGVGEKLDQVSEMSSRLTSDTRIYADKAKDLNRQAFIRKYAPVAIVIGVVIILFWAKNKIW

SEQ ID NO: 112559 - protein, 244 aa, Triticum aestivum
  unsure (1)..(244): unsure at all Xaa locations
  Clone ID: PAT_TA_6977.pep
MVKLTMIARVTDGLPLAEGLDDGRDQKDSDFYKQQAKLLFKXNLSKGQXKPHGMSIETGSYFFHYSIEXGELCYLTMXTNFDPKKLAFQXLXGLKNELDRANWNHIXTASTRLCFEIFMNTYMQXTKKLDLSNHXDRNLSRNWMHEIYEVHLNRCLCNGQEVLGVGEKLDQFTYVSSRLSSDTRIYADKANDLDRQAFIRKYAAFAIFICVVIILFWANNNDMVTLLNKKAGLLLHWREKFWFK

SEQ ID NO: 112560 - protein, 87 aa, Triticum aestivum
  Clone ID: PAT_TA_6978.pep
PREPERYRLRWSDLFHTALSLVAFVTFAASHHDIVRCYYPGAPRKVVNTVPLVVGFVVSLLFVMFPSKRRGIGYPFLLRTDLVYLRR

SEQ ID NO: 112561 - protein, 200 aa, Triticum aestivum
  Clone ID: PAT_TA_6979.pep
MSAKKGLSSTLRNLKFMQRAAVAQKIEDKADVEVEEPAAEVVMTPAANGGGVGSSVQVARKCVVVMEGNPLPGAVKGRMSFQNFNPSIDKLNDEASGRPTQSASPSNSQQDSANTSRVDDISASRFRSFNVDSSESISLNELKRKEPELEMETPPSRKLPKTTGQNVDGQPSSQSNGRGSGKSNKHEKLDFNLLRKRKSK

SEQ ID NO: 112562 - protein, 138 aa, Triticum aestivum
  unsure (1)..(138): unsure at all Xaa locations
  Clone ID: PAT_TA_6980.pep
CDSEAVAPECGESSDSCQQWRQNGDWVSWCVVSSLGLAGSTRVHVCRREWAGWLGSTCNALGVACDRGPGTGTGHECRVTGSLVLKDDVQSVDDAGNVTENGEENVDAEVGTAAALEEDTDGREDDGKNDXCRCRWRC

SEQ ID NO: 112563 - protein, 435 aa, Triticum aestivum
  unsure (1)..(435): unsure at all Xaa locations
  Clone ID: PAT_TA_6981.pep
MELYPGYLEDHFNIHKLSGTGGASPPEYMTSAAATQYAPAPLRMAMYERAPQQQHHHHHHHQQQQQQQPQLQPALGMWSSEPYKVDSGGQATSGSSIMEPDAKFDHAGLDDDPHMDELETAGDADQGASKPKEKVMRRLAQNREAARKSRLRKKAYIQQLESSRIKLAQLEQELQRTRQQQGMYVGSNPGASLQRHHGGGSAGHFGFAAAGQMMMDPPRVRFEIAYGHWVDDQKRNTEELRSALQPGQGTSELELEVMVQTGLANYDNLFRIKGAAAQADVFCVMSGLWRSPAERFFLWIGGFRPSEVLKILSPQLQPMSEPQSVAVYALQLTSAQAEDALSQGMQKLQQTLAESLTDPFAAXTPTWAGAVEKLKGLVGFVQQADHLRLETLQNMHRILTTRQAAKGLLVLGDYFQRLRALSTLWAARPRESAIS

SEQ ID NO: 112564 - protein, 147 aa, Triticum aestivum
  Clone ID: PAT_TA_6982.pep
MRGVGGPLLTVSDLLSDLAVEGGDDHLDGGGDASVPSSPLAAHQVEEADPSELQRLFAEDYDNLMKSLQENDPSWPSLMLKLCRTLKTSDKLLSYANMKAEQLLEKAEKLEHVLERGDREVGSIIEVLQSMQLTEDHQISKTNPPSK

SEQ ID NO: 112565 - protein, 164 aa, Triticum aestivum
  Clone ID: PAT_TA_6983.pep
PPPQPIYKTGGTSTKFTYSPIQQRANTASQIHKFMYGNKRKRKKKKTRIPKVLFNSKIYLHTLHTHRTYSPRRTPPVHDRLERTKTPTASPAPSISSTGGDWTRATTAADVQPRPPCVRPRPEPGRLGYLCTLIADHASKAEVIDCNKGYSVPIEGPDDQLNCW

SEQ ID NO: 112566 - protein, 396 aa, Triticum aestivum
  Clone ID: PAT_TA_6984.pep
GTSSSQRFTSPPPKRVGSDKSVYGKSLGREGCDMGPSPDWCSTPVVSDKHNSQKDSSWTRRYFDNGGRRRVSAVETVRSRTVSMAQAVQSTVDWELDPTKLLVGHRFASGAHSRLYRGLYDDKPVALKFIRRPKNDAGGIIAAKLDKQYNTEVNALSHLHHKHVIKLVAAHRVGPVYYIITELLPGGSLRSYLHNPEHCPLPLERTISIALEIARGLEYIHSQGVVHRDIKPENILFDEKFEVKIADFGIACEETLCDLLVDDEGTYRWMAPEMLKRKPYNRKVDVYSFGLLLWEMVTGRIPFENLSPVQVAYAVANNNKKAMEPEDYCPAVVRPLIEQCCALQPEKRPDFWQIVKTLEKIQSVMSQGGRLDALRSSDHKKGLKHWIQKLKPSHGA

SEQ ID NO: 112567 - protein, 134 aa, Triticum aestivum
  unsure (1)..(134): unsure at all Xaa locations
  Clone ID: PAT_TA_6985.pep
GAATEKDVDMQMRMXKDLMMSSIWKLNVVDIEVTLLHVCEMVLHENNVKKEDLKARAMALRNLGKIFQREKEALPGPSKPTILDDDSSSDESSDEEASRTVTYRTPXLTQGIGRLFRCLCNPAYDVDDDFEPRK

SEQ ID NO: 112568 - protein, 51 aa, Triticum aestivum
  Clone ID: PAT_TA_6986.pep
NRTAQFISSGEAHKSYYAAATTAPRTVTEQQHILRLEMRKIRSMIHYCWGT

SEQ ID NO: 112569 - protein, 156 aa, Triticum aestivum
  Clone ID: PAT_TA_6987.pep
PLHGLRVRTLHEDEQLTALEKIHHGFPEVRGVIVEKVEVPSAEHSEIKVGDIITHVNDVPFSSAAELGGILLDTCAQHMLQRQKLDPTKGGNQMETVISLKFDVKTVRGRRSEATTRTIDVSRFNPTGGFNRWPLGRLYFIRRVENGTLFTEKHRG

SEQ ID NO: 112570 - protein, 245 aa, Triticum aestivum
  Clone ID: PAT_TA_6988.pep
RRSCSVVPGPLPALCRAFSVCWLADCSWLPVPVCSFRGLGSFVHFALPSLLHGLCTPHACAASSRRGSQPCTSPPGWPPAGASQEPPAGCRSPAAPQAWASEWCPGRVPVALWCPRVAPYWGVHRGVQGNRRTSLRPLHSPSPRVVSRSRPILLPACSAQLTTLLYYTSSFLTIPGQSLPLLFFQRGDLRSVLTGGSIYRVPDGLPPLVGAPRARNVRPDLERMGLLPLLSQQRGASPPQCLPDA

SEQ ID NO: 112571 - protein, 312 aa, Triticum aestivum
  Clone ID: PAT_TA_6989.pep
AHQAPAIQPCDGTQHPHRPFLDRTAHLRDQVGFPPYKSGRGCRPLSAAIPPPPRPFPVRAARLRDQVAKAEIGTGKMEADLIGAGVGTGKMEAAPVGAGVGTDATQISDRGGAAWRSRLTSSRRSRRRRSTWRSSSCEKPRTPSLLRVASLRRARSPTCRSQSGCPRRPTIRTGRQPERGDRSRLIAPGLYRGTLAQRRALQRATRQHLRLETRNVDSLAMQVYRELKKTAILGDKVLSPVDVARVLKAEADVSGLHPNDLKTWKLIKACTGNINSVSGVVSTAGSAGGAIWTLRQWNTSYPMTELPEDFFW

SEQ ID NO: 112572 - protein, 175 aa, Triticum aestivum
  unsure (1)..(175): unsure at all Xaa locations
  Clone ID: PAT_TA_6990.pep
MREPPXFLPVQIVGRCLRHFKAYGEVKQPWLGIRGRSLHLLESARLEEICHKFSKPPSGVFVDMIPEASSANCGGVEVGDILNQLDGVVLHSIAQLTSLLLDKMEVAMHERRPVILKALIQRPKDGATVAAKLIVAERPPGECDTLLNNRWTLPPPTVYYWGPPDICDWVDDDSD

SEQ ID NO: 112573 - protein, 142 aa, Triticum aestivum
  Clone ID: PAT_TA_6991.pep
MGLYEADRVGCANTHATANAVTDEDLDELKGSMELGFGFNEENGGQNLCDTLPALDLYFAVNRQLSEPKMRVCSRSLPSLSVVTSSSSMHSGTPSPAGSPTAQPSLLDSLKISSPAGENPQLIKTRLRQWAQVVACSVKHSS

SEQ ID NO: 112574 - protein, 238 aa, Triticum aestivum
  unsure (1)..(238): unsure at all Xaa locations
  Clone ID: PAT_TA_6992.pep
MANSCREHKRGVPRPPPLSLFIGREQEPAVARTHPAAADNSNKKRMLSKQLSMKETTREVKWEKRRRQIQRQRSSMGLYDADRVGCANTHATSNGVTDEDLDELKGSMELGFGFNEENGGQNLCDTLPALDLYFAVNRQLSEPKMRACSRSLPSLSVVTSSSSMHSGTPSPAGSPTAQPSLLDSLKISSPAGANPQLIKTKAKGXAQGVACSVMQSSSPAEMDGSTEPPVLQNSCTFN

SEQ ID NO: 112575 - protein, 556 aa, Triticum aestivum
  unsure (1)..(556): unsure at all Xaa locations
  Clone ID: PAT_TA_6993.pep
MDASAAAAAEIAANGVLAKLEEEREAQKRYWEEHSRDLTVEAMMLDSRAADLDKEERPEILSLLPSYEGKSVLELGAGIGRFTGELAKTAGHVLAMDFIESVIKKNESINGHYKNASFMCADVTSPDLVIEDNSIDLIFSNWLLMYLSDAEVEKLVERMVKWLKVGGHIFFRESCFHQSGDSKRRVNPTHYREPRFYTKVFKEGHAIDQSGSSSELSLLTCKCVGAYVKNKKNQNQICWLWQKVNSTEDRDFQRFLDNVQYKISGILCYERVFGQGFVSTGGIETTKEFVDLLDLKPGQKVLDVGCGIGGGDFYMAENYDVHVVGIDLSINMVSFALEHAIGRKCAVEFEVADCTTKTYPDNTFDVIYSRDTILHIQDKPALFRSFFKWLKPGGKVLISDYCRSPGKPSEEFAAYIKQRGYDLHNVETYGQMLQNAGFHDVRCXRPHISDYCRSPGKPSEEFAAYIKQRGYDLHDVEAYGQMLQNAGFHDVIAEERTDQFLKVLQRELAEVEKNKDEFLADFGQEDYDDIVTGWNAXKLQRSSAGEQRWGLFIGTK

SEQ ID NO: 112576 - protein, 251 aa, Triticum aestivum
  Clone ID: PAT_TA_6994.pep
TKLRSASSISPTQLNSIDQIAMAAEELPVQIAMAAEELPVPDSPPSTRSTDSCLRALAREDDYVILIPHSRIFALMLQALKLPPAIYHHKTYPGNESRVTVTFNSSLQLFDGLLVPTSISGVVSNNYDEAEDSAAIAAIRFMEDACGKEIRDYHCTHVKKLENQVTHLVKLLVAANKTIKKVRKGWYYAVRYMSSYSTQIQNTTAARRLKGQDNTKGAMKTALASTGKLAKRLRYIGMKSEQRLETTDSIW

SEQ ID NO: 112577 - protein, 187 aa, Triticum aestivum
  Clone ID: PAT_TA_6995.pep
SSGSPLSSRPLFRSPPFLMAPVIDKRAELDTAVAGFSASLAQVVSITPSGTPGAPEYRYRVGFGEHAPAGGGGDVVRGSEQMLVCTDKADEWNTYSTTVIIPQNDACAFDGGRPPSVALREASPSAGSRGRPGRGCEKLGGAPVFDMHGLFVGLVHSFATVSRDNTLNDVVFVRRAVRFGVPECMRV

SEQ ID NO: 112578 - protein, 290 aa, Triticum aestivum
  Clone ID: PAT_TA_6996.pep
LIPSLLKESSKSSKFSSIGSRFKLQLQSLMETLSSTDPHYIRCVKPNNLLKPAIFENTNVIQQLRCAGVLEAIRISCAGYPTRKTFYEFVNRFGVLGPELLEGSNDDKIACQKILEKMKLENYQIGKTKVFLRAGQMADLDARRAEVLGKAARIIQRLMRTYIARKQFVLVRRSTTHLQSFVRGTLVRNLYECMRREAAAVKIQKNVRRHKARESYLLLQAATVTLQTGLRAMSARKEFRFRKETKAAVHIQARWRCHRDYSHYKNMQRAVLTYQCAWRQRLARRELRNL

SEQ ID NO: 112579 - protein, 136 aa, Triticum aestivum; identical to SEQ ID NO: 106789
  Clone ID: PAT_TA_6997.pep

SEQ ID NO: 112580 - protein, 132 aa, Triticum aestivum
  Clone ID: PAT_TA_6998.pep
GEDEDDYLFQTVRPGEKTLKWDYVPELRGVQITNNSADTFEPLPIKISAKKMGNISRFMNHSCSPNAFWQPVQFDHGDDGHPHIMFFALKHIPPMTELTYDYGDIGADSSGIGSPGAKRCLCGSSNCRGYFC

SEQ ID NO: 112581 - protein, 99 aa, Triticum aestivum
  Clone ID: PAT_TA_6999.pep
QSQRPAKRARQSVKGTSSVSDGNRTDAAPNAAPSGPSTAHTQADARRKRRNRNDSEQKRDKASKRARKDASGVGGVDKSLAEQYRSKFLQHGVNKTKAS

SEQ ID NO: 112582 - protein, 265 aa, Triticum aestivum
  Clone ID: PAT_TA_7000.pep
MASCSHPWLFPGMSPPPVASTAVPVPSFCKSSKVFASLRQRRKAGSVAPARTRRCTIRCVKDESIHFDPSKIEAPPYSSYFDSTSGQLEPASGARASIPGQEYWPEGTAARVRAARAPAPVGESAGTPSLGKKPGSRRKGYKGQVASASAAGGADTGGDDGEFIVATEVPLDDTLEETNDSLDEYVIYEAPKEESLSEYEMDKMMGRPHPFVDPAKAMLAEEPKSSEELWWNWRRKSEAEMWSRWQRRRPDVDTVFAKAMAETGQ

SEQ ID NO: 112583 - protein, 170 aa, Triticum aestivum
  unsure (1)..(170): unsure at all Xaa locations
  Clone ID: PAT_TA_7001.pep
MDGGGERGITKKEAEAEYHCHDFEWEDLRADVEANPSFSYHLSPFPTTTASPQPPSSEAWRSFHRRHASGKFFKERRYLLKEFPELLNSKGCAKVLEVGCXNGSTVVPILRCSPSITVYACDCSEDTLEKANEIVCNTQGVDAKDRFHPFLLDVSKENFPGWLFCKCCQS

SEQ ID NO: 112584 - protein, 298 aa, Triticum aestivum
  Clone ID: PAT_TA_7002.pep
MNPPPLQRREQGPVSSIYTHQGMICFYPDERPCNGFSEALERYRELVPHLRLAGPTSFAPIIEMAMTIVEQSGGQYHVLLIIADGQVTRSVDTASGQLSSQEQKTVDAIVRASELPLSIVLVGVGDGPWDMMKEFDDNIPARAFDNFQFVNFSEIMSKNMPQSRKEAAFALSALMEIPQQYKATVELGILGRRSMKAPERVPLPPPGGSHDAYSYGTKSFSKPQPSTSSSAYPPYETAHTAAPAAPSSAYDNQVCPICLVNPKDMAFGCGHQTCCECGQTLESCPICRSPITTRIKLY

SEQ ID NO: 112585 - protein, 219 aa, Triticum aestivum
  unsure (1)..(219): unsure at all Xaa locations
  Clone ID: PAT_TA_7003.pep
GASATRRPTARRRPPTAGGGGVEEDSNGLEQPPQDEGKAQTPGLKLYQIKVRNMLDDMLEKNLEIVRNPCLNLADPEETGGGIKLFKKAPXGIRMDAVDKYHVQLKRPKILPGPEVDEKSKKFRHMLQSVVVDGNDVLVSAKEASQISLARMEARETAAKTKAKREEERVNQLKKVRGEKWLPSIASKMKKEKSWEQWQEKKLKSNGSDGGSFQLGRIC

SEQ ID NO: 112586 - protein, 178 aa, Triticum aestivum
  unsure (1)..(178): unsure at all Xaa locations
  Clone ID: PAT_TA_7004.pep
NXXGRGNGAARHVGPSNGAGAAAMFPSPVHAAGNGGNNGTATNKVESKPEGIAKETAPVQPAVAMNHSYGRNDRRDVYDLDSDSMEEDEEDDFDDDDEEEDQDGVPGGCNINMPPAQYDAHFLQRQHQQQQQQNHNHGNNHNVVRPNAVNGSGNPPAGNATPSSAPATSGTPFLGMVQ

SEQ ID NO: 112587 - protein, 176 aa, Triticum aestivum
  Clone ID: PAT_TA_7005.pep
SARGINWAGGLHHAKKCEASGFCYINDLVLGILELLKYHARARSRPRAAQLGDGVEEAFYFTDRVMTVSFHKYGDMFFPGTGDIKDIGDREGKYYAINIPLKDGIDDTSFTRLFKTIIAKVVETYLPGAIVLQCGADSLARDRLGCFNLSIEGHAECVKFVKKFKIPLLVTGGGGS

SEQ ID NO: 112588 - protein, 115 aa, Triticum aestivum
  Clone ID: PAT_TA_7006.pep
ACCWRPVPTNSTSIHPVARGGATTKGKKQARRKYLILVGIVVARVAYQAALEPPRRAVAEPCQRGRGRQSSKARHEEALVPGLLLQQLHLICVFPCCHHHRATPVAATDVGMRDW

SEQ ID NO: 112589 - protein, 152 aa, Triticum aestivum
  unsure (1)..(152): unsure at all Xaa locations
  Clone ID: PAT_TA_7007.pep
CGLSCGCAVRIHQRESVTAPWHCYTTXYQQRRSSKMRSILNVSANSGAKEVMEEQXLRGKKVAELRVMILSSLKDAQPXVKVNKGNVVYGVVVLPPLKWELSFGSVVXIDDSAIVNVYNSGEMIRTRVFGPVPHELKKKKHLKILALAEHIV

SEQ ID NO: 112590 - protein, 75 aa, Triticum aestivum
  unsure (1)..(75): unsure at all Xaa locations
  Clone ID: PAT_TA_7008.pep
RNSARGWAAGVRAKADRDGVCIRASYQSEEATHVQALAGMHNQELSITLVCASVIQKLGVWXMMLCIAFKLNNMS

SEQ ID NO: 112591 - protein, 151 aa, Triticum aestivum
  Clone ID: PAT_TA_7009.pep
FPAPPLPETAASSPLRRPFSDLSGGEGSAFLGFPAERSRLSCPPSARSRYYGLERTPRNKPRSLEASPELPAVDSRSMRSLDVAGAERSDQYNRKKPRRETEMPLAGSIVAGSSGDCGGIEESGGCLSMRVEDIVQHPLPGYGAPVALSFS

SEQ ID NO: 112592 - protein, 204 aa, Triticum aestivum
  Clone ID: PAT_TA_7010.pep
GPWAAPTCPPGWRAAASSCGRSRPGAAPPAASAASSTPAAGRSARPAPRRPARACEAALPRPVRAWCRGALRPRRPRPPQRQQPSSRPRPCRCKSGLKLWWALVLPSSCSVLFWVGRSGDRSIEFFALSARWILLAAEEPCRVCIGAIRPPRSFRPVAPGIHCLFRSGDRTFLLVTRKTRRPLLSAESRAVFASVHSRPLAYLF

SEQ ID NO: 112593 - protein, 229 aa, Triticum aestivum
  unsure (1)..(229): unsure at all Xaa locations
  Clone ID: PAT_TA_7011.pep
MAMSSNLARSLPDSPAGDFRPASLLSKMASRGRRPSQLVTSAVSADEAPANMSPGSVVGDMERGTLAEKTGRSDGQLTSRWRELHGSNDWQGLLDPIDTVLRGELIRYGEFAQACYDSFDYDRFSRYSGSCKYPTRTFFQDVGLAGVGYEVTRYLYATCHPSYPNFSIWKHNPGDDKLWSESATFVGFVAVSTDEETARIGRRDIAVAWRGTVTRXLEWVSDLTAMLKP

SEQ ID NO: 112594 - protein, 131 aa, Triticum aestivum
  Clone ID: PAT_TA_7012.pep
TTFRLFVLEMPSASKSKAKDRAAAFKAAKEQPKVAVKPVGNGTGASTFNNLSGKFHLLEPSSSLLGSQGNEKLRNTDEIDEHSRSSHGTGDFDCTSNNGSCSGESEDTKEKSTSTAPRVDSIPGCDLDKRE

SEQ ID NO: 112595 - protein, 194 aa, Triticum aestivum
  unsure (1)..(194): unsure at all Xaa locations
  Clone ID: PAT_TA_7013.pep
HGGKSSLPPSLATAQPERRRPPAPAAEDSPPYGSVVLGGTFDRLHDGHRRLLKASADLARDRIVVGVCTGPMLAKKEYAELIEPVEKRIKAVEDYIKSIKPELIVQVEPIEDPYGPSFIVHYWCSVACSYCQLGDTXSVDSLVSREXLPLLKVEVVDLLSGDTEGEKLSSSALRKLEAAQAQQQKATIANQKGV

SEQ ID NO: 112596 - protein, 94 aa, Triticum aestivum
  Clone ID: PAT_TA_7014.pep
SFTPGLGEGVNEHRESEKLFSCDCVMECDACASKVVELAEQILCIIIVLFLLVECVCVCVCVCVLFHSFVRRCLYSRGVWCRSSVLPTMRREFC

SEQ ID NO: 112597 - protein, 156 aa, Triticum aestivum
  Clone ID: PAT_TA_7015.pep
MLYPTKVAEARGRPAPAPPQDITVLSPHSKQVLRKFWNLVRKFQLPIGLILLIVYGWRKPMVLAINTLLLLYSTRPDPYSIYLFLQEIHQGKVQQNPVLWKEEVIQTRKVDTEDYKFFSIGTVELKDRTVLHVIGILGNWWIYHVSYDKRVEQLYL

SEQ ID NO: 112598 - protein, 299 aa, Triticum aestivum
  Clone ID: PAT_TA_7016.pep
RRALPASQSVAIDWVNENVQPYISQTRIVGITVGNEVLGGDPSLAAPLVGAVKNMYDGLKKLHLDDKIELFTPHSDAVFATSYPPSACVFKEEIMVYMKPLLDLFSRIGSPFYVNAYPFLAYLTDPGQIDINYALFQPNPGIVDPNTSLHYDNMFDAQIDAAYAALQAAGYNDMEVRVAETGWASSGDQNQAGPSVENARTYNYNLRKRLFLRKGTPLKPKIPVKAYIFALFNENLKNGDPTEKHYGLFNPDGRISYDIGYSGLLPSSAPASLLSIKEMRAWGWIAHYSAAVILAIFLS

SEQ ID NO: 112599 - protein, 150 aa, Triticum aestivum
  Clone ID: PAT_TA_7017.pep
MRTNHSRRMLRQIARLMPSRHTFWEDIVPYGGLLLDGFLLPQVILNVFSASKVRALSPVFYIGGTMLRALPHAYDAYRTHHFVRSMRPSYIYASSRDDLFSLAWDIVIPCGVVLLATLLFFQQWLGGAFFLCSKRRKPSSEYEMVSTVSS

SEQ ID NO: 112600 - protein, 177 aa, Triticum aestivum
  Clone ID: PAT_TA_7018.pep
MEYTPRRWLAAVAVIVLLSCAPAPAAAAGRKLLQIQISEAQQFVVPQSHMRAIHGQRPLKWSSELADQAERWAARFKGNCAAASAAMPGGVNVFRGFGEAGKAWQPSDAVAAWAEQANYFDFKSGGCAAGKLCAQFKQVMSKGNTDVGCASVQCADGTTLMTCHYSPLGNVFGERPF

SEQ ID NO: 112601 - protein, 40 aa, Triticum aestivum
  unsure (1)..(40): unsure at all Xaa locations
  Clone ID: PAT_TA_7019.pep
XXXASISLANPTQPGSSSGAHSYTHVGSYTEKSTHSSSHH

SEQ ID NO: 112602 - protein, 110 aa, Triticum aestivum
  unsure (1)..(110): unsure at all Xaa locations
  Clone ID: PAT_TA_7020.pep
MATFRLYRRSTIGMGLTGTLDQLGSSGALAPLAIQVLDPRSNKSMTDALGTQVKEARITVKXGHLHHLQGSADKVWIFTLTHVAXKNEETTEQVGKVKIVACXDSKLLSQ

SEQ ID NO: 112603 - protein, 279 aa, Triticum aestivum
  unsure (1)..(279): unsure at all Xaa locations
  Clone ID: PAT_TA_7021.pep
MGSKNTRKANSDDSRSSSLEDEATSKRYEEKSRQDDNSFEAQGVNKRYDNCNKEGYNNDFGFDSITKTCEEESVQDDYAKSLSSNCENAKGVAKNESSVSERTNTSSHVSSDAGLDEIQSSAGKSGDSSFFGGFLKKGFKDLSLFNQSMDSVKVSINGHPISERALRKAEKKAGPVSPGSYWYDQRAGFWGVMGHECSGIIPPFIKEFSYSMXQGICAGGTTGVLVNGREFIKKIQLLGKERLQRFXXKNITXDTQGTVTDATTXDNYXPWKLAPTTXK

SEQ ID NO: 112604 - protein, 233 aa, Triticum aestivum
  Clone ID: PAT_TA_7022.pep
MLWVDKHRPKTLDKVIVHEQVAQNLKKFVAEQDCPHLLFYGPPGSGKKTLIMALIKQMFGAGVEKVKMENKTWKIDTGTRTFDLELAMLSSSHHVEMNPSDAGFQDRYVVQEVIKEMAKSRPIDAKGKRAFKVLVLNEVDKLSREAQHSLRRTMEKYSASCRLILCCNSSSKVTEAVRSRCLNVRVNAPTEDQIVQVLEFIGKKENLQLPFGFAARIAAQSNRNLRRAILFFE

SEQ ID NO: 112605 - protein, 380 aa, Triticum aestivum
  Clone ID: PAT_TA_7023.pep
MPPVPHLPPHLSRRRRGGPQGGRRAKMLWVDKHRPKTLDKVIVHEQVAQNLKKFVAEQDCPHLLFYGPPGSGKKTLIMALIKQMFGAGVEKVKMENKTWKIDTGTRPFDLELAMLASSHHVDMNPSPAGFQGGYVVQFVSAEMAMSFRTSTTNKQRIFKSMLKEVDKLSREAQHSLRRTMEKYSASCRLILCCNSSSKVTEAVRSRCLNVRVNAPTEDQIVQVLEFIGKKENLQLPFGFAARIAAQSNRNLRRAILFFETCKVQQYPFSANQVAPPLDWEQYVSEIATEILSEQSPKRLYSVRQKFYELLVNCIPPESILKKLLTELMKKLDSDLKHEVCHWAAHYEHKMRLGSKAIFHLEAFVAKFMSIYKEFLCAAFG

SEQ ID NO: 112606 - protein, 336 aa, Triticum aestivum
  unsure (1)..(336): unsure at all Xaa locations
  Clone ID: PAT_TA_7024.pep
MAAAPHHLLYEFAKAALIKIFAFPYATVCDMYCNGVGAREEWADAQAGRYIGIDASASAVSSDDRELWENKWKPFTTEFIELNPSADDFEAQLQEKGIQADIVCCMQNLQXLCFESEEHAKKLLNNVSSLLKPGGYFFGIIPDSSTLWTKYQKNVEASHNKGLKVVPNSIRSDNYTITFEIEEEKFPFFGKKYQLKFANEAMFENHCLVHFPSLMRLAREAGLEYVEIQNLTEFYDDNRTQFAPMLGSCGANLVDPRGKLIARSYDILGLYSTFVFQKPDPDAIPPVVTPDPDEEERLWRQQAAADDLRRPQAEVMPIDPDQKGILGPGPADMRLN

SEQ ID NO: 112607 - protein, 200 aa, Triticum aestivum
  unsure (1)..(200): unsure at all Xaa locations
  Clone ID: PAT_TA_7025.pep
MNNDEETNGLVSPLMSEREDSDILNGFEGHDLSMYPINRSFHMPKQKFDFAQYYAFDITIFALTMIYSLFAPLVVPVGAVYFGYRYLVDKYNFLFVYRVRGFPAGNDGKLMDRVLCIMQFCVIFFLAAMLLFFAVQGDSMKLQAICTLGLLVFYKLLPSGSDRFQPSLLEGMQTVNSFVDGPTDYEVFSQPDXDWNLYQS

SEQ ID NO: 112608 - protein, 127 aa, Triticum aestivum
  Clone ID: PAT_TA_7026.pep
LAGSPPRGISSLMACSSSTTPTCCTSSSPSSRNGDPTPLERLLLRSPSPTPAADLLQLRRPSLQHLLDINNGASSSWWCSAPGGWLTFRQGHHGSSPRPGPSLSIFVPAALLRLQHLRPRIEDHHDP

SEQ ID NO: 112609 - protein, 201 aa, Triticum aestivum
  Clone ID: PAT_TA_7027.pep
MGTRELPLPTCFELLLGKERDRWPLEATLICAAYDGSIRKIKKIAKELDVHGHGIPATVANTTYMGMNVLDAAGGCGSLPVYRYLVEEVKMDVGNPDSAQGFTPLEYAAQNGHLPAVRYLLDHGADLHQERSSLTLLHTAAVHGRSEIVKFLLSKGADVDALSDLGTPLTLASLRGHASILKILLQHNADPSKGNGAFVPL

SEQ ID NO: 112610 - protein, 203 aa, Triticum aestivum
  unsure (1)..(203): unsure at all Xaa locations
  Clone ID: PAT_TA_7028.pep
MAAPNNTSTPKKLIVIYSPPGMPGHLFPAVELGKLLVVQGLEVTVVLGGEDNHGAGGSFLAGIEAASPSLSFHCLPRATLPSDVXPAGSFEAQLFGLARASNPDLRDFLRSASXGPXALLIDFFCSSALGAAGVLRPPTPFFLSSCTACVAFCPLLLATQELPPLSFPAPGGALFLGPGLPPIPADHLPAFILDRDSLSSKFF

SEQ ID NO: 112611 - protein, 252 aa, Triticum aestivum
  Clone ID: PAT_TA_7029.pep
MATPTATAAAHLASPLLFSSSPDPRSRRTLRAPFRRARLAVVASVPDPADKPVEYTPWLIAGLGNPGSKYHGTRHNVGFEMVDRIARDEGITMNTIQSKSLLGVGLIGEVPVLLIKPQSYMNYCGEAIGPLAAYYQVPLRHILVIYDDMSLPNGVLRLQRKGGRARHNGLQNVIEHLDGCREFPRLSIGIGSPPGKMDTRAFLLQKFSSEERIQIDTALEQGVDAVRTLVLKGFSGSIERFNLVQKYKFNRA

SEQ ID NO: 112612 - protein, 155 aa, Triticum aestivum
  unsure (1)..(155): unsure at all Xaa locations
  Clone ID: PAT_TA_7030.pep
PATPSPPTPPSPPAPSWSRAPGSTPWASPAPAPPPPPPPSTPRSPARAPPPWPSSPPPPPSPASCPPPPSSSPRPSAPASSPGSPPAWPVSTRPTAPAPPPPSRPSSASSPARCPAPCPSSRPPPRXPGHAPPPPFQLGTEGLRCFKSRLPPKKA

SEQ ID NO: 112613 - protein, 103 aa, Triticum aestivum
  unsure (1)..(103): unsure at all Xaa locations
  Clone ID: PAT_TA_7031.pep
XQKSPSIFKNSTRSPFLRGYEKTFCFYKKDPAFVVIQPTIPSSSSSTPPPPDKKQRWRSPPASLQIPGDCKWFTRAHSRRPFSSPPYVPPLAGTSSASLPPLP

SEQ ID NO: 112614 - protein, 194 aa, Triticum aestivum
  Clone ID: PAT_TA_7032.pep
MATAPAPTAAAPAPAAAAAAVPSASVPRGQVDLVDFIDWTGVECLNQDPAHGIANALKQGYREDEGLHLASDSDEQLLIYIPFMQVIKLHSALFKGPEEEGPKTVKLFSNREHMGFSNVNDFPPSDSVDLSSSHLLESKPVTLKYVKFQNVRSLTMFIEDNQSGADITKIQKIALYGTTVDTTNMKDLKKIEEH

SEQ ID NO: 112615 - protein, 75 aa, Triticum aestivum
  Clone ID: PAT_TA_7033.pep
YMTVILNSQFCSADTKTRQKTKQRTHACKAIINNKVYHSLITNPLMRFHRWLGRWWTGLSGVRGIHRHRRRRRWA

SEQ ID NO: 112616 - protein, 293 aa, Triticum aestivum
  Clone ID: PAT_TA_7034.pep
MQGGGVSGFHNAPVTRAIVLASGLLSVVFSVNRRARALGLSYQDIIKNFRVWRIFASVFAFQSTPELMFGLYLLYYFRVFERQMGSNKYSVFSLFSIAVSLPLEILSLVLLKDTNYITALASGPYGLIFASFIPFFLDIPITSRFRIFGVNFSDKSFIYLAGLQLLVSSWKRSLIPGICGLIAGSLYRLNVFGIRRRKLPQIVASFFARVFVPPSASSSRPSRSLVGNVPSHTGRTVQNQPSTGFAPVVEPPESSIAMLVSMGFDSNAARQALVRARNDINVATNILLEAQSH

SEQ ID NO: 112617 - protein, 99 aa, Triticum aestivum
  Clone ID: PAT_TA_7035.pep
KNVRWVNADTAARRPYDIIITRGDNRIEYVEVKATTTSNKNWFYITAREWQFALEKGDDFSIARVMVSGEKMANIKMLKNPHKLCQKKMLHLALLIARR

SEQ ID NO: 112618 - protein, 234 aa, Triticum aestivum
  unsure (1)..(234): unsure at all Xaa locations
  Clone ID: PAT_TA_7036.pep
FGTRRLLADDLFLAKXLAMEMGVGMIAKTAAEYEKRRENFVKEIDIVIADVVMAIVADFMLVYLPAPTVSLQPPLARNAGLITSFFHNCPDNAFQIALAGRSFSLLQRLGAIVKNGAKLFAVGTGASLVGTGVTNALIKARKAVDKDLDDEVDDIPVVSTSIAYGIYMAVSSNLRYQILSPRVRQRMLEPVLHNHKLLLSALCFAVRTGNTFLGSLLWVDYARMVGVQKAEEEI

SEQ ID NO: 112619 - protein, 115 aa, Triticum aestivum
  Clone ID: PAT_TA_7037.pep
SARGNDWGSCVGIVHSRDCTKMDSPLLSMARPPLCVPCSTSLEHVIDLLLREKCEMVIVVKSGNMYEGSYTSSSRPLGVFSLGILSEATTNTANTHDECVSGAAPGQDPEARGRG

SEQ ID NO: 112620 - protein, 142 aa, Triticum aestivum
  Clone ID: PAT_TA_7038.pep
RRIRVLTGKSAYSLLMDDGTGGPLTDFALPIIEVGNIEELLDRRPVPEPTPWQLQAMKRVAQIACCCGKLDAKDRPAISDIVANLEMAYELICRDEHGSVDEPCLWPFVEQVDLPSDSPHSRSSSSAGYHSELESEVLEEGR

SEQ ID NO: 112621 - protein, 89 aa, Triticum aestivum
  Clone ID: PAT_TA_7039.pep
PSSSPLAADGLALAAPPASTHRLAPLVCIIGGCPKNQRGGRRWEAGGLILIGLQLQIKQRARERELSAVQRSRDVCAGRKKIRFGPRAE

SEQ ID NO: 112622 - protein, 408 aa, Triticum aestivum
  Clone ID: PAT_TA_7040.pep
MPLRLDIKRKLAQRSERVKSADLHPTEPWILSSLYSGSVCIWNYQTQTMVKSFEVTELPVRSAKFIARKQWVVAGADDMFIRVYNYNTMDKVKVFEAHTDYIRCVAVHPTQPFVLSSSDDMLIKLWDWDKGWACTHIFEGHSHYVMQVTFNPKDTNTFASASLDRTIKTRASGSPDPNFTLDGHSKGVNCVDYFTGGDRPFLITGSDDQTAKVWDYQTKSCVQTLEGHAHNVSAVCFHPELPIIITGSEDGTVRLWHSTTYRLENTLNYGLERVWALGYMKGSRRIVIGYDEGTIMIKIGREVPVASMDNSGKIIWAKHNEIQTVNIKTVGAGNEIADGERLPLAVKELGSCDLYPQNLRHNPNGRFVVVCGDGEYIIYTALAWRNRSFGSALEFAWSSDGEYAVRES

SEQ ID NO: 112623 - protein, 108 aa, Triticum aestivum
  Clone ID: PAT_TA_7041.pep
RRIRVRFRRGSLRNGYHIQGRQQARSRPFPGGRRLLPRHLLPASSPPTPASMSLGAVPRAPNITLRIVVSDRAAAAATVSSSLVVAGGPPAQLHILDLEATWYWSSPP

SEQ ID NO: 112624 - protein, 296 aa, Triticum aestivum
  unsure (1)..(296): unsure at all Xaa locations
  Clone ID: PAT_TA_7042.pep
MAPALPCRPKLRLLCVALAFLLAVDVGRADIYEDLEIIWSADHTYYFMDGESEALALSLDYNRGSAFKSKEMYHFVRVDIDIKLIEGNSAGTVCTVYTISEGPWEVHDEIDLEFLGNSTGEPYTLHTNIFANGVGGREQQFKLWFDPSSDYHTYSIVWNPKRITIEVDGVTVRTFDNNXDQGVPFPSYQRQRVYGSLWSAEDWATQGGRVKTDWSQAPFVSYYRNYNVTWCQPSPGVLWCGTEPAESTHFNLSPKALADLQWVRDNHYVIYDYCLDRSDRYTDATRPKECSLPPRP

SEQ ID NO: 112625 - protein, 196 aa, Triticum aestivum
  unsure (1)..(196): unsure at all Xaa locations
  Clone ID: PAT_TA_7043.pep
VSKGVIGKLYREIKKQNPHIGHFTKDVARRSYDTDLIVDGYQDYITEAVWFKEQYDFKLGNLMEHYGINSEAEIISGCILKMANNFTKKNDADAIRLAVKSLRKEARSWFXRWVQMRAEVVTEASDAKASAWYHVTYHPEYWGCYNEGYGRPHLISFPWCVYDKLLLIKQRKKFRRRMQPHVLDLQNSMRRNTIFG

SEQ ID NO: 112626 - protein, 471 aa, Triticum aestivum
  unsure (1)..(471): unsure at all Xaa locations
  Clone ID: PAT_TA_7044.pep
AGEASLRRRRAPARLLVAVAALVTCTIWLWSSSTDLTLTSYKAQDVDVNKLWRTANSNGWRASSAPRSYWPPPPTESETNGYLRVRCNGGLNQQRTAICNAVVAARIMNATLVLPELDTNSFWRDESGFIGIYDVPHFIKTLKYDVRIATSVPDIITNGKTKKLKAYQIRPPRDAPVTWYTTVALEKMKSYGAIYLTPFSHRLAEDINDPEIQRLRCRVXDIFTPQEQKILIKYRKENFAEKELVYRERRLIGKCPLTPEEVGLILRALGFDNTTHIYLASGELFGGKRFMRPFKDMFSRLENHSSVGPGKLEENTRGLAGSAVDYMVCLLSDIFMPTYDGPSNFANNLIGHRLYYGFRTTITPTRKALAPIFMDREVGLTAGFEERVRQVMTKTYVGGPHKRIHPEPFYTNSWPECFCQENPRNHADKCPPDNIYEVLENQFRSEENEESIEVKATSQTVSISQTEETVI

SEQ ID NO: 112627 - protein, 274 aa, Triticum aestivum
  Clone ID: PAT_TA_7045.pep
GCRFGARAVARSRPSIAWSRTMAPLAMLLVSTLFVSSPSKSTSDYVRRAISRDVWARIFSDWLARRDAGLMILDPYGGSIASVAESATPFSHRAGVLYNVQYMNFWGVGGDGAAHTRWIRDMYAFMEPHVSKNPREAYVNYRDLDLGENVVGAGGVTSFEAGRVWGEKYYSKGNFRRLAMAKGQIDPRDYFRSEQSIPPLVGEQLELELTSSRNVPHVHGVNAPAWWPVGLWDSRQSWVQSLALPYLGSCLLSLRRSSSFCFTTCICCLIINGV

SEQ ID NO: 112628 - protein, 215 aa, Triticum aestivum
  Clone ID: PAT_TA_7046.pep
HEGDARRERPHQTRRARPRLRRGRRGDAMRRARPPPGPGLEGEEVRYRGVRRRPSGRYAAEIRDPAKKTPIWLGTFDSAEAAARAYDAAARNLRGAAARTNFPASPAAAPPRAAPPAPVAAPAAMAAAATSSHSSTIESWSGGNVPPTSVLFRAAAAAIGAPAVEEDCRSYCGSSSSAVCEDGASGGAAAAADEAAAPPRPSSSSLPFDLNLPDP

SEQ ID NO: 112629 - protein, 318 aa, Triticum aestivum
  unsure (1)..(318): unsure at all Xaa locations
  Clone ID: PAT_TA_7047.pep
DFSIARFAQMMWRLNFXVACCCMALDNDFMLYYICPMHTLFTLMVSASLGLFNKYNEIPSVMAIKIAGCFLAVILIWEVPGVFEILWAPFTFLLGYKDPEPSKSHLPLLHEWHFRSGLDRYIWIVGMIYAYFHPNVERWMEKLEESETKVRLSIKGTIVTLSVLAGYLWYEYIYRLDKITYNKYHPYTSWIPITVYICLRNCTQQLRGASLALFAWLGKVTLETYISQIHIWLRSSVPNGQPKWLLSFIPGYPMLNFMLTTSIYLLLSYRVFEITNVLRAAFIPSRDNNRLYQNFVAGVAISVCLYCCSLVLLKIPAV

SEQ ID NO: 112630 - protein, 191 aa, Triticum aestivum
  Clone ID: PAT_TA_7048.pep
PPPTPPLQANYVFGRAWPDLNEGLSYTDTFRGADAETTATLTNFYSENYKSSAPLPGWIHRIRNGQITVDGQVVTDPDMILREGSKLVYHRLAWKEPFAPHLLQVLYEDDDMVALNKPSGLQVLPKGLFQQRTVLAQLQWKEWKMPPSSCSKRKNVQLHPVPVHRLGRGTSGLLLCAKTKLAKVQLASYFA

SEQ ID NO: 112631 - protein, 264 aa, Triticum aestivum
  unsure (1)..(264): unsure at all Xaa locations
  Clone ID: PAT_TA_7049.pep
MEDTTPPADERPLVLLGQPLFPEFATALAGRFRFVLVADADAATLAQGRALLIGLNPVTDDHLAALPALGLVAGISVGVNHVDLAACRRRGIAVTNAGAAFAVDTADYGVGLVVAVXRRLAAAEAHVRAGRWAADGDYPLTTKVSGRRVGIVGLGNIGSRIARRLAAFGCAVSYNSRSPKPSAAYEFVPTVRDLAAASDVLVLSCALTEETRHVVNREVMEALGKDGVLVNVGRGGLVDEPELVRCLQEGVIGGAGLDVFQSEP

SEQ ID NO: 112632 - protein, 135 aa, Triticum aestivum
  Clone ID: PAT_TA_7050.pep
MASFKGLVGEGSAALPHVLAVDDSSVDRAVISGILRSSKFRVTAVDSGKRALELLGSEANVSMIITDYWMPEMTGYELLKKVKGSSKLREIPVVIMSSENVPTRINRCLEEGAEDFLLKPVQPSDVSRLCSRVLR

SEQ ID NO: 112633 - protein, 117 aa, Triticum aestivum
  Clone ID: PAT_TA_7051.pep
PFTDKPKLRSGSATSLTDSHGRGTRPTVPINYGGFNPPNYPQAKSPRSAINFFNTEIQPCQLTVICGQPMGSHQSGQPAWPPYGMGEGVPWGGSGVHPFTTGGLPSSLPRKDYGSIF

SEQ ID NO: 112634 - protein, 605 aa, Triticum aestivum
  unsure (1)..(605): unsure at all Xaa locations
  Clone ID: PAT_TA_7052.pep
ASRSAPFGSEVLAVMVRTEAAGAALAVALLACMVGAGADGSDHKYKEGDRVPLYANKVGPFHNPSETYRYYDLPFCAPEHPKDKREALGEVLNGDRLVDAPYELNFKEDTNSKTLCKKTLSKEQVAKLRDAVAKDYYFQMYYDDLPLWGFLGKLDRNKEHGGGKCLLFKHIHFDIMYNNDRVIEINVQTDPNVAVDITEDKEVPVEFSYSVTWKKTXDIPFEKRMEKYSKSSSMPQHLEIHWFSIINSCVTVLLLTGFLATILMRVLKNDFIKYSHEDESLEDQEETGWKYIHGDVFRFPQQKSLFAAIIGSGSQLLALAIFIFLLAIVGVFYPYNRGALFTALVVIYALTSGIAGYTSTSFYLQLEGTNWVRNLILTGCLFCGPLFLTFSFLNTVAIAYSATAALPFGTIIVIILIWALVTSPLLVLGGVAGKNSNTEFQAPCRTTKYPREIPQLPWYRSTIPQMAMAGFLPFSAIYIELYYIFASIWGHKIYTIYSILFIVFIILIIVTAFVTVALTYFQLAVEDHKWWWRSVLCGGSTGIFIFFYCIYYYHARSDMSGFMQTSFFFGYMTCVCYGFFLMLGTVGFRASLLFVRHIYRSIKCE

SEQ ID NO: 112635 - protein, 180 aa, Triticum aestivum
  Clone ID: PAT_TA_7053.pep
GIRHEPNLDLPHIIMSRCQKFFFPKLKECDIVNTLQWICTSDGLDVDRDALKLIASRSDGSLRDAEMTLDQLSLLGQRITMPLVQELAGLVSDDKLVNLLDLALSADTANTVKALRDITETGVEPLSLMSQVATIITDILAGTYTFTQERIRRRFFKRPTLSKEDMERLRQALKTLSEAE

SEQ ID NO: 112636 - protein, 130 aa, Triticum aestivum
  Clone ID: PAT_TA_7054.pep
AFPKKKKKKIAKKKNTKNQKKYFILLIVTDGVVTDFQETIDAIIKASDFPLSIIVVGVGGADFKEMEFLDPNKGGRLESSTGRVASRDVIQFAPMKDVHGTGISIVQSLLAEIPGQFMTYMRTREIQAIS

SEQ ID NO: 112637 - protein, 133 aa, Triticum aestivum
  Clone ID: PAT_TA_7055.pep
MEMEVPSAQADRDGARRRLRDYLLALEEERRKIHVFQRELPLCLDLVTQTIEGMKSQMGGAASEETVSDHDGPVLEEFIPLKPSLSLSSSDDETSTHAAAPVSNAKAETPPPTPETKKAMPDWLQSAQAFDLE

SEQ ID NO: 112638 - protein, 198 aa, Triticum aestivum
  Clone ID: PAT_TA_7056.pep
MSSSSAAPIGLSWAPQLPSLAAAGGSKKGSAPTPSIDAQESLWKPSNELVDGLYVPPRDPRKVNKMARKNVKDTTGKGWFDMPAPSITPELKKDLEILQLRHVMDPKRHFKRSGKSKALPKYFQVGTVIEPASEFYSSRLTKHERKQTLVDELLSDQKLKNYRMRKVREIQVARTPGGNQKWKNKGKQTFKRAKDRRK

SEQ ID NO: 112639 - protein, 117 aa, Triticum aestivum
  Clone ID: PAT_TA_7057.pep
LLPPPRPLSPPHPSPARVSRPLPPLFPTPPSSPTPPPGPRASRSRPWTPNTSSSPRSSSPPGPACPAAAPQTPPPPSPAPAGSGAAAPAPLLPAPPGVYVELQVPQRHRRRCCHQGE

SEQ ID NO: 112640 - protein, 95 aa, Triticum aestivum
  Clone ID: PAT_TA_7058.pep
LDAMGANRVPPNRECFNTVIGGLCKEGEVGAAVALFKRMPEVPRLNGKGVSPNFETYIMLIEALVESNAFVPALEVCKECLAKQAGPPVQEAVGC

SEQ ID NO: 112641 - protein, 112 aa, Triticum aestivum
  Clone ID: PAT_TA_7059.pep
MANTTANAREIRRLQRADGPAAMLAIGTANPPNCVSQDEYPEYYFRVTKSEHLAEKLTDTLKIICALTGNERRFIYNTEKMLSAPPGFHAPGRPRTQQPSPPRPPNSCNGAT

SEQ ID NO: 112642 - protein, 96 aa, Triticum aestivum
  Clone ID: PAT_TA_7060.pep
DQAVEVDSAAKLPVMLALTSLWIRKNYAGSFMVNFIDSLPEMYPVVEEWVEDVLMDEGNATILTLFACLVTVLYLRERQRRQVVADNPQQPDGAPN

SEQ ID NO: 112643 - protein, 203 aa, Triticum aestivum
  unsure (1)..(203): unsure at all Xaa locations
  Clone ID: PAT_TA_7061.pep
MVGASTSSVVNVYPLANYTFGTKEPKMEKDTAVADRLARMKVNYMKEGMRTSVEAILLVQEHNHPHILLLQIGNTFCKLPGGRLKPGENEIEGLKRKLGGKLAVNSPSFPPNWQGGECVAVWWRPNFETVMYPYCPPHITKPKECKKLFIVHLTEREYFAVPRNLKLLAVPLFELYDNVQRYGPVISTIPXQLSRFQFNMVSS

SEQ ID NO: 112644 - protein, 246 aa, Triticum aestivum
  unsure (1)..(246): unsure at all Xaa locations
  Clone ID: PAT_TA_7062.pep
PPAPTTSPHPQPAPPLLPRRPRRRPPDRGTKHEGPAEGTAGDEAVGALAAPVVNVDPLDHFTYGTNDAKKEKDTSVADRLPRMKVNXCKEGMRTSVEAILLVQEHNHPHILLXLQIGNTFCKLPGXGRLKPGESEIEGLKRKLSSMLTEISPSFPPNWPGWWSVLHEWWYVRLXKQFMYPYCTPXFLTKPXECKKFFIVYTVLQGXYFAVPRNLKXLLADALFELYNNVQRXGAGISTIPHQQSRF

SEQ ID NO: 112645 - protein, 162 aa, Triticum aestivum
  Clone ID: PAT_TA_7063.pep
SVESSRQQGPKGDANSNSMAAASEVSVDWRGRPCRPQRHGGMKAAVFVLGIQAFEIMAIAAVGNNLITYVFNEMHFPLSKSANIVTNFIGTMFLLSLLGGFLSDSYLGSFWTMLIFGFVELSVSHRKTSKKKDHFFCFSTKTIKGTGKNSGRERLVRATLKF

SEQ ID NO: 112646 - protein, 141 aa, Triticum aestivum
  unsure (1)..(141): unsure at all Xaa locations
  Clone ID: PAT_TA_7064.pep
MALPNQNTVDYPXSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRVCENIPIVLCGNKVDVKNSHCPTTMTI

SEQ ID NO: 112647 - protein, 61 aa, Triticum aestivum
  Clone ID: PAT_TA_7065.pep
MALPNQNTVDYPSFKLVIVGDGGTGKTTFVKRHLTGEFEKKYELAAAAAQPLPDDDDDLIE

SEQ ID NO: 112648 - protein, 224 aa, Triticum aestivum
  unsure (1)..(224): unsure at all Xaa locations
  Clone ID: PAT_TA_7066.pep
MALPNQNTVDYPSFKLVIVGDGGTGKTTFVKRHLTGEFEKKYEPTIGVEVHPLDFTTNCGKIRFSCPAVSQQXKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDPNIHFVEAVGLKPPEVTFDLAMQQQHXAELAAATXXPLPDDDDDLIEKRS

SEQ ID NO: 112649 - protein, 82 aa, Triticum aestivum
  Clone ID: PAT_TA_7067.pep
MGIMPPPSPSSGQRRGNDAMVLPNTPPVDYPTFKLILVGDGGTGKTTFVKRHVTGEFEKKYESTIGVEVRPLDFQTSHGKIR

SEQ ID NO: 112650 - protein, 223 aa, Triticum aestivum
  unsure (1)..(223): unsure at all Xaa locations
  Clone ID: PAT_TA_7068.pep
MALPNQNTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLAREAGXIPTYHFVEAVALKPPEVTFDLAMQQQXHEAELAAAAXAQPLPDDDDDLIE

SEQ ID NO: 112651 - protein, 224 aa, Triticum aestivum
  unsure (1)..(224): unsure at all Xaa locations
  Clone ID: PAT_TA_7069.pep
MALPNTPPVDYPSFKLVLVGDGGTGKTTFVKRHVTGEFEKKYEPTIGVEVRPLDFQTSHGKIRFYCWDTAGQEKFGGLRDGXYYIHGQCAIIMFDVTSRLTYKNVPTWXHRDICRVCENIPIVLCGNKVDVKNRQVKAKMVTFHRKKNLQYYEISAKSNYNFEKPFLYLARKLSGDMTLRFVEETALLPADVTVDLAAQQQIEAEIAAAAAMPLPDDDDDNIMD

SEQ ID NO: 112652 - protein, 244 aa, Triticum aestivum
  unsure (1)..(244): unsure at all Xaa locations
  Clone ID: PAT_TA_7070.pep
MALPNQNTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWXRDLCRVCENIPIVLCGNKVDVKNRQVKAKQVTFHRKKNLQYYEISAKSNYNFEKPFLYLARKLAGDPNIHFVEAVALNPXEVTFDLAMQQQHEAELAAAAAQPLADDDDQLIEWREDHESVLSIITWRARDYAESV

SEQ ID NO: 112653 - protein, 87 aa, Triticum aestivum
  Clone ID: PAT_TA_7071.pep
MASKWVRPEVYPLFAATGVAIGICAFSLLRNITGNPEVRVNKMGRAAGVLENHEEGRRYAEHGLRAYVQDKTPEIMPGINKFFTSPK

SEQ ID NO: 112654 - protein, 87 aa, Triticum aestivum; identical to SEQ ID NO: 112653
  Clone ID: PAT_TA_7072.pep

SEQ ID NO: 112655 - protein, 87 aa, Triticum aestivum; identical to SEQ ID NO: 112653
  Clone ID: PAT_TA_7073.pep

SEQ ID NO: 112656 - protein, 221 aa, Triticum aestivum
  Clone ID: PAT_TA_7074.pep
MALPNQNTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDPNIHFVEAVALKPPEVTFDLAMQQQHEAELAAAAAQPLPDDDDDLIE

SEQ ID NO: 112657 - protein, 221 aa, Triticum aestivum; identical to SEQ ID NO: 112656
  Clone ID: PAT_TA_7075.pep

SEQ ID NO: 112658 - protein, 221 aa, Triticum aestivum; identical to SEQ ID NO: 112656
  Clone ID: PAT_TA_7076.pep

SEQ ID NO: 112659 - protein, 165 aa, Triticum aestivum
  unsure (1)..(165): unsure at all Xaa locations
  Clone ID: PAT_TA_7077.pep
MKEVVRKEILKLPEAGIIYPVDDSQWVSPVHCVPKKGGITVVPNDKDELIPQRIITGYRMVIDFRKLNKATKKXHYPLPFIDQMLERLSKHTHFCFLDGYSGFSQIPVSAEDQEKTTFTCPFGTFAYRHMPSGLCNAPATXQRCMIAIFSDFCEKICEVFMDDFS

SEQ ID NO: 112660 - protein, 387 aa, Triticum aestivum
  Clone ID: PAT_TA_7078.pep
MELWSKLRSLDAYPKVNEDFYSRTLSGGLITIVSSLAILLLFFSEIRLYLYAATESKLTVDTSRGERLHINFDVTFPALPCSLVAIDTMDVSGEQHYDIRHDIMKKRIDHLGNVIESRKDGVGSPKIERPLQNHGGRLDHNEVYCGSCYGSEESDDQCCNSCEEVRDSYRKKGWALTNVESIDQCKREGFVQRLKDEQGEGCNIHGFVDVNKVAGNFHFAPGKSLDHAFNFLQDMLNFQPENYNISHKINKLSFGKEFPGVVNPLDGVEWKQEQTTGLTGMYQYFVKVVPTIYTDIRGRKIHSNQFSVTEHFREAIGLPRPPPGVYFFYEFSPIQVDFTEENTSLLHFLTNICAIVGGIFTVAGIIDSFVYHGHRAIKKKMEIGKLG

SEQ ID NO: 112661 - protein, 116 aa, Triticum aestivum
  Clone ID: PAT_TA_7079.pep
RAAPPCHSQRLLGDAAVADPGPPDEAARINVRRTKDCYEVYALVPGLLREEVHVQSDPAGRLIVTGEPEQLDNPWGVTPFKKVISLPSRIDPHQTSAVVTLHGQLFVRAPFEQSKS

SEQ ID NO: 112662 - protein, 156 aa, Triticum aestivum
  Clone ID: PAT_TA_7080.pep
QIRHEGRPPPPPPPPPPYPPSPSRSSRHLPSPPRPVTRTGSRPKPLAPPLLSPFESGSRLTLHLRRSALAATDTGDGGVSSCLHGERRSRNSGAADCSDGQCAAGPGSRRSRAPGASSCCCSSDQFQSGCEIDQQQFGENPRELREQESDIHCGWG

SEQ ID NO: 112663 - protein, 100 aa, Triticum aestivum
  Clone ID: PAT_TA_7081.pep
MHLTLEFGGGLELLLEKSTKVHKVDVQPRDGEDKATMKGLLSWVKSNLIKERPEMFIKDDSVRPGVLVLINDCDWELCGGLDAELEDKDVVVFISTLHGG

SEQ ID NO: 112664 - protein, 188 aa, Triticum aestivum
  Clone ID: PAT_TA_7082.pep
CQLPPQPLETLWSVAGEAEMENAVVLREWFDRVDAAGTGNITAPQLQSALAVGNLDFPLSVVQQMIRMYDFDRNGTMSFQEFLALNKFLQKVQGVFSTLERGRGFLSLEDVYEALIKLGFSLDSPAFYTVCESFDKSKKGMVRLDEFISICIFVQSARNLFSSFDTTKQGKVTLDFNQFVYCTANCRI

SEQ ID NO: 112665 - protein, 225 aa, Triticum aestivum
  unsure (1)..(225): unsure at all Xaa locations
  Clone ID: PAT_TA_7083.pep
SSQPRLSPNHSSLMSSSQSLILRRTSPPPPPPRVVAAIPPSSRPTTASRFRHLPRLTANLCLPPPATSASGGFGDGNFPGGDGGGGGGGGGWQGGRGDPPDKPGDGWRRWLQSLHPELFLLFLLLQSDAFASIPSALADALGATGGDGGSVWEMRGSARTLLVPNPNGTSYLXAGDDKRKQEEGMEKTXAGPANLADXGGNXNXHXXXALMLLXXCXXLMDTXTX

SEQ ID NO: 112666 - protein, 315 aa, Triticum aestivum
  Clone ID: PAT_TA_7084.pep
FGTRLERRHASCPSAAARDDGDPSDATVRRFERLARVADEFFRYVQLGGRPKSLTASMEVPAEPLLAGKTLEFSLRSGSRDALLLLHPCNREIVLFLSCDDSAAWERNVKLCVVFRLLEHTDVLDIVMSSLQLLPPQFGAACATAREFVREARAQETSYTSASSMSMRCVSSAWRCHRNSTDGGCAATDGMPRLAVADRSSRRRVLRHAAERFAGCACGPEQASEIGMPYHSPSCARDVLPALPADRDGNTTRAVPQGGGRRSFRLWTDSCVVVSSQLNVFVGGTRGFGAAADAAAVVPGAKLEGGNVVLLGFSQ

SEQ ID NO: 112667 - protein, 210 aa, Triticum aestivum
  unsure (1)..(210): unsure at all Xaa locations
  Clone ID: PAT_TA_7085.pep
FARRSLKSSDXRHGIGAILKEEPEEVRRWGHFPGIDPHLGFSEFMERFFEHGKCSLRVFMVWNSPQWAYGVRHQRGLESLLLQHPDACVVMLSEMLELEAFHEFVKEGHKVAVAVPNLDELLEGTPTHIFASVWYEWRKTVNYPLHYSELVRLAALYRYGGIYLDSDIIVLKPLKSLRNSIGTVKEVSRGSSFSGAVLAFEKQSPFLLEC

SEQ ID NO: 112668 - protein, 199 aa, Triticum aestivum
  Clone ID: PAT_TA_7086.pep
HASGFSSLIESTAANLRSPHVSYLVEGPTATFDESHHSVILHGNNLNSVSQLPINTNTNKCSAKIVSCSEFLPTKRHDLSSIRENADAIQITVLSNQSLNISKAGSPAPMLKYFPAPAPAPASLRVIDLKLDILCYSSMDLPVAVAVSELVIPGLADQLSIMKKAIVSELLTQQPKLCPYHFIPPLLLIPLTAIYDTRY

SEQ ID NO: 112669 - protein, 192 aa, Triticum aestivum
  unsure (1)..(192): unsure at all Xaa locations
  Clone ID: PAT_TA_7087.pep
PRVRGRVGGRVGGEQGETSKAPLSRGVSRGVSILDLILRVIAVISTLASAIAMGTTNETLPLFTPFIQFKARYSDLPALTFFVVANSVVSAYLILSLPVSIAHIIRSGAKYSRLVLIIFDAAMLALVTAASSAATAIVYLAHKGNVRANWLAICQQLDSFCERISGSLVGSFGAMVLLILLIILSXIALARR

SEQ ID NO: 112670 - protein, 349 aa, Triticum aestivum
  unsure (1)..(349): unsure at all Xaa locations
  Clone ID: PAT_TA_7088.pep
MRLHGDVSDDEEEGAVMDPALLSPSSPPAGAAAAAASRLVVGYALTKKKVKSFLQPKLLLLARKKGISFIPIDETRPLSEQGPFDIILHKKTSKEWQRFLEDYHEVHPXVTVLDPPNAIEHLNNRQSMLEEVADLNLSSFYEEVCTPRQLVIMKDPSSIPTAVAMAGLTLPLVAKPLVVDGTSKSHELSLAYDEASLPMLDPPLVLQEFVNHGGILFKVYIIGEAIQVVRRFSLPDVNTYDLLNNVGIYRLPRVSCAAASADHADLDPRIAELPPRPLLEKLGRELRGRLGLRLFNIDMIRELGANDRYYIIDINYFPGYGKMPGYEHIFTDFLQSLGQNKYQRCLSGG

SEQ ID NO: 112671 - protein, 113 aa, Triticum aestivum
  Clone ID: PAT_TA_7089.pep
LHTVSYNTPLNITFSAAAMGLCPDVQTRMTSRHCTSGLRPPLLPRLHRPPPLLPPGHMKRGCRSLNCATPAGRLVQVVPFALLPAVVSMASKVMLAQLIFHYHGEMSVRVHTS

SEQ ID NO: 112672 - protein, 34 aa, Triticum aestivum
  Clone ID: PAT_TA_7090.pep
RHEGFVPYRHHIDYFHPIYWNWLEKLNLLAIMGS

SEQ ID NO: 112673 - protein, 186 aa, Triticum aestivum
  unsure (1)..(186): unsure at all Xaa locations
  Clone ID: PAT_TA_7091.pep
LFPLLYRGFRHKNLVSFFASVAANLVLSHELPFLGLLNIPKLLAGPVSAGLPAPPDRPPSAVFFGSDAVPGFRLLNTPTLLAAVEAGFPADGSAFGFDCWNCGRWLLYGGTWPPLSFPLGSCCGGLLPWLNLGGGGPGCCRGGLWLSWGRQYLSSLFSFLLRSCCGGLPWLNLGXWWARLXQRXPL

SEQ ID NO: 112674 - protein, 159 aa, Triticum aestivum
  Clone ID: PAT_TA_7092.pep
HPQGRPSDDGNTSEVADATTSSRGMVMAENTCTELPFGDLEGLLMEISDDQRATKSFQEFSDSVPQLQLQHDDHEVWLNANMEEISVADYTTTSGVMDASECTGTELPYGDLEGLLLQLENGHENIELADFSAPVTHHEVPSGWRWRFPWMPRCYIQLL

SEQ ID NO: 112675 - protein, 116 aa, Triticum aestivum
  Clone ID: PAT_TA_7093.pep
ARSSVPLSPACSVPVREPPPAQRARAALEGVQDGASKHVYEQGSLWWSRSWRRGRRSSRATTSSVGGHKIASTPMLPPPPCILRTGRQNRPRPLRQYPCQNIKHIGAVAMLRKQKK

SEQ ID NO: 112676 - protein, 89 aa, Triticum aestivum
  Clone ID: PAT_TA_7094.pep
NTFDNNYYRNLLAGKAVLGSDTELLLDRVTKDLVEKFAKDQGLFFSQFGKSMSKVAHISVGANYGEYRRNCFRPNFIRNLTDEGFVARD

SEQ ID NO: 112677 - protein, 199 aa, Triticum aestivum
  Clone ID: PAT_TA_7095.pep
ACVNLGLVFVAEGRWEDAVSCFEKAVKSDDLLDAAESNSAAPLAWACKQEGIRGCAVLSWLPSRRRLPRAGPGRAGPVAGCSTLLRPARQLCRLARCRLPALGSGPAPGLRTCARGLSVAGHPASVALELRPGWAWPGSPRLACVIFLGPLSLAPLRDSSAAAIRAADQPPGSAVAVLVGFLWPVIRKGQSSKKFWSRI

SEQ ID NO: 112678 - protein, 198 aa, Triticum aestivum
  Clone ID: PAT_TA_7096.pep
MAATTATPAFLRATELRLLRCTLPSPISQPAPPSPPPAHPLGPVAASALAAVEAGDYAAAIASAVPHIFHSSAFAEVAHGSPAQVYADLTAAAEAFLRGDGGGAAGEGFQCRCALVLSAAVAALLAFTQQNVTGPSGKCSPFPFQSSPLDEGGHSDPGSEWVDWASDQLASFGSHVHGKFALLPFIVFAELLFTSIKG

SEQ ID NO: 112679 - protein, 192 aa, Triticum aestivum
  Clone ID: PAT_TA_7097.pep
LPFTAKVKHSGCRAPIALSGPIPRDLMWGTKLRTLNLGRNLLDGEIPESFKHLRSLLFLSLAGNDLTDLSSALRVLQHLPKLTTLVLTRSFRGGQTMPMDSISGFKSLQVLVLANCALSGMIQPWLQNSKNLRVLDISWNKLSGPIPPWLGNLNNLFYIDLSRNSFSGELPESFTQMKGLISSAYSSEHASI

SEQ ID NO: 112680 - protein, 246 aa, Triticum aestivum
  Clone ID: PAT_TA_7098.pep
VNWMMADIGSRDYGMVDCLFKVVIKDDNYIAVLSHGNGKFCRRVTIDDKIDYFHASSDDGNTKEATFQIEEPVRSREIYDVEYRVGGKKTSTNKNVSRTLVLATNRTHETHNAQTTIELYDRIESTWDAKLTLDVGIKAKLSAGLPFLMEGDVESHLDFHGEYNWGETKIQETKRSIEYSYPVPPMTKVTCSIFSREDVVDVPFSYMQKDVLLSGEVVPPRQLHDGVYRGAKSTDVDIDTSEEKIT

SEQ ID NO: 112681 - protein, 241 aa, Triticum aestivum
  Clone ID: PAT_TA_7099.pep
MERNNRVHISSNYDRSHEDCLDNSMKHMQLKPNTAETTYTGQHAASAPLYQMNKTGATGAPDPGTEGSHPDQTSDRVGGANGSMDCIHPTLPVDPKIGSSSTAQSFPHNYAGFAPTMQCHCNQDAYRSSLNMSSTFSNMLVSTLLSNPTVHAAARLAASYWPAADSNIPVGPNQEVFAENAQGRHIGSPPSMASVVAATVAAASAWWATQGLLPLFAPPIPRCGSKRPGKDAQDFDPKEGG

SEQ ID NO: 112682 - protein, 58 aa, Triticum aestivum
  Clone ID: PAT_TA_7100.pep
HICVGSLLKRLRRSERVRVHFQGFSSGSVSESETAFFSFFLLIRLHLIKMHERSSKKK

SEQ ID NO: 112683 - protein, 238 aa, Triticum aestivum
  Clone ID: PAT_TA_7101.pep
HSPIPFPNLLVSISSHRNYCLPPWPPMPRQSFPASCPTTHSPIPSPISLISISSHRNHCLPPYPTMPRAIFPGELSCGSAHAALPHPWKARGAVWWGLHGERRRSWAQLEQPCAVTGLQSIDTTKAEAAGDGHDTLRCCNRSAFCWNHAVEKLEPFRRKAASSVAGDGDDRLQCCNRPAKSWNYVGQKLEPWRQKVSSSVAGDEDEGSGATTGWHFLLEPCRRKARTTPTKSCNQHCR

SEQ ID NO: 112684 - protein, 168 aa, Triticum aestivum
  Clone ID: PAT_TA_7102.pep
GLVIRGWAPQMTILSHPAVGGFLTHCGWNCTLESLTHGVPLLTWPHIADQFLNETLVVDVLGAGVRIGVKVPTMHVFLNPELYAKQVVRDDIKKALRELMEEGAEIRTTAKKLATVAREAMAEGGSSDRDVADMVRHVGDLAHRKEKGVPELENNQKTDGQVKHSSVG

SEQ ID NO: 112685 - protein, 322 aa, Triticum aestivum
  Clone ID: PAT_TA_7103.pep
MDADTSRQVRPRVRTKLPPPLRAPPTAIAVPAELSRMGLSEIVNSLLLSAEPDHQAQPFDFIVDGELVRMPLHQFLLAKGISAERVLELEYIKAVAPRKQEPPLPHDDWVSAVDGSNPSFILTGCYDGLARIWKDAAECTQVLEGHSGAITSASFINKGVETDGSLHVVTGSKDRSLRLFKFDTSVTIGSSKRIGAYKILPGHTSSIPTRPVDPSRNMICSASWDTTMKLWAVEGSEEDGDTVSVKKRRMNSDESGPEESQLEGSASSTLLGHTQCVSSVAWPEQRTIYSASWDHSIRQWDAQTGRETWNMFCGKALNCLDC

SEQ ID NO: 112686 - protein, 357 aa, Triticum aestivum
  unsure (1)..(357): unsure at all Xaa locations
  Clone ID: PAT_TA_7104.pep
MSRRKSVYSYNFSVGTDTSDGTEAPDSQMGTLPESQSTQDDMPPSVPERTKPPVPSSSSQCDIQDVSTREDSFAKKDKGATLDSLMSAFKNLDASKEESLLREKLQIKEINIGEACIPDLFNVPGDRPVRRTKQKYLTSDRTPERPVSGSHHAPISKWEKHILGRDILNDKADLSEDDESDNSPETVVDKQSQVHSSYNDVVLTNGEASTARETPTSIIKFPDHVLEPVSSPLGACIDSDVAKEKDASSGQNVSLEEEHMPVNSPIYREAXNEPETSSHHLEGETTKVLGSAPGRNASVLHGEDDNIGYQGVLGGDMLVQDEPIHPPEIPPDAHNQSHIQDEDVEKQAVDISHVTPS

SEQ ID NO: 112687 - protein, 128 aa, Triticum aestivum
  Clone ID: PAT_TA_7105.pep
MKQKIVIQLSISCDKSRSKALTLAARAAGVTSMGITRRRQGPAGRRSGDGVDPVCLVSCLRKKLGHAQIIKVEEVKKPEEKKKDEPKPAPALAVHPPPYYHPPTYYNQQCPPPQTAVCGNRHSTCRTL

SEQ ID NO: 112688 - protein, 183 aa, Triticum aestivum
  unsure (1)..(183): unsure at all Xaa locations
  Clone ID: PAT_TA_7106.pep
VQFXKLRARDXRVXEFKSTWPXRATTARGASLQLRRRFIATSPELRRPPRRFTAASTTLHYNLAAPDGSRRSFTAAQRDGGEVLRRIRRWRRRCCDAARGAAGSPMLPCSSPQLPDCSMCDEWQPISNTVVICSSGGHYHAAPRDSAPPPHTMRTIVLFVFNIDWVGRRMQQASRRRQPLLFF

SEQ ID NO: 112689 - protein, 251 aa, Triticum aestivum
  Clone ID: PAT_TA_7107.pep
HNDSPPEDGDEAAESSIFPRAEFIPGLGSINSFTHDPKRAELISKFWAESTAESDASKERDLYGLPDIQEPKTMPRSTGTVKHHKGVEGTVLRHDITASPGVASTMNKLSSSPSRKAFSVQDKLWSIYAAGNTVPIPFLKAIDISPLALVSDSVAGNGPAGSSTTDALEAVRELFSGDGQAKKGRKGQNEAPLPPGVHDRLTTSPTLMNLAQALAYHKTCYEDMPLQDSQATEEQQTIQNLCDTLRTILRL

SEQ ID NO: 112690 - protein, 358 aa, Triticum aestivum
  Clone ID: PAT_TA_7108.pep
GGTESENAVLAVSKSVVALAASIDGDPPSTLACTGTVVSHEDSATWILTSATLIRKQGINTEVHEASIAKIEVLLHNKKVVNGQLLMYDLQYNVAVVSIDIQANLPVVVLSDLPESYFLTPSPVVAIARKFESQSLQMKRGNTCRTVSDLDCNELMISTCQIEQVFIGGLLIDLEEKIVGMNFIDDETTPFLPVQVVRGCLTHFKKFREIKQPWLGIRGRALHVLELAKLEKICHRCPKPHSGILVDMIPEASRANCEGVEVGDILNQLDGVVLHSPDAWAAMLLDKMVVAMDTRKPVVIKAFVRRPRDGMTFDADLKVMERPPGECDLLFKNRWTLPQPEMYYWVPAETGEWVDESD

SEQ ID NO: 112691 - protein, 132 aa, Triticum aestivum
  Clone ID: PAT_TA_7109.pep
GEKLNAMAMRRSKLSAMAMAEAADDGFQFLLDPTGSGSKSLLDGEAIQTLVCTATESSIGDVGDTEETIQVDVNSTCNGVALSLANSEHSTSKDNPQAPGWTKRYTSVNACFYFEHMPTLTGMYVPSKNTKV

SEQ ID NO: 112692 - protein, 220 aa, Triticum aestivum
  unsure (1)..(220): unsure at all Xaa locations
  Clone ID: PAT_TA_7110.pep
MAPVKVFGPAAFANVARVLVCLEEVGADYEVVDIDFMALEHKSPEHLTRNPFGQIPAFQDGDLILFESRAISKYVIHKYKMNEANLMREGNLXKEATMVDIWTEVEAHTYNPALSPVVYECLFNPLLQGIPTNQKVVDESLEKLKKVLEIYEEHLSKHKYLAGDFISFADLNHFPYTFYFMATPHAVLFDSYPHVKAWWESLVARPSIKKLGASMAALTT

SEQ ID NO: 112693 - protein, 282 aa, Triticum aestivum
  Clone ID: PAT_TA_7111.pep
MEAAPTPAAAETQHRHGGCLSARTFMPPGPVARCSGGSSQAAGSPDEASCGSPRWIGKSLSCVCIKRKGAYERICVNLTPVQEQRLQRLRHRMKVYFDHSRRDHQEALRALWYATYPDQELEGLVSEQWKDMGWQGRDPSTDFRGAGFISLENLLFFAKTFSASFQRLLQKQSGNQATWEYPFAVAGVNITFMIMQMLDLQSTKPRTFVKAVFVQMLSEDEWAFDLLYCVAFLVMDKQWVEKNASYMDFNEILKSTRAQVQKELLLEDVMRIEDMPSYRLLC

SEQ ID NO: 112694 - protein, 269 aa, Triticum aestivum
  Clone ID: PAT_TA_7112.pep
HPSARESEERSGARRRRWSRIRASSSSAASPGRRRRRSCRSTSPTSARSPRPPPCSSSSSSPLASCRSLAPASNFGGGGGGDAGGARTKKIFVGGLPSSLTDEEFRQHFQTFGAVTDVVVMYDQTTQRPRGFGFITFDSEDADDRVLHKTFHDLGGKMVEVKRALPREANPGSGGGGRSMGGGGFHSNNGPNSNASSYDGRGDASRYGQVQQGSGGYPGYGAGAYGSAPTGYGYGHTNPGTTYGNYGSAGHGAASAAYAGGYGNPVLML

SEQ ID NO: 112695 - protein, 447 aa, Triticum aestivum
  unsure (1)..(447): unsure at all Xaa locations
  Clone ID: PAT_TA_7113.pep
MESDQGKLFIGGISWETTEEKLQEHFSNFGEVSQAAVMRDKLTGRPRGFGFVVYADPAAVDAALHDPHTPDGRTADVNRALSRGXQQATKAVNPTAGRNAGGGGGGGGGGGDAGGARTKKIFVGGLPSNLTDEEFRQSYFQTFGAVTDVVVMYDQTTQRPRGFGFITFDSEDAVDRVLHKTFHDLGGKMVEVKRALPREAVPGEGGGGRSTGGGXSNASSYDGRGDASRYGQAQQGSGGYPGYGAGAYGSAPTGYGYGHTNPGTTYGNYGSAGYGAVPAAYAGAYGNPSAAASGYQGGPPGANRGPWGSQAPSGYGTGGYAGNAGYGAWNSSSAGGNAPTSQAPGAAAGYGNQGYGYGGYGGDASYGNHGGYGAYGGRGDGAGNPATGAASGYGAAGYGSGNGNSGYPNAWTDPSQGGGFGGAVNGASEGQSNYGSGYGGMQPRVAQ

SEQ ID NO: 112696 - protein, 141 aa, Triticum aestivum
  Clone ID: PAT_TA_7114.pep
DLGHGFGRLLRVGGGEWGRLLEAEELEQLAGGGGGRGGRVADGGGASSLAALVHEEVVELRGEREEEERGHHREPDAKPTQTPHLFLPLAGGFSSFLPRQVGKLTRIHHWWEAKQSIDTPPTQTSRSDVESRKLGPMNGRS

SEQ ID NO: 112697 - protein, 95 aa, Triticum aestivum
  unsure (1)..(95): unsure at all Xaa locations
  Clone ID: PAT_TA_7115.pep
PLCTSTWXCLALACGSAVRAALPNTPAKPRCSHRSYRRRNGRRQGKREEQERGSQQGASYPFSERRATGNQIASKPVQFNQHIHKINIEIISKKK

SEQ ID NO: 112698 - protein, 334 aa, Triticum aestivum
  Clone ID: PAT_TA_7116.pep
HDLFRKTSVPPSAVGAVVVNCSGFCPAPSLAAIIADHYRMRADVKIFNLSGMGCSAGSIGVDVAAGLLRAHALTYAVVVSAEILTVGWYCGKDHGKLLLNCNFRTGCSAALLTNSTAVPVKYRLVNVTRTNTTANDRSYRAGYREEDDEGITGFTLGQGVGRMVSELLRAHLLTLSLSILPWREKARFAAALLLSMRQRGQDKLAGSSSGASAPMPNFRAASDHFCLPSSGKPMILRLGKGLGLGEREMEAALMTFHRFGNQSAASLWYQMAYLEAKARVRKGDTVWHLGIGSGLKANSLVWERVAVADDVAAGGLDALGPWMECIHQYPQWEE

SEQ ID NO: 112699 - protein, 453 aa, Triticum aestivum
  Clone ID: PAT_TA_7117.pep
MPPHGLFPPEPPPRLPLSRPWQACPAPASLPSSAMEAPPSPRRLVAVVLAAVALLVSSPCSALLSAKGVNIEVQALIGIKNQLKDPHGVLKNWDQYSVDPCSFTMITCSSDNFVTGLEAPSQNLSGLLAPSIGNLTSLETILLQNNIITGPIPAEIGNLASLKTLDLSGNNFYGEIPPSVGHLESLQYLRLNNNTLSGPFPTASTNLSHLVFLDLSYNNLSGPIPGSLARTYNIVGNPLICAANTEKDGYGTAPMPMTYNLSQGTPPTKAKSHKFAVAFGAVTGCMGFLFLAAGFLFWWRQRRNRQILFDDEDQHMDNVSLGNVRRFQFRELQVATEKFSSKNILGKGGFGHVYRGQLPDGTLVAVKRLKDGNAAGGESQFKTEVEMISLAVHRNLLRILGFCMTATERLLVYPYMSNGSVASRLKGKPPLDWITRKRIALGAARGLLYLHEQ

SEQ ID NO: 112700 - protein, 220 aa, Triticum aestivum
  Clone ID: PAT_TA_7118.pep
AGSPFCRLRFHADTTPSCWLHGGRRGRSLWLFLPSCSGQFIIDVYFVCCACRCGRVHRCACDSGCYSSCPSFGTYVRALLRLCPWSGWKWTRRQPCVRGMFCLCRVSNWRRRSPLCRWFLVVEDDVLGVPRADDVDAAGLLVPAPSRSPLVDDNYIKKHNEFYDFLDKWVADQSGPGITSGCLPKKKPNREKAKRNKSKKGGVIRKTPTISRWRVLRFYR

SEQ ID NO: 112701 - protein, 203 aa, Triticum aestivum
  Clone ID: PAT_TA_7119.pep
MIMGVGRATRRMQGRSSMSVLLVSLLLLAAAAGVSSRATYTGSSTAGAGASVTTTAPPKKHVDGKKQQVPALVVFGDSIVDPGNNNAISTIVKANFAPYGHDFGADHRPTGRFCNGRIPTDFIASRLGLKQLLPAYLAPNLTTHDLLTGVSFASGGTGYDPLTAQLASVISMTDQLRMFHEYKARVRAAAGDAALSEILAKGV

SEQ ID NO: 112702 - protein, 202 aa, Triticum aestivum
  Clone ID: PAT_TA_7120.pep
AGFCRSIGVEESRRVGSVGRLSQGAEAKIIDPGTGDALPPGVPGELWVRGPFVMEGYLGDKESTSEILDSEGWLRTGDVCLIDKEGFLFVVDRLKEIIKCNGYQVAPAELEDLLQTHPGIDEAAVVGYPDDQAGELPVAFVVGRSGSKVHEAQIKDFVAKQVVHYKRIHRVFLVDSIPKNAAGKILRKDLAKLALHQINAKL

SEQ ID NO: 112703 - protein, 90 aa, Triticum aestivum
  unsure (1)..(90): unsure at all Xaa locations
  Clone ID: PAT_TA_7121.pep
RHEGGISLGXFPSLKGLSIGLCETLSSLPDGPRVYPSLRVLKVYDCPGMKRLPACLQQRLGSLEGVTLDAHHQGPILSKPKTWINGICRG

SEQ ID NO: 112704 - protein, 157 aa, Triticum aestivum
  Clone ID: PAT_TA_7122.pep
GSIPEREPEKRLPHPRKAAGAQITQSSFSRTCCSPWMNLGSPAWCMTFQVSCGVSGILTYYLVFMLNHWTRQQVAAAGKEDGASGMPQVMGLCFADSVGLRLCCSGVWFLSGLGCNYHCMQRLCMPVIFLVLATQINTILCFLHPRFLNIRRFGSSN

SEQ ID NO: 112705 - protein, 104 aa, Triticum aestivum
  Clone ID: PAT_TA_7123.pep
GFLVQPPHHRQDRRTTAGATQDTCRCHLRQESPTQGSSWDGRRDIRSDGAGTRRPHARYAGCAATVPRRRTAQNIYGPGGHLESNCRTGEDSRYGKSGVKLQES

SEQ ID NO: 112706 - protein, 168 aa, Triticum aestivum
  unsure (1)..(168): unsure at all Xaa locations
  Clone ID: PAT_TA_7124.pep
FGTRLELAGTPFLWALRKVGDQDVLPPGFEERIKGRGLVAMGMVPQTRVLAHXPVGAFLTHSGPGSAIEGIQYGHPLVMLPFFGDQQTGAQFMERKKVGLLVPRNGEDGLSFDRQGVASTVRAVVVDEQAGRVFAANAKKWQQVVADTACHERYIDEFVQQLRFYKDQ

SEQ ID NO: 112707 - protein, 104 aa, Triticum aestivum
  Clone ID: PAT_TA_7125.pep
AAVELARHGVRVNCISPHAIATPMVVQQFSQMLQGADEATVTAIIRSLGELKGAACEAVDVARAAVYLASDDGKYVSGHNLVVDGGFTTYKYMNVPFPKPQDSE

SEQ ID NO: 112708 - protein, 60 aa, Triticum aestivum
  unsure (1)..(60): unsure at all Xaa locations
  Clone ID: PAT_TA_7126.pep
QNKPGQAHFSGKDKVLKSKKKPQKNTEKSPSFDGSIILRSPSSPPPVSVSGEGFXLVLVP

SEQ ID NO: 112709 - protein, 202 aa, Triticum aestivum
  Clone ID: PAT_TA_7127.pep
SRRREREREQGGRDDARMSSATTYAESIASCRTPAPIRSPSLAATAAAVPDAAPLPVRRQLDFPSGDGNTDDDDDFFFLVAEEMERNLDQVTRRAAQSLTPPTVALARPTFREKLCICGRGPCAVEWKEGGWAYVCSAPPKCRHSSYCMESDVNPSSQPAFLSHHEPDNHMTNGTTQVNVSPQGAGATTPVNVTTQRDGART

SEQ ID NO: 112710 - protein, 413 aa, Triticum aestivum
  unsure (1)..(413): unsure at all Xaa locations
  Clone ID: PAT_TA_7128.pep
MDLYYGQRATIAVMSXSGYDIEDAIVMNKSSLDRGFGRGIAIKKYRVTAENFFXGFIIDDSQXSRQGFCIEEIYESRGHWMIDXFMTPGQIIVDHDIYVNKQTPKVTNRTPGTALTDRDYRDSPAVYKGVDGETTVVDRVMLCSDTNDKLTIKCIIRHTKRPEVGDKFSSRHGQKGVCGTRVLGKGFPFSEKGICPDLIMNPHGFPSRMTIGKMIELLGGKAGVSCGRFHYGSIFGEPSGNADKVEDISHTLVKHGFSYSGKDFLYSGILGHPLQAYVFMGPIYYQKLKHMVLDKMHARASGPRVLLTRQPTEGRSRDGGLRLGEMERDCLIAYGASMLIFERLLLSSDPYQVQVCRKCGLLGYYNYKLKTSFCSMCKNGENMAKMRMPYACKLLFQELQSMNVVPRLTLTEG

SEQ ID NO: 112711 - protein, 64 aa, Triticum aestivum
  Clone ID: PAT_TA_7129.pep
AFFPFGGGPRICIGQNFALLEAKMALSIILQRFSFELSPSYVHAPYTVITLQPQHGAQIRLKKI

SEQ ID NO: 112712 - protein, 173 aa, Triticum aestivum
  unsure (1)..(173): unsure at all Xaa locations
  Clone ID: PAT_TA_7130.pep
MHPEWQEQARXKVLHQFGRTRPDFENLSRLKIVTMILYEVLRLYPPAIFLARRTYKAMELGGIRYPAGVNLMLPLIFIHHDPDIWGKDAKEFNPQRFADGISNAAKHPAAFFPFGGGPRICIGQNFALLEAKMALSTILQRFSFELSPSYIHAPYTVLILQPQHGAQIRLKKI

SEQ ID NO: 112713 - protein, 532 aa, Triticum aestivum
  unsure (1)..(532): unsure at all Xaa locations
  Clone ID: PAT_TA_7131.pep
MATESLRMLLGDASPWSVAGAAAAVALLWLGAWVLEWAWWTPRRLGRALRAQGLRGTRYRLFTGDVPENARLSREARLQPLPRGSHDITPRVQPMSCNVIKEHGKMSXTWFGPTPRVTIPDPELVREILSNKFGHYGKQKSSRFGKLLADGVANHEGDKWAKHRRMLNPAFHHEKIKRMLPVFSASCCEDWITRWENSMSADGSCEIDFCPEFQNLTGRCXIRRTAFGSNFQXEGMKIFQLQGELGERLIQAAQTLFIPGHWYFPTRLNRILLALVRPCQWILPTNTHKKRRAIKNGEASSDDLLGLLLESNMQQSNGKADHGLGLLVVSKMRQAFGIANLGMSIEDIIQECKLFSLXSMHPEWQEQAREEVLHHFGRTTPDFENLGRLKIVTMIFYEVLRLYPPITFLTRRTYKAMELGGIKYPAGVNLMLPILFIHHDPDIWGKDAREFNPQRFADGISNAAKHPAAFFPFGGGPRICIGQNFALLEAKMALSIILQRFSFELSPSYIHAPYTVITLQPQHGAQIRLKKI

SEQ ID NO: 112714 - protein, 130 aa, Triticum aestivum
  Clone ID: PAT_TA_7132.pep
NSLGSRALCHRERRPAVPWASHPGLPEVPLTTPHARPMLISFILPSAEQNSPKDRRSSSGKPLTLHTRHTCLQTYMQTKHSSGYLRAWPAIVALSSPSSMDICCHPATVISGNPLSLPPRHLSLAFLLCL

SEQ ID NO: 112715 - protein, 198 aa, Triticum aestivum
  unsure (1)..(198): unsure at all Xaa locations
  Clone ID: PAT_TA_7133.pep
MCEWRARSAAIAKAAIFLRHCELLRPPPALLSLSFSSLNPPMVMGNHKLTLKTEEDSNPRDKYITWTDEVTRFMLEWYIDLRKDKPATFKFKKQHHLQCVDALNAKFLLGVTQTQVDRHYRQCKEKWGWVRRALDRTTFTFTLSGSXKQRLNKTAVNYLTRPIRFFHQLEELFLDQSHADGSLALDQTTVNVDDGSDD

SEQ ID NO: 112716 - protein, 64 aa, Triticum aestivum
  Clone ID: PAT_TA_7134.pep
AKQRHAEEMEKQRIKFLKDLELKRMQAFVDMQLQLSRVKQAKNGTSEMLMSLAALPFLSNPAYL

SEQ ID NO: 112717 - protein, 138 aa, Triticum aestivum
  Clone ID: PAT_TA_7135.pep
SFCTKDEVDVGLDKVFVKPTNRLEMEKRKALEQGQTDVQKQKDPQKCCDNTPVSLDEILVKRVSRLEREKMEYEKRNASGQGQTIVSRDQRKHGNIATASESLDQVLVKRVSRLEREKMEYEKRNASRRSKNWVCKTG

SEQ ID NO: 112718 - protein, 218 aa, Triticum aestivum
  Clone ID: PAT_TA_7136.pep
GKGNPKLEEKVTLSSSLMGRRLKSKRGGVVQNPRTHEEDRSVALAAAEAAADEARSAADLCPYCRTCRSRVGPGGGGPCPCSDTTSAQPSAPSRGSAVPAQPCQDHVAEPPSARAQPQPSVSYLSILLGTTTLKDTATSSSSPQAVAETPPPKPTIYVNDPPDWYFSIYIRIDRSGSFHTYPHLGGPFKSLQEVEKAIESYLHDKRHKTLWNEQAGDS

SEQ ID NO: 112719 - protein, 200 aa, Triticum aestivum
  unsure (1)..(200): unsure at all Xaa locations
  Clone ID: PAT_TA_7137.pep
HASAERAGKVIDRPKPPVGKKIXRTAKEKLLDSDLWAARIESLRREPDGAFWAKVRWYTIPEETAAGRQPHNLRRELYRTNALGDIEMESIVRRCFVMSPKEYRDATNDGDDVFYCEYEYDVHWHNFKRLADIDDEPETKEDPSDEPYNAANDYNSDTDEDSEYDEEDEPAARCSARKNQSNEKILAANSWKGRIYGLQK

SEQ ID NO: 112720 - protein, 139 aa, Triticum aestivum
  Clone ID: PAT_TA_7138.pep
MGRGRGRGRKPIANGRSHEDKMSSGEEVVPARKRRGRPQKQRAPDKVDIPAEPKNSAAGVHGDAEGGDAKLKENDDPEGNGNKRNRAPKEESSNLDMEENSSSTRSSNDESTTTTRSSGFRQNGSRRKSTPRRAAEAGL

SEQ ID NO: 112721 - protein, 226 aa, Triticum aestivum
  unsure (1)..(226): unsure at all Xaa locations
  Clone ID: PAT_TA_7139.pep
PQGHPLPWRARAPSPXAEVGIACFTSALPGFRGVLKHRYSDFIVHEVARDGSVVRLTSLDLPDQCVDAKEEEKAAPAADADHSKALESFSGLCGEADCRALRGLLEKVAAGGEGEFSPVMLSPDADKGHRSEVHNFFKKNFKFLVTDTVEHSDGVQKYIRVRVGSEAGGGRGRGGGGRGGGGGGAGGRGRNRKNMNGSDWGDDRPFDSRGSSSWPAHAGKFLRFHL

SEQ ID NO: 112722 - protein, 49 aa, Triticum aestivum
  Clone ID: PAT_TA_7140.pep
DNPPMLLPCGHVLVRSSRPQNYQSSSSRSFKCPYCPFEALASECKRLYI

SEQ ID NO: 112723 - protein, 352 aa, Triticum aestivum
  Clone ID: PAT_TA_7141.pep
SCRIRHEAPRATPACLSALSRHAAERRLARVTAHLLPSSFPLASAPLLAPSPAAASSSPAGDSYRRVHGDVSSEPPEWRAATDEDGKGFVDIIYEKSVGEGIAKITINRPDRRNAFRPLTVKELMRAFSDARDDSAIGVVILTGKGSKAFCSGGDQALRDSDGYVDFDSFGRLNVLDLQVQIRRLPKPVIAMVAGYAVGGGHVLHMVCDLTIAADNAIFGQTGPKVGSFDAGYGSSIMSRLVGPKKAREMWFLSRFYAAEEAERMGLVNVVVPLADLEPETVKWCRQILRNSPTAIRVLKSALNAADDGHAGLQELGGNATLIFYGTEEAKEGKNAYMERRRPDFSKFPRKP

SEQ ID NO: 112724 - protein, 109 aa, Triticum aestivum
  Clone ID: PAT_TA_7142.pep
IESRNPPPLCPCWCSTEDEGGSSWRFPMVLGGDDGLAAAKRQWDDGRQGGRWRSAEGAGGYPAPLLAATAPPAVRKSFFTCAPLLLCSCDGSGRGREERRQQHAAVAAS

SEQ ID NO: 112725 - protein, 138 aa, Triticum aestivum
  Clone ID: PAT_TA_7143.pep
RVSFFSSPDWWLGFPSAVPQPPPLEKAARRPSEMLFSSKLFVFAARCHSIPSPWWLQRRGGRGWHRGADGAHRSRRQDAEVRVVRTERQLHTRAQSPALSFLLCLPSPPVSAATTATPRRYTIPAAVTPWRSRSTTTV

SEQ ID NO: 112726 - protein, 343 aa, Triticum aestivum
  Clone ID: PAT_TA_7144.pep
STHASGRRLRTTFISAGSPLVRAEVSVALTRFALGHNKHLKSVAAEYWRPQTNSLLKSLPSLANINNPSNVYSPSNFLQGSSGLSSHIGPVLRVGSDTSATGRDGRISTSSPIATNSIMHGSPQSDDSSQHSDSGILLRDNASNGGLSYTRSRPIIDSGIYSLFISTMCSIAKDPYPRIANIGRRALSLVGVEQVVMRNTRFGSGGAGESSAPSSNIGMARSSSWFDMNSGISMAFRTPPVSPPQHDYLTGLRRVPALVVPPHLLNSPDGLADPLLSSAAAPSTSELNILPQSTIYNWSCGHFSRPLLTGSDDNGEVSARREERERTALDCIAKCQRSSACKM

SEQ ID NO: 112727 - protein, 151 aa, Triticum aestivum
  unsure (1)..(151): unsure at all Xaa locations
  Clone ID: PAT_TA_7145.pep
FFYLKSTAFYSSSVRREPKIQQAKTWHTLLFLPMTMPNGALFNXDHTNLLRSSPAVYYYIGKHKLRGGASTHRQADTQNRAPEPFILQSRRGDDPGAGPDEQRAGGGRTQLAGRRAGGMALYSTTSHQLIATNGASKAQQFTTTWENTTQG

SEQ ID NO: 112728 - protein, 373 aa, Triticum aestivum
  unsure (1)..(373): unsure at all Xaa locations
  Clone ID: PAT_TA_7146.pep
AAVRVVQVACTLCQRVQDSLLLADPGSGSGXVHSKLDRSPVTVADWGVQATVSWLLSDCFGDENVSIVAEEDDKTLSSSDGTALLESVVAAGNGCLVEAPKYGLRSPEKDLGPHDVLQAIRKCSSTGGPKGRFWVLDPVDGTLGFVRGDQYAIALALIEDGEVVLGVLGCPNYPMKKEWLNYHQRYYRLMSKVAPPTSGSWNKGCVMYAHKGCGQAWMQPLVHDFGMLSWHNSREVQVSSVSDPVSATFCEPVEKANSSHSFTAGLAHSVGLRNQPLRVYSMVKYAAIARGDAEIFMKFARAGYKEKIWDHAAGVVIIQEAGGVVTDAGGCPLDFSRGVYLEGLDRGIIACSGALLHWRILQAVDASWNSSTL

SEQ ID NO: 112729 - protein, 226 aa, Triticum aestivum
  Clone ID: PAT_TA_7147.pep
MARERRAIRRIESAAARQVTFSKRRRGLFKKAEELAVLCDADVALVVFSSTGKLSQFASSSMNEIIDKYSTHSKNLGKSDQQPAIDLNLEHCKYDSLNEQLAEASLRLRHMRGEELDGLSVGELQQMEKNLETGLQRVLCTKDRQFMQQISDLQHKGTQLAEENMRLKNQMHEVPTASTVAVAEAENVVPEDAHSSDSVMTAVHSGSSQDNDDGSDISLKLALPWK

SEQ ID NO: 112730 - protein, 111 aa, Triticum aestivum
  unsure (1)..(111): unsure at all Xaa locations
  Clone ID: PAT_TA_7148.pep
GASPEHLLLRLGAAPSPAAVGAVGGGGASISAGSRRMPAAARSGGPGQANIMMGRRKLQVVTLAILCFWSSAGVCKAQTVDFKPADSYLVDCGSTKGTTVLGRDFAXDGAX

SEQ ID NO: 112731 - protein, 203 aa, Triticum aestivum
  unsure (1)..(203): unsure at all Xaa locations
  Clone ID: PAT_TA_7149.pep
HAVGSSPHVKFLMMVSRLVVDNFFGVFAVAVAAAVVGRAWLIRPEEILDQMLTLPRVYVFLAVILAAALEKMRRMRRLRDVYLVEYGCFRPKPCYRTPFATCLEHAHLMPYLVDEESVAFAMRLLERSGLGEETCVPDAYHYMPPDRSLKASRDEAELVMFXAVDDVFAKTAVIKPADIXDVLIVNCSIFTPVPVFADMVVNK

SEQ ID NO: 112732 - protein, 196 aa, Triticum aestivum
  unsure (1)..(196): unsure at all Xaa locations
  Clone ID: PAT_TA_7150.pep
MQQGGCAYKLLLGSSPSISRRRPPRTLPSVVAMAATNGAGADPVHEPPHKITKMAPLLKVKKLSDKAILPSRGSALAAGYDLSSAVETVVPARGKALVATDLSIAIPEGTYARIAPRSGLALKHAIDVGAGVIDADYRGPVGVVLFNHSEVDFAVKPGDRVAQMIVQVIATPEVAEVEDLDATLRGEGGXFGSTGV

SEQ ID NO: 112733 - protein, 140 aa, Triticum aestivum
  Clone ID: PAT_TA_7151.pep
LARPSRATPVYGYEVVPDAFADAQKNAQLNGISNATFVQGDLNKINETFGKEFPKPDIIISDPNRPGMHMKLIKWLLEVKAPRIVYVSCNPATCARDLDYLCHGVDEKGLSGCYELKRVIPVDMFPHTPHIECVCLLERC

SEQ ID NO: 112734 - protein, 355 aa, Triticum aestivum
  unsure (1)..(355): unsure at all Xaa locations
  Clone ID: PAT_TA_7152.pep
SSSLATLKLDDNHLVGEIPASLANLSKLQTLDLSSNNITGSIPVSLAQIPSLLSFNVSHNDLAGEIPPVLGSRFGTPTAFAANRDLCGPPLQSECRASRRRRKRQRLQRLALLVGAVAAASLLLLLLCCCCAFSLLRWRRRFVERRDGVKKRRRSPGRGSGSSGTSTESQTKLVMFNSRITYADTVEATRQFDEENVLSRGXRHGLMFKACYSEGTVLAILRLPSTSADGAVVVEEGSFRKEAESLGRVKHRNLTVLRGYYAGPPPDVRLLVYDYMPNGNLATLLQEASHQDGHILNWPMRHLIALGVSRGLAFLHQSGVIHGDVKPQNILFDADFEPHLSDFGLEPMVVTAGAA

SEQ ID NO: 112735 - protein, 179 aa, Triticum aestivum
  unsure (1)..(179): unsure at all Xaa locations
  Clone ID: PAT_TA_7153.pep
SAFSYSSHSPSSPPLSSSSSSTISVSSSTTSSVYSNPSSPSSYCSSYCSKSFSSXSTAASSSYSGSSSNSSRSPLSSSSYVSFAAPSSSAWLAPFSAASALAFSSAAGCCGGGDGCGFCSSTLGGASSAALTTSTGASSATGWGFAGLAFVADPFLAAAAPPLLTDLGGISLRPPHQNQ

SEQ ID NO: 112736 - protein, 227 aa, Triticum aestivum
  unsure (1)..(227): unsure at all Xaa locations
  Clone ID: PAT_TA_7154.pep
MAAVRVILPHPHLPIPSWRPQLKPSSSYPRRAVAAPASLSPSPLTASLQLGDVIEAQQFDRQVLNEIFEVAREMEAVERGSHGFRSRVLEGYLMATLFYEPSTRTRLSFEAAMRRLGGEVLTTENAREFSSAAKGETLEDTIRTVEGYSDIIVLRHFESGAARRAAATAEIPVINAGDGPGQHPTQALLDVYTITREIGRLDGIKLGLVGDLANGRTVRXLAYLIAK

SEQ ID NO: 112737 - protein, 149 aa, Triticum aestivum
  Clone ID: PAT_TA_7155.pep
ATVLQSARCRQPAARRGAGSCNRQCVELGPTRGRAATRALRRGGRRGVVLRPARRRQPPSAKKLQPSMSMDATGGYQCYNPVLGTVVTRTPAMLQRQDEVLLPASFFCWIRLRFLLESTNFFCFNRLLDFLLPKFVLLKSMLIFAVKKK

SEQ ID NO: 112738 - protein, 105 aa, Triticum aestivum
  Clone ID: PAT_TA_7156.pep
MVKRHTVLLLLVFVIMFSYNVLEGGAYQNQVAFSRKELKAQQKVSFTGMDPSLGGQVSGATDAGGASNNAEISNAKTTAATESHRDVSWDQFRGIIIHTHQVKKP

SEQ ID NO: 112739 - protein, 97 aa, Triticum aestivum
  Clone ID: PAT_TA_7157.pep
TPPRSASLVLPVPWPHLSWRRPQRPQARSMPASSSCKILPHQASAPSNPICSIKQVKKTKLTTPTQPKTFVLQENIKTFVELECIAGARSNHTRISL

SEQ ID NO: 112740 - protein, 158 aa, Triticum aestivum
  Clone ID: PAT_TA_7158.pep
MAAARPHHRAPPGRVPTRCVAALCAACFLLGVCVVNRYWAVPEPPDCPSKANSGRSRAMLSQAQTREVVIALDRTISDIEMRLAAARAAQMRNQGVSPSDSAADHGNMRPRLLFVMGIMTTFGNRRRRDSIRKTWMPQGERLRRLEKDKGIWHAFWYW

SEQ ID NO: 112741 - protein, 118 aa, Triticum aestivum
  Clone ID: PAT_TA_7159.pep
YRWTISMVCMSLKQSSSVGPLDYKKLLIHIYSFTTTPSSDRYAMHVFIDMTTCPWKFNYDDHHVSSTATRDRCRSNPRHHVPRHAPHPSQPHRPSAFVCLTCGPPEMRRASSFYHSHT

SEQ ID NO: 112742 - protein, 95 aa, Triticum aestivum
  Clone ID: PAT_TA_7160.pep
GPNGCAHVGDALKSPPLPLLQPGHFIANVGCSAPRTVILMSDNQVSSLTPRWVDHAARLVSVGLQDDTHTEPSYLRYKYSYIWERMEDLSIYLSF

SEQ ID NO: 112743 - protein, 180 aa, Triticum aestivum
  unsure (1)..(180): unsure at all Xaa locations
  Clone ID: PAT_TA_7161.pep
SARGYLNTATLQPXKDSQSGRLVTGVLQLPQGAHLTFDETLLQSGSLASRGAXEERAAEEQEGAPAGGKSNILPSDLEVPFRPSTVSAVNATSEELESWRWYLATVRSLPQSSEPEIYQTIQDEMVSAMRNDRSLGCTELSRWLTMAQMTASSFGEKSLXSLEHWQMVKELERLRKERMQ

SEQ ID NO: 112744 - protein, 120 aa, Triticum aestivum
  unsure (1)..(120): unsure at all Xaa locations
  Clone ID: PAT_TA_7162.pep
KTLAGMRISKXXGISLQRTRRPSSRTLAAPVAKVAERLVCRSLGITKDGQDVTASILEAFTERFKEQLPPEVIVAMRDFFKLDDSSISAAEDALIDHGGAAALDSVGLEQDGQGSEPAIA

SEQ ID NO: 112745 - protein, 134 aa, Triticum aestivum
  Clone ID: PAT_TA_7163.pep
AIIKVYMQTTLVITLCNNQLLELVEERLVWVFSNSPGVSSILPSLVTKLKTAKDKFLMASVATSASSAAKGKKWNLSFSLIWNTVVWLMIVNFIIQIITSTAQSYLKKQQELEISMKSSATLSSASEPAARISN

SEQ ID NO: 112746 - protein, 42 aa, Triticum aestivum
  unsure (1)..(42): unsure at all Xaa locations
  Clone ID: PAT_TA_7164.pep
XYTLSLSLSLSLSLSLSLSLSLSLNIVRCIVRIGELPRINVV

SEQ ID NO: 112747 - protein, 132 aa, Triticum aestivum
  unsure (1)..(132): unsure at all Xaa locations
  Clone ID: PAT_TA_7165.pep
HGGTTTTLILLILRPSTTFRTAAPRGPVPPGGRPQRPRRGGRAAVQXAPPGPGGPPAVPASACPAAQRLVQPSPAPRPAACGDRGPRAPAAPGGGAGGAGPRSPGTGAGPDVDIARGRSAGRGGSALAVCGA

SEQ ID NO: 112748 - protein, 265 aa, Triticum aestivum
  Clone ID: PAT_TA_7166.pep
PYISKETVEQHWGVHQRGHVDRLNGMIGGSEWERMSIGQMMLASFNEGREPPHAPFFHAAQVWNHDFYWRSIKPGGGGKPPERLLKFINRDFGSYDGMIKQFMDVALTQFGSGWVWLSYKGSKLPHVKSKSPIPSDNYGRLVISKSPNAINPLVWGHSPLLAIDVWEHAYYLDYENRRAEYVSAVLEKLVSWEMVESRLRKAVLRAIERDGHTSPKQRRKQLLSQARSRVGDASTSGEARRRPRSKDQQAPSSVRMVPAGEAVPN

SEQ ID NO: 112749 - protein, 261 aa, Triticum aestivum
  unsure (1)..(261): unsure at all Xaa locations
  Clone ID: PAT_TA_7167.pep
PESPRWLVSKGRMAEAKRPTRGLRGREDVSGEMALLVEGLGVGKDTHFEEYIIGPDDELADDGLAPDEEKLKLYGAEEGVSWIARPVRGGGQSALGSALGLMSRHGSMVSQGKSLVDPLVTLFGSVHEKMPEVMGSMRSTLFPNFGSMFSVAEQQQAKADWDAESHRDDEDYASDHGADDIEDSLNSPLISRQATSVEGKEIAAPHGSIMGGVXKKVAACRXGEAVSSMGIGGGXWELAWEXWLDRKGAYGQKEGGVSAYL

SEQ ID NO: 112750 - protein, 145 aa, Triticum aestivum
  Clone ID: PAT_TA_7168.pep
HEDPLALTARGSIAPPPIPSAWPQIRHRRRLLVLVTAAADADSSSSPPPQAPCLCRRRRLLVLAAAVPFCWIPRRATTGGSSRLDPAMVRGRWSTSRRGHDERRMIWISWHRLVQDQGMAAESRSAMPIVRFFCSFGPCQHPREQ

SEQ ID NO: 112751 - protein, 299 aa, Triticum aestivum
  Clone ID: PAT_TA_7169.pep
MGAVQLESVAAQHAQAKLNVESLPQGPSLFDGNDTARINGSESDEYEKFDKGLMQYGCAHYRRRCRIRAPCCNEIFDCRHCHNESKNSIKIDTPTRHELPRHELQQVICTLCGTEQEVRQVCINCGVCMGKYFCEVCKLFDDDVSKQQYHCHACGICRIGGRENFFHCSKCGCCYSKVLKNSHACVEGAMHHDCPICFEYLFESRNDVSVLPCGHTIHEKCLREMKEHCQFACPLCSKSVCDMSKAWERLDAELATLSNSFDDKMVRILCNDCGAVSEVQFHLIAHKCHNCKSYNTRQI

SEQ ID NO: 112752 - protein, 87 aa, Triticum aestivum
  Clone ID: PAT_TA_7170.pep
EYRVLIIARALDLINALSASCEQAGGVNDPPDPPHASPAAAVPYIVVPDRGHICTPTLILARRRCLKVHYLSCLALILSTTTSARLV

SEQ ID NO: 112753 - protein, 113 aa, Triticum aestivum
  Clone ID: PAT_TA_7171.pep
MDSSKSPQPLKKSRTSLSGTDGHQFENDELPSETASDKTPGLKFETVDKAQDEFGEDSSPLQQSAASNVSYRGSPCIGAFTIQCARCFKWRLIPTKEKYEEIREHIIQEPFDC

SEQ ID NO: 112754 - protein, 207 aa, Triticum aestivum
  unsure (1)..(207): unsure at all Xaa locations
  Clone ID: PAT_TA_7172.pep
ERLDCDSSSGWKPHETCDDEEDIDHDGSXLEAIDKPDIAQPPAGXWETQILEKRXGGTVFADVNFTSPTARNLSSLVXEVDRYLXENPEYGAQGVTLAQFSFQIPRPLRQNYVKKRPKNASPSDEATTKPLQPVEVNPISWAAPLASEAKASEPASHADEKPVGSADVELVRKRKAEPGESNANNHVSDGPETKLEDAQNGDATTTA

SEQ ID NO: 112755 - protein, 255 aa, Triticum aestivum
  unsure (1)..(255): unsure at all Xaa locations
  Clone ID: PAT_TA_7173.pep
LVEIKSVTPPKRPRERNCKNSHCLKLYCECFAAGLYCDGCNCKQCGNKVENEHARQEAINSTKLRNPKAFQPKIENVPSALSVRKDAGAPSVPKHNKGCHCKKSGCLKKYCECFQANILCSKNCXCMDCKNFEGSEELQAIIQGDNASDKNNIQQAANVTLNGAIGSSGYKYSPVRRKRHPEDPLGPEANHLDASQVASSSGLEGCIGYQSRSKMVYRSPLANTIHPTDVNDLANHLVIVCRKATETFLTITIKS

SEQ ID NO: 112756 - protein, 135 aa, Triticum aestivum
  Clone ID: PAT_TA_7174.pep
FFFLSPWLTGYHPSRLLHNMVGTSWTNYFSFDADPLLENSANSSAQAGDHTSLNLNASANTIRCWLRHLHVLKLGQIQEHLDELSVVLRVIPAGSVAVAAGKLAPGAPRRVAAGRRGGEGGRRHGLYRPLNPFLW

SEQ ID NO: 112757 - protein, 59 aa, Triticum aestivum
  Clone ID: PAT_TA_7175.pep
PSCINEFISSLSLISRDLILVLICISSYAKIRVKLYPLVFDQMLSISKLITVHYESIER

SEQ ID NO: 112758 - protein, 101 aa, Triticum aestivum
  unsure (1)..(101): unsure at all Xaa locations
  Clone ID: PAT_TA_7176.pep
LHPQFAELNAFHGIENEGPRAYKYGPEMCGAIHGREATKCKGPSSCDXQPKAEIFPPELTVGEGHPTEVSFFKLAGMKLRLFLEEEGGLLCGAWDRERSTY

SEQ ID NO: 112759 - protein, 254 aa, Triticum aestivum
  Clone ID: PAT_TA_7177.pep
SARDLYIAPRLLRPLQVGPDGGLATPLATEAEGVRFNFTNDLDLDADGNVYFTDSSVLYQRRHFMQLVFSGDASGRLLKYNPQTKETTVLHRNLQFPNGVSLSKDGSFFVFCEGSRGRLSRYWLKGEKAGTVDLFAILPGFPDNVRTNDKGEFWVAIHCRRSAYARLLSRRVQLRKFLLSLPIPAKYHYLMQIGGNLHALIIKYSPEGEVLDILEDTKGQVVRAVSEVEEKDGKLWIGSVLMPFIAVFDYAKES

SEQ ID NO: 112760 - protein, 70 aa, Triticum aestivum
  Clone ID: PAT_TA_7178.pep
ALQVLFLACRLIRQLYVVIVLLLILFTSATNYEAASYLFHLCTLATLVEKDECFLMYELLWVIQVCHSVW

SEQ ID NO: 112761 - protein, 232 aa, Triticum aestivum
  unsure (1)..(232): unsure at all Xaa locations
  Clone ID: PAT_TA_7179.pep
MAEELVLDTAIRDWVLIPLSVVMVLIGVLRYFVSKLMRSPPSASPSPDPKTVKEGQVVIRARNLRNGAQFIPAKAFKARKLYYTNGEAGLLHVPKEDAQKAQAAMFSDPNMAMDMMKKNLSMIVPQTLTFAWVNFFFSGFVAAKIPFPLTQRFRGMLQNGIDLSTVDVSYVSSRSWYFLNXFGSRDLFTCILGAENGADDAQKRMXSGGGMGFTPAMRLSTYKVRLVIIQHS

SEQ ID NO: 112762 - protein, 208 aa, Triticum aestivum
  unsure (1)..(208): unsure at all Xaa locations
  Clone ID: PAT_TA_7180.pep
AKGFSLSQLLDGATEIHTLTLNFQGEKLWILPESKQLRAAFSNLRKLSIHGIYVEFDLLWTINLLEAAPSVEIFDIEVFEHPCXVLYWERVGIQRVKPSWKVAGFTSCNKWKLRELHVTNFSPLMEQHMLFVREVMDRAPNLKTVILKEDDEPCKDCEAMDALPNLVGGLFPRTKNEQETIAQQLRDNMVGSSSLKIIFKSIVSAVVF

SEQ ID NO: 112763 - protein, 75 aa, Triticum aestivum
  Clone ID: PAT_TA_7181.pep
ALFLAHAHPQRREPEPWACLLLATTVACHGARDIPATEPESYRPQNVFGFGGFYPGPSVNWVFPGPNGVTPRALH

SEQ ID NO: 112764 - protein, 227 aa, Triticum aestivum
  unsure (1)..(227): unsure at all Xaa locations
  Clone ID: PAT_TA_7182.pep
AAARAGTHVRASVTPDMEASFRGRKTYATQNVMAAVDFDLRFTYVLAGWEGTAHDALVLRDALERENGLRVPQGKFYLVDAGYGAKRGFLPPFRGVRYHLXEWGNNPXVQNERELFNLRXHSSLRVTVERAFGSLKRRFKILDDATPFFLFPTQVDIVVACCIIHNWVINDGIDEYIIPEDEWVPNITHASSSSGQAHEHAYMVNFRQGVADQMWEDRQNHLQGQNM

SEQ ID NO: 112765 - protein, 95 aa, Triticum aestivum
  Clone ID: PAT_TA_7183.pep
HWISLLQLRSEIGRKLGGLVRSENYSPETNTKMNITLKQQISHIRQPFLTLVLLGRMLPAHSLCSFIFWRGLKLLNYNPIRVTESSSKVAGLPTH

SEQ ID NO: 112766 - protein, 209 aa, Triticum aestivum
  unsure (1)..(209): unsure at all Xaa locations
  Clone ID: PAT_TA_7184.pep
LICXNSIIAPWKLLFALVPPYQIAHGWIAFIFSLIFISGIAKGGTANGDPKSRDPGRSATGLAPTALAAGAPGAGPAGRELAAGRQAAAGPATADTASGNTASSNAGNGDAGTGDPGXNNTAYQDPAYQDPAAGDSAAGLGFSAPAFGGTTVGGLRGMVLGGEVGGAGLGGRGPWAWATAAWVVVVRVASVRVSGVRETGVGATYGGAR

SEQ ID NO: 112767 - protein, 135 aa, Triticum aestivum
  Clone ID: PAT_TA_7185.pep
MYRNLNSGGSVQISVWTLADPDSTEWTLESEATFAEIWDDASYKATGLPRKIPVLALIHPTNPDVVYFFLDEHLFGVDVRARKVVECEVYELVQPPREHVTTRFVHAWQLPQALCSGSAKETEDGVKEELQQLQL

SEQ ID NO: 112768 - protein, 417 aa, Triticum aestivum
  unsure (1)..(417): unsure at all Xaa locations
  Clone ID: PAT_TA_7186.pep
MAEVDDVXNRMEAQLRVHAGEDDADLPLPALFDRASHLHSLASXSSLDQEGIRKGVDLLRRCDDMVSKLGALLLQRGPKEDVSTXANLKYLLRVRTYLGEMTEQVEQEDRIPVLKASQDHLKEFISVCEALELIPEDELQLYRQGQSETGANRRAQKVARFKRQKAAETKLQEIKERKERRGRSLRATALSAPIEAGEEDDLEADGEEEREAWLATISLALCKAFDLVDMLKKEEEMLLAVKERKEKDGNAFAREMLDERRQKAEAWHQNAASRAPYSKPAAPITCATFAQDVIEGRASVSQAHDHKHQPLIFGPASLVGGGLTSERERMAAQVFQPSFRMPTMSIEQAGLAEMKMMEQWQERTAKMIQEASSSWHKDDTSLAQDDEDAEEEKARAFDDWKDENPRGAGNKKLTPCG

SEQ ID NO: 112769 - protein, 174 aa, Triticum aestivum
  Clone ID: PAT_TA_7187.pep
MASLLEIFVGSCSSSAPPVDWEAEAYPEYADYAVLPLLLAFFPALRLLLNQFLFEVLARRLIFGKGYDKLAETDERRKKINKFKESAWKFVYYLSAELFSLSVTYNESWFTNTRYFWVGPGEQLWPDQKMKLKLKAVYMYAAGFYVYSIFDLLFWETRRKDFGVMMSHHVATIV

SEQ ID NO: 112770 - protein, 156 aa, Triticum aestivum
  Clone ID: PAT_TA_7188.pep
YKIRLTASLDCARYLIAQGEAFRGHDESSTSINKGNFRELLDWYQHQPEDVKGAFDKGAGNAQMICSDIQKDLAAACAMEVTKVIKNDIGDKKFSILIDEARDCSIKEQMAVIVRFLDDHGVLQERFLAIKHITDCTSAGIKEALVDMLEFHGLLL

SEQ ID NO: 112771 - protein, 141 aa, Triticum aestivum
  unsure (1)..(141): unsure at all Xaa locations
  Clone ID: PAT_TA_7189.pep
SVGLVSALLAVKYKWWMDPVGAILIALYTITTWARTVLENVGTLIGRSAPAEYLTKLTYLIWNHHEEIRHIDTVRAYTFGTHYFVEVGRGAPRATCRSSQAHDIGEALQEKLEQLPEVERAFXVHVDFEFTHRPXEHKADV

SEQ ID NO: 112772 - protein, 92 aa, Triticum aestivum
  Clone ID: PAT_TA_7190.pep
KDDVVTHILSGLGAGFFAVCVGSPVDVVKSRMMGDSAYKNTIDCFVKTLKNDGPLAFYKGFLPNFARLGSWNVIMFLTLEQVQKAFVRKPAN

SEQ ID NO: 112773 - protein, 97 aa, Triticum aestivum
  Clone ID: PAT_TA_7191.pep
CSSIQHKFNNTFDISELPQHLFKVLSRPTKFYYSFSQLRCQICPLYHNSQGLTSYVGENKCAHILVVYHLLQNPYHLIFNLQAFSQRPSEPAPVSRT

SEQ ID NO: 112774 - protein, 307 aa, Triticum aestivum
  unsure (1)..(307): unsure at all Xaa locations
  Clone ID: PAT_TA_7192.pep
MAPDHGSKVDISFAGRFTASAIAACFAEITTIPLDTAKVRLQLQKKAIAGDLAGPKYRGLLGTAATIAKEEGAAALWAGHRAVAXGAGRLHPPVSQAKPSMAPDHGSKVDISFAGRFTASAIAACFAEITTIPLDTAKVRLQLQKKAVAGDLAGPKYRGLLGTAATIAKEEGAAALWKGIVPGLHRQCIYGGLRIGLYEPVKSFYVGENHVTDVPLXERYTHILSLLGAGFFAVCVGSPVDVVKSRMMGDSAYKNTIDCFVKTLKNDGPLAFYKGFLPNFARLGSWNVIMFLTLEQVQKAFVRKPAN

SEQ ID NO: 112775 - protein, 276 aa, Triticum aestivum
  unsure (1)..(276): unsure at all Xaa locations
  Clone ID: PAT_TA_7193.pep
RPRPPPRLAPAPLARPALSRPVPQKLGTGAPRTPTFLTSPHLPSTVPHGETPALVVLLVFDLEDADSIISKDSSTPLLVVVPGLTSDSDAAYGQHLVHSMARKGWNVVVSNHRGLGGVSITSDCLYNGGWTEDVREVINYLHRKYPKAPMFCVGTSIGANILVKYLGEEGESTPLAGAASICSPWDLVVCDRFISRKLVQRFYDKALAFGLKGYAKLHQPVLARLANWEGIKKSRSXIREFDNNATSIVAKYETXDXYYRXCNNCQFLLGFNSPAL

SEQ ID NO: 112776 - protein, 117 aa, Triticum aestivum
  Clone ID: PAT_TA_7194.pep
RHEGQTLASPSPTAASPPSSSILVSSRRHSASLLSVLRPCCREEAIVRGAIPQPGCCTRGQGPPPPRAMGRPSMSLRAGSPHRARHQQAARTTYWPVPRRRARALVAPSWRRRTIKE

SEQ ID NO: 112777 - protein, 112 aa, Triticum aestivum
  unsure (1)..(112): unsure at all Xaa locations
  Clone ID: PAT_TA_7195.pep
CFEHAIPKIEEQDPLLVLAYFSAGLSRKNQGDKETAIKLLQRLTELKEPEQVMNKACYFQGFIALGSILSNEGRKSEAAKYLRAATAYDPGVERFLKECEEAMEDQXKSAEH

SEQ ID NO: 112778 - protein, 148 aa, Triticum aestivum
  Clone ID: PAT_TA_7196.pep
PGTGACGLSGLASSLCQWASQVKKHTSYMMTIEMSFIGSMCLLASTFQSPDGEALRIYGFFHEWTLWTVIPVLMNAVGGILVGLVTSYAGGIKKGFVIVSALLVTALLQFIFDGKPPSLHCLVALPLVMTSIFIYQKYPYVDSKKKDR

SEQ ID NO: 112779 - protein, 768 aa, Triticum aestivum
  Clone ID: PAT_TA_7197.pep
GGGARAAGRRQRVMEDLGIEAKEAAVREVAKLLPSQDLLSSIASIKADYLSRQQTNDTQLSSMVAEQVEQAHAGIDALAISQQTINSLRENFIDIDKLCQECQTLIENHDRIKLLSNARNNLNTTLKDVGGMMSISVEAAAARDSLSDDKELIHTYERLTALDGKRRFALAAAGSHKEEVGRLREYFEDVDRSWETFEKTLWGHIANFFKLSKESPQTLVRALRVVEMQEIIDQQVAEEAAEAEGAGAMATIANQRRTTKKGAGAASTPRNSTQEKSKTQGKGYKDKCYECIGKAVEARFDKLLTELVFSEDMMEALEEAKAIGEELGDIYDYVAPCFPPRYEIFQLLVNLYTERFIHMLRLLSERANDIQNINILKVTGWVVQYQDNLIGLGVDESLAQVCSESGALDPLMNMYVERMQATTKKWYTNILEADKTQPPKSTEDGKLYTPAAVDLFRILTEQVQIVRENSTDVMLYRIALAVIQVMLDFQAAERQSLEEPASDVGLETLCALINNNLRCYELSSELSSSTLEALPPNYAEQVNFEDTCKGFLEVAKEAVLQTVSVIFEDPGVQDLLAKVYQKDWMDGMVTEYLVATFADYFGDVKLYIEDRSFRRFVESCLEETIVVYVDHLLSQKNYIKEETVERMRLDEEVLMDFFREYTSVTKVENRVRILADLRELASAESLDSFTLIYTNILEHQPDCPSEVVEKLVALREGIPRKEAKEVVQECKEIYENSLIDGNPPKSGFVFGKLKCLTVKKGIWGKLGQ

SEQ ID NO: 112780 - protein, 191 aa, Triticum aestivum
  Clone ID: PAT_TA_7198.pep
RLARPPRDVGSSPPSNSSRRSSPVPIAPPLKPPAGALPSPEELGERSVGRRRPRAPHVAAVASAQSGAAPLRRFPPPPPRGRPGSSVGRVDSKVESYPRHNRGRDERGGLAICGAVPAVPQSRTRSSSSCSTICPCAACRCRLGCSCCLSIPQSVSASGIGWTLLTQYDSNFAYICLGEEIEARGHVQVCF

SEQ ID NO: 112781 - protein, 527 aa, Triticum aestivum
  unsure (1)..(527): unsure at all Xaa locations
  Clone ID: PAT_TA_7199.pep
IRHEGCPQCKTRYKRPKGSPRVPGDEEEEDVPRLRNEFNYKQGNGKGPEWQPQGQGEDIDLSSSSRHEPHHRIPRLTSGQQMSGEIPDASPDRHSIRSPTSSYVDPSVPVPVRIVDPSKDLNSYGLNSVDWKERVESWRVKQDKNMMQVTNKYPDARGGGGDMEGTGSNGEDMQMVDDARLPLSRIVPIPANQLNLYRIVIILRLIILCFFFQYRVSHPVRDAYGLWLVSVICEIWFALSWLLDQFPKWYPINRETYLDRLALRYDREGEPCGLCPIDIFVSTVDPLKEPPLITSNTVLSILAVDYPVDKVSCYVSDDGSAMLTFESLSETAEFARKWVPFCKKHNIEPRAPEFYFQQKIDYLKDKIQPSFVKERRAMKREYEEFKIRINALVAKAQKVPEEGWTMADGTAWPGNNPRDHPGMIQVFLGHSGGLDTDGNELPRLVYVSREKRPGFQHHKKAGAMNALIRVSAVLTNGAYLFNVDXDHYFNSSKALKEAMCFMMDPALRRKTCYVQFPQRFDGIDLHD

SEQ ID NO: 112782 - protein, 189 aa, Triticum aestivum
  Clone ID: PAT_TA_7200.pep
LFQRVCTRGYHMFRCIARYGYKDKKQEHHNTFERLLIEGLEKFIQREAVELSLQSEDDVDSDEEPSTPGQIITAPNGSLYSLDAPLLVDFTPSVDTIPETPSCSTPQDPGLDYTQNLELELAFIKQAKESGAVYLIDNPIVKARKDSWFFKKLIINFERPPGQVNCRRAIVSMSIPHSNLLQVRLTSYV

SEQ ID NO: 112783 - protein, 140 aa, Triticum aestivum
  unsure (1)..(140): unsure at all Xaa locations
  Clone ID: PAT_TA_7201.pep
MSWRKAGGDGGVSKRWAVLLCLGSFCLGLLFTNRMWTLPEAXEVPLPNQSVEEGKALVAADCGSKKVQELQKYKDVLPDQDTHHDVQTLDKTIATLETELSAARTLQESLLNGSPVSEDFKVSESIGRRKYRMVIGINTA

SEQ ID NO: 112784 - protein, 145 aa, Triticum aestivum
  unsure (1)..(145): unsure at all Xaa locations
  Clone ID: PAT_TA_7202.pep
PQEDFHLRKEXYICWRRIDVQLQISIGGKEDTMPLWFPKXPWINELRSQAYYSVVAAEVQDGGTCCFGEITVSYPVMKNKLHYFRLDELLIQAIQSKAQSPTIGCQLATALWKTASELSPSGLVRVKRRTSEFSVGGASGWLVTC

SEQ ID NO: 112785 - protein, 162 aa, Triticum aestivum
  unsure (1)..(162): unsure at all Xaa locations
  Clone ID: PAT_TA_7203.pep
MARAAAANLRGLVGIAAAGRRRVTASVATPRASPGGRGFRAVASGSGGRTTPESSSSSSPALPQLQPRRGLETRRAVLRDLISGGLESEDGKLSCGYSSFKGRRPTMEDRYDVKFAKIKGQSVSLFAVFDGHAGPLAAEYLKEYLLDNLIKHPQFLXNPKLA

SEQ ID NO: 112786 - protein, 147 aa, Triticum aestivum
  Clone ID: PAT_TA_7204.pep
AGFEQNLGTWPPPNGRNSSSPLRFSLAARRPPQPVGVDGAPGPRAVLHPPAPQPASPAFVRVAPTAPHRLRPPPCPAGVLVAALAAPRPGPPLPGLPRLRLGLRATVPPPRPSPPFLPPPGPPPHPRLPVLLSHANVSRAMACFEHS

SEQ ID NO: 112787 - protein, 119 aa, Triticum aestivum
  Clone ID: PAT_TA_7205.pep
RVCGHPYCPYKFYHIRCLRTSQIALEKQKNLECWYCPSCLCRGCFKNKDDEEITLCDGCDEAYHVYCMTPKRTCVPKGHWYCPLCSVRRAREGMQRYEKSILKKQQHISAKRASQSDDA

SEQ ID NO: 112788 - protein, 285 aa, Triticum aestivum
  Clone ID: PAT_TA_7206.pep
VDPARTPRVAPRVRLNGEKVAVKSFSDYVQLYIDSASKEGIKLPRIYQKVNDRWEVCVSLSEGQFQQVSFVNGIATIKGGTHVDYVASQIASHVMGVVNKKNKQANMKLHIVKGYLWVFVNALIDNPAFDSQTKETLTTRQGSFGSTCELPDDFLKKVSSSGVVTNLLSWAEFKLSKELKKTDGTKKTSIVGIPKLEDANDAGGKNSDKCTLILTEGDSAKALAMAGIGVVGRDHYGVFPLRGKLLNVREASHKQLMENAEIQNIKKILGLQHEKKFDSTKGLRY

SEQ ID NO: 112789 - protein, 207 aa, Triticum aestivum
  unsure (1)..(207): unsure at all Xaa locations
  Clone ID: PAT_TA_7207.pep
MAADEAKAKGNAAFSAGRFEEAAGHFGDAVALAPDNHVLFSNRSAAYASLHRYKEALADAERTVALRPDWAKGYSRLGAARLGSGDAAGAVEAYEKGLALDPSNAALKDGLAXAGSAALPRRPASGADAIGKIFQGPDLWSKIAADPTTRAYLDQPDFMQMLRDLQRNPGNLNNYLSDPRMMQVLSLMLNVKVHNQNNDASEPAPAP

SEQ ID NO: 112790 - protein, 113 aa, Triticum aestivum
  Clone ID: PAT_TA_7208.pep
KAGKNVIISNQPYFYKKAELFPGSAFIIGADTAARLVNPKYYGGENDRALAQHLGWESAGTTVLVGGREIEGVFKVLEELNIPTELKDMFISIPEEKFRIDISSAELRKKQGL

SEQ ID NO: 112791 - protein, 145 aa, Triticum aestivum
  Clone ID: PAT_TA_7209.pep
AFWWPQQQHRDLDASCCPLFLQCRCCCFCSSNLLAVAGLKTSEQFRGAAEVVALFLQDEEAQEPRISESLLVLGNSRSSELSSDSTSTFTCLSCLISFSFAFPIGGVFSVALKNAGNPGSFFTSANLANPGGLVMLRENLIGDFF

SEQ ID NO: 112792 - protein, 136 aa, Triticum aestivum
  Clone ID: PAT_TA_7210.pep
MARTKQTARKSTGGKAPRKQLATKAARKSAPATGGVKKPHRFRPGTVALREIRKYQKSTELLIRKLPFQRLVREIAQDFKTDLRFQSSAVSALQEAAESYLVGLFEDTNLCAIHAKRVTIMPKDIQLARRIRGERA

SEQ ID NO: 112793 - protein, 179 aa, Triticum aestivum
  Clone ID: PAT_TA_7211.pep
VAAAFEAGAQAPPPDPPRAPSPPPTPRSPKRSHSRTPPQALAPVARSKQTGRRSRRREAPPQQPATKGGPKSAPPTPGVNKPPRFRPGTPALREVSCPQKSTGLLIRKPPCQRLARGIPQDPRSDLRVQSSAVSALQEADQAYLVGLFEDTNLCAIHAKRVTIMPKDIQLARRIRGERA

SEQ ID NO: 112794 - protein, 123 aa, Triticum aestivum
  unsure (1)..(123): unsure at all Xaa locations
  Clone ID: PAT_TA_7212.pep
TRRGYRSTRTALFDGIEEGGXRASAYSSHEIDEHENERAMDGLQDXVSILKRISGDINEEXEAHNRMLRQNGVVNDDSXSRGFLSGTVDKFKTVFETKSXRGWMGTLVASFVALFMLVYYLTR

SEQ ID NO: 112795 - protein, 64 aa, Triticum aestivum
  Clone ID: PAT_TA_7213.pep
LKYSIHVHFAIDTPTITLFYSSQNAVDQRIYSTYIEDPLVFLATTIEKNTQVNIQVVACYKIWA

SEQ ID NO: 112796 - protein, 92 aa, Triticum aestivum
  unsure (1)..(92): unsure at all Xaa locations
  Clone ID: PAT_TA_7214.pep
PPLFFFFFDFFSSXFHINQTRADSAQLGEPSLVVAPSKVYTGLKEWRTVYVQAIWATQNFALRKLLSTSQRRTALSLTVHALSIRLRLTEIK

SEQ ID NO: 112797 - protein, 78 aa, Triticum aestivum
  Clone ID: PAT_TA_7215.pep
HKSVQKPSPRPSLEMRTSTMSKRLTKFTFQSSRGLSLPPVAHFIGSFKRTSTARVVCCLKCASVFPPLCCPASTCVDA

SEQ ID NO: 112798 - protein, 145 aa, Triticum aestivum
  Clone ID: PAT_TA_7216.pep
TLMELLNQLDGFDELGKVKMIMATNRPDVLDPRVRGRVGALLRPGRLDRKIEIPLPNEQSRTEVLKIHAAGIAKHGEIDYEAVVKLAEGFNGADLRNVCTEAGMSAIRAERDYVVHEDFMKAVRKLNDAKKLESSAHYSADFGKD

SEQ ID NO: 112799 - protein, 129 aa, Triticum aestivum
  Clone ID: PAT_TA_7217.pep
RWSEKHQVASAAGHCRLPIHLHRHLHLRPPSVRHAYKPSPHLTTTTLHKTTPDPPPSLHSFPFIFDLPRDLAFLTARSDAPRRPADKARSFSLSLSLVPARIRFSGSRIFLQGFCGLLPMLAGLIRPAC

SEQ ID NO: 112800 - protein, 134 aa, Triticum aestivum
  unsure (1)..(134): unsure at all Xaa locations
  Clone ID: PAT_TA_7218.pep
DIVIFKSPPVLQDVGYTDNDVFIKRIVARAGDTVEVHKGKLVVNGEARDEXFILGPPSYDMNPVQVPENAVFVMGXITRNNSYDSHVWGPLPAKDILGRSISRYWPPGRIGSTTRDCFGPETKPDSLSDVKLTK

SEQ ID NO: 112801 - protein, 185 aa, Triticum aestivum
  Clone ID: PAT_TA_7219.pep
LPKKTCQGEIPKRAGVLRWHDRGVQQYWQEGTSRASERKWNRLAGRRQAQRGAPNGLLGDHNLIVHRQECYISQQKRFINHLVNQLAAHRSLAIACQLERRTKISSAYSLLKATEMELQSYVLAVNSRLVMDQYHLIGEAASSMIEEGSIDDRDTFLHAVRDILSSYSGCSNNATHIWFQACALG

SEQ ID NO: 112802 - protein, 141 aa, Triticum aestivum
  Clone ID: PAT_TA_7220.pep
GASTYNTFSSCPNPHQFDLDNVKFIGTSGQNIDDLYRYSDAKDRLEFMERTLKWRHLAPTAPNRVGGCPSTDGDPGQVETCPHVYFVGNQERYETRLLRGREKQQVRLISIPRFCESGIAVMLNLRNLECSTLRFSTSFDA

SEQ ID NO: 112803 - protein, 81 aa, Triticum aestivum
  Clone ID: PAT_TA_7221.pep
FYIVGLLRGICTDQAKAHVIFFATGWLCLIAPNLSYINFMLHPSYECYVVYRHKRQPLYPVEEVNLVGLHLQVLARDASDP

SEQ ID NO: 112804 - protein, 146 aa, Triticum aestivum
  Clone ID: PAT_TA_7222.pep
ELLQLIEEEDIPAPAPIEQRWTAHSRSPMSPASSSEEDDIFSWVGIIMYLPTSDPRQRKDITEEFFNYRSLTQTSLWDDYSAYEHWAKIEVPKDKDELAQLQARLRKRFPVDAYNKARMELDPNKVLSSAKLEKFFPGMQTVQHAR

SEQ ID NO: 112805 - protein, 150 aa, Triticum aestivum
  Clone ID: PAT_TA_7223.pep
PRGRQHVPDLGIANYHVGAHIDPSSRKLTMLYKVEPGSCDQSFGIHVAEFANFPEAVIALAKSKAEELEDFTSAPNLSGEPSDEVGSKRKRVFSPDDVTRGAARARLLLEDFSALPLDEVDGSKATEMVAKLKSDFENDAASNPWLQQFL

SEQ ID NO: 112806 - protein, 200 aa, Triticum aestivum
  unsure (1)..(200): unsure at all Xaa locations
  Clone ID: PAT_TA_7224.pep
TXXXEQYAXXEERHIGLHAMHRKILDGVEDVKMRAAKAGVKGVELRFLNSLGAEISFLRAENKSLHDQRKDTAEAVQAAGELLVRLKEGEEAXQSRAGMAEQGRAEATPELENLKETPDHEIVALNQRLTEYSKHNDATPLPAASSNLDSAPRYDSVGGSPGDDQQWRGELDAIHQQGSLEVTKSTDLNSWFSGYDRCNI

SEQ ID NO: 112807 - protein, 102 aa, Triticum aestivum
  Clone ID: PAT_TA_7225.pep
GKLGNKKKSASFGFVEELFEEGSASLEERFGRNSLSKANLPPFRCAICQVDQVPFEDLITDNGGGYCSAPSTPSSCPYLCSGCRKKKDAMEGKRSNRSTACT

SEQ ID NO: 112808 - protein, 145 aa, Triticum aestivum
  Clone ID: PAT_TA_7226.pep
VKDCSVMFALRVTCVRVHRGTQPTRRTLTILSTRPAQRGLIACWLPAGICDLAFCLSAAGCSRVSAWRTRPPPSLLSWPFFMATPSILLLLHPHPLPLPARSSSSCLVPSQCHQISSLLWASVPRHTGVCTKNPLERRIVSSSVY

SEQ ID NO: 112809 - protein, 276 aa, Triticum aestivum
  unsure (1)..(276): unsure at all Xaa locations
  Clone ID: PAT_TA_7227.pep
DDNFATIVAAVSEGRAIYNNTKQFIRYMISSNIGEVVCIFVAAVLGMPDTLVPVQLLWVNLVTDGLPATAIGFNKPDSNIMTVKPRKVNEAVVNGWLFFRYLIIGAYVGLATIAGFVWWFVYSEDGPRLPYSELVNFDSCSTRQTSYPCSIFEDRHPSTVSMTVLVVDEMFNALNNLSENQSLLAIHPWSNLWLVGSIVLTMLLHVSVVYIEPLSALFSVSPLTLAEWKVVLYLSFPVILLDEVLKFFSRRPRAWXVFPLRLWRREMLXPKEARDN

SEQ ID NO: 112810 - protein, 81 aa, Triticum aestivum
  Clone ID: PAT_TA_7228.pep
YKVVLRLRHLFWDGGVLNTRKWFTNVPLQHQKDNVFGSSDLTCPYEEIISLWQNHLPLEKSSLSVGLEHFVELRDMTEEPP

SEQ ID NO: 112811 - protein, 121 aa, Triticum aestivum
  Clone ID: PAT_TA_7229.pep
MAAPRGAAVVLAMVLAAMVVAPPATVHAAISCSTVYSTLMPCLQYVQQGGSPARGCCTGIQNLLAEANNSPDRRTICGCLKNVANGASGGPYITRAAALPSKCNVALPYKISPSVDCNSIH

SEQ ID NO: 112812 - protein, 120 aa, Triticum aestivum
  Clone ID: PAT_TA_7230.pep
MAAPRGAALVLAMVLAAMVVAPPATVHAISCSTVYSTLMPCLQYVQQGGSPARGCCTGIQNLLAEANNSPDRRTICGCLKNVANGASGGPYITRAAALPSKCNVALPYKISPSVDCNSIH

SEQ ID NO: 112813 - protein, 122 aa, Triticum aestivum
  unsure (1)..(122): unsure at all Xaa locations
  Clone ID: PAT_TA_7231.pep
MAAPSGAPRVRARVPAELLVPPPATVHAQIXAPRVFRTLMPXLQYRHQGGSPAPGCCTGRPWTCWPTPTSSPARRPVWGCRKNEANCAPGGPXISRAAARPSPCNVALPYKVSPSVACNAIH

SEQ ID NO: 112814 - protein, 159 aa, Triticum aestivum
  Clone ID: PAT_TA_7232.pep
MLVCILQGQVGAGSGSVPGGRIAAIYCLLFAYVGMAGVGFLQFCNLNSFRTKFILGFSLFMGISVPQYFNEYTSVAGFGPVHTHARWFNDMINVVFSSKAFVGGATALLLDSTLHRHDSTARKDRGHHFWDRFRSFKTDPRSEEFYSLPFNLNKFFPSF

SEQ ID NO: 112815 - protein, 98 aa, Triticum aestivum
  Clone ID: PAT_TA_7233.pep
ESWLTNVFHVLSMMWVFPSTWFEMKQATCVFNLTNVGSSMCVKEHSDLFLNLMIEYAGKRANSDIYVPLQGITRMEGKDDYDKTRMAGNVWENTCVTG

SEQ ID NO: 112816 - protein, 174 aa, Triticum aestivum
  Clone ID: PAT_TA_7234.pep
VKCCRPTSVVLRAHPEKQLPAFSIPPTALLYPVQPPDSKERWDIKEEEKHVKIWLQVPGLSEDDLEITAGEDMLEIKRKPRTGAGGREEPPVEVHGVGSFHVRLLMTKEYNSEDVTAELKAGMLEITIGKADNRGIKKPVGFGKKSTAQNTPAQDKPSSNNAAQGNGASPKNQK

SEQ ID NO: 112817 - protein, 173 aa, Triticum aestivum
  Clone ID: PAT_TA_7235.pep
FRTGRANRAAETCKRRGEGGVGIRGGGGLQYINLYNLRSSAGLDCLGGVGSMKKLRVLNLRMCRNLTDDSVVAIASGCPLIEEWSLAVCHGVRLPGWSAIGLNCNKLRILHVNRCRNICDQGLQALKDGCVRLEVLHIHGCGKITNNGLALFSIARPSVKQMVDEAMSIGPSI

SEQ ID NO: 112818 - protein, 69 aa, Triticum aestivum
  Clone ID: PAT_TA_7236.pep
MGCRHSKVEDEEAVRRSRDRRNLMKQLVRRRVDLAAAHITYLHALRNTGATLRQFAEVETASSHQSLPA

SEQ ID NO: 112819 - protein, 96 aa, Triticum aestivum
  Clone ID: PAT_TA_7237.pep
RPQSETGAAASGGAGEGDESRTTRSQGRSKGRRRSTTVAAAHERLYAAPNRAQAEEMRRRTFLPYRQGVLGCLGFSSRGYGALRGFSKTLSPVFSR

SEQ ID NO: 112820 - protein, 259 aa, Triticum aestivum
  unsure (1)..(259): unsure at all Xaa locations
  Clone ID: PAT_TA_7238.pep
MVSLLPRAPYLASLGKPTSRASTSSLRLPAMSSSAPAPAATAAAEPEASRPRKMPVLLFDVMDTVVRDPFYDHIPSFFQMSMKELLESKHPTSWSEFEMGLINEGQLAEKFFNDGRSFDLEGLKACMVRAYEYVDGVEDILCSLKQNNYEVHAFTNYPVWYQLIEEKLKLSKYLSWTFCSCHIGIRKPSPDFYLHAVDHLNIDPGNCIFIDDRMVNIEAALSVGMVGLHFXNAEALKNDLCSLGVELAPLVLEDETEVQ

SEQ ID NO: 112821 - protein, 183 aa, Triticum aestivum
  Clone ID: PAT_TA_7239.pep
GEMGLAFGKLFSRLFAKKEMRILMVGLDAAGKTTILYKLKLGEIVTTIPTIGFNVETVEYKNISFTVWDVGGQDKIRPLWKHYFQNTQGLIFVVDSNDRDRVVEARDELHRMLNEDELRDAVLLVFANKQDLPNAMNAAEITDKLGLHSLRQRHWYIQSTCATSGEGLYEGLDWLSSNIASKA

SEQ ID NO: 112822 - protein, 251 aa, Triticum aestivum
  Clone ID: PAT_TA_7240.pep
MPLRHDYYLPTIRVLLRLTIPPNFFAGVRKRGRARWGSRSGSSSAGSSPRRRCDSSWSVLSRCSEQGSGEMGLAFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDSVLLVFANKQDLPNAMNAAEITDKLGLHSLRQRHWYIQSTCATSGEGLYEGLDWLSSNIASKA

SEQ ID NO: 112823 - protein, 386 aa, Triticum aestivum
  unsure (1)..(386): unsure at all Xaa locations
  Clone ID: PAT_TA_7241.pep
DDHVDGFLRCEKWERRDMADSKETKTSSWFNRFIGRAKKPEMTWPYPFLEGKMFVLTIQAGVEGYHINVGGRHVASFPHRMGFTLEDATGLAVTGGIDVHSVYATSLPKAHPSFSLQNVLEMSDKWKARPVPXXPIQLFIGILSATNHFAERMAIRKTWMQFPAIQLGNVVARFFVALSHRKEINAALKKEAEYFGDVVILPFIDRYELVVLKTXAICQYGGQNVTAEYIMKCDDDTFVRLDVVLQQVSTFNRTLPLYLGNLNLLHRPLRSGKWAVTFEEWPELVYPPYANGPGYVISIGIARNIVSRHANQSLRLFKMEDVSMGMWVEDYNTTTITAPVQYIHSWKFCQYGCVDNYFTAHYQSPRQMLCLWDKLSLGRAQCCNYR

SEQ ID NO: 112824 - protein, 118 aa, Triticum aestivum
  Clone ID: PAT_TA_7242.pep
DDKPAVVVTHGDRLSLQQRSQVQNELAETLAIPPQQIFDIPGSDDYETDIAVLDMLRYCIQHAEQKFSMKLKNLVEMHGREPITEMMARLMGLDAVMDAPIVFLCAVALLLGESDNLL

SEQ ID NO: 112825 - protein, 136 aa, Triticum aestivum
  Clone ID: PAT_TA_7243.pep
SKQFTRRSGGVDLVHMKVRHGHPAEGSFAVGNNCGVIVGETSLTISWDESPRSSVFSFLFRFLVPSSGLGAQDWRRVTVHNPIPESGDGLRVEVNVAGHWGWRSLDGPRIVGRVTGHWGWSRFTCTQNCCRNIHWV

SEQ ID NO: 112826 - protein, 249 aa, Triticum aestivum
  Clone ID: PAT_TA_7244.pep
VAYGEMLNFEISIGFYELAGDFNRGWAEACNNLGVIYKDRDNLDKAVECYQMALSIKPNFSQSLNNLGVVYTVQGKMDAAASMIEKAILANPTYAEAYNNLGVLYRDAGSITLSVQAYERCLQIDPDSRNAGQNRLLAMNYIDEGSDDRLYDAHREWGKRFMKLYAQYTSWDNIRVADRPLVIGYVSPDFFTHSVSYFVEAPLTHHDYTNCKVVVYSGVVKADAKTLRFKDKVLKKGGVWRDIYGIDEK

SEQ ID NO: 112827 - protein, 117 aa, Triticum aestivum
  Clone ID: PAT_TA_7245.pep
ASGANRKSCTRTYKQWQTPKELQERSALQAAREIRKPRNEVSTLGNKGVETEQSRPIFSQESAVMEAEGDKTRVKNEVVVMGKTLKMLEESLGKLTDALRPMLKVMSASGVLIGTGA

SEQ ID NO: 112828 - protein, 161 aa, Triticum aestivum
  Clone ID: PAT_TA_7246.pep
PAHKIVVAGRSPVFKAQLFGPMSDRAKQRITVEDMQPAVFKALLHFIYTDSLPSMEELDGDEGKEMVKHLLVAADRYAMERMKVMCESILCKSLDVENVTATLALADQHHCSNLRDACLEFITSPDRMDDVMASQGYAHLKRSCPSIVIDVFERAKRSRKI

SEQ ID NO: 112829 - protein, 83 aa, Triticum aestivum
  Clone ID: PAT_TA_7247.pep
RLPEVKANTPLYFDFSDLQQDARCVIFRLLGDVTAFVDDIAEIDGLSLRNLPLASGLSLSNKIKLYYYADTYEMGKIGSLSAV

SEQ ID NO: 112830 - protein, 131 aa, Triticum aestivum
  Clone ID: PAT_TA_7248.pep
KNQTWNRPNRRLLVAPCLDHTTSVGTSAQLINDNNDEEEESDSVKTEQKSDHEDENRPGPHLTESSVDIASTSPPVPAQRQTWRRWAWFACLNSGSSNSAAPSTAGSKQCGGSGQGMGRQEAEDDSEAAQP

SEQ ID NO: 112831 - protein, 108 aa, Triticum aestivum
  Clone ID: PAT_TA_7249.pep
TRPLFDCVEGVLLKISDDFFGADPWVAFLKNNVRPAPLGMELVREVAKCIDCLVDDTGTPKALDEVVLKDLESGPWMDLRCDAEDAVIDVWDGMLDDLLEEMVFDLWF

SEQ ID NO: 112832 - protein, 205 aa, Triticum aestivum
  unsure (1)..(205): unsure at all Xaa locations
  Clone ID: PAT_TA_7250.pep
XKAXSLLQYIFSVAADARCEVREKEIEIKEMKEQMTEMKWGANDXLVGILRHSESRRRELEKQSKQKEQTAPMATTPPGSVNGSAKHTADDSNTPLSPVAVPAQKQLKYSAGIVNSPSKGVAASNKQLKMVPIAQLPVGKKASISGQSGKLWRWKRSHHQWLLQFKWKWQKPWKLSEMIRHSDETITRARPRPQLLITHKPRKVM

SEQ ID NO: 112833 - protein, 271 aa, Triticum aestivum
  Clone ID: PAT_TA_7251.pep
RSWGTAVHKSVNGLVGYEGLEVINPDGGTDDAEAEAMKGRWKQEDRDSYWKMMNKYIGSDVTSLVTLPVIIFEPMSMLQKMADSHVYCDLLDKADECEDPHMRMVYASTWALSAYLAYHRTWKPFNPILGETYEMVNHQGITFIAEQVSHHPPMGVAHCENDHFTYDITSKLKTKFLGNSVEVYPVGRTRVTLKKSGVVLELVPPLTKVNNLIFGRTWVDSFGEMVLTNLTTGDKAVLYFQPCGWFGAGRFEVDGYVYTAAEEPKIMMTGK

SEQ ID NO: 112834 - protein, 310 aa, Triticum aestivum
  unsure (1)..(310): unsure at all Xaa locations
  Clone ID: PAT_TA_7252.pep
WNIETRGITFISWAGQAIILPMGVAHCENDHFTYDITSKLKTKFLGNSVEVYPVGRTRVTLKKSGVVLGLATTXLTKVNNLIFGPNWGQNSFGRXMSWSNLVQLVDKDVLYFXPCGWFGAGRFEVDGYVISHMGKXKKMMTGKWKKPVSXSCCDQRGAPLLGPEQKGGPEKLVLEQRVISTSIPTFAQKINTIDRAEKKLLPSGAEFGPKMVQKRRAKFPNLGAENSRRKGKNRDEKKIRDTKAAQLTPXWFKMTEDLSPAPXCDLEVYEYNGSYDEHRDAXTASNVAAKEKDVSSIEFNPWQYGDLPSQ

SEQ ID NO: 112835 - protein, 249 aa, Triticum aestivum
  Clone ID: PAT_TA_7253.pep
MGNCAGVQGNAEINPTFSAPNTSGNNSKSSNSSNATDTSTFGKSSSSSVPPTPRTEKEILQSSNLRKFTFSELRSSTRNFRTDSLLGEGGFGSVFKGWIDERTFTPVKPGTGMIVAVKKLKLDSFQGHKEWLAEVNYLGQLSHPNLVKLIGYCLEDEQRLLVYEFMPKGSLEHHLFRRAPHFQPLSWNLRMKVALEAPRGLAFLHSDEAKVIYRDFKTSNVLLDSEYNAKLSDFGLAKDGPSGDKKSCF

SEQ ID NO: 112836 - protein, 206 aa, Triticum aestivum
  Clone ID: PAT_TA_7254.pep
YKEAPSYWGGTVPTVLIEKAEEYLPPDMSSLIKFVKDDDGDSVYTFPSWIHSDIMDDNILTQRAPEMGSLTDTKSTGDGDLEKLNEIHIIDFSDLSIGDPLCDLIPLHLDVFRGDIDLLREYLRSYQLPFLRGKSNNDIYKSVQNSKFSTASYRAMCYCILHDDNVLAAIFGLWKELRDATSWEEVEHLVWDDLNRYQQSSPTLSS

SEQ ID NO: 112837 - protein, 197 aa, Triticum aestivum
  Clone ID: PAT_TA_7255.pep
RASSAPAGGRTRGDRRRDNLCASMFRQLVVGIMIRKFSKRMVALKGLQMAVLWIIKILSRSKPPVVQLLGEFSFVDADSTRRGSVRDSIQNAGHVAVPESMCKRRRGGRVQKGCDRMRTKCRRAAAKEETGRAGQEKARKKETPRGRRRGVRSFTDSWAFKQSPQTGFFLLIDSDGAFCGGGTLMRHLVVGTVGCFA

SEQ ID NO: 112838 - protein, 150 aa, Triticum aestivum
  Clone ID: PAT_TA_7256.pep
RRTAVLCLLPCLRTIRLSIHRPCNAVATSAAPRDAVATATTRNPTDSQRSGDQDWKARFLRLQAFLRNNEQSGQEEYIRMLQSLSSVGRSKHAIELEKRAVNLLIEEGKELQKMKSLNVLGKLPPAEHPSLPTQPTFGMRLPFQPFPARR

SEQ ID NO: 112839 - protein, 112 aa, Triticum aestivum
  unsure (1)..(112): unsure at all Xaa locations
  Clone ID: PAT_TA_7257.pep
MEDSTSQGVEWEESSDLLDVASRCDVIYQTRIQKERFGERIDHYEAXARGKYIVDKKVLGVLPKHAVIMHPLPRLDEITVDVDSDPRAAYFRQAKNGLYIRMALLKLLLVGH

SEQ ID NO: 112840 - protein, 177 aa, Triticum aestivum
  unsure (1)..(177): unsure at all Xaa locations
  Clone ID: PAT_TA_7258.pep
RGQLGQDAAAGLLVHGDPQRRPRDIAALRLLQHLQVRRRARGRRVGCPLPHHLQLPALRHGQYHLHRALIFRNGGHGGSAGNKFRMSMGLPVAATVNCADKTGAKNLYIISVKGIKGRLNRLPXACVGDMVMAIVKKGKSDWRKKLMPVVIVRQHKRWRRKDGVFMYFEGEWSLCCW

SEQ ID NO: 112841 - protein, 122 aa, Triticum aestivum
  unsure (1)..(122): unsure at all Xaa locations
  Clone ID: PAT_TA_7259.pep
NGELCVKKKKKKKKKKKKKKKKKKNQKKKKKKKKKRGRPKGSKLTYPXRQRKTPSKGSPKFNSRAVVXKRLNGKNPGVTKLNPLEKNPPFANWRNTKKARTIRPSKNLPTLNGKWNPPCTGE

SEQ ID NO: 112842 - protein, 75 aa, Triticum aestivum
  Clone ID: PAT_TA_7260.pep
VLICCILIQLSLTVLVSLKSCFYFLCLCMWTNTTSSRRTDITIKYAIEVNGACVVGRTPLMTSSYVESMFRGIQE

SEQ ID NO: 112843 - protein, 177 aa, Triticum aestivum
  unsure (1)..(177): unsure at all Xaa locations
  Clone ID: PAT_TA_7261.pep
MSKRGRGGSAGNKFRMSLGLPVAATVNCADNTGAKNLYIISVKGIKGRLNRLPSACVGDMVMATVKKGKPDLRKKVMPAVIVRPAQAVGARKDGXYMYFQDNAGVIVNPKXGEMKGPAITGPIGXDCADXWPKIANATNALEWLDMFKFHMLLQLLCMLSWSSIWETDWDTRGLTML

SEQ ID NO: 112844 - protein, 140 aa, Triticum aestivum
  Clone ID: PAT_TA_7262.pep
MSKRGRGGSAGNKFRMSLGLPVAATVNCADNTGAKNLYIISVKGIKGRLNRLPSACVGDMVMATVKKGKPDLRKKVMPAVIVRQRKPWRRKDGVYMYFEDNAGVIVNPKGEMKGSAITGPIGKECADLWPRIASAANAIV

SEQ ID NO: 112845 - protein, 289 aa, Triticum aestivum
  Clone ID: PAT_TA_7263.pep
MRRCDLRQSHNSRVSGGMSSSLPILPNSLKETFHGPYNPQLTPMQRQLTSDLVPLHQSALPSATLHPRAGAMRSSYAASLGYSPNPLDSAPNHERQSMVAPFAPQPSDIEVFQTLSNNIPGGHTGATWFPGSADGLSDYRDNIPASGSQIQNGGPAVTSDVVAKQNEWWAEIMNDDWRDILDATAADPQSKSMVQPSNSAASQPAVNQPASSHGGEICNVASPPNSNSAAKQRMRWTPELHECFVDSVNKLGGSEKATPKGVLKLMKVDGLTIYHVKSHLQKYRTARYK

SEQ ID NO: 112846 - protein, 101 aa, Triticum aestivum
  Clone ID: PAT_TA_7264.pep
NSWIYERRTTAKAFAKDVFINQERKLGARRRSDTVLVSTINDADLARCSFDHTLRREVNGACVVGRTSLMTSSYVEEHVPWYPRVHRFTLVERFICRSQYL

SEQ ID NO: 112847 - protein, 140 aa, Triticum aestivum
  Clone ID: PAT_TA_7265.pep
MSKRGRGGSAGNKFRMSLGLPVAATVNCADNTGAKNLYIISVKGIKGRLNRLPSACVGDMVMATVKKGKPDLRKKVMPAVIVRQRKPWRRKDGVFMYFEDNAGVIVNPKGEMKGSAITGPIGKECADLWPRIASAANAIV

SEQ ID NO: 112848 - protein, 105 aa, Triticum aestivum
  Clone ID: PAT_TA_7266.pep
MSKRGRGGSAGNKFRMSLGLPVAATVNCADNTGAKNLYIISVKGIKGRLNRLPSACVGDMVMATVKKGKPDLRKKVMPAVIVRQRKPWRRPVAQDCQRRECHRLI

SEQ ID NO: 112849 - protein, 121 aa, Triticum aestivum
  unsure (1)..(121): unsure at all Xaa locations
  Clone ID: PAT_TA_7267.pep
MSKRGRGGSAGNKFRMSLGLPVAATVNCADNTGAKNLYIISVKGIKGRLNRLPSACVGDMVMATVKKGKPDLRKKVMPXAVIVRQRKPWRRKDGVFMYFEDNAGVIVNPKGEMKXIDHVTW

SEQ ID NO: 112850 - protein, 140 aa, Triticum aestivum; identical to SEQ ID NO: 112847
  Clone ID: PAT_TA_7268.pep

SEQ ID NO: 112851 - protein, 151 aa, Triticum aestivum
  unsure (1)..(151): unsure at all Xaa locations
  Clone ID: PAT_TA_7269.pep
MSKRGRGGSAGNKFRMSLGLPVAATVNCADNTGAKNLYIISVKGIKGRLNRLPSACVGDMVMATVKKGKPDLRKKVMPAVIVRQRKPWRRKXDGVFMYFEDNAGAHCEPKXGEMKGSAITGPIGKECADLWPRIASARQMPSSDLIAGAAR

SEQ ID NO: 112852 - protein, 140 aa, Triticum aestivum; identical to SEQ ID NO: 112847
  Clone ID: PAT_TA_7270.pep

SEQ ID NO: 112853 - protein, 140 aa, Triticum aestivum; identical to SEQ ID NO: 112847
  Clone ID: PAT_TA_7271.pep

SEQ ID NO: 112854 - protein, 140 aa, Triticum aestivum
  Clone ID: PAT_TA_7272.pep
MSKRGRGGSAGNKFRMSLGLPVAATVNCADNTGAKNLYIISVKGIKGRLNRLPSACVGDMVMATVKKGKPDLRKKVMPAVIIRQRKPWRRKDGVFMYFEDNAGVIVNPKGEMKGSAITGPVGKECADLWPRIASNANAIV

SEQ ID NO: 112855 - protein, 140 aa, Triticum aestivum; identical to SEQ ID NO: 112854
  Clone ID: PAT_TA_7273.pep

SEQ ID NO: 112856 - protein, 140 aa, Triticum aestivum; identical to SEQ ID NO: 112847
  Clone ID: PAT_TA_7274.pep

SEQ ID NO: 112857 - protein, 140 aa, Triticum aestivum; identical to SEQ ID NO: 112854
  Clone ID: PAT_TA_7275.pep

SEQ ID NO: 112858 - protein, 140 aa, Triticum aestivum; identical to SEQ ID NO: 112847
  Clone ID: PAT_TA_7276.pep

SEQ ID NO: 112859 - protein, 167 aa, Triticum aestivum
  Clone ID: PAT_TA_7277.pep
REQKLELPAVAAALELVDPPGCRNSARGSKRGRGGSAGNKFRMSLGLPVAATVNCADNTGAKNLYIISVKGIKGRLNRLPSACVGDMVMATVKKGKPDLRKKVMPAVIVRQRKPWRRKDGVFMYFEDNAGVIVNPKGEMKGSAITGPIGKECADLWPRIASAANAIV

SEQ ID NO: 112860 - protein, 208 aa, Triticum aestivum
  Clone ID: PAT_TA_7278.pep
MARGVAAAVSALGVVAVLLTAAAAKVCTNTFPSSDSVATHAERAAGQLRLPAGLAGRGHGHGHAHEQHLTPTDESAWMELMPRRLLGGGGGGTPPRVAFDWLMLYRKLRGGAAAVDGPAGPFLWEASLHDVRLQPGTVYWQAQQTNLEYLLLLDADRLVWSFRTQAGLTATGTPYGGWEGPNVKLRGHFVGHYLSATAKMWASTHNDT

SEQ ID NO: 112861 - protein, 114 aa, Triticum aestivum
  unsure (1)..(114): unsure at all Xaa locations
  Clone ID: PAT_TA_7279.pep
PWDCPLCYACYVHGEPKDAGRGGQGXAEERDPPYRXRYDVEVPDSYEHLLLGVVDGDSHLFMRSDELAAAWSVLAPILHEIDPEECCSLSSYEAGDKGPINAYYLAAKHGVRMG

SEQ ID NO: 112862 - protein, 137 aa, Triticum aestivum
  Clone ID: PAT_TA_7280.pep
DWGNELSNFSWPQAKAEQKSVEASEKIFRLGLAADVVLTVGKAITGYLSGSTAITGDAAHSLSDIVLSGVALLSYKAAKVPRDKDHPYGHGKFESLGALGISSMLLITAGGIAWHSFEVLQGVMSSAPDIIGSTSHM

SEQ ID NO: 112863 - protein, 193 aa, Triticum aestivum
  Clone ID: PAT_TA_7281.pep
MFLVDWFYGVLASLGLWQKEAKILFLGLDNAGKTTLLHMLKDERLVQHQPTQYPTSEELSIGQIKFKTFDLGGHQIARRVWKDYYAKVDAVVYLVDAADKERFAESKKELDGLLSDDSLANVPFLVLGNKIDIPIAASEEELRYYLGLSNFTTGKGNVNLSDSNVRPLEVFMCSIVRKMGYGEGFKWMSQYIK

SEQ ID NO: 112864 - protein, 194 aa, Triticum aestivum
  Clone ID: PAT_TA_7282.pep
MADRLVLLVLVVAAASLTVASPVAAARPCNTLFISSHSANANPSNDPDHRSPLTTTVVTVFRIRRFGPHFLRTQGHAHPHLNHHHRHHLHSIPANIQIRRPELPELPHSAAGVAASIQERVKDILVVLVGILFGLGCGALTAASMYLVWSVIAGPGASSHYDELYGDEASDSESPKKVGYVIIPGVEAYDGGKN

SEQ ID NO: 112865 - protein, 265 aa, Triticum aestivum
  Clone ID: PAT_TA_7283.pep
MVAATVASTSTAAAYSSLAPNPTARDPVRRRTTHPLVAATNRHVHGRTVTSLRQIHSRDHFANPPRPLFVASPAEAEAEEMAAEASTPAPAEASAKPFAVLFVCLGNICRSPAAEAVFRNLVSKRGLESKFQIDSAGTIGYHEGDKADSRMISTSKKRGIEVTSISRPIKPSDFRNFDLILAMDRQNYEDILSSFDRWQHKETLPDSGPKKVKLMCSYCKRHTESEVPDPYYGGAKGFEKVLDLLEDACESLLDSIVAEKENISA

SEQ ID NO: 112866 - protein, 111 aa, Triticum aestivum
  Clone ID: PAT_TA_7284.pep
TSMYRGGEFGYTKLVATREKLTLMYVGNHDGQVHDMVEIFSGQTSTEASATEAVNQTKLGSGTSAKLKISPLYLEIGGSVMLALLLGFALGFLLRKKREAAQWTPVKNEES

SEQ ID NO: 112867 - protein, 105 aa, Triticum aestivum
  Clone ID: PAT_TA_7285.pep
IFVTVMTKTWVNGRNLRFCREYGSRYIPPMRKGKPLMLQAEGRTTEWPARLGIDATRVNWIRRGWKEFVAGNDVREGDICLFERAKSTTRLRMTVHFLRKSDMEV

SEQ ID NO: 112868 - protein, 146 aa, Triticum aestivum
  Clone ID: PAT_TA_7286.pep
YLLNHCSEIIQDGEHLGCSSKVKYHDIELSSSHRSAIEPWSCGDSAVPATGVLFHAMAIQEECHGYRSSPHAILLDVDRVLAPAAAGAWYVQRGMALDWSIAVIDPLRGSHGVGWRRAQPRELQFTSSFLTCKPSKKENGLCYIYD

SEQ ID NO: 112869 - protein, 103 aa, Triticum aestivum; identical to SEQ ID NO: 107316
  Clone ID: PAT_TA_7287.pep

SEQ ID NO: 112870 - protein, 154 aa, Triticum aestivum
  Clone ID: PAT_TA_7288.pep
RSAGRLQHQSPPLLDRHFLAARTKASSSATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGRLGPVPWSSIFFAPPCRFPKAR

SEQ ID NO: 112871 - protein, 229 aa, Triticum aestivum
  Clone ID: PAT_TA_7289.pep
GTGPPLGVDGIDKLDIEFPGEIPSSGVSGGIMSLIDGSYEYYHYLHDGIDDNGWGCAYRSLQTIMSWYRLQQYSSINVPSHREIQQVLVEIGDKDPSFIGSREWIGAIELSFVLDKLLGASCKIINVRSGDELPEKCRELAIHFETQGTPVMIGGGVLAYTLLGVDYNEASGDCAFLILDPHYTGGDDLKKIVNGGWCAWKKSVDSKGRSFFLKDKFYNLLLPQRPNMV

SEQ ID NO: 112872 - protein, 83 aa, Triticum aestivum
  unsure (1)..(83): unsure at all Xaa locations
  Clone ID: PAT_TA_7290.pep
KDKDDAIXMLAKKVDTLTKAMEVEAKKMRREVAAMEKEVSAMRLEKEQENKAKRLGSLRGPGTVSQALPGRSAPRGGLSRNIQ

SEQ ID NO: 112873 - protein, 48 aa, Triticum aestivum
  Clone ID: PAT_TA_7291.pep
LETIIFSGLLHGGRPRTGVVRRSQAGGSCVFDRVAYMLAFLSHPCLTY

SEQ ID NO: 112874 - protein, 135 aa, Triticum aestivum
  Clone ID: PAT_TA_7292.pep
NPNTPLICVDCITDLVILLCHGRFVILVTWNHLTNRRRYGFISVCNILLCMRSLLVILVLCSLSNTGHCISNTGHSIICISTTIIFFWSQIIIVALRNSFIGIGHRITSILPLVSLLLPVPLLFAIHLLFCSLAL

SEQ ID NO: 112875 - protein, 148 aa, Triticum aestivum
  Clone ID: PAT_TA_7293.pep
STVRLSNRYSQTVLIDGLTGTVTRPCNGRFVILGTCNLLTNRRRYGFISVCNILLCMRSLLVILVLCSLSNTGHCISNTGHCIICISTTIIFFWSQIIIVAVRNSFIGIGHRITSILPLVSLLLPVPLLFAVHLLVCSLALKLLSVCT

SEQ ID NO: 112876 - protein, 136 aa, Triticum aestivum
  Clone ID: PAT_TA_7294.pep
PDHIHPAAHTSIQPYMSAESTYAYLSYIKSHTYPPVLAGTLRACIRLRRFTTTYIHMRREVPQCMHLQRRVPTTHEHMQPLHRSLYAHRHRLPQCKPQVITVAGRSKPLDPIVGVTGLAWPGEDPPTTKLLEPCPD

SEQ ID NO: 112877 - protein, 172 aa, Triticum aestivum
  unsure (1)..(172): unsure at all Xaa locations
  Clone ID: PAT_TA_7295.pep
EYAQSGQITEKADVYSFGVVLVELVTGRKAVDINRPKGQQFLTEWARHLLEDNAVDELIDPCLGDRYSENEVRCMLHAANLCIRRDPHSRPRMSHVLRLLEGDMVVDSVSVSAPSSDSASRSWRKANDQQHYQDXASPARQDSQRGVGRKQQSYDALRAAWDRDKKSISNRY

SEQ ID NO: 112878 - protein, 132 aa, Triticum aestivum
  Clone ID: PAT_TA_7296.pep
ALILDEIINYVQSLQNQVEFLSMRIASLSPVVYGFGMESGAAFSDQSQKIEGMFHDAAALPTGPPMNRSSSPAPSQAMMDTGTSSSSPPYSLQGTQDNGSSSSSYMMQTVGEPRHELFNQVMFSNYMCSFQQ

SEQ ID NO: 112879 - protein, 344 aa, Triticum aestivum
  Clone ID: PAT_TA_7297.pep
MKTHERAANLALAGLSLAPLVINVNPNLNVILTACLTVYVGCYRSVKSTPPAETMSKEHAMRFPLVGSAMLLSLFLLFKFLSKDLVNTVLTAYFFILGIAALCATLLPTVKRFLPEGWNDNAIVWRAPYFHSLSVEFTKSQVVASVPGFFFCVWYAMKKHWLANNVLGLAFCIQGIEMLSLGSFKTGGILLAGLFVYDIFWVFFTPVMVSVAKSFDAPIKLLFPTADAARPFSMLGLGDIVIPGIFVALALRFDVSRNIKNRYFNSAFLGYTAGMTVTIVVMNWFQAAQPALLYIVPGVTGFVAVHSLWNGEVKPLLEFTETQPEEEGAAEEEEEDSSQSKKVD

SEQ ID NO: 112880 - protein, 200 aa, Triticum aestivum
  Clone ID: PAT_TA_7298.pep
DAKIAHYMAKIDEARKSFEVSIQAAKQHYPVSASYVALDSNELRGQCWTMYLTQCRKEAKDLNAKASNIVEKYGPEVIQRHLFEFCSQETNRQALLKYAQTKVNKLKEAGGAREDTLHDYMTLLEIEKAYALLAAEEQIANGPDTCGGSEDADHGNRNNTIARGEAAEGARGDGHDGGEGASEGPPRQKRQRNDQDYVWW

SEQ ID NO: 112881 - protein, 322 aa, Triticum aestivum
  Clone ID: PAT_TA_7299.pep
MLLHPTSAISWEILRSEICRDRLEHEIVTASFFDKFLFGSSPYTSDDAVSHHFVHVNERQGVIISCLYCSLDVGKLYLFDYAVTPPFFLAKARGGWCTMALSDAAQLVVHRAKHLLNNGFGMYSLFKKNCEDFAIYCKTELLVETAYSVGRSGQLASLTAAFSAVASSPLRFLTTSASGLAIVTSGMYCVGRYVSDMGVRRDVIKVPVERLVEHWVNNVTPALPQGATQAETATPGGLPELPEEGELAKTATPGGSLELPGESELAKTATLGGSRELPGEGELAKMATPGGLPELPRESELAKTATPGGSLELPGKGGLAKK

SEQ ID NO: 112882 - protein, 174 aa, Triticum aestivum
  unsure (1)..(174): unsure at all Xaa locations
  Clone ID: PAT_TA_7300.pep
MISSSKLKSVDFYRKIPRDLTEASLSGAGLSIFAALAMVFLFGMELSSYLAVNTTTSVIVDRSSDGEFLRIDFNLSFPALSCEFASVDVSDVLGTNRLNITKTVRKFSIDRNLVPTGSEFHAGPIPTVNKHGDDVEEXMVMVSVALSSRNFDSYSHQYPVLXVANFYAPWWYWS

SEQ ID NO: 112883 - protein, 498 aa, Triticum aestivum
  unsure (1)..(498): unsure at all Xaa locations
  Clone ID: PAT_TA_7301.pep
MPARCHPKTSSSKLKSVEFXTERIPRDLTEASLSGAGLFIFAALAMVFLXGMELSSYLVVNTTTSVIVDRSSDSGALTRXDFDLSLLELSCEFASXDVSYGQGSARLKMTKTEHKFSLDCNLVPTGSEFHAGPIPTVTKHGDDVEXISWNCVSLVSLSLSSHNFDSYSHQYPVLVVNFYAPWCYWSNRLKPSWEKARERYDPEMDGRILLGKVDCTEEVELCVGLRMRRHPPGYPSIRIFHKGSDMGHHQRHPDHGARDAERVAAALVAAVATFPAEAPVLALVRPVQHDSCSSVDPAKRPAPMTGGWRIEGFVRVKKVPGSVVISARSGSHSFDPSQINVSHYVTTFSFGKRLSSKMFNELKRLFPYVGGHHDRLAGQSYIVKHGDVNANVTIEHYLQIVKTELVTLRYAKELKVLEEYEYTAHSSLVHSFYVPVVKFHFEPSPMQVLVTELPKSFSHFITNVCAIIGGVFTVAGILDSILHNTLRLVKKVELGKDI

SEQ ID NO: 112884 - protein, 172 aa, Triticum aestivum
  Clone ID: PAT_TA_7302.pep
YRTKEGKGTCLQQWLPPAAAPFALCILLLASPAVSATFLFDDGKSASKGKSKDKAAVDVEWRPATATWYGDAEGDGSTGGACGYGTLVDVVPMKARVGSVSPVLFKCGEGCGACYKVRCLDHGICSRRAVTVIVTDECPGGYCSLRRTHFDLSGAAFGRLAVAGHAGQLRNR

SEQ ID NO: 112885 - protein, 265 aa, Triticum aestivum
  unsure (1)..(265): unsure at all Xaa locations
  Clone ID: PAT_TA_7303.pep
GCRRVFEVAVELSRNMGCSFISPEHLAIALFTLDDPTTNNLLRSLGADPSQLASVAVTRLHEELAKDGRDLAGASSLKVPEKAPAGAGAGRSAFSKSLSKKKDKGALDQFCLDLTTQASGGFIDPIIGREEEIERVVQIICRRTKNNPILLGEAGVGKTAIAEGLALRIANGDVPIFLVAKRIMSLDXGLLIAGAKERGELESRITSLIREVREAGDVILFIDEVHNLVGSGTAGKGKGAGLDISNLLKPPLARGELQCIXATTL

SEQ ID NO: 112886 - protein, 139 aa, Triticum aestivum
  Clone ID: PAT_TA_7304.pep
WIPRAAGIRHEKSKKGKKGKDSVEDKHPHIDLSNDKRFDPMFTSHLFALDPTDPQYKRSADFKRKQAGKKGVHAVTLDSEPPVEESSPGSTLPPDDASTRNIKQKHAGASTEKLQMLSAVKSLKRNLTAFKKGSSTSER

SEQ ID NO: 112887 - protein, 508 aa, Triticum aestivum
  unsure (1)..(508): unsure at all Xaa locations
  Clone ID: PAT_TA_7305.pep
MKVYQLCHLTHRLLIGKEMIVFLIAAGFGFPILSPAEIAEQLFQYGXAPIANLRPEXIASPQPDLLPGVLARFFDSFVDAPGDGEDGLLGFSDLEVLDNPEHHAEAIRVLRLYNKSQAFLDSIQFKDFTLADFTRPTPRRVVEVLSALINFLFYREEKVTLLQPIVSETPDYHERTLELKARMAQLQKEIADHELAEQMEEPMAQQLEADVNALQQKVQVYNKQQLALRAKAAAINDKKEEIHRKITQADFELTKHAQENSKLRSKLVKSPEKVQRALEEKKSARAKLKESEKIATQNAQEKTGTLEIRNKAHEKLTKQHSKIQDVHEQLVAAKTVEKEVKARKAKLNDESVSVMSFDAQIVDWQGKVHEMEERLKGKVKERNQIIADENQKLGALSSEIEGKLQCLEPREKKVEATIAKASNLCSEAASARTAATAEQQKIRAKFNNIVKAFNTYMDSVDPFLERVEEVGRQSAGEGASAPDPSAAVTTKTTPRASAMSKKRARKRT

SEQ ID NO: 112888 - protein, 90 aa, Triticum aestivum
  Clone ID: PAT_TA_7306.pep
SFIHSGHVLKTRRVEQSGPECASALMPMQQSKGGTKGHHLLHEKIWPGSVLGSILMIMGLYILLWGKSRDASATVPPAKEEEDKEKQIKS

SEQ ID NO: 112889 - protein, 105 aa, Triticum aestivum
  unsure (1)..(105): unsure at all Xaa locations
  Clone ID: PAT_TA_7307.pep
YTVVNQNCRLFCLVNHRASSFPRVIPRVRIKPSVADWFQRPLTCCVLSVSLLILEPVLNDVDDEGNTEHXLEPRTTGIWTHNEEAKASRTSKCQSATHRALKADP

SEQ ID NO: 112890 - protein, 72 aa, Triticum aestivum
  Clone ID: PAT_TA_7308.pep
QQCTVLSPHLLLTMNGNAKGLSRPGFPTLSCLAWAMSAPCDESILLCVQSPGRQVTDRFSSVVVRSAPWIIS

SEQ ID NO: 112891 - protein, 134 aa, Triticum aestivum
  Clone ID: PAT_TA_7309.pep
GVRWMGELDPRAFANACSKNAAQQDAQVNYDTLCSKWQDEIANPNWRPYRVFTVDGKETRILSKDDTKLQKLKEEHGEEVYALVTNALLEINEYDPRSRVGVPELWNKKDGRRATLEETIQFVLEQKQSNKRKR

SEQ ID NO: 112892 - protein, 83 aa, Triticum aestivum
  Clone ID: PAT_TA_7310.pep
HGEVVTINNNTGRVMSSRLARGPSNGGHLATEAGTLARVVADCTITAAGYLGIGSLLNVTLLPSLVICAASIACTFLTYNSLF

SEQ ID NO: 112893 - protein, 146 aa, Triticum aestivum
  Clone ID: PAT_TA_7311.pep
QNLGCSLLSKLAGSDANKANIIQQDGFDKFLKLASRFSEDPSVIQEVMSIVQVLTLRSPEHAARAVALGYGTLAIHTMQKFPSSALTQKQACLMIRNLVVRNPENRTILLNEGVEKLIRKAKAIHGSCKAAATDALRDLGLDNYNA

SEQ ID NO: 112894 - protein, 146 aa, Triticum aestivum
  Clone ID: PAT_TA_7312.pep
SSKQLQLRSSIAECLMISENLEGGSRQLGMPTSSEQHRGGGGWPLAARENQALREGMDGMKQRVAELEKECSTMREEIARLGRSRSTGKSRLFSLGAKPQICSTAKDAAPAKAATSSDDDKLAVVKADATPRLKLSRHKKNLSIEA

SEQ ID NO: 112895 - protein, 195 aa, Triticum aestivum
  Clone ID: PAT_TA_7313.pep
WDYGYQTTAMANRTVIVDNNTWNNTHIARVGTAMSSPEKAAWEIFDSLDVKYVLVVFGGLVGYPSDDINKFLWMVRIGGGEFPHIKEPDYLRDGQYRVDAQATPTMLNCLMYKLCYYRFVETDGKGFDRVRGYEIGKKHFKLTHFEEVFTTHHWMVRIYKLKPQKNRIRGKLKKSKSSSKTSSTLAAGRKKNPWQ

SEQ ID NO: 112896 - protein, 183 aa, Triticum aestivum
  Clone ID: PAT_TA_7314.pep
RTREPSSPTVAAADTPSALDRALHHRPLCPRMRLPPSTPYSDSVRPPPMSMTPVRRGQPRLPPHAFGFAPFGTATTTGYRAWFVEVDTGLLPTMSPATLTTSTVSAPHYPSTTWCSDLSWRKRDAGVIFPYKEALLFCLMKTHKMLSRYLLSSPCCTFSLPSTESVLGSKSFLLLLIFILLLN

SEQ ID NO: 112897 - protein, 137 aa, Triticum aestivum
  Clone ID: PAT_TA_7315.pep
TFIIWIFSSLSRTLEKLQLRRSMAKLELYRKFTNSLAMSVVISIAWIGYELYFNATDPLSELWRRAWVIPAFWNVLSYVLLAIICTLWSPSRNPTGFAYSEETGDEADEEGLSLVGSAVKGTGDIVNMHVFTEDKRA

SEQ ID NO: 112898 - protein, 96 aa, Triticum aestivum
  Clone ID: PAT_TA_7316.pep
FQLLVNHQVLQLTPGYCQLTSQQQILRCTLLEDEKEPIPQPPSFEVQIFTQSKKLTRFHKRKTQPPSTALRNLTSRVLQDDSSKNNQNIKFRTNDN

SEQ ID NO: 112899 - protein, 117 aa, Triticum aestivum
  unsure (1)..(117): unsure at all Xaa locations
  Clone ID: PAT_TA_7317.pep
RRRRGPDPVLLPLPIHLPGRLSLQAPLDAALHLIDQDPGRRRHGLLLPGGRGRQLVHLPRNPXRHHLAVSVADYDRFATKLKTPGTDLFAKTQPDGRARQVFFLDRDAFVREWCSMM

SEQ ID NO: 112900 - protein, 91 aa, Triticum aestivum
  Clone ID: PAT_TA_7318.pep
PAAVSSSTRASTQESRRHHLAFSVPDSDRFATKLKNPGTDLFAKTQPDGRARQVFFLDRDEFILGGLLSSLDSLFLNFSFRGRTDNWMPRL

SEQ ID NO: 112901 - protein, 105 aa, Triticum aestivum
  unsure (1)..(105): unsure at all Xaa locations
  Clone ID: PAT_TA_7319.pep
DVVWGEWNKEGGAGHKPSTGLDWELNWIKTYSGPTDVENGGTXTAERVSQXXELEEFXPSPRSDVEDKYRRKLYLWAGRXAYEKDVXSCGYGXPXXXKVXSXFXG

SEQ ID NO: 112902 - protein, 249 aa, Triticum aestivum
  unsure (1)..(249): unsure at all Xaa locations
  Clone ID: PAT_TA_7320.pep
HFSSRIHTQILTQPPPQSQTPRHIDFSVGSSSKSGVXTSQAALLGGENGSVDGLCKEQVAPAMEGQQPRKRGRKPANGRVEALNHVEAERQRREKLNQRFYALRAVVPNISKMDKASLLGDAITHITXDLQKKLKEMESGKRHVLGSLGMVDRRVQTPRPXEVDIQVGQDEVLVRVMSPMDNYPINNVFQAFEEAEVKVGESKIASNNGKVMHSFVIKSPGSEQQTREKLIAAMSPCNELHVRYITLMH

SEQ ID NO: 112903 - protein, 97 aa, Triticum aestivum
  unsure (1)..(97): unsure at all Xaa locations
  Clone ID: PAT_TA_7321.pep
FXATAHNPLLSAGNQRPLGIQNQTLAALSVQTQYSGGVADFYNLASIRPGGLSVPGASASSRSKLYSEDPLAYVSRASDKKGSSYSYSLSNMSKYNP

SEQ ID NO: 112904 - protein, 123 aa, Triticum aestivum
  Clone ID: PAT_TA_7322.pep
IKQENKSVNGMKLPPRTVNGMDFYFDVSALGEKEQLSMFQRIENSMERAYLLPSAFSTAQDVNGNLGTNDLYISEQVVNNDQIDRIAADTTEFISAEPLENVSSPANKSKMRWVRGRLVEGEE

SEQ ID NO: 112905 - protein, 138 aa, Triticum aestivum
  unsure (1)..(138): unsure at all Xaa locations
  Clone ID: PAT_TA_7323.pep
MAEAIDLYRQSVIGVALIETLNEMVASGALSPELAMAVVMQFDKSMCHALDNXVESRATFKGGNLRTYRYCDSIWSLNLRNTTFMNEEKEAVLPQERKVGAGRRTDAEPVAPITGADRGSASTFSHTPLHDRPGATPN

SEQ ID NO: 112906 - protein, 233 aa, Triticum aestivum
  Clone ID: PAT_TA_7324.pep
MRRRRLHSVACTGHNPLCLYHFEEFFGTMGSKMLLVTALLVGIASQSYATRSLDGNHLADQKYGGGGYGGGGGGSGGGGGYGGGGSGGGGGYGGGGGGGGYGGGGGGYTPTPTPSTPSHSGSCDYWKGHPEKIIDCIGNLGSILGSLGEVCHAFFGSKIHTLQDALCNTRTDCYGDLLREGAAAYINAIAAKKEKFAYTAYQVKECVAVGLTSEFAAAAQAAMLKKANYACHY

SEQ ID NO: 112907 - protein, 156 aa, Triticum aestivum
  Clone ID: PAT_TA_7325.pep
GPVWRSSSHRLYPWRRCLGFRRGHCLVPAGKPRLGPGAGGGLNAGCRLDHVAKRKGCAGPPAAAERRCSLAAHRPVPGASTCAWGFSFVPKQPSPCSMWRRLRRRAAPLRQSWLEPVPSAPIQAGNQALALVPCQRHTERGEAINFYVYVIMYCTS

SEQ ID NO: 112908 - protein, 180 aa, Triticum aestivum
  Clone ID: PAT_TA_7326.pep
DQRGMSILAEGLPRKVADPFDYGGGNINPSRAAHPGLVYDINPRNYNKFFQCAIINQRTSTSVGCNATLLAYNLNLPSISVPDLRGPITIPRMVTNVGDVHSVYHAIVQSPDGVKMEVFPPVLVFDNANKVQKFDVKLSPMWNLQGDYTFGSLTWHNDLHTVRIPVAARITNQDFYADVA

SEQ ID NO: 112909 - protein, 80 aa, Triticum aestivum
  Clone ID: PAT_TA_7327.pep
LVSRLRSRSLTELTRQIAPPTKNGHAPPPIESRKSSQSVNPCYVWSWHVPPWPVLLRRRLHAWWCPSVNSFKFQPCPRAE

SEQ ID NO: 112910 - protein, 112 aa, Triticum aestivum
  Clone ID: PAT_TA_7328.pep
WSQPTITPARRSPLHTLRSYWSSRSPSRARSMLPQQQLLQRRQDRRGTTARASAATAKFTLLAARVPTRTRALPPPTHTYHHHHAWRTRSEDDEDDHTAQSEVSRVATRGSN

SEQ ID NO: 112911 - protein, 267 aa, Triticum aestivum
  unsure (1)..(267): unsure at all Xaa locations
  Clone ID: PAT_TA_7329.pep
MGSSTTTPCSHCFSYSRYTKKFHMPSLGLALVLLVSLVPPTSSCTEQEKSSLLQLLAGLSQDGGLTKSWRHDTDCCTWEGITCNEDRKVTDVSLASRGLEGPISPFLGNLTGLLRLNLSQNLLSGGLPLELMSSSSILVLDISFNRLTGGLSELPSSTPARPLQVLNISSNLLTGILPSTTWEVMKSLVVLNASSNRFTGQIPTTPCVGAPSFAVLELSFNQLSGNIPPGLSNCSALKLLXAGYNNLSGTLPDELFKVTSLEHLLFT

SEQ ID NO: 112912 - protein, 90 aa, Triticum aestivum
  Clone ID: PAT_TA_7330.pep
GGVPAGWVPSRSRHLLLCQQGSLGGRCTRCGFIGVVGHAASPTLKCARSREKQCRAVSALCSSLLIGATSRCRWALIQFALCLGLLRSME

SEQ ID NO: 112913 - protein, 387 aa, Triticum aestivum
  Clone ID: PAT_TA_7331.pep
MAAPLEFLEAQGSTRPELAEWYAALADLYQRKLWHQLTLKLDQFLALAVVQAGDALIQLYTHFISDFESKINLLKFAHFAVVVSRQYSDKDAGISYLEGVISKLRDTKESRVEEPILYVKMQIASFLLEKGNQKECKKLVDEGKTTLDSMDDVDPSVHSTYYWLCSQYHKVCQDYSEFYKNALLYLAYTTVESLSEPFKQNLAFDLSLAALLGDNIYNFGELLAHPIIHSLVGTSVEWIYHILQAFNSGNLASYQELCKVHAAALSAQPALVQKERELLEKINILCLMEIIFSRASQDRTIPLSTIAEQTRLSVEDVEYLLMKSLSAHLIEGIIDGVDGTVHVSWAQPRVLGIDQVKSLRDRLDTWVGKVHTTLLSVEAETPDLVAS

SEQ ID NO: 112914 - protein, 119 aa, Triticum aestivum
  Clone ID: PAT_TA_7332.pep
SAQFDMLDATIPRDNDDRLLIERDIFGPCALNVIACEGADRVDRPETYKQWQVRGHRAGLRQVPLSSAVVKLVKDKVKSLYHKDFLIDVDNRWLLQGWKGRVLYAMSTWVAGDHDNSKF

SEQ ID NO: 112915 - protein, 158 aa, Triticum aestivum
  Clone ID: PAT_TA_7333.pep
KAQFIKEASRICLERFGGDIPDTLTDLLALKGVGPKMAHLVMSIAWKNTQGICVDTHVHRISNRLGWVFREGTKQKTTTPEQTRMSLEKWLPKDEWEPINPLLVGFGQTICTPLRPKCGSCGINTICPSAFKEASSPNPKQKKRGRSNLVGGVPSEPS

SEQ ID NO: 112916 - protein, 85 aa, Triticum aestivum
  Clone ID: PAT_TA_7334.pep
RAFAPLRRCRRRPRPGRLALLPVSFAHSRPEVNALPLLRLERVPASLTRTTPRPAALAPPSTQPVTNLGPSPLGEATPLSAFFFS

SEQ ID NO: 112917 - protein, 80 aa, Triticum aestivum
  Clone ID: PAT_TA_7335.pep
NNKIHTPWTRTTTGTSTAMMKPAHGRARWNNSASVWCSRVGPLQCIRNSACCCPLSHHLNYYSSRSILYAVHFLATQHVC

SEQ ID NO: 112918 - protein, 197 aa, Triticum aestivum
  unsure (1)..(197): unsure at all Xaa locations
  Clone ID: PAT_TA_7336.pep
XPIMDALQSPSRWPLEFERKQQEIIDLWHACYASLVHRTYFFLLFKGDPADSIYMEVEIRRLSFLKXTYGNGGMEGKVVAGSPNTSLASSARKLQREREMLCRQMQKRLSIEERESMYTKWGVSLSSKRRRLQVARRLWTETKNLEHVRESASLVARLIGLLEPGKALREMFGLSFAPQQFSRRSHSSWRYGRSSLD

SEQ ID NO: 112919 - protein, 350 aa, Triticum aestivum
  unsure (1)..(350): unsure at all Xaa locations
  Clone ID: PAT_TA_7337.pep
MGRYEVVRDIGSGNFGAAKLVREVRTKESFAVKFIERGHKIDENIQKEIMNRRSLMHPXFKEDALTPTHLAIVRSXTAGPVELLRERSLCGLGRFNEDEVRFFFQQLISGVSXCHSLQIWHRDLKLEKTLMDGSEAPRPKMCDIGYSKSSVLHLLPSLEGXTVGTPAHIAPVLQXEYDGKVADVWSCGXVTVYVMVVRGLAFXEPDEPKNFRNXESLTQILSVTYELPHCELLGCSAYSCPNKHLLYQIPVVNPEQPVTIQEIKNHPWFLKSLPLEMTDEYQMSLHLAGVNAPPQTLEEVMAIIQEARIPGDGSKFAGQLSVAGLGSMELDDIDDVDADVEDSGDFVCAL

SEQ ID NO: 112920 - protein, 160 aa, Triticum aestivum
  unsure (1)..(160): unsure at all Xaa locations
  Clone ID: PAT_TA_7338.pep
LSARLLAAKVADCGEAIVYHICKLVLSDMSDPVQSFVSDTNNFMQSENMPPNETSTSGKEDRKLLSEVLETFDVRLGGLQSSLSRIENMPSFQDYAAALHQIEQWSMTHQFIKLNEYKRLHAGYGSGPKRPLXVGAIRKHAGGSSAPVSELKRIRCRSLK

SEQ ID NO: 112921 - protein, 168 aa, Triticum aestivum
  unsure (1)..(168): unsure at all Xaa locations
  Clone ID: PAT_TA_7339.pep
ERAHQWSQVYSEETKKQSIPVITAWQLNERMYGELQGLNKQETADLFGKEQXVHEWRRSYDIPPPNGESLEMCAERAVSYFKEQIIPQLVSGKHVMIAAHGNSLRSIIMHLDKLTSQEVISLELSTGIPMLYIFKEGKFIXRGSPAGPSEAGVYAYTKIWQYXQNLTH

SEQ ID NO: 112922 - protein, 181 aa, Triticum aestivum
  Clone ID: PAT_TA_7340.pep
SNPAQHKLDAEAFWSSGEELKFPEVSKPFASPTENSVQGEPSTKEIIEDAKKWMGEEVMVAFKKYIKWQDQFKDVEYSLDELQHQCFSVESYDHTFHHFNFTVKMKKPDGDWSSTPYFAQEGENYGRKYYTCYELSSYDDGHCYACINQGMHALKHPIGEFGYDGGHPDTGSPFLYLSDDE

SEQ ID NO: 112923 - protein, 302 aa, Triticum aestivum
  unsure (1)..(302): unsure at all Xaa locations
  Clone ID: PAT_TA_7341.pep
ETSPRIGLENSEGSPSPSGRAQPAVSPSNQTFGQRFMGNMMGNLLVRSLTSKPKGKMDDAALPSPAKTPEADGADKTEEEENPMMETVRSKCITQXLLLLGAIDSIQKRYWSKLQATQQIAIMDILLSLLEFASSXYTHHPNLRTRMHHIPPEKAPLNLLRQELAGTTIYLEILHKSTVHNGANGSSEETNGSGVESDQQEKLKSLAEGKLVSFCGNILKEASDLQPSNGETASADIHRVLDLRAPVIIKVLNGMCIMDAQIFKKHLREFYPLITKLICCDQMDVRGALGDLFSKQLTPLMP

SEQ ID NO: 112924 - protein, 82 aa, Triticum aestivum
  Clone ID: PAT_TA_7342.pep
NSYRRLLQYHQQGYTGIDFLHPLLLQHGTPSPTTNSFRKLAVFTANDYRGLPAQRTTLYLGRDPARTAHLSGRADLLKQYSS

SEQ ID NO: 112925 - protein, 210 aa, Triticum aestivum
  Clone ID: PAT_TA_7343.pep
RHTSMCMEQAGVSQNEMGIRQCLFWPDGTRKKRTKSYIFKKGHEHISRLVCAIVDQYNEDHNLLGDLAYKLKDMVRHKSFREKDEWYRHLNFTAKIKGADGLDWFEKLFFVELRNTKQEESYGEWVVSCFCMVDPTDNGHCGGCKSGVRHPNKADAYTCGHVGADELCGCPAEWSDSDEDDRSKERRIRRMYKGRKPFVLPASAVPKEIA

SEQ ID NO: 112926 - protein, 107 aa, Triticum aestivum
  Clone ID: PAT_TA_7344.pep
NHPKYIDEHFCPKQPSSRFYSKPIISQSKQSFDLHWIKTHKTNMVILDPTSLTPKTANCIVPLPLKSNQQPKHDQLASKQSTKVLLQIYHVPIKKNPVASTVAKLIK

SEQ ID NO: 112927 - protein, 85 aa, Triticum aestivum
  Clone ID: PAT_TA_7345.pep
IETKQGTPLRPAVPIDVYVFALFNENLKPGPASERNYGLFYPDGTPVYNVGLRGYLPPMDESDATRTAIHFLALIALAFVTLVLS

SEQ ID NO: 112928 - protein, 378 aa, Triticum aestivum
  Clone ID: PAT_TA_7346.pep
AWSRPSYLRHEKALIVKLVDIVDFNGSFLARVRDFAGANPIVLVITKVALLPRDTDLNCIGDWVVEAVVRKKLNVLSVHLTSSKSLVGITGVISEIQQEKKARDVYILGSANVGKSAFISAMLRTMAYKDPVAAAAQKYKPIQSAVPGTTLGPIQIEAFLGGGKLYDTPGVHLHHRQAAVIHADDLPSLAPQSRLKGRCFPANDTDVGLSGNTLFWGGLVRVDVVKALPRTRLTFYGPKKLSINMVPTTEADEFYKREVGVTLTPPTGQERAEGWCGLQGVRELQIKYEELDRPASDIAISGLGWIAVEPLGVPSSDPDSCVEEEGGGSGELHLRVHVPKPVEVFVRAPLPVGKAASQWYRYQELTEVEEELRPKWHY

SEQ ID NO: 112929 - protein, 89 aa, Triticum aestivum
  unsure (1)..(89): unsure at all Xaa locations
  Clone ID: PAT_TA_7347.pep
IHPQHPQVYTTKAAQQMLYLTTHMLASLSYPPLWVVLRARDNCLYTGVNMKVDVDQSPIPPVLAQLKEIVLPYALWKLQGHRFAHRXLT

SEQ ID NO: 112930 - protein, 137 aa, Triticum aestivum
  Clone ID: PAT_TA_7348.pep
FSSTSKEGRVRLFYDLTEFAALELEDCEYTVQDTVERLKELTGGKSPPKKSIKDGTYKRRICNEIDKLFPREIELYTSFLKQKMKTAEEHNVIPKGTCERFRSLSNFESREKELELSMCVTCYFSVKGFVYDTAEGT

SEQ ID NO: 112931 - protein, 207 aa, Triticum aestivum
  Clone ID: PAT_TA_7349.pep
MIEANLEVPDWLLDYANPDYTRSVELDSEDEENDKDRYDLARSLASRKIDNIYDLACVWAELNCRRTKQSFDDSRIKTMSKDCCIAFTQQEEYKFLKFYFVKVTQHCYSPESYEKTYWHYNFIAKIKSKSGIWTEGIYFAERKLECDVETFCCSFLEPSDDGECYGCQHGEAKVRHPTRGDYERGTPDHVWLSDGDCEISDDDMVDF

SEQ ID NO: 112932 - protein, 80 aa, Triticum aestivum
  Clone ID: PAT_TA_7350.pep
LSAAKLYKLSMTKVIWIISSIIVLVIVLVQHVLHTCISVSTPSLASSEHKQFVYQPAQKRFSVLDCITVNRSFATAGLQL

SEQ ID NO: 112933 - protein, 184 aa, Triticum aestivum
  Clone ID: PAT_TA_7351.pep
RCSRRGTNSKTAHTQLGEELKGVRAQLSGSVKENQRLCRGIYGVLTGRPTEEMPGSTGDQLPELVQLLERVWQAMSGVVQALWPSISLPEGLGGLAEKLQGVRQRLRLWKISACRQGAREAWAMVKTRYPKADPNHMAEVGPVGPDGKEIPMSLMYDQVELAAKYFQQDCKLDNLLDGIEKEYN

SEQ ID NO: 112934 - protein, 209 aa, Triticum aestivum
  Clone ID: PAT_TA_7352.pep
PPTPRKTEVPGQSSSSNGSAPKQTFKHIPKNGMLLFETAQFEGILKKITEFSATLASDSEQKHLSLSEADFSRLAAIVKVLKNTSFYHTSKLADADIVLLLKILKSWPSQMMFPVVDFLRVFVLHPDGATLLLKTIESGNDVPMETFRKAVAIPVHSPNVLTILKAVTNLFDNSCLHQWLKTHCAEIIDTFSGCKPALSKAAHLAYATL

SEQ ID NO: 112935 - protein, 245 aa, Triticum aestivum
  unsure (1)..(245): unsure at all Xaa locations
  Clone ID: PAT_TA_7353.pep
VGGSKVHAGCNGKLVWRHTPWLGSHAAKGPVRPLRRALQGLDPLTAASMFAGARCIGERKVNGEDCFILKLCTDPETLKARTEGLAEIIRHVMFGYFSQRTGLLVHIEDSHLTRIQSTTGGDAVYWETTINSFIEDYRPVDGIMIAHSGRSAVTLFRFGEVAMSHTKTRMEEAWSIEEVAFNVPGLSMDCFIPPTDIKSGSVSETVELPHGGEKSKFWSSXGHRAKVAALEKTDGGELAWRGAHT

SEQ ID NO: 112936 - protein, 220 aa, Triticum aestivum
  Clone ID: PAT_TA_7354.pep
MKATRQGPNTKMLSSTALRPLSPATATTPAYPATATSATPGRRSVAVRVLRDYGSIPKREPFSSSRSILDEFFKQEKPLVQRTKDHITDYCTTLEGDDCCSCWDAYFELNKLEQELPQEEISRMVKDSRSDPRYLISSIHHRSDLRKKMAEKAHNSAPSNSPGQTAKPRPFPVPDGLPKTQEEIDEDEEALMPESPYTRLLRRMGRFPDWYTPRPDHETD

SEQ ID NO: 112937 - protein, 118 aa, Triticum aestivum
  Clone ID: PAT_TA_7355.pep
ARGTVMSSSGKLHPFISWISSTIKNIIPQTTVHKIDLTKASFHLSKRSLKKNHLVHDPISSLVAGAGVIPCFHNTTLSAPLLHGCPSSVLMKTEQDCFLLVILKLVHSFSSKLKITCK

SEQ ID NO: 112938 - protein, 192 aa, Triticum aestivum
  unsure (1)..(192): unsure at all Xaa locations
  Clone ID: PAT_TA_7356.pep
KSLNGSSAGIESSSSLADEQKNPSVDLSLFNSGIKXIETGSSSCEDANSCDGSQRHLSDNEEIKPPSEPHDAFYEGLHEIVADNKDANSSSDPVDAEDEAXASLSIIPTDTTDVSARSDSRYDEALLLSEPIVAGQEESYPTEEEPSPEEMAFPKSLGWKQDEVVPPLKQEEIADCLRHNVRLQQKLEECRG

SEQ ID NO: 112939 - protein, 132 aa, Triticum aestivum
  unsure (1)..(132): unsure at all Xaa locations
  Clone ID: PAT_TA_7357.pep
KAIVLTREHKAIFPQERSRIQKAGGSVGPNGRLQGRNGVSRALGDRHFKEGGVXATPDAHPFELTVRAHFXSFFGCDGLWGVFGPSDAVEFVQKXLKETSSATLAVRRLVKEAVRERRCKDNCTAVLIVFKH

SEQ ID NO: 112940 - protein, 162 aa, Triticum aestivum
  unsure (1)..(162): unsure at all Xaa locations
  Clone ID: PAT_TA_7358.pep
RAEFGTRWATRNAVYSLQWPLNNGSYLAAEFVDPLEVKLKIEHPPPPPPPTTLSKDTTPNAVAFQQAEANQTMLPHGAGTAWGLSPTPQPHTKSYPTSNPRPEREVLPPPPKQPXTTIKTLDDLFRRTXGVLRMIYYFALIRRREVSSQSSAARRKGEIGDR

SEQ ID NO: 112941 - protein, 126 aa, Triticum aestivum
  Clone ID: PAT_TA_7359.pep
FLDYNNVFSVGGRPAARAGLWVAREGDDLGGQKAVRSKKTHRVCSLSPMERWTSPVHVLVRRRLQSIIKKTRACMHRSTRRRGKKHASKCKSRSLLAILLDLLLLPLLGCFVYKAYGVGVGRIYES

SEQ ID NO: 112942 - protein, 241 aa, Triticum aestivum
  unsure (1)..(241): unsure at all Xaa locations
  Clone ID: PAT_TA_7360.pep
MSSPAEYYNSLPPISKAYGTLCFFTTVLVQLQILDPGLLYLSYPYVFKSFQIWRLFTSFFFLGKFSINFGIRLLMIARYGVQLEKGSFEKRAADFLWXMIFGAISLLVLSAIPYIETYFLGIPMVSMLLYVWSREYPNSQISMYGLVQLRSFYLPWAMLGLDVIFGSPILPGLLGIMVGHLYYFFTVFVXPLASGKNYLKTPMWVHKIVARFRLGVQANSPVRPANTGPTAFRGRGYRLNQ

SEQ ID NO: 112943 - protein, 242 aa, Triticum aestivum
  unsure (1)..(242): unsure at all Xaa locations
  Clone ID: PAT_TA_7361.pep
AQFGPFLSDLHLTHLQSRLMYPGLRCHDHVSPAPIPSRITTDLTIGSSPARNGVSTTLPASAKRPNDAKPPGLVLFGQTILTEQQMSRGDLAGVSSAAATGNSXAQLETPDKAGNASQGSGSTVVQNSGSTDNTSXGETAGGLETIATSPSFGLKPGQCKVFVESDTVGRNLDCSAMSSFEELYGRLSETFCIEGAELRSRVLYRGADGEVKHAGDEPFSEFIKSARRLTVLTDAGSNNTAS

SEQ ID NO: 112944 - protein, 243 aa, Triticum aestivum
  unsure (1)..(243): unsure at all Xaa locations
  Clone ID: PAT_TA_7362.pep
APGPLPXXPTTQXIDWSLNQARSIRWNLTASGPRPNPQGSYHYGQVPTTRTIRLANSAATINGKQRYAVNSVSHVNADTPLKIADYYKIAGVFSVGTISDSPTYGGAYLRTSVMGADYRGYVEIVFENSENEVQSWHIDGYAFWVVGMNGGKWSPASRQIYNLRDGVSRYTVQVYPNAWTAIYMPLDNVGMWNVRSETWARQYLGQQFYLRVWTPSTSWRDEFPIPKNALLCGRAAGRRTRPF

SEQ ID NO: 112945 - protein, 286 aa, Triticum aestivum
  unsure (1)..(286): unsure at all Xaa locations
  Clone ID: PAT_TA_7363.pep
SGASALGRTPSSACTVGVRGDEPPRRRSAGFMLPRARCGCACRDSLVRDTRKLFRSEDETTGCKMINQYVHLGKIGAGSYGKVVKYRNIKDQSVCSPGQDRRWKLWQSXLYRNIEDGKLYAVKVLNKPHMMKVRVVRSETAMTDVIREVSLMKMLSHPNIVNLIEVIDDPNSDKFYMVLEYVEGKIVWDKGLGEATCRKYLRDIISGVMYLHSHNIIHSDIKPDNLLVTSTGNVKIGDFSVSQIFEDDDDMLRRSPGTSVFTAPECCQXSYHGRAXDTWQVVYSVL

SEQ ID NO: 112946 - protein, 103 aa, Triticum aestivum
  Clone ID: PAT_TA_7364.pep
KQPLLAQAEPTRNHQEGAQQLNENADAAATNPIQYEDQNLEQAGNAPAASGSLNPFGSLLLWLLGGGASDGIVSFFSMFRDVRDHHGGQDYAEPPQNENEQVT

SEQ ID NO: 112947 - protein, 78 aa, Triticum aestivum
  Clone ID: PAT_TA_7365.pep
EKTEIPGRLAGHAEITQALEHAGITEALTSNRTVVTVDAPGPGHVLLDHIHDHDRGLALLAYTETYLPHRAGVALVPN

SEQ ID NO: 112948 - protein, 169 aa, Triticum aestivum
  Clone ID: PAT_TA_7366.pep
EAHFHALLLYEAASGNRDYEDVVAECERGLRIEVPSDPAPHFLKLPAAEPDQLRDDLRNLIQKANLASISTWVKTLGGTDDKLGFFRLADEPLELQPLPAAHHPIGIKKATKTPEERRKEIEVQVAAMRLVEQHQLPHNPAVAASSPPLSEEDEAPCSSCQSGVKLRRS

SEQ ID NO: 112949 - protein, 196 aa, Triticum aestivum
  unsure (1)..(196): unsure at all Xaa locations
  Clone ID: PAT_TA_7367.pep
SGHQEPFQCWEDSRDHAWSDTPAAGKILGVPTGERPFVLHGQKSDKIKELRDLYLNNGLRATIPHCVSLLKNNEDEESFMRTFLLIALAAVLTPTTGNTIDLDYLWAFEDMSKVQDLDWAGHITEHLMDEVQKFQYKSREEKMRDFWVGGCLPLLTIAYMDHLDLPRGRIVDHEINYSVPXICHVSKDDFQFAAIC

SEQ ID NO: 112950 - protein, 83 aa, Triticum aestivum
  Clone ID: PAT_TA_7368.pep
SFGGFPYAAILLVLCILHVDVVRGQITHPTEVSALNAIKDRLIDPMNKLKKWNRGDPCTSNWTGVICHKIPNDAYLHVTELYD

SEQ ID NO: 112951 - protein, 103 aa, Triticum aestivum; identical to SEQ ID NO: 107316
  Clone ID: PAT_TA_7369.pep

SEQ ID NO: 112952 - protein, 154 aa, Triticum aestivum
  Clone ID: PAT_TA_7370.pep
MNPYFVGLLVPIAVSLLLQKRRKVEKKRGVPVDVGGEPGYAIRNHRFERPVETHWEGVNTLAELFEHACKEYLYMPLLGTRKLISREIESSPDGRSFEKLHLGEYEWKCYAEAFKSVCNFSSGLVNLGRQDNESVAIFAETQAEWQIALQACFR

SEQ ID NO: 112953 - protein, 160 aa, Triticum aestivum
  Clone ID: PAT_TA_7371.pep
LLSPSPNAALAADLPPTSGPRCRAPPPLHKLCRFTAANTLSRSGSTTSSLSLLLHHAAPSTARFGDLTVRSGDLAAESSDLTTRSVVRSLQLSATRGEYRRRREATPLLTSVTHLHQLHRKIPDALVGRQSGLVTKVKDQGNDAECARRQIRMKHVWAII

SEQ ID NO: 112954 - protein, 371 aa, Triticum aestivum
  Clone ID: PAT_TA_7372.pep
GASPARRLGRTRGIQTNFGDDYVFQIASCQEISTLAVSLSTNALKFYAPATGQYLGECTGHTGSIHEIAFSAPSSPQVICSCSADGTIRAWDTRSFKQISLLNAGPSHEMFTFSFGGTSGNLLAAGSSSKVLLWDWRSSKQVACLEESHMDDVTQVRFAPNQQSKLISAAIDGLICVFDTDGDINEDDHLLSVMNAETSVSKVGFYGNTYQKLWCLTHIETLSTWDWNDGTRELNIENARSLASDKWNLDHLDYFVDCHYSLPDDRLWAIGGTSEGTLGYFPVKNDPAGMIGLAEAVLEGGHTGVIRTICPGGSSLESLGQNKGIFGWTGGEDGRLCCWRSDDAVATKKSWISSTLVSRMDKKMKIRHQPY

SEQ ID NO: 112955 - protein, 100 aa, Triticum aestivum
  Clone ID: PAT_TA_7373.pep
GNLSVFAASYYHKVNSQTEAGAKATWDSKASNAVGLEVASKYRLDPVSFAKAKINDRGVAAVSYNVLLRPGVTLGLGASFDTQKLDQATHKVGASFTFES

SEQ ID NO: 112956 - protein, 331 aa, Triticum aestivum
  unsure (1)..(331): unsure at all Xaa locations
  Clone ID: PAT_TA_7374.pep
MGTASGAVALLLVVLGASVSSSSGQLQVGFYSKSCPSAESTVASVVRGTAAADSTILPALLRLQFHDCFVRGCDASXLIKGGNNNAEVDNNKHQGLRGMDVIENAKAQLESECPGVVSCADIVVLAARDAVAFTGGPSFDVPTGRRDGKVSNVRDGDVLPDVRDSAQVLRSKFRASGLDDKDLVLLXSSAHTVGTTACFFIQXRLYKFPLPGGGARVRPVDPGRPSCRSSSPRCAPGDSNSRVSLDRGSERVFDTSILRNIRNGFAVIASDAALYNDTSTVDVVDSYSGLLSTIFGPYFRQDFADSMVKMGSIGVLTGASGEVRKVCSKFN

SEQ ID NO: 112957 - protein, 75 aa, Triticum aestivum
  unsure (1)..(75): unsure at all Xaa locations
  Clone ID: PAT_TA_7375.pep
HSYNNNNDIRHKSRAVSNMAPRIYASQSSYKRNTTKCPGSSIFNYHTSQTELPKKPTTRCPFAHAEYPXADPSCR

SEQ ID NO: 112958 - protein, 172 aa, Triticum aestivum
  unsure (1)..(172): unsure at all Xaa locations
  Clone ID: PAT_TA_7376.pep
MLPYATASDAEAALRRAMTRAEAAWFGYTAAKADYYLYYHTVAVLLAVYTLLPLMLALLELGAPALAMRYKLQPRGKRLSPAGFLRCYTDTPRFLLPLAAPVQLLSYPAVKMLGIRMGLPLPSAGEMAAQLLMYLLVEDYLSYWVHRLMHTKWCYDNIXRQHEYTAPNGSSR

SEQ ID NO: 112959 - protein, 446 aa, Triticum aestivum
  unsure (1)..(446): unsure at all Xaa locations
  Clone ID: PAT_TA_7377.pep
MHCLACAAPAAAAAARAPGRRFGRRRVVVDCVASADRNVEGTPPRLREACELSEISSTTLLFASKRKILAFSAFCLCLHSSRYLSALALGDPTVKIEDVTPKIFPSGPLFPTEKRIAELFETNTYSVVNIFDATLRPQLNVTGVVEIPEGNGSGVVWDESGHIVTNYHVVGNALSKNPKLGEVVARVNILAAEGIQKNFEGILIGADRAKDLAVLKVDAPSDILKPIIVGQSSALKVGQQCLAIGNPFGFDHTLTVGVISGLNRDIFSQAGVTIGGGIQTDAAINPGNSXGGPLLDSKGHMIGINTAIFTQTGTSAGVGFAIQSSTILKIVPQLIQSGKVRRAGLNVEFAPDPIAYQLNVRDGALILKVPPGSAVEKAGLVPTGRGFAGNIILGDVIVAVDGKPIKGKSDLLRVLDDYGVGDTVTLTIRRGAETIPVALSLEDASV

SEQ ID NO: 112960 - protein, 123 aa, Triticum aestivum
  Clone ID: PAT_TA_7378.pep
MSSTQKKKSNYKEKMARRKEENKKEEPETPRYRDRAKERREDQNPDYEPTELGSFHAVAPPGADLRLEDAQKISIEKSKYLGGDLEHTHLVKGLDFALLNKVRSEIDKKPDAEDGKDAKARET

SEQ ID NO: 112961 - protein, 132 aa, Triticum aestivum
  unsure (1)..(132): unsure at all Xaa locations
  Clone ID: PAT_TA_7379.pep
QGGSGSVSAVTFENVRMDAVRNPIIIDQYYCLTKSCENATTAVFVSDITYXGIRGTYDVRGPPIHFGCSDAVPCTNITLSGVELLPASGDTVDSPFCWNVYGNTTTPIVPPVACLIEGVPRNVDEASSLKCY

SEQ ID NO: 112962 - protein, 154 aa, Triticum aestivum
  Clone ID: PAT_TA_7380.pep
PRPKPKQRGSEDDTNINGTEEDKPPELGLDRHQRNKEQHNPNRTLAWNYNQTKNSETRSARSEPITRWPYLRLTRREGGEQRSVPLTLATRRNHHGSYAPDDNKGRSSTTQTETPARKCRRPTNRGTRRGRAEPNTRWAATCHNLSKLVKKFLV

SEQ ID NO: 112963 - protein, 60 aa, Triticum aestivum
  Clone ID: PAT_TA_7381.pep
FVNSGPEDDFVSSSFGVITCLLLRFFCQNNMDHGGSFVPGKCASQISRNEVGVCLFARWD

SEQ ID NO: 112964 - protein, 304 aa, Triticum aestivum
  unsure (1)..(304): unsure at all Xaa locations
  Clone ID: PAT_TA_7382.pep
FIDGTVLSLEDRVAVALRRLNSGGSLVTVGTSVGVNHSTVSLITWRFVEAVEARAGHHLRWPDSDEMAMIKSKFEKIHGLPNCCGVVDTTHIIMCLSSAEPNCKVWLDHEKNYSMVLQAVIDPDMRFTDIVTGWPGSMKESSILHSSGLFRLCENGATVEWQQTDGYQXGSEVGEYVIGDAGYPLLPWLFTPYQENDLSELKVEFNKRHSAARTVALKALARFKDTWKFLQGEMWRPDKHKLPRIIHVCCLLHNIVIDMEEDAAMDDAHISDDHDANYRQQVCQLSDEKAVRMRDKLSEHLNSS

SEQ ID NO: 112965 - protein, 209 aa, Triticum aestivum
  Clone ID: PAT_TA_7383.pep
MDPCCAFAGMGGGSPDMFISSSRQSSCQLVPCDSVKVEEECAVHKGRKNRHGDDDLEPEDERRRKQLALSEEETVREMFDKVLLCNGVNCILQSPLPAEAEISSVYVKGSGNRRGRKKGKTGVPTVEEESVDLTTLLIHCAQAAAIDDHRGSGELLKQIRRHSSPHGDAGQRLAHYIANGLEARLAGTGSTVYRSLVARRTSSADMLKI

SEQ ID NO: 112966 - protein, 271 aa, Triticum aestivum
  unsure (1)..(271): unsure at all Xaa locations
  Clone ID: PAT_TA_7384.pep
KAGPDEYRTRKQRVHAAXLWVKEIDKMEEARLGGGGGGRGAADDIDRLLDSCSEIFDSGNADFGDSKIPSTGEIKTKPDGWETTSRGQDGNIWEISQREEDILLQEFERRIAFSKQQIASFIKTHIFSRRRPIDGWKYMIEEIGPPATGGIGTVPDGWETTSRGQDGNIWEISQREEDILLQEFERRIAFSKQQIASFIKTHIFSRRRPVDGWKYMIEEIGPNARKGKGSVQRLPSVTDPATQPFREESPAIASAGGSSSGPPPFRGNRHY

SEQ ID NO: 112967 - protein, 123 aa, Triticum aestivum
  Clone ID: PAT_TA_7385.pep
IRTRGMGSAVVVQAGGWWWRRRAQIRLWRRELRATWITVGLPYHGSWGGSGWMRVPLPVRALVAGRCCTALETPLVAIHGCGGGLCFLIRLNFGITFFSTSCECSIVSIVQAGLLSLLRRVWM

SEQ ID NO: 112968 - protein, 60 aa, Triticum aestivum
  Clone ID: PAT_TA_7386.pep
QDKRREDNKRGIAFFSCCLFLFLPAPPSPGTSSSVCVCVFVRPSFSFRYTPLCFIYAPGW

SEQ ID NO: 112969 - protein, 154 aa, Triticum aestivum
  unsure (1)..(154): unsure at all Xaa locations
  Clone ID: PAT_TA_7387.pep
MRALFAWCALLLACGGVMHCAEAAKARHLKWEVSHMFWSPDCEEKVLIGINGQFPGPTIRAKAGDTIVVELKNGLHTEGVVIHWHGVRQIGTPWADGTAAISQCAINPEETFTYRFVVHKXGTYFYHGXTTGMQRAAGLYGSLIVDVADGEEEP

SEQ ID NO: 112970 - protein, 325 aa, Triticum aestivum
  unsure (1)..(325): unsure at all Xaa locations
  Clone ID: PAT_TA_7388.pep
MDDSNMFIQWAMETLEQEQDAAAAAGDVFPSSLLELDNPAELQNGTHMAAHRHGATDSWSSGDSGAAVAVENDGWSSNCSTNYPAASWNFTSAIPQPPSIIEATPSPPAAPSHVVPELAHRSPPSRKSSGASTGAXPTVQEHVMAERKRREKINRRFIELSTVIPGLKKMDKPPRPSDALRCVKEQQEKLKALQDRDVRSIDSVVLVKRPCISNGDDGCPSPPPSAAAGGGPPTTRIPLPEIEARISESNVMVRIHCQDGKGVLVTLLAEVEGLHLSITHTNVVSFPASTLIINLMAKVDEGFTVTADDIVWKLDSALRRHHSGK

SEQ ID NO: 112971 - protein, 105 aa, Triticum aestivum
  unsure (1)..(105): unsure at all Xaa locations
  Clone ID: PAT_TA_7389.pep
EMVXSVEQLYAATRSPGVSVVYFMSSVNQQCIQITPAVDSLCSECPSMNFLKVNVEDSPTVAKAENVRIVPTFKIYKDGARVKEMICPTLHVLRYSVRHYAVSSS

SEQ ID NO: 112972 - protein, 150 aa, Triticum aestivum
  Clone ID: PAT_TA_7390.pep
ARAITKAFPHVKCSVLDLPHVIQGVSAQADNVEFVAGDMMEFIPPADRILLKYVLHNWSDEDCVKILTRCREAIAHGEKEGKVIIIDEVVGSSSQNILEAQLLMDMQMMSLFMAKERYEQDWNKIFTEAGFVNYKIRPILGVRSVIELYI

SEQ ID NO: 112973 - protein, 207 aa, Triticum aestivum
  Clone ID: PAT_TA_7391.pep
MPMIFPFPVAVAAALFAAAALAPRHASALTRHDFPEGFVFGAGTSAYQVEGAAAEDGRKPSIWDTFTHQGHSSDGSTADVSADQYHHYKEDVKLMHKMGLDAYRFSISWPRLIPAGRGQINPKGLEYYNNLIDELILHGIQPHVTIYHFDLPQVLQDEYGGLLSPRFIDDYTAYANVCFKSFGDRVKHWVTVNEPNIEPIGGYDNGS

SEQ ID NO: 112974 - protein, 229 aa, Triticum aestivum
  Clone ID: PAT_TA_7392.pep
SARGGRRHVLKGDLVKQWVAEGLIYTTEGQDIEKVAESYFYQLVGRSFIQPTCVNYYNEVLSCQVHDMVHDLIAHKSAEENFIVAIDYRCQKNVSLSHKARRLSLIFGDARYAKTPANIQKSLVRSVRFSGLLESMPCLTEFKLVRVLNLQLSGQGRSDNDIADLTGISEMFQLRYLKIASDVCIKLPDHVLQCLGTLDITDARFAPVPWDVNFPRLLHLHLSLPVERD

SEQ ID NO: 112975 - protein, 236 aa, Triticum aestivum
  Clone ID: PAT_TA_7393.pep
MAPPPRRLLLVLLGFLAAASLATLAAAVYEDQVGLADWHQKYIGKVKQAVYHTQKSGRRRVVVLTEENVIASLDLRSGDIFWRHVIEKNNPIDQLSLSAGKYVVTLSSGGSILRAWNLPDGQMIWETNIHTSTSSKSLLHVLSNSKVVKDNLVLVLAGQWIYAVSSIDGVISWGKEFTHDGLEIKQVVQSPDNDIVYVVGIAGSSKLAVYQLNAKTGEIVKDAQESLPDGLCGEIL

SEQ ID NO: 112976 - protein, 72 aa, Triticum aestivum
  Clone ID: PAT_TA_7394.pep
VTRRGSSTLRPCCESFRPDGYCGEEDENGTRQYTLCDDAGRYFYWDDVHPTQAAWAAVARTFRAAVKSFLSV

SEQ ID NO: 112977 - protein, 92 aa, Triticum aestivum
  unsure (1)..(92): unsure at all Xaa locations
  Clone ID: PAT_TA_7395.pep
GDVLQVLSNQDVXAAARAGLRAPAPRPPPTAASTNLHGDKWVEPLPEFAAHAGEPPRYRGFRYNEYMQLRMRNKTHPPSRPEDVVHITHYDI

SEQ ID NO: 112978 - protein, 86 aa, Triticum aestivum
  Clone ID: PAT_TA_7396.pep
MRITRKTSDPGVKKPRKRAQAYEDHGHMGGMNQALGVIRTCSDCNTTKTPLWRSGPCGPESLCNACGIRQRKARRAMMATGAAPVT

SEQ ID NO: 112979 - protein, 94 aa, Triticum aestivum
  Clone ID: PAT_TA_7397.pep
QLPVRTICSLCRRVAHVRRRSGAGGSRCSVCRRCSRPLPCGLPRLRGGAPFLGCGLSRAPLAGPCIHDNSTDRTAFVPATHPFKFLPYQLSMVG

SEQ ID NO: 112980 - protein, 102 aa, Triticum aestivum
  unsure (1)..(102): unsure at all Xaa locations
  Clone ID: PAT_TA_7398.pep
GRRKAAERVEGEQQQVEEGDKEQKVRQQVTLRRREQQXGEEAEQRRGEVRERAAAGRSVREQQRDLSSRKGGEEQQQGGARRRSIRGVERRTRASDRWQEVQ

SEQ ID NO: 112981 - protein, 402 aa, Triticum aestivum
  Clone ID: PAT_TA_7399.pep
GTRILSGAAVSSSFARADPKQIGFFLLADESLLQAASESRPPAEKRAEPDDPTGADEPDLSGCVLSSPYVKKLFTFHDMEGGHYNKSFPVTHPDEYSLYFANCAPESLVSMNVRTEMYNANPDGSKDYLPVGQAPVPAIYGFFAFGYAAFLAGWAYLTLSRDRVAANQIHHLMSALLVARLLYCLSAAEDQHYIRVTGTPHGWDVAFYLFQLIKGVILFAVIVLVGTGWSFLRPFLQDREKKVLMVVIPLQVMANIADAVIGETGPFMQSWVTWNQILLFVDVACCCAVLFPVVWSMRSLRETSKTDGKAARNLSKLTLFRQFYTVVIGYLYFTRIVVFALRTIASYQYRWVSILAEEVASMAFYMYMFYTFRPAERSKYFSLDDDDEEAAEMVLREEEFEL

SEQ ID NO: 112982 - protein, 97 aa, Triticum aestivum
  Clone ID: PAT_TA_7400.pep
TYSRLHALIEYEYYKASYFSNYRVFRERKGEKAAAKRCRRREAAAEAWARREQQQEKKQSKGRSSSKTEERSSSGKLRRRSISVGASNMSMTTSELA

SEQ ID NO: 112983 - protein, 216 aa, Triticum aestivum
  unsure (1)..(216): unsure at all Xaa locations
  Clone ID: PAT_TA_7401.pep
TRPSQSAPPPPPPPPAARPTGRPRPTALAPPRAPPLPRARPAPPPAPPAAPGPVPPRAPRRPPAPPPASPAAAPLPXVPPPPRSSTPHRPFPSAPPPPPPGPSPPPGRPWAPPPPRPRRAPPPPRAPPPPRPALPPRRPPPRPAVLHPPPPPPRPCAPRSSPLRPRCLAPPSCGGVGYRSIRLAVAAGGSGRSGLLSMAAAGVCWSGQFSGNNASV

SEQ ID NO: 112984 - protein, 264 aa, Triticum aestivum
  Clone ID: PAT_TA_7402.pep
ACRNFTAFTPAVNVLREIEAFLRRNPSEVITIFIEDYVEAPMGLTRVFNASGLTPYLFPVWRMPKNGGDWPLLSDMVRDNHRLLVFTSRSAKEAAEGFAHEWGYVVENQYGSKGMVKGSCPNRAESAAMNDLSRSLVLVNYFRDLPNFPEACKDNSAQLLGVLDTCHAASGDRWANFIAVDFYKRSDGGGAAEATDKANGGLVCGCGSIAACTSNGTCSPRRRGSTPKGISNKTSDAASWQPPAMLRWQQLMLPATFTALLLCL

SEQ ID NO: 112985 - protein, 50 aa, Triticum aestivum
  Clone ID: PAT_TA_7403.pep
TRAIAAINVAKRPENAGKLIAVIFPSFGERYISSILFRPIYNSVRRMRKR

SEQ ID NO: 112986 - protein, 199 aa, Triticum aestivum
  unsure (1)..(199): unsure at all Xaa locations
  Clone ID: PAT_TA_7404.pep
HEAQSHTHSLIPAPHRTSPAGRPAPXRPWQPPAAXPASPPAPPVAXTISSYSAAAAEAEQPVXTSCSASRPPCTTPPAPSPPGPAPRPTATGPTSPARTPPPRPPPPPSPSRSSSRASASPATSTPPRSAASKDCSDIVSWVRRRINLIDGASQILDPSIPRTEQQGMKAALELAVRCTSVKPDQRPDMYAVVRSLQAL

SEQ ID NO: 112987 - protein, 222 aa, Triticum aestivum
  Clone ID: PAT_TA_7405.pep
VPNQHQKTKRIKMMSTMALALGAAAVLAFAAATAQAQRCGEQGSNMECPNNLCCSQYGYCGMGGDYCGKGCQNGACWTSKRCGSQAGGATCPNNHCCSQYGHCGFGAEYCGAGCQGGPCRADIKCGSQAGGKLCPNNLCCSQWGFCGLGSEFCGGGCQSGACSTDKPCGKDAGGRVCTNNYCCSKWGSCGIGPGYCGAGCQSGGCDGVFAGAITANSTLLAE

SEQ ID NO: 112988 - protein, 262 aa, Triticum aestivum
  Clone ID: PAT_TA_7406.pep
MSGQNNYTTPESESSRFRDSLTSADARGKMGNMRVEEGINTGSTHLTSPVELTHQINSTTSDSCGNECTPEVINNHLDLYSCPEEFGNHACSVEDDVAANENLCSNVISDPTSFKEFSGDNECLHVDNDQLPKISNGSQHAHKVVPYGGYYNDPYRWTVDEIKAATGKEECTYVEHNLKVRSVYTDVEDFNGTKDANKEPLVTSYNSKFMGTVDYIWASEDLQTVSVLDTFPEVILKETNGFPTKKWGSDHIALVCELAFKD

SEQ ID NO: 112989 - protein, 113 aa, Triticum aestivum
  unsure (1)..(113): unsure at all Xaa locations
  Clone ID: PAT_TA_7407.pep
QHATRCYLPLQRRQRESKRYTFPVQKNIKRANMLAWAIRNKRSMFQLHCVSHLSLAMLGILHSHIFLQILEPLRIKLAWHVVQGRSCFCHRSLVVCLIIPPRVISSTINXFVR

SEQ ID NO: 112990 - protein, 433 aa, Triticum aestivum
  unsure (1)..(433): unsure at all Xaa locations
  Clone ID: PAT_TA_7408.pep
MWRGGATAASAARALRSRMLGDPIHQPSTAILPIPSARAACSAPSAASSAPIVAEAAAASVAVSSGARSASDVLRHYGSCYWELSKARLSALVVATSGAGYVLGSGSIVDIAGLCYTCTGTMMVAASANTLNQVFEIKNDAKMKRTMRRPLPSGRISPVHAAMWATTVGTAGTALLACKANDLAAGLAASNLILYAFVYTPLKQIHPVNTWVGAVVGAIPPLLGWAAAASELSLNSMILPAALYFWQLPHFMALAYLCRADYLAGGYRMLSFADPTGKRTAWVSLRNCLYMLPLGLFAYNWGLTSEWFSFEASLLTTGLAIGALSFVLAPSQKSARRMFHASLLYLPALMAGLILHRLPNEQKEHNNIHQTSEIAGVLXGAELWDEEERARQKQEDLKHSRRAQSRPPVAYASVAPFPFLPVPVYVSPEAHEF

SEQ ID NO: 112991 - protein, 137 aa, Triticum aestivum
  unsure (1)..(137): unsure at all Xaa locations
  Clone ID: PAT_TA_7409.pep
MTQNRAKWTARYEKGLVEVLTEYNLSHYRGQNGWTTEGWNQVVKELNNLYPEARFTKDQVQDKEAQLKKHYKNIKLIVNRSGISWNDIACVINTTPEKWEEIIAEXPKLKMYEGKSFIASIGCLYENNPQLQNACRS

SEQ ID NO: 112992 - protein, 352 aa, Triticum aestivum
  Clone ID: PAT_TA_7410.pep
CPPGLRRLSPCRQPAGSAPSAEAEAEALLPRPEPPLSAVDHFGRPASRGSSGGWPAALFIIGVEVAERFAFCGIMGNLMIYLTGPLGQSTAAAASAVNAWLAAAMLLPLLGSAVADSWLGRYRTVICASLLYILGLAMLTLSTVLAPGERPGCAGKPADSAGCSTSSSLAQVALFFFSLYLVAFAQGGHKPCVQAFGADQFDENDPGELASRSSFFNWWYFASYGGFAFTVSARVYVPESVGGQLRCASPRTAMALALAVFCLGTKTYRFHPLPSANKLPDDSENLLEPPRGDHGATGLLKLFPIWASCLIYAVVLSQWFTFFTKQARRRAQPDARRAHRPRRWRSSSSPTT

SEQ ID NO: 112993 - protein, 273 aa, Triticum aestivum
  unsure (1)..(273): unsure at all Xaa locations
  Clone ID: PAT_TA_7411.pep
AAHKVFAQXMQAQAQRNNNQGNANQHPSSSLASTAASGSAKLPDQLVRMPTPPNQGHKSQGSSSPQNFVPLSGTQMQSSMHYFAHDNSIQKPDVKGVHAVPNRPPGMSLPIPLQTSNKQLQPTEIQQASQQLYGTTNTPQSYPRPTSGSMPLRPQSQAPETRPPFHPHGRIPAKIGTVPTHPTMQQNASARPMQQNKDIKNNAYNPSANTKQGSEPAGKARQVGPGGPSAKSQGKQAAPKTSTPPAARTKKSGRRIMGTVVHTTRKRSGPQRR

SEQ ID NO: 112994 - protein, 203 aa, Triticum aestivum
  unsure (1)..(203): unsure at all Xaa locations
  Clone ID: PAT_TA_7412.pep
ARGGTSDPLWPPSNQIPKSLRRTPWLLFRCSFYRRRLSATNRACSTLALSWAEKLCPPRRPPTPPQATTAESASPCGSNSPPRSPTCTCKPTTRSSKIPWCWLPAATSSSSTWSSTTLPMICRASRTSSYTRPTPLARRSVVSPIPTPSPAGPNLVASSPVTTGXFVVASFRTIKTDLDLQTGLAMERVEFLHYSPATGHWDL

SEQ ID NO: 112995 - protein, 112 aa, Triticum aestivum
  Clone ID: PAT_TA_7413.pep
KSVAAGGVWVFRKDGVMELKSAGLEPSAAAPSKKALVYVPANETVRSLEALERRLGSLGWERYYENRDIVQLHRRDGGVDLIALPRDFARFRSTHMYDVVVKNRHHFKVVDI

SEQ ID NO: 112996 - protein, 186 aa, Triticum aestivum
  Clone ID: PAT_TA_7414.pep
MPPKRKSPVATAAAPAMPPRMTRSMAAGKRGADAPAKKEEAEAAPAAAGGKGRKKAKKEVSAVETVLSPPAAAKQKVKKNAKKEVVAAAVDDGGAGAESGKRVIVEACTQCQQFKRRALKVKEDLESAVPGVSVTINPEKPRRGCLEIREEGGDVFISLQNMPRPFKKMRELDMDKVIKDIAQKIA

SEQ ID NO: 112997 - protein, 123 aa, Triticum aestivum
  Clone ID: PAT_TA_7415.pep
PWLMTPYQERDLSPAKAARDKQHAAARMVVQGAMARLKERWQVLKGELWRPDKHRLPRIIYACCLLTNIMIDLGDTHRERAPASHDHDDGYYQQFSNVADDGAVAQRDVLCQFVSRLGSKLPE

SEQ ID NO: 112998 - protein, 212 aa, Triticum aestivum
  unsure (1)..(212): unsure at all Xaa locations
  Clone ID: PAT_TA_7416.pep
IKYPSVHPNNWPILHMFPSFVANLHNLQDYFTLVLAGSGHNFRAHGPPGTGMQFFVTCDPANIRHIFTTNYTNFPKGAGFAAIFDIMGGSIFTIDGGPARXQRAKIKGVLRRQRVLARMEACCRDKVENIPLPLFAHMASTDTPVNMQELMSEFMFDMAATPLFDVDPGLLSXDMPPMDAAVAMDTXMEVALFRVMMPASXXXLIRWLNMDP

SEQ ID NO: 112999 - protein, 157 aa, Triticum aestivum
  Clone ID: PAT_TA_7417.pep
GTRVSLTGISVGGEDVQSPGFSSGGGRAIVDSGTIITSLVPSVYAAVRAEFVRQLAEYPQAPPFSILDTCFDLTGLREVQVPSLKLAFDGGAEVEVDSKGVLYVVAGDASQVCLALAALRSEDDTPIIGNYQQKNLRVIFDTAGSQIGFAQETCDYI

SEQ ID NO: 113000 - protein, 256 aa, Triticum aestivum
  unsure (1)..(256): unsure at all Xaa locations
  Clone ID: PAT_TA_7418.pep
MTNIPVFLIGHVXKTGDIAGPRVLEHIVDVVLYMEGERCLSHRLLRSAKNRFGSTDELGVFEMSEHGLQAVLNPSEMFLTEHDSDSEILAGLAVAVVLDGSRTFAIEVQALSVPGSLGQGKVVGTKSKRVEMIISVLMKQAGLKLQDNVIYLNVVSGFELSETAGDLAIAASICSSFLEFPIPNDIAFIGEIGLGGELRTVPRMDKRVMAIAKLGYRKCVVPKTSEKLLKPLDLDIQILPCNNLKEFINTVFRPEV

SEQ ID NO: 113001 - protein, 224 aa, Triticum aestivum
  unsure (1)..(224): unsure at all Xaa locations
  Clone ID: PAT_TA_7419.pep
MEMNELWTSLCPTSEWVICGSALSDQDKEILDQFEYHSGVTTTNNWSSNVTHVLANTNEHGACGRTRKVLLAILAGKWVVNVNWLSACLEAKKPVPEEPYEICSDVHGAIDGPRIGRLRAMQKAPSLFSGLTFYFIGHPLTFKVELDELIAAAGGSILGKADLSSTSLIVYNKEVLNGCNEDAVDEVFSKREXEALDLATTFGCRVIPHTWVLDSIASCTLQPI

SEQ ID NO: 113002 - protein, 199 aa, Triticum aestivum
  unsure (1)..(199): unsure at all Xaa locations
  Clone ID: PAT_TA_7420.pep
EQEVILSEGDEQKPKEIDLLPASERQKRIAELQAKLFQAAAVGAVRVKRRKGPRLGEDFTCXQAMIKADFWLLFFSLLLGSGSGLTVIDNLGQMSQSLGFEDSHIFVSMISIWNFLGRISGGFFSEIIVKDYAYPRAIALATAQVFMAIGHFIFAMGWLGKMYIGTLLIGLGYCTHWAIVPAAASELFGVKNFGAVYNF

SEQ ID NO: 113003 - protein, 191 aa, Triticum aestivum
  Clone ID: PAT_TA_7421.pep
PRVRELREMVANGAKCSIDALLEKTVKHMLLLQSVTKHADKLKDSTESKILGSENGPVWKDYFEGGATWAFDVGSQSMTCPIIVEDLDRPRQMLVEMICEDRGIFLEIADFIKGLGLTILRGVMEARKSKIWARFTVEANRDVTRMEIFLSLVRLLEPNCDGSGAAENPNSVNMPLGLVRQPVIPATGGIQ

SEQ ID NO: 113004 - protein, 444 aa, Triticum aestivum
  unsure (1)..(444): unsure at all Xaa locations
  Clone ID: PAT_TA_7422.pep
LAELLVIAVVHLTYGFYLFTIAVCRDLSRLAGAPKDAVVGDGQAEAVLDGAVPPIVLVHGVLGFGKGRMXGMSYFAGAARGDDRVLVPDLGSLTSVHDRAPALAFALXPGRLVSAGAHGRSHRHPPCGRACRRGPCPGRGAAPPAHFVGHSAGAQVIRLLQQMLHDKAFDGYENSAAYWVVSVTSLSGVLNGSTTAYLGGIRPQDGRSIRFVCLAQIYRVGTTIYHWLDIPWLRRYYDFGFDHFGMSWRTVGVSGLPSLLAGTSGPFATGDWILPDLTIQNAARMNADVRTFPDTFYFXSYATRRTTKFCGITVPSGVMHIHPLVFIHVMQLCRWRHFAAEPPCKGYRDEDWEDNDGALNTISMTHPRIPVEHPSIFVEDDSDCHQLQPGIWYYKIVEADHMTFVMNRPKGSVQFDLIYDNIFRNCRKNVFRTAPLTLPNQNST

SEQ ID NO: 113005 - protein, 85 aa, Triticum aestivum
  unsure (1)..(85): unsure at all Xaa locations
  Clone ID: PAT_TA_7423.pep
MQHPVLTILHYVSSFDKPRNXFFSLIQVEIQMEKFEGYSEKHKSRQQYFVYPLLFQEYIYAFAHDYGLNGSEPVEIXVSCNNKKF

SEQ ID NO: 113006 - protein, 260 aa, Triticum aestivum
  Clone ID: PAT_TA_7424.pep
LIQPIANGATVLSLDTDFDGCMRLIREVTAELPIYLANSLNSLRLEGQKTAAIEILQQFNWQVPDWVIIPGGNLGNIYAFYKGFEMCRVLGLVDRVPRLVCAQAANANPLYRYYKSGWTDFQSLVAGTTFASAIQIGDPVSIDRAVVALKATDGIVEEATEEELMDATALADLTGMFACPHTGVALAALFKLRDQGIIGTNDRTVVVSTAHGLKFTQSKIDYHDKNIKDMLCQYANPPISVKPDFGSVMDVLQKKLNGKI

SEQ ID NO: 113007 - protein, 211 aa, Triticum aestivum
  Clone ID: PAT_TA_7425.pep
TAEEEAPLLVLTASPRCSPRISHAYDGMRMGSVERAAKRKAVAIGSDSSSEPSCRSASLSRRRKKKTKTTAVAGLLELPLLNTPSPLTRGKLKRIAQCCELNASAILEQANTQVVSVSLGDTSTSVVTLLALLHVSSAPSMVRPGASLLGRRVGSPAAMSLFCLFCIVLCSTPLYPLYLVLLVSLALSCYKVCSLLWFVSHESVCGYQISI

SEQ ID NO: 113008 - protein, 93 aa, Triticum aestivum
  unsure (1)..(93): unsure at all Xaa locations
  Clone ID: PAT_TA_7426.pep
AXNSARGGGELTHDETTIIAGALEMTQKTAKDAMTPISETFSLDINAKLDVHTVGMIMTKGHSRIPIYSGRPSNIIGLILVSKLRFSRINCID

SEQ ID NO: 113009 - protein, 311 aa, Triticum aestivum
  unsure (1)..(311): unsure at all Xaa locations
  Clone ID: PAT_TA_7427.pep
ANSARGLSDPSGEVEQISLXKPKAQSPHDEGFLEYLEDIIGTNQYVEKIEEANKQLEVLNEKRTASVQMLKLAEKERDSLENAKNEAEAYMLKELLLLKWQEKATTMASDDATSHVTQLEENVADLAKNLASEREKIKQNSQELKEMEKAYNKRVKRQEELENNMKVCKDQFKEFERKDVKHREDLKHLKQKIKKLEDKAEKDTSKIEGSAKEIEESANLIPQLEEEIPKLQERLNQEEKVLERIKESSREETEKLRAELAQVRTELEPWENQIIEHKGRLDVASGEKKLMKQKHDGARAELTGAQNQKET

SEQ ID NO: 113010 - protein, 134 aa, Triticum aestivum
  Clone ID: PAT_TA_7428.pep
MVEQEAPLSAGLNDNDLWRQKSPFQQLPLDTDSLFLSHDMSENAIHNDLGFGSPNKTARAHPFGPPDPCHSWSKEQLVPNGPQGASPIRSPPTGGHAGLFPTNPNAQSVWSFDKKRDSIEVMGEARLPPSSLGS

SEQ ID NO: 113011 - protein, 216 aa, Triticum aestivum
  unsure (1)..(216): unsure at all Xaa locations
  Clone ID: PAT_TA_7429.pep
LVPNARAAEFTSGSETDDDDSGRXSFLSIQKSSXALXKELXASXFTKKEQVEIEKFIDENAEGHXSGSDDEDSTSEQESEGGDAVSAEISSLKIVDQDPAGVPDLVVMDSXKHETLSKEHATSTSPSGEXNKSTDPADDGIEDPKGAESGGDDDNDSSEDTEDEGDALLTKQLNKQRKRAEAAGRGGRRPLNSRNAYKDKGKGTMNSKIQRQACQW

SEQ ID NO: 113012 - protein, 191 aa, Triticum aestivum
  Clone ID: PAT_TA_7430.pep
MDIWTRSRVLSSLFIFLDLFLSSLSRAPLVPSVIEAAAPSLNPGAHWLQQYLEPQHPRMAGPFMASHLGPQPLSVATGAIMEPIYPDGQITSPMLDALSDPQTPRRKRGASDGVTDKVVERRQKRMIKNRESAARSRARKQAYTNELENKVFRLEEETARLKKLKELDMMITSAPPPEPKYQLRRTSSAPV

SEQ ID NO: 113013 - protein, 107 aa, Triticum aestivum
  Clone ID: PAT_TA_7431.pep
TSYNMETECFANAEYQILVFYCSIHDPTHDYNAHVDVRQGIDICGFTISAPSRGLASASPSRQKMVVGQISVAPMCGCSAGYRQQRFPHLCIILRLYGGKRRHRGGV

SEQ ID NO: 113014 - protein, 242 aa, Triticum aestivum
  unsure (1)..(242): unsure at all Xaa locations
  Clone ID: PAT_TA_7432.pep
PRSRRKVGDNIRSHFNIPXVEIKQLPVGDALWIARHKELDTEYVLDFIVKRKNVDDLLGSTKDNRYKDQKLRLKKCGLTKLIYLVEGDVNTVDGSESVKTACFTTEVPEGFDVQRTTGYADTENKYDHLTGSIINYYSTNFSAGADTSXLCLTYDKFVKRCSDLEKVTLSDIFALQLMQVPQVTEEAALAVTSLYPTLLSLAKAYTMLDGVRRAQEEMLKNKSGMVNAGASKNIFKLIWAEG

SEQ ID NO: 113015 - protein, 167 aa, Triticum aestivum
  Clone ID: PAT_TA_7433.pep
RPTRPHPFKLRTEQRGKAKEQQFIQKVQEMLIEDEKKRIHIAQGLPWTTDEPECLIKPPVKERTEPVDLVLHSDVRAVERAEFDQYVSERIKFGEELRLERERQQKLEEEEMIRQLRKELVPKAQPMPYFDRPFIPKKSSKTITIPKEPNFHLRPERLSCDAWSLES

SEQ ID NO: 113016 - protein, 140 aa, Triticum aestivum
  Clone ID: PAT_TA_7434.pep
LLSIWDVPYKLRYIWYLHILEPMADTPITEIREAAGQTNTTIYQDVFSCVPNDLIHSRTQFRQSIAYWKEKIGHTTIDLGVAQEQLETYQDGDLKGADPMERLQLVRGHLVSFPLDFMCQEDLRPYFSESEYYTSPQVFH

SEQ ID NO: 113017 - protein, 365 aa, Triticum aestivum
  Clone ID: PAT_TA_7435.pep
MLPGSFVTKAQDDKLLEWANTIKSGFPLFVAAMDESNVSLNDCHVYIPLWLVGQFKEEVVKIVAPDKSTYVVGAKKHNDDQIVLQSGWDRFVTDQRIQQNDFLIFIIEGGTRLKVLVLDPSGSEKTFAMGNSSKVQEKPPLPPTVTNRSSEDNEVADLSSDDEVIDPSCDDDEVVGKDTTASRREQPLRSCRAKAETMASTSCPSTKSGRRKAGNSNEAGLKAPMPNKSYILSEGASLSKQQEEKVKEKVRAIGSDFPVFVRVMTVHGVWRPIQLRFCVEYGSACPLPLQQTPLLLGIEGSDMQWPSMLVVKKYKKGWWISSFWSDLVLEAGMEAGDICLVELADRSSERLRMTVHLIRKSEMQL

SEQ ID NO: 113018 - protein, 104 aa, Triticum aestivum
  unsure (1)..(104): unsure at all Xaa locations
  Clone ID: PAT_TA_7436.pep
SRPRRPSLFHICSSCYPGRQVDHDDHHLDGHHVGKRVEHWPPITSSSRRLKLTRVEQDVGGLVDHRQVGVVEKGKALGRDDSDLHPCHPQEGTICTSMRGSCGX

SEQ ID NO: 113019 - protein, 189 aa, Triticum aestivum
  Clone ID: PAT_TA_7437.pep
TEYLVSEHFLIQIVLFKGQMFAIDFPQTLKTISLAPQPNVQEVDVVWGEDIVVGLNYDPWLVVCGDMLLMVDLVDDLISNGTFQVFRFDSSAEPAKWTKMEKLENWALFISLDRRSPTFSCMNPERWGGKSNCIYVPSASKDSDEPWIAVELGQAVYSITRSDSYILEGKSNQLESLWVLPSLVYGVGQ

SEQ ID NO: 113020 - protein, 141 aa, Triticum aestivum
  Clone ID: PAT_TA_7438.pep
IVGQIFKGKENKFYASDFTRDELARLPWQLNMYVTNVRRDERFQNLKNLCQLSVMLVETNKHEQYHTSSLLKLVLILPVATASVERVFSSMSYVKNKVRNKMGDDYLNNCLVTFVEREFFNQVKDEDVINLFQKGDRRVIL

SEQ ID NO: 113021 - protein, 168 aa, Triticum aestivum
  unsure (1)..(168): unsure at all Xaa locations
  Clone ID: PAT_TA_7439.pep
EGGGAGTSATKAMSVSLSGKRGRYVRXVTGXHNDTDLHVAARAGDAAVLRRALDEAAVVVAVGEGGEQLEAVRRAVAAEDNEEEATLNLNAMNKLQTKKPWNLSFSFGRALQQSTLKEEEAAQAPGLIILKSQRLSLIKCMPCKETGCLNSALPLQLRMYMLNQVYAL

SEQ ID NO: 113022 - protein, 530 aa, Triticum aestivum
  Clone ID: PAT_TA_7440.pep
AGQRGRYVRQVTGRHNDTDLHVAARAGDAAALRRALDEAAVVVAVGEGGEQLEAVRRAVAAEANEAGETPLLAAAEKGHLEVVVELLRHLDSQGVAAKNRSGYDALHVAAREGHHAVVQEMLRHDRMFAKTFGPANTTPLISAATRGHAEVVKLLLEQDDFGLGEMAKDNGKNALHFAARQGHMEIVKALLEKDPQLARRNDKKGQTALHMAVKGTNCDVLRALVDADPAIVMLPDKNGNTALHVATRKKRAEIVIVLLRLPDTHVNALNRDHKTAFDIAEGLPHCEESSEIKDILSQHGALRSRELNQPRDELRKTVTEIKKDVHTQLEQTRKTNKNVHGIAKELRKLHREGINNATNSVTVVAVLFATVAFAAIFTVPGGNDNNGVAIVVQTASFRIFFIFNAIALFTSLAVVVVQITVVRGETKSERKVVEVINKLMWLASVCTTISFIASCYIVLGRHFQWAAILVSLIGGVTMTGVLGTMTYFVVKSKRMRKIRKKEKMSRRSGSSSWVDNTEISETELNQVYAL

SEQ ID NO: 113023 - protein, 92 aa, Triticum aestivum
  unsure (1)..(92): unsure at all Xaa locations
  Clone ID: PAT_TA_7441.pep
MNAQLLGDPIAPSAAPAPAPPPLPVPPPPPPPGAPPPXATSPPPPYPPYPPAPPPPGAPPPPPPPPDPPPPLPPPPAAPAPAPPPPLAXYAP

SEQ ID NO: 113024 - protein, 591 aa, Triticum aestivum
  unsure (1)..(591): unsure at all Xaa locations
  Clone ID: PAT_TA_7442.pep
TQPLVSSAGSPASVXNMLPIPNASSPSVGTSMADRSILEKFRNIEAISNRHQLHNKKNKVDNLSNNRKSMINASREKVVTLLSNCFHTEDYKDELRPLCNSMLNGTINSFRTRILNFVVTNRSYQGPTKPFRIIFKDKPDGTVGMQYGDPEDFDNRNSHECTLILPTKYHADLLATQLIARMEKEGYDKADDQVVPSNPPGNLSGLSGMLADNTANEVKQEGGITQQLNAAAHANMVSGSPLQQLSANRMLPSGSSNQAVPMQQEYMQGATMSPRSRTRGQNLIQQQQHQQPQLQQNAQSQLQQQTSLPLNQMQRPQLLPASPLSQMLGPGSNLPMGSNHTSNTKATPASLQLHMMQQVQQQQPVQMSRKVMMGPGSSVNMGNMVNNVVGLSGLGNIMGMGNVRSVSSPMGSMSGLGNSPNQMSLGMASNLAAAGLRPGMNPAAIAKMRMGLAQQQRVTSLYPQTGMVGLPGSGSPILPSSAGLAMMGHHSLNRNNLNPMQRAMMSPMGPPKMPVGNFQMNAQQQMQQLQQLQQQQQQLQQQQQLQQQQLQQQQLQQXQQKQQQQQHQQQQQQQQQQLQQQQQQQQQHQHQ

SEQ ID NO: 113025 - protein, 167 aa, Triticum aestivum
  Clone ID: PAT_TA_7443.pep
FVREVTIQYNLCNEPWLKYSISIVADKGLKKSLYTSARLKKGEVIYLETHFNRYELCFSGEKPRSIGSNSNASDLEPEKHQNNSHHHLQNGDRGATEHELRDVFRWSRCKKAMPEVAMRSIGIPLPAEQVEVLQDNLEWEDVQWSQTGVWVSGKEYPLARVHFLSAN

SEQ ID NO: 113026 - protein, 247 aa, Triticum aestivum
  Clone ID: PAT_TA_7444.pep
MASSRAILAMGLLAAVLSPALSKRSFISMPADVSSPVTLANGLSYGYHANSCPQLQDIVWPIVESAVLGEVAIAAGLLRIFFHDCFPQGCDASVLLTGPNSERDLPPNQTLQPRAMQLIEDVRVKVHAACGATVSCADIIALATRDAVFVAGESEMFYFYDLPLGRFDSLEPANSSAVFDLPQSTADADTLINAFKSRNLEPIDLVALSGAHTVGKAHCSSFNNRFSEDADFARRLAANCSSDPNRL

SEQ ID NO: 113027 - protein, 136 aa, Triticum aestivum
  Clone ID: PAT_TA_7445.pep
EEPLGPEDMWYCPCCKKHQQAMKKLDLWRLPEVLVIHLKRFSYTQFTRNKLETFVDFPISDLDLSSYIATENEQLYNHYRLYAISNHYGNMGGGHYTASIYQEGKGWHKFDDECVTPISEDNIKTAAAYVLFYRRE

SEQ ID NO: 113028 - protein, 112 aa, Triticum aestivum
  unsure (1)..(112): unsure at all Xaa locations
  Clone ID: PAT_TA_7446.pep
MLYSRQCINAGIPDMVALDFLEELVTKYTEPKFVKLSPLTIFPNYPYRMFPKGXFVRLQQLCGTKCTPELAHCQSVLVLNHGQGGGNSSYNNVIEGIHRXFLEKLVIQHEGR

SEQ ID NO: 113029 - protein, 234 aa, Triticum aestivum
  Clone ID: PAT_TA_7447.pep
DDHSQDPRRHRRRQSDGELVGMCSEFLGAGTETTASALQWIMANLVKRPDIQETVRKEINAIVGADAEEVSEVVLGKLEYLHAVIMEALRLHPPTSFAFRQVMEEDHVVHNGRRIPVGTKVYFPLAAIARDRTAWGNPDEFKPQRFLSCKDASQGTDGTIKMMPFGGGRRMCPGRGVATLHLSYFTANLVREFRWREGEGERAVDLRPHVEFFTVMKRPLRAHLELERTEIKTS

SEQ ID NO: 113030 - protein, 312 aa, Triticum aestivum
  unsure (1)..(312): unsure at all Xaa locations
  Clone ID: PAT_TA_7448.pep
GRSRRSQYPRVXAKEGLPWXSKGKTDKDGCYPPGHGDIFPSLMNSGKLDLLLSQGKEYVFIANSDNLGAIVDMKILNHLVHKQNEYCMEVTPKTLADVKGGTLISYEGRVQLLEIAQVPDAHVNEFKSIEKFKIFNTNNLWVSLKAIKRLVEADALKMEIIPNPKEVEGVKVLQLETAAGAAIRFFDHAIGMNVPRSRFLPVKATSDLQLVQSDLYTLVDGFVTRNAARTNPSNPSIELGPEFKKVGCFLGRFKSIPSIVELESLKVSGDVWFGSGIVLKGKVTITAKPGVKLEIPDGKVIENKDINGPEDL

SEQ ID NO: 113031 - protein, 103 aa, Triticum aestivum
  Clone ID: PAT_TA_7449.pep
VMGHECSGIIPPFIKEFSYSMPKNCAGGNTGVLVNGRELHQKDFDLLVKRGLQRFSEKSYTVDISGNVIDAATGDKLRSLGKLAPTIEKMKRGFGMHVPEEIS

SEQ ID NO: 113032 - protein, 408 aa, Triticum aestivum
  Clone ID: PAT_TA_7450.pep
MASSGKMEGPSAPALRRDPYEVLSVSRDSSDQEIKSAYRKLALKYHPDKNASNPEASELFKEVAYSYSILSDPEKRRQYDTAGFEALENEGMDMEIDLSNLGTVNTMFAALFSKLGVPIKTTVSPTVLEEAMNGTVTVSPLPVGTSAMGKVEKQSAHFFGVTISEEQAHSGIVVRATAGPQGRHTRRLFEQEINGGYGLALQEDSQKTGKVTSAGMYFLHFQVYRMDSTVNALAMAKDPEAAFFKRLEGLQPCEVSTLKPGTHIFAVYGDNFFKPASYTIEAMCAKSYEDTTERLKEIEAKILEKRNDLRQFETEYRKALAQFQEATARYTQEKEVVDDMLRERDDIHSSFTTERTITSSLGAGSSSSRYPVEQNKTESPENGNIDSRDKSSKKKWFNLNLNRSDKRA

SEQ ID NO: 113033 - protein, 209 aa, Triticum aestivum
  Clone ID: PAT_TA_7451.pep
MGVHAAPFPFPLPRREEDDAIVLGRGGDRWGAAAMPAEDEAVEQSPTAPPISSCGRYILHRVCRFDTLAGVAIKYGVEVADVKRVNGLTADLQMFAHKTLRIPLPGPPPARPTFPSLLLPGRRRRRKVPPSLPPFPLSSIRLYSFQPEDGWITPARLPLSTWQMEPHLIPPSHSPVSSEPTAGRLVLNPDQFQEKISSDLPPTIPLFSC

SEQ ID NO: 113034 - protein, 144 aa, Triticum aestivum
  unsure (1)..(144): unsure at all Xaa locations
  Clone ID: PAT_TA_7452.pep
MVHGTLEVLLVGAKGLENTDFLCNMDPXYALLKCRSQEPTRRIASGKGSNPEWNESFVFTVSDQATELVIKLMDSDSGTSDDFVGEATIPLEAVYTEGSIPPTVYNVVKGEHYCGEIKVGLTFTPEDTRQRGLPEDFGGWKQSH

SEQ ID NO: 113035 - protein, 252 aa, Triticum aestivum
  Clone ID: PAT_TA_7453.pep
DVAKEREYSSEVKMQLEAVEGIRKVLGSELESAHQETMKLQEKVLSLEVRLKEQSVLLVEFTAKAEDAMSARKAMGSQLEEPNLELAKLTNRVSLLQGKIEQEKLLSEEYEAKCRKLEAQLSRDSREAKLWRLANTNGDLKFKQEKEVASAAGKLAECQRTIANLGLQLKSLTNLDSVMTEPGKLESKDTLLDFREDGTEPLADESYGLHLPMSNGGCASPVPRAQSPSSRRSVFSGYRRSVATGAEQGSES

SEQ ID NO: 113036 - protein, 293 aa, Triticum aestivum
  unsure (1)..(293): unsure at all Xaa locations
  Clone ID: PAT_TA_7454.pep
GREEVVALSLEAHGPGDDRPEKPRRYGVTEMRSPCYAFRPAHHALQEILDNIGPFVDGLKFSGGSHSLMGKELIREITDLAHKHDMYVSTGDWAEHLLRQGPSSFKQYVEECKEXGFDTIELNAGSLKLPEEAILRLVRLIKNTGLRAKPLFSVKFDSSDIPAAGDRAFGALHSSSVGADSERFEDIDLLIRXAERCLEAGADMIMIDADDVCXSTQDSLRADLIAKIVGRLGLERTMFETSGANTSEWFVKRYGPRVNLFADHSEVMNLERLRGLDVRRSVRPLLPSPFFLM

SEQ ID NO: 113037 - protein, 274 aa, Triticum aestivum
  unsure (1)..(274): unsure at all Xaa locations
  Clone ID: PAT_TA_7455.pep
ENPTANLYFNDMCEIQVLLNTWRNSPSPVVAQVAGRMLKKFEGYWDLTRPVMAFASILDPRYKMKSIEYFXKLIYGNDQFXAKATIEAIKQTFTSLCNEYEHSADSXKNPAVLFYAXNSSSCMSSVYNNGXDSKTFSRITLSDARRGLDQYIQESSSGQSFKSDLDLYLEEAVYRQKEGNQDNFDILGWWKSFAAKYPVLSQMARDILAIPVSIIPLDSEARVLNEYLSTMDPSTVEGLVCAQDWLRADTEVANSDGHADDKVPRGDELIVAPN

SEQ ID NO: 113038 - protein, 189 aa, Triticum aestivum
  Clone ID: PAT_TA_7456.pep
LHSSCRDCIIHCDIKPENILLDGSFTPKVADFGMAKLLGRDFSQVVTTMRGTIGYLAPEWISGTAITSKVDVYSYGMVLLEIVSGSRKSSKQSSSQDGVHEGYFPVRVARSLVEGDVASLVDAKLLGEANLEEVERVCKVACWCIQDDEFDRPTMSEVVQFLECLSEVETPPVPRLLQAIAGQSNPKMM

SEQ ID NO: 113039 - protein, 263 aa, Triticum aestivum
  Clone ID: PAT_TA_7457.pep
MDYDRLNSPSTSAITLELMGHRLHISQDPNSKHLGTTVWDASMVFAKFLEKNSRKGRFCPSKLKGKRAIELGAGCGLAGLGMALLGCDVVTTDQVEVLPLLMRNVERNKSWIAQSNPDSGSFGSVTVAELDWGNKEHIRAVEPPFDYIIGTDVVYSEHLLQPLLETIIALSGPKTKVLLGYEIRSTTVHEQMMEMWKINFNVKTVSKSKMDAKYQHPSINLYMMDLKASSVPEAGPNGNGNTEEEEDDDASNPGEDEDPGVKT

SEQ ID NO: 113040 - protein, 304 aa, Triticum aestivum
  Clone ID: PAT_TA_7458.pep
DHDHAHEQSHAHSLKDLSVGLSILFGIVLFFIVEKIVRYVEDNSQRGGHSHGHHHHHHKRQDISDKAKSDHIKSDDEGKDTDQAQQNSLHDGATGKIIDAENEQESNATKEAVLGSQRSALDVVPGATDREPINSETDPAPGKALSSEDSSVSNSNLVFGYLNLFSDGVHNFTDGMALGSAFLLHGSVGGWSRTLFLLAHELPQEIGDFGILVRSGFTVSKALFFNFLSALVALGGTALALSLGTDPGHSSLIEGFTAGGFIYIAVAGVLPQMHDQKTTLSNSLCQLSFLTMGMLVALGISLVE

SEQ ID NO: 113041 - protein, 186 aa, Triticum aestivum
  unsure (1)..(186): unsure at all Xaa locations
  Clone ID: PAT_TA_7459.pep
MNRKPGHWDCRSCRPRSLGRGTAGRAWRHNFSPGDRGRRCGAPGGVHATVGGRGVGGSSFRTGFGPGSHVRSVHWYRLCGPHRFPRRPLLLQLRCLQGRQAALNGGAGAADGDVAPSKGWPLRGCRWHQCQASPGLXAFRPVWWSVGWRCIGSRRREDNCASRQECFRCNAPRDSGSATPYENFLH

SEQ ID NO: 113042 - protein, 147 aa, Triticum aestivum
  Clone ID: PAT_TA_7460.pep
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGKLLAGVTIAHGGVIPNINSVLLPKKSPAAAEKEAKSPKKKTTTKSPKKKTAATKE

SEQ ID NO: 113043 - protein, 235 aa, Triticum aestivum
  Clone ID: PAT_TA_7461.pep
MAEGVVRRNYTTWDDEMDGALLEVLVDHHNNGDHSQNGWKPHVYCAAIRNVKEKCNKNITKDNILGRLRTFDRYYEVITKILSQSGFGWDWVNHKLSMDSDDVWIKYVEANKKEKGLASYKTKVVKHWESISIIYSKDHANGEGAMTGAETTADPEAEPIEISPEVAPKRQRTGESIMCMIGEMRATFKDALKTTDPLPLPKATTPAAILAALYLIPDLAEPDMLRSYGKLFLNE

SEQ ID NO: 113044 - protein, 165 aa, Triticum aestivum
  Clone ID: PAT_TA_7462.pep
MFSPSKFDESSDHGPDTSKLDKDGVTSKLDKDGVTSITEPEVTTGKCLFPEEAFTFTVENDNKTNQVSSMNSQEKLDSLRVTFDIVCGISGSTKNSLITKQELFHNILANNLEIEETGEIEEQLHILEDLSPDWISKELRGGEILYSIKQIPDQKSVRERLTEVI

SEQ ID NO: 113045 - protein, 158 aa, Triticum aestivum
  Clone ID: PAT_TA_7463.pep
MQSDPHILTEGEIIAVGPPEMGRNGEPDTGAVASDKRRSVREAALSSQDQENIRPPGGTNEHDRQKNIVRGKVSLAHVINKAEACSQQGGWSRQKGMSITEKLEQENLRLEPRSSLLCWKASSTTRRKLSELKIRTRRSRALSRLVLCGRCISVKSPR

SEQ ID NO: 113046 - protein, 145 aa, Triticum aestivum
  Clone ID: PAT_TA_7464.pep
MSTVPLFFPAFLLVFSFSFTIINRLMQRSKKRRTQTRPSRRRSPPSPWRAPASSPRPRARTPPRRTQTAPSTPPGTGSWRSGSSPRLPARVQGTSTATRPVQSSSPASTAWRTGSALAASPARAPPPRRSRRTWWCRSPDDPSSP

SEQ ID NO: 113047 - protein, 183 aa, Triticum aestivum
  Clone ID: PAT_TA_7465.pep
AQSLLSLSVAEFVHRRLPDLGRLLKKSRSLVVSHLCNSQWHLHQAEERDKQETATDIKASRLQTTISILASFIAPGWLGPLPVSLPMISSFLHHVPMMFYPRRAPSLYKANHQNHHVMLQVTYLKQAKHQAGSLVLQIKFHHFVSCQLLELLSTMIHLVLGNSRSSSPPHQIHLFVSGQFIST

SEQ ID NO: 113048 - protein, 114 aa, Triticum aestivum
  Clone ID: PAT_TA_7466.pep
SADKEGLVNFLAFENSFSSDRVEKAVEKIKAASDKYSPAGRAKLLTPVANLSGSTEKESKCVLGASGQGLRSRTAIQVCSSSSSGFRYGSSSSKPLVLGRQSGVHVKPPTFSFI

SEQ ID NO: 113049 - protein, 469 aa, Triticum aestivum
  unsure (1)..(469): unsure at all Xaa locations
  Clone ID: PAT_TA_7467.pep
MGGAEDGAHAAGGHASNGHANGAVEEKVDELRRVMGKADGDPLRIVGVGAGAWGSVFCALLQDAYGHLRDKVQLRIWRRPGRAVDRATAEHLFNVINAREDVLRRLIRRCAYLKYVEGRLGDRTLYADEILRDGFCLNMIDTPLCPLKVVTNLQEAVWDADIVINGLPSTETRVVFGEIGRYWKERVNAPVIISLTKGIEASLDPVPRIITPTQMISKATKVPLDNILYLGGPNIASEIYNKEYANARICGTDKWRKPLAKFLRQPHFIVWDNSDLITHEVMGGLKNVYAIGAGMVAALTNESATSXSVYFALCTSEMIYITHLLEEEPEKLAGPLLXDTYVTLLKGRNAWYGHKLAKGELTLEMGDSIKGKGTIQGVSAVDAFYKLLSQDSLSVMHPEAKKSVAPVEMCPILKTLHKILIKRELPTESILQAIRDESMCDPRERIEMARGQSLYRPSILGQPNGDVKA

SEQ ID NO: 113050 - protein, 118 aa, Triticum aestivum
  unsure (1)..(118): unsure at all Xaa locations
  Clone ID: PAT_TA_7468.pep
XLLAFSDGFNSAFFSCLRSKGDVSNEAAAAVDKIEAALKFSDGPFFLDQFSLFVDIAYVPFIERFQIFYSGIKKDDLAKGRPNLHKFIEEVNKVDAYTQTKLDPQFLLDQMKEKFGIA

SEQ ID NO: 113051 - protein, 300 aa, Triticum aestivum
  Clone ID: PAT_TA_7469.pep
MTSLAFPCRASPLTPASISPPVPSPCIKIRRSRRAAPHRRLIAARSSSSPRTVAMAAAAAAAAPVISPKENLPPSLTSTSEPPPLFDGTTRLYVAYHCPYAQRAWIARNYKGLQDKIKIIGIDLADRPAWYKEKVYPQNKVPSLEHNNEVKGESLDLVKYIDSNFDGPALLPDDSAKKQFAEELLVYTDESNKALYSSITSKGDVAEETVAALDKIEAALGKFSDGPFFLGQFSLVDIAYVPFIERFQIFFSGIKNYDITKDRPNIQKFIEEVNKIDAYTQTKLDPQFLLEHTKKRLGIE

SEQ ID NO: 113052 - protein, 148 aa, Triticum aestivum
  unsure (1)..(148): unsure at all Xaa locations
  Clone ID: PAT_TA_7470.pep
TNSCYDGPSFRSEDSARNFCRTKRLQFSVRINGALLSCIRAWCKGTVYPEKKVPTMEXHNKEVXGEAFDLVKYVDWKIYHLALLPDGSENNHFADERIMYREECNIALYSYISXQGDVTDKTHAALDXKIEAALEKFRESPCFRDQLI

SEQ ID NO: 113053 - protein, 171 aa, Triticum aestivum
  unsure (1)..(171): unsure at all Xaa locations
  Clone ID: PAT_TA_7471.pep
GRAIRAGLVPLIMGLVTNPTGALMDEAMAILSILSSHQEGKAAIGAAEPVPALVEXLGSGSPRNRENAAAVMLHLCSGEQQLVHLARAHECGIMVPLRELALNGTERGKRKAVQLLERMSRFVVQQQEEQESNSRLQAAVAQVLPQAPEQVQERDIPDQLDSPASQYPTLL

SEQ ID NO: 113054 - protein, 60 aa, Triticum aestivum
  unsure (1)..(60): unsure at all Xaa locations
  Clone ID: PAT_TA_7472.pep
PXKXLQFLSGNSLAGQFYTDCNNIKLMWALTKPHTIFFFGRADHPDGRHQIIILSNRRGL

SEQ ID NO: 113055 - protein, 445 aa, Triticum aestivum
  unsure (1)..(445): unsure at all Xaa locations
  Clone ID: PAT_TA_7473.pep
MAASAVLAVLLASALAGAAAGGDIVHQDDQAPKIPGCNNDFVLVKVQSWVGGNEGDEFVGVGARFGPKIVSKEKQATREPLTLADPIHACAPPKNKLVSGGVLLVERGKCKFTKKAKLAEAAGASGILIINSVTELYKMVCEKNETELDIHIPAVLLPKDAGQALRSLLTANTSSVGVQLYSPDRPVVDTAXVFLWLMAVGTVLCASYWSAWSAREAVTEQEKLLKDGHEVSRLGRRFYGAAIVDINVISAMMFVVVASCFLIMLYKLMSAWFIDLLVVXFCIGGVEGLQTCLVAILSRWFTSAAGSFVKVPFFGAISYLTMAISPFCVXFLAVLWAIYRQFPYAWIAQDILGIALIVTVIQIVRVPNLKVGSAXLPGPLLLGIRRRVVASRLRHERRCAPVARGDNTDEDGVPXLLKIPRMFDPWGGYNTLGWXHLLLAXCSLR

SEQ ID NO: 113056 - protein, 113 aa, Triticum aestivum
  Clone ID: PAT_TA_7474.pep
VFRPCRPRRRLRPYWGQGGGPQVGAGAGRAGARRDSTERPQCVRRIGGRSQLDTADATRLLLSAYVCSVIASFEIHVASFVLKVETDDFLVGVLVRAWVCFQYSTTFFFMPRD

SEQ ID NO: 113057 - protein, 85 aa, Triticum aestivum
  Clone ID: PAT_TA_7475.pep
LQKHGEWILTHVVGSLVYLTTRQAFHNLEARKLPCLAAKDHKESVMLETYRSLMMQDTTRMSEDVRCEDVLALKCFREKLFGKTD

SEQ ID NO: 113058 - protein, 354 aa, Triticum aestivum
  unsure (1)..(354): unsure at all Xaa locations
  Clone ID: PAT_TA_7476.pep
MEVRCLLLLAVLLLAGAHGGEAQPLVPGVFTFGDSSVDIGNNDYLHTLIKADFPPYGRDFPNRVATGRFCNGKLATDITADTLGFTXYPPAYLSPQASGKEPSDRAPTSRLLESRPSYDHTGXLMSHAIPFSQQLEYFREYLSKLTAFAGSSQAKSIISGSLYIVSFGASDFVHNYYINPLLFKTQTVAQFSDRLVSIFVNSVTRLDARGARRIAVTTLPRLACLPAAIALGGHGSTGCVSRLSSDSQRFNGKMSAAVSSLAKRYHDLKIAVFDIYTPLYSLVTSPGDQGFTEAKRGCCGTGKVEFTVLLCNPKSVGTCPNATTYVFWDAVHPSEAANQVIADALLVTGIDLVT

SEQ ID NO: 113059 - protein, 89 aa, Triticum aestivum
  Clone ID: PAT_TA_7477.pep
QPCSNMVHVTPSCTVPQRRGPEAAICSAARQNQEPIAHVPIRQHPISSNRQHPASSSFFHAAPLHAKSCRHQFVLLRLVSSDHWTDSAP

SEQ ID NO: 113060 - protein, 133 aa, Triticum aestivum
  Clone ID: PAT_TA_7478.pep
PSIPQLLHLAGFRTGFGASPRSGQVVRCWPPFRLVLRLPVLLLCPSFRPLSRPAVAHPSSSRFLGAYKPASLPPLLPPVLASSFPSSPAWSFWINLINRLLRCLWFIIAPGCECPIRRTDLPLAMGVSLVPNS

SEQ ID NO: 113061 - protein, 94 aa, Triticum aestivum
  Clone ID: PAT_TA_7479.pep
TSRPLLLRCLRTSPVVPQVQRLKEAMTQIYQKLQDIKESAQPDVRHEISQLVKPMTQALDAAFYHDQQQKSSKAGTGSKPPGPRAAQTAPKDSA

SEQ ID NO: 113062 - protein, 160 aa, Triticum aestivum
  Clone ID: PAT_TA_7480.pep
NSCSGYLANVSSFWACLIRLAILKHLQGFRHSKACLKACAVELRELCLLPSRVSLSVMKSRRCILTVLKRLLACVSIAGANGLFSNRKEHIPRSSSSLISKSAILLDPRSGEGMCEGGGCVEAGATSGRRRGQADRVQGEVSLSPHFLPERNGGLEYFWR

SEQ ID NO: 113063 - protein, 134 aa, Triticum aestivum
  Clone ID: PAT_TA_7481.pep
VKDIMYHIYTTAKESLKIISPPEMKLLKYLLNIEDPEERFAALASAFPPGDEHEVKDEDALYTTPNELHKWIKMVLDSYHLNKEETDFMDARRMSDPVIIQRLILLKETVEEEYMKQYINPEDQESEDREEPEF

SEQ ID NO: 113064 - protein, 246 aa, Triticum aestivum
  Clone ID: PAT_TA_7482.pep
KARKRLGAIVAHIISVRRERERGSDLLGSFMDGREALTDDQIADNAIGVIFAARDTTASVLTWMVKFLGDNPAVLKAVTEEHAEIAREKALSGEPLSWADTRRMRMTGRVIQETMRVASILSFTFREAVEDVEYQGYLIPKGWKVLPLFRNIHHNPDHFPSPEKFDPSRFEVAPKPNTFMPFGNGTHSCPGNELAKLEMLVLCHHLATKYRWSTSKSESGVQFGPFALPINGLPMTFTRKDDKNKA

SEQ ID NO: 113065 - protein, 98 aa, Triticum aestivum
  Clone ID: PAT_TA_7483.pep
MSTNTNVNPAPKDAEEKKAAGSSSSSSEHLDEDDDFFQIEGPVLNTQFSLAGPNLDGCPDPKRIPSSVFARTSTLQTDWSVTSNEALFSINVGNTSFD

SEQ ID NO: 113066 - protein, 109 aa, Triticum aestivum
  Clone ID: PAT_TA_7484.pep
YTYINKCFILVHITQVRKFIHIVNLWKFTTCKTRARHIEVHMFGFRFREEEEGHHFHCFEIVSEPIRVWRPSAQLPSKNGPKSTRRHGAMVNQWRRGTITAYKLAEQAT

SEQ ID NO: 113067 - protein, 250 aa, Triticum aestivum
  unsure (1)..(250): unsure at all Xaa locations
  Clone ID: PAT_TA_7485.pep
EQDEDVTGLDARVGSTSDPGSSMKFVLVPPDDGAGIMGQQYYESGPEHDESFETLSNHSHSEKVGAASPYYGSPLKVILPEQKPDMKSTRCHVVKPMKSVQADYKLYDVELAVEGTYKGHRAPLVSLTSKWNRKPVMGFPVPVVVLDDSCPVESRDNHHLAKNSPTHLLKRSEVAEPRQPRSSHSSKSKLGGRKKVSEHDIDKSWRPHTKKSASSPRKMRRLSSFGSSRRESSNRNXVVRKIGGPTIACI

SEQ ID NO: 113068 - protein, 314 aa, Triticum aestivum
  unsure (1)..(314): unsure at all Xaa locations
  Clone ID: PAT_TA_7486.pep
GMQFSEPSTSRSYPKDQADEFSSHENIPSRTAEENKESPLKSQVLMQAAEIENLKQDKLRLTEEKDGLEIQSQKLAEESYYAKELAAAAAVELKNLAEEVTRLSYENAKLAADFTAAKELTASVTRGNDTKRRDQDNGILVEEMQKELVASCQREAALEDTLSQKARRENELLKIIDDAKCHEHDLENELENMWALVSKIKKESSQDDLFEFKSKQNGFHSSKTDTGRILSDMEASXDXWKWDGISTLEEAKAAYNFERRRFKEFXNXMSRLKGEDSXAWRLNPLGASKFXVEXLSRIXKKXXXKSIASSVKLI

SEQ ID NO: 113069 - protein, 207 aa, Triticum aestivum
  unsure (1)..(207): unsure at all Xaa locations
  Clone ID: PAT_TA_7487.pep
MGSNEADKPLRRIGASFEQLAAVAKQQQQQPAMAAGDFSRACSNVSVLFGCLGIAFKFAEMDYVAKVNDLLEASKTISTLPSMVELDIQKGTVRQAGSHTRNLLRVKRGIDMVKVLFEQILVTEGNSLKDAASKAYAQVFAPHHGWAIRKAVGAGMYALPFKSQLLKKLXEDENSARAQMQSFVRSFGPVIFYVEDLFTSKNLGLDW

SEQ ID NO: 113070 - protein, 275 aa, Triticum aestivum
  Clone ID: PAT_TA_7488.pep
MVASALAVLAAASQPLRNREILDAVGTTAAALSTTDHISPDADAAQPKLSNSKRPPSPPAASRGGGRPMGSNEADKPLRRIGASFEQLAAVAKQQQQQPAMAAGDFSRACSNVSVLFGCLGIAFKFAEMDYVAKVNDLLEASKTISTLPSMVELDIQKGTVRQAGSHTRNLLRVKRGIDMVKVLFEQILVTEGNSLKDAASKAYAQVFAPHHGWAIRKAVGAGMYALPSKSQLLKKLNEDENSARAQMQSFVRSSGPVILYVEDLFTSKNLGLDW

SEQ ID NO: 113071 - protein, 137 aa, Triticum aestivum
  unsure (1)..(137): unsure at all Xaa locations
  Clone ID: PAT_TA_7489.pep
FSGAVLAFEKQXPFLLECLKEWYSTYDDTLIQWNGAELMTRVIRNQPGREPTGEPHGSPWERALTLHPINSTDISRYFSEPDSTAERAQHDALFSRILTXSTTFHFWNSITSSLVPESNSLVERILNHYCLHCLDVL

SEQ ID NO: 113072 - protein, 192 aa, Triticum aestivum
  unsure (1)..(192): unsure at all Xaa locations
  Clone ID: PAT_TA_7490.pep
FGTRGVLGEIAPVVTIGGISKRWMVPGWRLGWIAATDPKGVLRDKNVLQSIMSYCAISVDAVTFXVQGALPQILANTGKAFFEKAMDVMRSAAEICYRKVEGIECITCPHKPEGSMFVMVKLDLSCLDGIADDVDFCTKLAREESVVICPGSGLGMKNWLRITFAVDPGLLEDGMERVKSFCQRHGKAKELK

SEQ ID NO: 113073 - protein, 171 aa, Triticum aestivum
  Clone ID: PAT_TA_7491.pep
HEAAKLKHGFNDPIEIAENSVPEPDQMKLLAHRIPVYLPCQELLKIFSGNPSIDEKIDSRIRGEFYSTCISFNDIDEADKAFDELDGQETKDSSGRLQKSVLLKRDNGDVAGFFVRKMVYGSRLSNSEVLKKRPQPTENTEQKKEDANGDKRKRQRTSKKHAEKAKAPVVE

SEQ ID NO: 113074 - protein, 304 aa, Triticum aestivum
  unsure (1)..(304): unsure at all Xaa locations
  Clone ID: PAT_TA_7492.pep
MAADGGGEPDHLAGERATAQFDVDGMKVAWAGSRHAVEVADRMARLVASDPVFRKDTRTMLSRKELFKDTLKKAAHAWKRIVELRLTEEEANLLRLYVDQPGYVDLHWGMFVPAIKGQGTEEQQKKWFPMAYKFQIIGCYAQTELGHGSNVQGLETTATFDPSTDEFVMHSPVRTSSKWWPGGLGKASTHAVVYARLITEGKDYGIHGFIVQLRSLDDHSPLPGVTLGDIGGKFGSGAYNSMDNGVLRFDHVRIPRDQMLMRLSQCTWEGLYGHSDVXPKQLLYVTLVYVRQTIFVNASKAFPR

SEQ ID NO: 113075 - protein, 153 aa, Triticum aestivum
  unsure (1)..(153): unsure at all Xaa locations
  Clone ID: PAT_TA_7493.pep
TTPIVSDSRPVILFAEFGLWADAGAQVSVSGVSWSVPEGSPPQAVDPGLMGFILISNTLFFKITNESEYAEETDSSFCPLTSEYVMPLFRLKDIGRDGAGGGNVTIGDADQYTVLFNSCXTAFKITMDVRTEMYNMPGPGGDREYLPVGLLPL

SEQ ID NO: 113076 - protein, 92 aa, Triticum aestivum
  Clone ID: PAT_TA_7494.pep
LAKLVTAAGAKLGLDVQTKSVPNPRVEAEEHYYNAKHSKLSELGLVPHLLSDSLLDSLLNFAVQYKDRVDTAQIMPSVSWKKMGAKPKTVSV

SEQ ID NO: 113077 - protein, 88 aa, Triticum aestivum
  Clone ID: PAT_TA_7495.pep
LRVRPLVRPRRGPAPNPTRGGCRLHRVAAAPSASAATNPSHRRRPAPPRANPSASHARRRRRRSRSRSTHRVPGVSTPSAILAVRLLR

SEQ ID NO: 113078 - protein, 125 aa, Triticum aestivum
  Clone ID: PAT_TA_7496.pep
RTNQILLLTPNYDQAPSGVTVTLLVPGNYQGDRRIVVSQVYNEPGHKRMQLPTVPVRTTGTVLVEMVDKHGLHFADEYSLTFHVHYFKLLKWLVVLPMLGMFLVLVILRPQEGAPLPSFSRNNID

SEQ ID NO: 113079 - protein, 164 aa, Triticum aestivum
  Clone ID: PAT_TA_7497.pep
MATTASKYPQHYDDDEDDDDEFEDDDDDDEPSRPLPAGSAEDRLEAVLRRLTADEVRIRVHDVAIRGCARTRRAAAEAAVGPDLARAATVPELLRAAAAAGERLRRLGAFESVSITLDTAPPGVPADARGGAVVVLVDVTEARGRAAGGLGVFANTETRSCSVE

SEQ ID NO: 113080 - protein, 63 aa, Triticum aestivum
  Clone ID: PAT_TA_7498.pep
ELSSLENLEELNLTHNYLSGSIPTSLTKLSFLSKFDVSYNNLTGDIPTGGQFSTFTDESFRGQ

SEQ ID NO: 113081 - protein, 117 aa, Triticum aestivum
  unsure (1)..(117): unsure at all Xaa locations
  Clone ID: PAT_TA_7499.pep
EFAAASTGSSLIAAGGSDPVLRVWDPRKPGTXAPIFQFSSHSSWISACKWHPSSWFHLISSSFDGKVMLWDLRTAWPLASVDSHKDKVLCADWWKGDSVISGGADSKLCISSGVEIA

SEQ ID NO: 113082 - protein, 150 aa, Triticum aestivum
  Clone ID: PAT_TA_7500.pep
PPCPMTAFLFACPRVGNDSFKSVFASFDLLRAIHVKNKNDIVPTLPPEDFEYVDVATATLPINTDRSKFLRPGNVLTYHNLECYLHGVAGDHGNKDFWLEVDRDIALVNKSADALKYEFGVPANWWADKKKLMVKGADGRWKRKDDLKEA

SEQ ID NO: 113083 - protein, 164 aa, Triticum aestivum
  Clone ID: PAT_TA_7501.pep
MASNYKMKGFFKGFKIISQIFAAKEQEMVIGRPTDVKHVAHIGWSSSTPGMLTGNASPSWMNVIEGSSDFSSLGYFAPSAGTSWTSQDFEQQHQLPRDMLPLGIASEITGEDVAAAPRPDVPRPPPRKTRRKKKTTVGSLVDSSMPNDSSTSGLEGSYSRYRYH

SEQ ID NO: 113084 - protein, 75 aa, Triticum aestivum
  Clone ID: PAT_TA_7502.pep
MMAPPLSPPRGFADNKNTVEVCRDYLKKMCNRESCRFAHPDSQTEVAHDKVEVCRDFKRGECTRPTCRFYHPSSS

SEQ ID NO: 113085 - protein, 137 aa, Triticum aestivum
  Clone ID: PAT_TA_7503.pep
FTRYNGQNIAWFLLTSSNLSKAAWGALQKNNTQLMIRSYELGVLFLPKTLQSVPQFSCTDKSRSNLDKLALGKNIKPKLVTLCWKGDEEKDPSAEVVRLPVPYQLPPQLYGPEDVPWSWDRRYTKKDVYGSVWPRHG

SEQ ID NO: 113086 - protein, 76 aa, Triticum aestivum
  unsure (1)..(76): unsure at all Xaa locations
  Clone ID: PAT_TA_7504.pep
FVVLLFTCCFIYLAAKCSVLSNPCITMLSGIFQLEFYYFSSXNLWVCTKVRXXXASSSNPDXYNAGXXEQGLLPVA

SEQ ID NO: 113087 - protein, 99 aa, Triticum aestivum
  Clone ID: PAT_TA_7505.pep
KTQVVVGCRRGIPILRLCEEPNAPHSVHTEPHGTTQEHPQPTSAKNTNLDWMPRDGRLERLTIWGGIWRHQIAKMNQDITKSMTLAATHRPPRESLEHA

SEQ ID NO: 113088 - protein, 71 aa, Triticum aestivum
  Clone ID: PAT_TA_7506.pep
MRSSDSPQRLVISTGDLRSTRGAEAGSRLGSGAEPARGAALAAAPRREEAADPDRRKDLAAATAAIAAGCV

SEQ ID NO: 113089 - protein, 67 aa, Triticum aestivum
  Clone ID: PAT_TA_7507.pep
LRPWYLASCNFSSACSLGTGGVNFCCMFYCFLILMEVQISNLKRKAFASNYHCFLTWFLLIEARFIL

SEQ ID NO: 113090 - protein, 60 aa, Triticum aestivum
  Clone ID: PAT_TA_7508.pep
GALVVGFWLQLTQLPDRYASAWALLALADPFISCAFLCMYCCVHWLAWMPGPEHTRPAYD

SEQ ID NO: 113091 - protein, 132 aa, Triticum aestivum
  Clone ID: PAT_TA_7509.pep
TRPPTRPPTRPSGFSSLPSISSTAPPPARLPSLSLSIGNGSADGEDQQLGLSSDDGHRSIRAMKNRESALRSRARKRAYTQELEKEVRRLVEDNLKLKRQCKLLQSEIAALTAQQASNKQSSPHRRTSSTQF

SEQ ID NO: 113092 - protein, 121 aa, Triticum aestivum
  Clone ID: PAT_TA_7510.pep
AAPAPSPRPRARPLRMPPAPPSPASAASAPSPATPARPTPAPTSPTSPSGSATVVPTQRITGRGRAATRARSRRGRGGSSRRRSNPRQGGKPIRRSSGGTSAGTPRTSPNSRNGENCSTQF

SEQ ID NO: 113093 - protein, 116 aa, Triticum aestivum
  unsure (1)..(116): unsure at all Xaa locations
  Clone ID: PAT_TA_7511.pep
PXTQPGXKLKIVQLEARDIKRPNHRGDHNFVIKVKIPKNISDQAQIIVLGVRQESVQGXRRGSEICFDQCTTCYSTVDLSTRSSSCCPIVRRMLHDHNIHLPDMQNGQIQVSPEGG

SEQ ID NO: 113094 - protein, 212 aa, Triticum aestivum
  unsure (1)..(212): unsure at all Xaa locations
  Clone ID: PAT_TA_7512.pep
VHHRLMLMPETLYLTVYIIDQYLSXENVLRKELQLVGVSAMLISCKYEEIWAPLVKELLVLSDNAFSREQVLSTEKSILNKLQWNLTVPTVYVFLLRYAKAAMGDKELENMAFFYAELALVDYSMLVYSPSVTAAAAVYTARCTLNMSPGWSDILEHHTGLGESQLMQCARRLASLHSTAAGSSKQKVVYNKYANPKLGAVSLYSPAKRLAI

SEQ ID NO: 113095 - protein, 106 aa, Triticum aestivum
  Clone ID: PAT_TA_7513.pep
FRLFCFCPCDCRFILAQRVLAVSRNLLKSFGLQSISMRFNLLSVHLSCRLQAIFRKFVLMGKSLYSESGQCSINGLFGLVVFLHTLVAGLDLECGDPYDVVCRKGI

SEQ ID NO: 113096 - protein, 94 aa, Triticum aestivum
  Clone ID: PAT_TA_7514.pep
PGSSEQKQKNEVASIEEMQSQFPSDAVYYTESEDTQQSIEATPPSVKIPNRMMLDVLVESLGLPLAEYRTKVCEDGLKLQRIPFLFRYARPFVI

SEQ ID NO: 113097 - protein, 68 aa, Triticum aestivum
  unsure (1)..(68): unsure at all Xaa locations
  Clone ID: PAT_TA_7515.pep
HGINILEGVSSKEGSPCTFGLSSEGLPWLPTYITKQILCASAIDFQHLLQYRIIXFPDFVDEKFGEQA

SEQ ID NO: 113098 - protein, 197 aa, Triticum aestivum
  unsure (1)..(197): unsure at all Xaa locations
  Clone ID: PAT_TA_7516.pep
MAHLTALLLASVLVFVLSATPTLSIITGGGGATARQSTSLNHGAARTYVVLVEPPAHAHHDDEAAHRRWHESFLRTGSRPGRKAGGEAPTIRHSYTGVFSGFAAKLTEDELAAVSRKRGFVRAFPERRVPLMTTRTPGFLGLDAKQGVWNATNYGEGVIVGLLDTGIAASHPSFGDEGMPPPPAXXXXKCQAPVRCX

SEQ ID NO: 113099 - protein, 183 aa, Triticum aestivum
  unsure (1)..(183): unsure at all Xaa locations
  Clone ID: PAT_TA_7517.pep
MAVAQAAAVVTPVVAGAAPSVSPRPPSRGPAGAGGGLGWRRRAGGRGGRGPGMAGAFGGQYEDGFGDVELEIMNYFTYKATQTVLYQLYEMNPPAYTWLYNYLVVNDAKEGIHFLRALSKERQDLAERVMVTRLHLYGRWIKKCDHTKMXERISNENLELMRERLMETVVWPXDDTNSSDKQD

SEQ ID NO: 113100 - protein, 121 aa, Triticum aestivum
  Clone ID: PAT_TA_7518.pep
HHPVLIKPIDNMWAPAPQRSSVARSPGAVKSEETARLVVQNDDEMIGCRQSGHDNSACWVHQCVAGQANVRGTHLMQNSCLHPSVATELCKQTAHGTIRTGDLFRYLQLTPCEAKMPLTIR

SEQ ID NO: 113101 - protein, 219 aa, Triticum aestivum
  Clone ID: PAT_TA_7519.pep
SKDLATTAGYALKNNIAAFGPLVLPATEQLLVALSLLKRRLLRGRAKVRLYRPDFRTAFEHICIHAGGRGVIDEVQDGLGLSDDDVEASRMTLHRFGNTSSSSVLYELAYLEAKGRMKKDDRVWMISFGAGFDCNSVSWECVKPAGDADGPWAECIARYPVQLPEIDKDMRGGAACTAKVRGKETRRGREHAAGGRVAGRAGAGHGKDEQAPSTRRCRL

SEQ ID NO: 113102 - protein, 107 aa, Triticum aestivum
  unsure (1)..(107): unsure at all Xaa locations
  Clone ID: PAT_TA_7520.pep
GIVLLXLLTGRRPGMFAGEDEDIVKWVKRELQCGAVAELLEPGLLELDPESSEWEEFLLGIKVGLLCTASDPLDRPAMGDVVFMLEGCRVGPDIPSSADPTTQPSPA

SEQ ID NO: 113103 - protein, 64 aa, Triticum aestivum
  Clone ID: PAT_TA_7521.pep
WVAKHPPCNMIFLTVGWDNTLVSYDMDHHQVQEICDLGGDNDPRYLPYVPLYSELQTLHMRHKN

SEQ ID NO: 113104 - protein, 264 aa, Triticum aestivum
  unsure (1)..(264): unsure at all Xaa locations
  Clone ID: PAT_TA_7522.pep
PADPHTKRNPEAAAATSITLLAVVTMGYLAPLALNSEALFASRRNQYYDFYYSTSRRLELNEVMMRAPTLIAFVLQLRLLQLAWSSRHTSTVSERTVLWICLPLYALGGAFAAIIHRINXGAMSGDPSMISMGGGPATIWEDLVSYAGLILDGFLLPQVILNASLGGSRARAISPWFYIGGTMVRVAPHVYDVVRAHVYKPSMHSSHLYASPHGDLFSIAWDVVIPCGAVLLALLLFLQQRLGGTASLPAQRRRSGGYEMVSNI

SEQ ID NO: 113105 - protein, 96 aa, Triticum aestivum
  Clone ID: PAT_TA_7523.pep
MPKDIRILKHLIMIEDPAERLSALNDAFTPGPELQGENVDTLFTSPEVLHTWASAIIDAYYSSREGTLLGQARDLMNPKIIKRVEELLKTIKDQYL

SEQ ID NO: 113106 - protein, 391 aa, Triticum aestivum
  Clone ID: PAT_TA_7524.pep
VRPRVRPRVRVMALEGGYNLKSIANSLCACTKVLLGDNFTYNSPRMQPFESTWRVIQMVRDELKAYWPVLSSKLPDNVPLRSAPSYIEPYASSGSESDVEDVSELPDAISSVNGTQVVDDVLSKHITMLKLDEDNLATKNTSSDSVQAQDDGPVVASTRIYDLPFTWRSALSKVYVWYASFGSNMWKPRFLCYIEGGKVDGMSISCFGSHDTSPPRGTMWKTVPHRLFFGRSSTPCWGTGGVAFLNPEINYNDESYVCMYKITLEQFNDVLFQENRLVKDNSEDGKLESPSSPLIGLSEIESVSSNKALHLEPIKDSWYSNVLHLGEEDGLPILTMTCPSTAVAQHKSGELPLAPPSETYSATLIKGLVEGKQLDANEAANYISSAAARSL

SEQ ID NO: 113107 - protein, 246 aa, Triticum aestivum
  unsure (1)..(246): unsure at all Xaa locations
  Clone ID: PAT_TA_7525.pep
NSARGRGALPSXFDCDYAYVLGXVCYHIIAAGLNGYMATVTNLKSPVDQWKCGAAPITSMMTVRGWSRGPTASQIGKPAVHMASVDLKGKAYELLRQNSYSLLMEDIYKNPGPLQFEGPGADAKPISLCVEDRDYMGRIKQLQEYLEKVKNIVKPGCSQDVLKAALSSMAHVTEMLTIMSSPSYSGQGDHLRANSERSICRNPTGIIFLLSAVETGILIGSVLYLSFRLQSVASLEIGIWEELEQE

SEQ ID NO: 113108 - protein, 103 aa, Triticum aestivum
  Clone ID: PAT_TA_7526.pep
CSHLRSLYIFGCSWDTLPDQMEHLTSLKDLGLKGCRNIRSLPTLPQSLECFKLSRSNEMLMSSCRTVGDPNWEKLQHVPVAYVDGYRLERRAQYTSSSEPETP

SEQ ID NO: 113109 - protein, 350 aa, Triticum aestivum
  Clone ID: PAT_TA_7527.pep
MASDRLAALKAFDETKAGVKGLVDAGVKAVPDIFRHPPDPLSPCTKVAAIPVVDLSGPRSEVVGAVREAARTAGFFQLVNHGVRRRPCRGLLAAVRRFNEEPAEAKAPYYTRDAARRVRYNCNADLFRTLLGKWRDTIYMDDVDRLAAGEEEEVLPPACRGVAPKYTAQMRMLGRALFELLSEALGVRRGYLEEEAGCLGTLSVAGHYYPACPEPHLTLGAVRHNDPGFLTVLLQDGVGGLQVLTDVEDGEGNVSAAWADVPAVPGALVVNVGDFLQLVSNDRFRSVAHRVVANSVGPRMSVACFFRAKGATVCAPVVMDGGGLPRYRTVTAEELLRSSGKQNGLRDVRL

SEQ ID NO: 113110 - protein, 195 aa, Triticum aestivum
  Clone ID: PAT_TA_7528.pep
GATVEAAALAEAEGFGPTDGASTGSLFPPDITFYVDGKPIEAHRVILCARSPFFEQKFETDWKNRKEVRFSNKKLSFGALYNLIHFFYADRLEAPVDEMESLSRTCKVCKCEELRKLVDKEILHLRFALYKSTSKLGLENSQESETVHFTRASHCHEEDRLPSALRRVLQKCLANSREEEFKKTLANEICRNWKG

SEQ ID NO: 113111 - protein, 187 aa, Triticum aestivum
  unsure (1)..(187): unsure at all Xaa locations
  Clone ID: PAT_TA_7529.pep
MAEGKLLLRSFVEVPRDSHFPIQNLPFGVFRRRGQPEGPPRPATAIGDFALDLAAVSAAGLFDGPLLSASPCFHQETLNMFLGLGRPAWKEARATLQKILSADEPVLRDNEALRKNCLVPMSDVEMLLPITVGDYTDFFCSVHHARNXGFIFRGPQTPVNPNWFHLPVGLXHGRASSVIISGTDIIR

SEQ ID NO: 113112 - protein, 427 aa, Triticum aestivum
  Clone ID: PAT_TA_7530.pep
MAEGKLLLRSFLEVPRDSHFPIQNLPFGVFRRRGQPEGPPRPATAIGDFALDLAAVSAAGLFDGPLLSASPCFHQETLNMFLGLGRPAWKEARATLQKILSADEPVLRDNEALRKNCLVPMSDVEMLLPITVGDYTDFFCSVHHARNCGFIFRGPQTPVNPNWFHLPVGYHGRASSVIISGTDIIRPRGQGHPTGSSQPYFGPSQKLDFELEMAAIVGPGNELGKPIDIADAEDHIFGLVVMNDWSARDIQAWETIPLGPFLGKSFSTSVSPWIVTLDALKPFACEAPKQEPEPLPYLAEKNHINYDIPLEAWIKPKEQSEASIVTKTNFKHMYWTVTQQLAHHTVNGCNLRPGDMFATGTLSGPEPDSLGCLLEITWNGQKEISVGNSIRKFLQDGDEVILTACCKGEDYNVGFGTCTGKILPSLP

SEQ ID NO: 113113 - protein, 190 aa, Triticum aestivum
  Clone ID: PAT_TA_7531.pep
CAALRRQVSNNDLQGLWFERDSSLLMLPSMNDNLLDHLKGRGVSTVLSLLDHSREELHKLLQPFSAAELYQDLQHFPRLDVKVKLQNEDKEQSKPQMLNIRMQIKNTRRSPRVFSSKFPKAKQEAWWLVLGNTTSSELYGLKRISFADRVLNTRMELPPMLNIQEAKLIVVSDCYLGFDQEVSLGHLAKV

SEQ ID NO: 113114 - protein, 246 aa, Triticum aestivum
  Clone ID: PAT_TA_7532.pep
GGSTSNSIKELISNATLNYSDNRIKKPKAVLIMDEVDGMSAGDRGGVADLIASIKISKIPIVCICNDRYSQKLKSLVNYCLLLNFRKPTKQQMGKRLMEIARKEGIQAQENAMEELAERVHGDIRMALNHLQYMSLSQSVVKYDDIRLRLNSSSKDEDISPFTAVDKLFGFNGGRLRMDESTVRSMSPPVPLPLLSPEVLLFFRPAAARTVVCGPKRLSLRARAAVAFPNFLAKCWVWKTDLMLPQ

SEQ ID NO: 113115 - protein, 146 aa, Triticum aestivum
  Clone ID: PAT_TA_7533.pep
RHELMHTKWCYDNIHHVHHEYTAPNGFVAPYMHWTEVLILTVPTVVGPVIAPCHMITFGIWFVIVAISAIETHCGYNFPFNPTKLIPLWGGAEFHDYHHYLGGNCQSNFATVFTYCDYLYGTDNAFRRHKAGQAKLKMVAEKNVEK

SEQ ID NO: 113116 - protein, 167 aa, Triticum aestivum
  Clone ID: PAT_TA_7534.pep
SQDPRLMTQADKDKGLGSVFKRDDDRLKQLREKDAREKDPNFISDSYSECYPGYQGYNQEIAGSDDEDDLSKMDMGGRAKGRLHRWDFETEEEWAKYNDQKEAMPKAAFQFGVKMQDGRKTRKQNKDQKLSNDLNKINKILARKKGDKDGGEGHYDDDLPSGKKQRA

SEQ ID NO: 113117 - protein, 147 aa, Triticum aestivum
  Clone ID: PAT_TA_7535.pep
LELLFQSGIDLMGKHVTIIGRSKVVGLPTSLLLQRHHATVSVIHAFTENPEEITRGSDIVISAAGVANLVRGSWLKQGAVVIDVGTNPVEDPASDFGYRLTGDVCFEEAVNVASAITPVPGGVGPVTIAMLLANTLDSAKRVYGLSD

SEQ ID NO: 113118 - protein, 244 aa, Triticum aestivum
  Clone ID: PAT_TA_7536.pep
EGDGGPPRIRITAIDLPQPGFRPAERLEATGRRLSEYAKMFHVPFEYRAIAAKWDAIRVEDLRIDKDDLLIVNCLFRMRHMMDETVTDESPRKTVLNTIRKMNPHRFIHAVVNGTYNAPFFVTRFKEALFYFSSLYDMLEATAPPVDEHRQLIEREYFGRELLNVVACEGTERVERPETYKQWQVRNLRAGFRQVPLLQESVKKARYKVIKSYHRDFFVDEDNKWMLQGWKGRVIGALSTWKPS

SEQ ID NO: 113119 - protein, 169 aa, Triticum aestivum
  Clone ID: PAT_TA_7537.pep
MAAPEAPTCYVGIARQSAAFRLMKQMGWEEGEGLGKDKQGIKGHVRVKQKQDTLGVGVDNPQNKWAYDTTQFDDILKKLKVQSTTPVKEIEDVSSSPDSTPKKDKPAKDEVAKVTRPQGRYKKRERGKSVRGYSAVDLEGILVRKKENDCKVDQEVQPSCMEEPDITIG

SEQ ID NO: 113120 - protein, 146 aa, Triticum aestivum
  Clone ID: PAT_TA_7538.pep
MCGDGHAQEVDAVWRRGGVGGSETEQGSYNSTALKLYNNKTKATIFATSVATRGYSAVDLEGILVRKKENDCEVDQEVQPSCMEEPDITIGQGAVSQAEDVNWWGHKFGYVSGGFLGAKSRKNKKDNSNVRQMFGEDDQENLYNLV

SEQ ID NO: 113121 - protein, 118 aa, Triticum aestivum
  Clone ID: PAT_TA_7539.pep
ALADNENNPSEQRTSAKQMEDKLSKVVEVFVGRIRKMENDYMSLSKRASMLDVHLECQDLERISIVNRLGRFHGRNHAAGVEASSGSQMVSRRIFPDRHVMSFSVPGNLPEEVHCLAL

SEQ ID NO: 113122 - protein, 390 aa, Triticum aestivum
  Clone ID: PAT_TA_7540.pep
HASDQMQAMGHVDVDPGNKTGKMLKPNEISSDASQVDWKSAQRFAHGATNSLRSSIDNIGSTSVQGSFPSDMKMLSFAPWRGRGRGTSIPSQIPSREVLSHGMVMRNDHQSQVQSLGTNASSNLIERSERPGINPQMAPSWFEHYGNQRNGQNHSVFNAQKTPTPPYNVPKASWCMENNSLEDRADAGQAARPLVPNMKTALMTRPKKRKFTERALVSWHKISEGTQKLRKTSTNEMDWAWAANRLIKKSEDDPESLEDAPVNYLPRKRLIMTTKLIQEVFPAIPARVLRAQAVSAYESATYNIAMFTLGDTCIISSDNSRALADNENNPSEQRTSANHGAVSLAGVAGGFPGWVPFIDHGGPRLGTAPMLDGLPQRRDLPGIVNRLGHG

SEQ ID NO: 113123 - protein, 149 aa, Triticum aestivum
  unsure (1)..(149): unsure at all Xaa locations
  Clone ID: PAT_TA_7541.pep
KIGADPFNNEETDPAKSGAMRSSLWEIDTLRHHYTPAVSRFVASLETDLTVRAKTMEMKITDFSSGSYATVFPXDRPRRRIKQVPLAFYRSTPTSLFQESDFPGWTFGCQSNSGAQASVEGTAVHTLETGDASPAKRSRVQISVGRDRV

SEQ ID NO: 113124 - protein, 181 aa, Triticum aestivum
  Clone ID: PAT_TA_7542.pep
LLPAVASWDADFYVKVDDDVHVNLGMLLTTLGRHKLKPRVYIGCMKSGPVLSDKSSKYHEPEFWKFGEDGNKYFRHATGQIYAISKDLATYISVNNPLLHKFANEDVSLGAWFIGLDVEHIDDRDMCCGTPPDCEWKAQAGNACVASFDWRCSGVCNPVERLKDVHMRCGEGDEAIWSASF

SEQ ID NO: 113125 - protein, 553 aa, Triticum aestivum
  unsure (1)..(553): unsure at all Xaa locations
  Clone ID: PAT_TA_7543.pep
RAAGRSAKILSQFNRGTSAMQHYVATRPMFIDVEIMNTDIQVVLGDDGPQADSSSIAEGLSIFVREIADTVRKEATTIMAVFPSPNEVMSILVQRVLEQRVTAILDKLLIRPSLASLPAIEEGGLLHYLRVLSVAYDKTKELAKELQSIGCGDLDIEGLTESIYVSHKDEYTEFEHASLRQLYQSKMAELRAEAKQQSESTGSIGRAKGASLNTSPQQLISVTVVTEFVRWNEEAISRCTLLFSQPTTVAANVRSIFACLLDQVSQYLTVGLDGARESLNEAAAMRDRYVIGTSVSRXRVAAAAASAAEAAAAAGESSFRSFMIAVQRCASSVAYLQQYFSNTISRLLLPVDGAHPSACEDMGSAVSVVEAAAHKGLLQCIDTVMCEVERLLSSEQKATDYWSPXDDGAAPDHRPTNACIRIVAYLSRVLEVAFSALEGLNKQSFLTELGNRLHKGLLNHWQKFTFSPSGGLRLKRDITEYGEFVRSFNAPSIDEKFELLGIMANVFIVAPESLASLFEGTPSIRKDALRFIQLRDDYKTAKIASMLNSIMSE

SEQ ID NO: 113126 - protein, 113 aa, Triticum aestivum
  unsure (1)..(113): unsure at all Xaa locations
  Clone ID: PAT_TA_7544.pep
XYXTDCGEHGXXXLSGGRTRRIAIARAIIRNPAILLLDEATSALDAQSEQVVQEALDRIMTGRTTIVVAHRLNTIKNADSIAFLGEGKVIERGTYPQLMNKKGAFFNLATLQK

SEQ ID NO: 113127 - protein, 197 aa, Triticum aestivum
  unsure (1)..(197): unsure at all Xaa locations
  Clone ID: PAT_TA_7545.pep
MGSCEMTATEVAALLDLKPHPEGGFYAETFRDSSVFLSRXISSSSHGNTSNTFFMYAADKVGRAVSTAIYFLLPSGSVSHLHRIPCAETWHFYKGEPLTVFELHDDGHIDLTVIGPHLDAGQRPQYTVPPTHACLAPSLTQLVSPLHRDPQKHYSLVGCTCARGFEYDDFEMATFDDVKSIAPKAEPFLNYLIPSKK

SEQ ID NO: 113128 - protein, 131 aa, Triticum aestivum
  unsure (1)..(131): unsure at all Xaa locations
  Clone ID: PAT_TA_7546.pep
MGSCEMTATEVAALLDLKPHPEGGFYAETFRDSSVSLSTAQLPPQYKVGRAVSTAIYFLLPSGSVSHLXHRIPXAETWHFYKGEPLTVFELHDDGHIDLTVIGPHLDAGQRPQYTAAXPKLWFGLFPYVVC

SEQ ID NO: 113129 - protein, 173 aa, Triticum aestivum
  Clone ID: PAT_TA_7547.pep
STHASELGNLCILKIAVKGLPPQCADILRGLPALAALSLYLETPPDDTIIFDKAGFSVLKHFKLTFMRGIAWVNFEADAMPSLWKLKLVFDAIPPMDQQWKTYAHGTALINIDYMPGLREVSTKFRGAAADLECVSLIGVVSNHPSNPIIDVQLADSSGYYGNESTETQITTE

SEQ ID NO: 113130 - protein, 62 aa, Triticum aestivum
  unsure (1)..(62): unsure at all Xaa locations
  Clone ID: PAT_TA_7548.pep
AWAVCLLLYFFKSCRQSATVLLALRLICQCKLAADQLAQLSVFLFRTMTPLVNIPYLFLVXH

SEQ ID NO: 113131 - protein, 79 aa, Triticum aestivum
  Clone ID: PAT_TA_7549.pep
MQPPPPNQGDAGDRLRRRGSPGRPPLPPPPPPTRPPPQSHRRRPPPPLAPPLQPLTFSSWIRTTRCGAMGEKAPYRATR

SEQ ID NO: 113132 - protein, 103 aa, Triticum aestivum
  Clone ID: PAT_TA_7550.pep
GGKVVVVDNFPSTKVKDLLQMADGAGDKAGSSSLVQQSPPQPSQNTLPDLPIARRNSLHRFLEKRKGRIVAKAPYQINSASAAPSKQANGDNSWLGLGQEVTN

SEQ ID NO: 113133 - protein, 230 aa, Triticum aestivum
  Clone ID: PAT_TA_7551.pep
MEGAGSGGKMSGGEGMAGRAGAGAASAAKEKSGFAATCSLLSRYMKEKKGGALQGLVGLDMSPPAAVVVGEGAFQPPTTMNLLSGLEEPNAADVELPLEKSSVGQFLKATTDNQDAGEDAHQLTIFYGGKVVVVDNFPSTKVKDLLQMADGAGDKTGSSSLAQQSPPQPAQNALPDLPIARRNSLHRFLEKRKGRIVAKAPYQINSSSAAPSKQANGDNSWLGLGQEVTN

SEQ ID NO: 113134 - protein, 191 aa, Triticum aestivum
  unsure (1)..(191): unsure at all Xaa locations
  Clone ID: PAT_TA_7552.pep
VSXFSAVSAHLWQCMCLARMLPPGARTPPMFSANIRRIMRPPLPDGYFGNAIINLSVTDKVRDISSCELTYIVRRIRDTHSRVNNELVHSAIDYLELTKRDDERPAAGNLPVTDIRVVSWLGMPSYDADFSWGRPLAMFRAEPNRGGFVHLIDSAEGDGSVRIIMSIEVAILSEFKRLLYAKFNNMLYSKF

SEQ ID NO: 113135 - protein, 84 aa, Triticum aestivum
  Clone ID: PAT_TA_7553.pep
HLVATVGKFSLIWNFQKVKDSNHHCYRDQEGLKSCYCYKVVLKEESIVDSRFMHENFAGSDSPEAPLVVATPMKVSSFSIANRR

SEQ ID NO: 113136 - protein, 398 aa, Triticum aestivum
  unsure (1)..(398): unsure at all Xaa locations
  Clone ID: PAT_TA_7554.pep
TCSSRXEAGDGSGIQSLALGALDNSFLVGGAGIQVVKNDRGGGHGKGVSVRISGGRGGGTSTTSTNYSTPKKALLMRGETNMLLMSPGDTGAPHSNGVHHVDIETGKVVAEWRFEKDGTDITMRDIANDSKSAQLEPSGSTFLGLDDNRLCRWDMRDARGRVQTIGNSDDSPVLHWSQGHQFSRGTNFQCFASTGDGSIVVGSVDGKIRLYSRSSMRMAKTVFPGLGSPITHVDVTYDGKWILGTTDTYLVLICTIFKDKDGKEKTGFSGRMGSRIAAPRLLKLSPLDSILAGNDNKFHGGQFSWVTENGKQEKHLVATVGKFSLIWNFQKVKDSNHHCYRDQEGLKSCYCYKVVLKEESIVDSRFMHENFAGSDSPEAPLVVATPMKVSSFSMASKR

SEQ ID NO: 113137 - protein, 121 aa, Triticum aestivum
  Clone ID: PAT_TA_7555.pep
GPVAFTYDEQTASKLDERDRQLGLHGEGVLNGFLEGLTGLLQSPIRGAEKHGLPGVISGIAMGTAGLVARPMASILEATGRTAQSIRNRSNPHESNRLRVRFSRPVARDRPLFPYSWERAV

SEQ ID NO: 113138 - protein, 164 aa, Triticum aestivum
  Clone ID: PAT_TA_7556.pep
MAAPPPPAFTDDDEDMDAVDLSLTLAHTPWPASPSSPPAASSGGGNGRRSGNGGRGGVRLFPCLFCNKKFLKSQALGGHQNAHKKERNIGWNAHLYTTPINTNSAADAMPNHQTMYPIQVSHSCQHQGYPHVADGGSPGGSWWRDQDGDKKQQQPRKVDLNLKL

SEQ ID NO: 113139 - protein, 80 aa, Triticum aestivum
  Clone ID: PAT_TA_7557.pep
VHDSISEKLWFVRSIYPNLPQMGQKIYHSMLMPLNDSMQSFMNFRRVLDLLEFKNQASQCFADIQRCGVFEIHSHFLHGT

SEQ ID NO: 113140 - protein, 128 aa, Triticum aestivum
  Clone ID: PAT_TA_7558.pep
NALKTQIMHKNVQTNPEKSQKNHTTLLLFYVDTRKKLLKAIRGNGYRFVPKGGTFPTENHHACCEKLRFVRSIYPNLPQMGQNLYHGMLMPLHDSMPSFMNFRRVLDLLEFKNQASQCFAGNQRCPGV

SEQ ID NO: 113141 - protein, 176 aa, Triticum aestivum
  Clone ID: PAT_TA_7559.pep
AGTQRDMVVSMWHFLRHPRPNLSFNDMFELTCEGRSLCGPFWDHILGYWNAGKTMSGDEGQPEMTSAAVLFLRYEEMIKDPANNVRKLARFVGQPFSAVEEETKVVDDIVDLCSFEKLSSLKVNKAGPVVFTKYPRESYFRRGGVGDWMNHMTPEMAHRFDALLQSKFHGSGLDLL

SEQ ID NO: 113142 - protein, 146 aa, Triticum aestivum
  Clone ID: PAT_TA_7560.pep
TAANVAARQAVGGSDMFSKWQLMAEQAKQKRAPAPRPSHASGKGSAERSEASKRSHLAAFGTGGTERQGKGSFANRHSHGPQRTVSVKDVICVLERGPQRATARARARANGRWAGGTPRAGAGAADDEAAAELPAERAIGGRGPHR

SEQ ID NO: 113143 - protein, 195 aa, Triticum aestivum
  Clone ID: PAT_TA_7561.pep
MIIRKYKMRSDIRNVHLSGMGCSAGLVSVGLARNFLQVAPRGSHALVVSTETITPNYYVGKERAMLLPNCLFRMGGAAALLSTSRAKARFRLSRVVRTLTGAQDNAYRCVYQEEDDEGHRGINLNKDLMTIAGDALKANITAIGPLVLPASEQLLFALSFIARRVFNNKSIKPYLPDFRMAFEHFCIHAGGRAVI

SEQ ID NO: 113144 - protein, 271 aa, Triticum aestivum
  Clone ID: PAT_TA_7562.pep
DAWVDDENEDGHIQDGAVKAKNAHVGARRDWRRVRKVYRRSKQYVFVAATLPQSGKKTAGGVLKRMFPSAVWVSGAYLHRHNPRLERRWIEVTTDTQVDALLDAVKYGLKSEVDTELGPNRTMVFTNTVDAANSVSDILRRVGIPCILYHRESSLEERTANLQSFRENGGVLVCTDAAARGLDVPNVSHVIQAEFAACPVDFLHRVGRTARAGRSGIVTSLYTDANRDLERAVRQGEEQAQPVERAFSRKRSFRNKLKKQARLREPATLLS

SEQ ID NO: 113145 - protein, 88 aa, Triticum aestivum
  unsure (1)..(88): unsure at all Xaa locations
  Clone ID: PAT_TA_7563.pep
VLAMQPRXLLTVDEDLKPLPVPVRVGQAVDVVGQAGRPKTITGFQTHTTPVLLAAGERAELATDKYIPLTSTLEGFVILKKNPEYHEE

SEQ ID NO: 113146 - protein, 515 aa, Triticum aestivum
  unsure (1)..(515): unsure at all Xaa locations
  Clone ID: PAT_TA_7564.pep
ESGLSPGSAADCANSCSRAAGPLAECVDRISNPYQPGPASRRGTSLLWDCDARLPRLDKYXHSTNSQDVAGALLGIGVITCVVKRDCYPAFAIFMEYVAKDVSKVGLRIISDLGHVFVVSQKAVLSVQLSGKLGDAQVTPLVVVFAAILLGMVVVSSCSVVIAKPISICFMARIEGAPAGPIMRLLPVAPRILYLGKTQSAEATAEVSKTFEETIGKYXDGTLISLAYAGXGNVLRVQKLHGICSQHLEKGETHQGPXAVLGIALIAMSEELGAEMAVRSLERLLQYGEQNIRRAVPLALGILCISNPKVNVMDTLSRLSHDADADVSMAAIISLGLIGAGTNNARIAGMLRNLSSYYYKEAAHLFCVRIAQGLVHLGKGLLTLSPYHSDRFLLSPMALGGIVTVLHACLDMKSTILGKYHYILYIIVLAMQPRMLLTVDEDLKPLPVPVRVGQAVDVVGQAGRPKTITGFQTHTTPVLLAAGERAELATDKYIPLTSTLEGFVILKKNPEYHEE

SEQ ID NO: 113147 - protein, 108 aa, Triticum aestivum
  Clone ID: PAT_TA_7565.pep
LYYSHRNCKVLHQTLHHHRDSPLVPASAQARGAWGPATASTRPSEESRGTSLRQTFRSLLIEIVPGQPVDQEKKEKKSNPAVDELGIAMNRSNRLRLLRHWSSLPLPY

SEQ ID NO: 113148 - protein, 86 aa, Triticum aestivum
  Clone ID: PAT_TA_7566.pep
LVPHMTCFHSNTSTLSYAGICTKGLNSLAIPPGPSAWIMPRVCSSIVIVLNLCENLPAVPLYELRGNIIINFHHYGLTCRCTEESN

SEQ ID NO: 113149 - protein, 334 aa, Triticum aestivum
  Clone ID: PAT_TA_7567.pep
MSSSGAGEEGAAAPQGPLPVEHRKGANGLDKVVLREARRISAEVYLYGGHVTSWKDEHGEELLFVSNKAIFKPPKAIRGGIPICFPQFSNFGHLEAHGFARNKIWGVDTDPPPFPVPISSRAYIDLILKPTDEDLKIWPHSFEYRLRVALGPGGDLMLTSRIRNTNADGKPFSFTFAYHTYFSISDISEIRVEGLETLDYLDNLQDRARFTEQGDAIVFESELDRIYLGTPSKIAIIDHEKKRTFVVRKGGLPDAVVWNPWDKKAKAMADFGDDEYKRMVCVEAAAIEKAITLKPGEEWTGKLELSAVPSSYYSGQLDPDRVIQDSVVPEDSVS

SEQ ID NO: 113150 - protein, 160 aa, Triticum aestivum
  Clone ID: PAT_TA_7568.pep
MEQATPPAAAGIDLSPAATDLGRVHLLPCGIRHNSAAAVSDYFKPRDTGVEVDGVKVEEAFFRGRNLQGATVALPDDYRGYVLEKKKNEEKDAQGMDEEASNFVSRAEFQNITYWNHDTMPSAEDPLPRCFHWLAIANAMHKPVTAEDMANMSARQNQNS

SEQ ID NO: 113151 - protein, 153 aa, Triticum aestivum
  Clone ID: PAT_TA_7569.pep
NLLAEIKKKRHRRRCCQRHHSACTCCRQPISLPRATAANACCRRCCCSSCLPLALLLASLIADAAAAACFLASWRCCYCLLGWLPASAACLLGRESKHTTATMRGGRQQDLTTPTSARSGATGRRCRISCGATGSRRARQVNGDARPVRRRES

SEQ ID NO: 113152 - protein, 133 aa, Triticum aestivum
  Clone ID: PAT_TA_7570.pep
LEFFFFFFFFFFHTSDAPARGTHFIDWFGNHSRSTSPYFAGCCWALNLAPPLVALDLTIRSAFCFGGRRRRAAGGVGAADPEADGAALLHVAFFLAFLDTVDFADPSAAAAPVVAGLVALAEGLGGRPLLGRH

SEQ ID NO: 113153 - protein, 246 aa, Triticum aestivum
  unsure (1)..(246): unsure at all Xaa locations
  Clone ID: PAT_TA_7571.pep
ELIXQLEINPTKGNKSWSSTAVAAALELVDPPGCRNSARDDADQCSSDNLSCRSSVMSADTNNHIDTRSGRNAPYKSPYPPSIASADDIELYPQTPSSFQSNSRTPTPIAEHHPSKHFNPIYQTSANRSPFSAKANEAAIPEANNARRFSAPNTDRSPRSSVYWDQEAGRFMSAQANQGPSSRVTRPDLLYTGQSIFFGGPLMADSATRSFRDPGGSSQRSGVSRPHQLPVFIPADPQKDHLPKLP

SEQ ID NO: 113154 - protein, 371 aa, Triticum aestivum
  unsure (1)..(371): unsure at all Xaa locations
  Clone ID: PAT_TA_7572.pep
NGKPQGSESSTLAAFLRSSPASPLNPTVRSPATGTKCLGAAPLGPRGDLVPDAPAEVVARRALLRPMYAETGTDNPPCGLLASGADGRWSLKPGHRLQLYVTHLPCGVMPVPQTPLQVGCVVSPLVPPSLEVRMEQLDTMVNGCSDVGCVLWKPGRGDSTWAVSCFGMAPRWCVVGIQGALLSHILEPLYLSTITIGQSPDGAPDGFCVESNVVKVLGARLSCLSRKFPDPFKPNKPLFFEAPIPPQEFQQTSGDIPPLTCGXVIRYSICWNKSGLHEVVLGTTGRKQGTSSKAASSPSTESLLCKIRLAEAFVSLEHPLVTKFRHEKLSYRAIKDMACEYQQMPELLRKAPFFGPWRAKPASVDSFTVPR

SEQ ID NO: 113155 - protein, 114 aa, Triticum aestivum
  unsure (1)..(114): unsure at all Xaa locations
  Clone ID: PAT_TA_7573.pep
EFGTRAVGAAGNRVGSGVMSMTFLSLSGAITXGGTFFLYXGVAVLAWVFFFTXLPETRGRTLEEMGSLFGMTDTGPEAEDAAPGTQDASCRARLLINHMNIWGSVHRKVCVGHI

SEQ ID NO: 113156 - protein, 132 aa, Triticum aestivum
  Clone ID: PAT_TA_7574.pep
RPRTRGSVSSPATASSEQRGACGVGAESDAADSGRRLLITTAFSSAMANRGGKGSYPPSKSGAPNGRQNNSNDVIHLSDSDSDSDDFFEEEAPPTHSKSNGKASSDSLKTGGKASSFSNGEGSKGGKAFSAG

SEQ ID NO: 113157 - protein, 133 aa, Triticum aestivum
  unsure (1)..(133): unsure at all Xaa locations
  Clone ID: PAT_TA_7575.pep
GRVGAELKLQLDMPPNSILLSNCEAAEMLXXIQGHMAILSEDPTIKIPXSFDKAFQYAKEGNHFTSAKLVKEILEPLKDYGVNDGEICMIANIGPETIEEVYALIPSLKATRSINEGKIVEALAALANIKASK

SEQ ID NO: 113158 - protein, 176 aa, Triticum aestivum
  unsure (1)..(176): unsure at all Xaa locations
  Clone ID: PAT_TA_7576.pep
MANRGGKGSYPPSKSGAPNGRQMVLISDDSDSDSDSDSDDFFEEEAPPTHSKSNGKASSDSLKTGGKASSFSNGEGSKGGKAFSAGKGGKGSASNAKPAMSDAELKLQLDMSPNSILLTNCEAAEMLQKIQGHMAILSKDPNINNPAWFVKAFQYANKGNHLTSAKXVREILEPIK

SEQ ID NO: 113159 - protein, 135 aa, Triticum aestivum
  unsure (1)..(135): unsure at all Xaa locations
  Clone ID: PAT_TA_7577.pep
TLPGPRAQHQMDPCVQFLXQQSSTVTLPFVQSRMWQLSSCHIMRHQCCQQLALIPEQFRCRAIHNMAQAIMQPQPEQWQGMSQSQRQAPLEVMRMSLQILPSICGVYVPTDCDSLRHPHRQHRRLMALCNGVVAK

SEQ ID NO: 113160 - protein, 200 aa, Triticum aestivum
  Clone ID: PAT_TA_7578.pep
IHHLPLLQYIFLASLAPMEMVQTTSLAFSGIVIILLSMAITAQASDTKPMSSAIMLEACKNVSSNFFKVRFTYDFCVSTLQSDKRSTDAKDYRILALVAVDAMKPQATAMTDKVENLIHGATKDKLAIRALGFYRVDYGGMMSTLEICQDIIQSFEIRKGNEGPTPFDLPDCIAKTTKAINDCADKTEFTSVSEGLTKEL

SEQ ID NO: 113161 - protein, 247 aa, Triticum aestivum
  unsure (1)..(247): unsure at all Xaa locations
  Clone ID: PAT_TA_7579.pep
MDLGTENRLAALLLEEARRLRMQAEKEGVHAYLQKPNVRHRPNSRFLAATVLGVQQANRVVEVNEMWRAREKELELESKMKTRTNGRIDSRSHKRKNDSRDQSPVSKTQRDRPYGASFSSRDSHSSSYSDWEDGLGDDEIEEFLRSRVKRGRGAIGSRMDEPGPYLKPPSGGQDNSISPDARVKEERKRQVYGPEKPLFLRSKSSDEEPSTSKHKHIKQEKNNSSXRERKEENRRSKHHHREHKSRK

SEQ ID NO: 113162 - protein, 87 aa, Triticum aestivum
  Clone ID: PAT_TA_7580.pep
TPSKRHGQSTGDEAMDATWILRKLGNDAIGKRIEIQLASDGKWHQGVVSNVISGMLCVQLDNGSSENLELGKQAVRLIAQRSKGGKR

SEQ ID NO: 113163 - protein, 289 aa, Triticum aestivum
  Clone ID: PAT_TA_7581.pep
EFGTRATRDAANNLTAVQLTVDLKPNLPKEAERIQQCRGRVFALQDEPEVSRVWLPNNDSPGLAMARAFGDFCLKDYGLISVPQISYRRLTEKGAWIILATDGVWDVLSNKEAIDIVAAAPSRATASRALVDCAVRSWRLKFPTSKSDDCAAVCLFLDHEKSPNLVEESEAKNEKAEPAKDALISDAGDKINEDIADVNEHISREEHPEPTLEHSSTLRNVDEIMPVDEPPVSKEPQRCGSARSLADCISTNEEEEWSALEGVTRVNSLLNLPRKLSGDKKSTSWKKRR

SEQ ID NO: 113164 - protein, 281 aa, Triticum aestivum
  Clone ID: PAT_TA_7582.pep
MAANANCMSTNRHADDQPSLPPAISLASSTHHPNRGLSSEEENLAFSLMMLASGIRDEHPASLDHVTTPSSPLPPHVTDVPAGVSQGAPATEATSQTPASVVVVASRQVPTQVPSPSSAVAVRPNMVLEQVVPPSQATGLVTVTQPAPGLALASTQVHPIVATGKAPFSKPNKVSTRPIKTVATMAENQTPQQESQQLLHECPLCLKRFKKSRGLNVHMKTHPDGRMHPCVWCTSTFPTSSALRSHVRRSNTCGGNRPRRLAPIAAAAIAWHTIDLNMPEI

SEQ ID NO: 113165 - protein, 204 aa, Triticum aestivum
  Clone ID: PAT_TA_7583.pep
MADAALGVVQWVVSKALATVTDIFQEAWEGTRMFGPNVEALRMELLLVKATLENAACKEISGPAMEELLQMMRDSAHNAQDLLDELDYFRIQDKLRGTYEAADEHGEGGVQHLARDVRHTRKSISKRLASFTGSCFGANARHPQQEDARQHVSCCAWQHARHITRGDSSSAPNANQADQEVSPHPHVHGNEDRDNAPETPIPEF

SEQ ID NO: 113166 - protein, 88 aa, Triticum aestivum
  Clone ID: PAT_TA_7584.pep
KCEIIVSLHCYVCSSHQSHKYLQQNFVICQTSVLPKFLMRVMLLDLLVPPYHPAMKYPIEKNYFVICHTSLLPDEVFESPTNRRLVAD

SEQ ID NO: 113167 - protein, 197 aa, Triticum aestivum
  Clone ID: PAT_TA_7585.pep
MDGGSSGVGADGIWRPWDEHTVLRPEEMEYVRRFHQHEPGANQCTSFIAKHIKAPLQTVWSVVRRFDKPQVYKRFVENCVMQGNIEPGCVREVTLKSGLPGKWSIERLELLDDNEHILSVKFIDGDHPLKNYSSILTVHHEVIDGHPGALVIESFVVDIPEENTKNEIFYLVGNFLKFNPKLLADVSEGRIDPRALN

SEQ ID NO: 113168 - protein, 232 aa, Triticum aestivum
  unsure (1)..(232): unsure at all Xaa locations
  Clone ID: PAT_TA_7586.pep
RGWKSTDAEQLNNQGLYVLSSHCPSLSDLALSFCSYIDDTGLGYLSDCKKLRSLRLNRAPAVTSTGIFRVAVGCRYLSVLHLVDCKAVDNREWLEYFGRYGSLGELVVKDCDGISQYDLLKFGAGWANLQKFEFEIKGAYCLCLPPDPSXVAGYPYSYDICCDSLKDLRLAHIVTKPEIGLRFLLGKCKALETLYLEYVIGLHEDEMIALFQRCCNLKTVALRLMPLRCEDH

SEQ ID NO: 113169 - protein, 299 aa, Triticum aestivum
  Clone ID: PAT_TA_7587.pep
MLICFLCASGGLTSVDAYGRLQNNGTFLTSPRSTSFVLAGRNKYKGNNDYNHVAGWITRASSYGARVKIGIWGSQVQHHSQESGAAISISTDDQDKTFNMIEAGFHVLPELYNNNDVHFFIRWTKDDNKSTGCYNLECHGFVPASGAALVPGQAVAPPSTYGRDDRYITISLHTDPKTRDWVLYRDDLHKPAFLGHFPKELCPRLYGIAPGVALLGFVNYQDKDKGGPAMGSGHFPEEGQRKAAYFKNIKLFDSKANVYDPSGLVRLVTRPACYKVSDVLHAKKDGHMFYYGGPAGCMG

SEQ ID NO: 113170 - protein, 145 aa, Triticum aestivum
  Clone ID: PAT_TA_7588.pep
MWMKTMFLVLLLCMLVVTPKAAEYGVGSHNSGPWMWCDPAMGHRVRPLMGCRAMVKLQCVGNQVPEAIQRDCCQELANITNDWCRCHDLGSMLNSVYQELGAREGTEVFPGCRKEVMKLTVASVPAVCKVPIPNARGGEGVCYWA

SEQ ID NO: 113171 - protein, 139 aa, Triticum aestivum
  Clone ID: PAT_TA_7589.pep
MATAAAAKRKPVFVKVDQLKPVTSGHTLVAKVLSSKTVLQKARAAGGPGPAAKPTRIAECLIGDETGCVLFTARNDQVDVLKPGNTVIIRNAKIDMFKGSMRLAVDKWGRVEVTEPASFGVKEDNNLSLVEYELVNVEE

SEQ ID NO: 113172 - protein, 159 aa, Triticum aestivum
  Clone ID: PAT_TA_7590.pep
MVAGNALPLIGGKGDADWQPSKDLGSYDLLPASLSGEELAFNMNSGAIHGSWRDAAPDRSGSAPPSMEGSLAELDHLIGKHSGNLEATLRNLSSGAVSSESELCSDPAYLKYYGCKVNLNPRLPAPLVSRESRRLMNRSSKAGEWRPLYDHSSSDRSLT

SEQ ID NO: 113173 - protein, 208 aa, Triticum aestivum
  Clone ID: PAT_TA_7591.pep
MEAAAAAVGGEDDGRGRKGSWYAVGERAVLVPYLREHVPRYHEWMQDPALLEATASEPLSLAQEFEVHRSWTLDPLKHTFIVLDKELIEGDFVVGNPHTEAMIGDVNIYMNDPDDLELAEIEIMIAEQKSRGKGLGQEVTLMMMSFAVEKYGIHTFRAKISDSNTASLKLFRKLGFKDASHSAVFKEVTLEAPAAELPLSSPLTIGSW

SEQ ID NO: 113174 - protein, 180 aa, Triticum aestivum
  Clone ID: PAT_TA_7592.pep
FAGSPTPRPPMLHTSRGDEDSSRRRGRHLRRWARESGAGRAACGRPGRQPTCGRTAASGVVSGVKPGAALTTLIPRRHVGDGKMKTRSLGPSRSLGEETKMSASRPLSGSWYLTGKCGPVASARRASRSCSATPRGTDTVWGRTKREVEDGGRDERERRRRRDGRGCAGGLERRSGNGER

SEQ ID NO: 113175 - protein, 146 aa, Triticum aestivum
  Clone ID: PAT_TA_7593.pep
HEATLLRRRRSSTLCWPSTTAHQDKGRLTSGGESCCCRFLDVFFHHNDNKTLVTLTMATEMQPLGSHLIPINSNQNRRSRQNRAVGARLPPQLACVEGKGQAKRSDEAPPGGGVRADGFPTKPTVYNDVRNLRHDDEPNNCRLSQS

SEQ ID NO: 113176 - protein, 40 aa, Triticum aestivum
  Clone ID: PAT_TA_7594.pep
SDLGLLVVQSSCFKLSVDVSFFEFFVATIGTYAFILLLMP

SEQ ID NO: 113177 - protein, 220 aa, Triticum aestivum
  unsure (1)..(220): unsure at all Xaa locations
  Clone ID: PAT_TA_7595.pep
VRRHNGGGFSVPRYCAETIFPKLDYRADPPVQTVLAKDVPREVWXFRHIYRGTPRRHLLTTGWSTFVNQKKLVAGDSIVFLRTEHGELCVGIRRAKRVTCGGMECISGWNAPGYGGFSAFLKDEENKMMNGGPAGYVKGRGKVKIADVVEAATLAANSQPFEVVYYPRASTPEFVVKAAAMQAAMRIHWCPGMRFKMAFETEDSSRISWFMGTISSVQVA

SEQ ID NO: 113178 - protein, 100 aa, Triticum aestivum
  unsure (1)..(100): unsure at all Xaa locations
  Clone ID: PAT_TA_7596.pep
KKKLTTPTVLDTLKKKTKRAYNKRRNATANNLCTXVTATDSITESANVQEDQVNEGWPLTSSGAPDTFPYGVETISFDLTQYNNAPSFHWPESSSRSQLQ

SEQ ID NO: 113179 - protein, 124 aa, Triticum aestivum
  Clone ID: PAT_TA_7597.pep
FGTRKEPWVLISASLCPLAGPPCLPPSLRLRPLLFSHPPLAASHQLLSRSVHFTIVSLLHLPPPPLHLPPPPVAPVPPPPPCSRRLPSTHQAVPPAPHHSQGSEVRPPSHVWQFNMASPPPGSL

SEQ ID NO: 113180 - protein, 268 aa, Triticum aestivum
  Clone ID: PAT_TA_7598.pep
ARGLDEGEGSHNVSLGGDFSIQVLQKALEVWDLQVLPLDSPAAGSSLFDPELEIAFICHLQDHWFCIRKVNEEWYNFNSLYPAPEHLSKFYLSAFIDTLKGAGWSIFAVRGDFPKECPMATEGSNGFGQWLTPEDARKITASCNQVPAPTHQGAVSQLGGQSAGMSEMDIIAAQQEEADLNAAIAASLMDAGGPFGSQSAPQEESRPQPSYVVEQGANVTTSDAVGEDSYVVEQGANEAEASEPGSDTIEGSAPGSYPRERSPPSERR

SEQ ID NO: 113181 - protein, 193 aa, Triticum aestivum
  Clone ID: PAT_TA_7599.pep
VPPSLRPPACPLPPGLSTPAPLVRAGAALRASPSSSVRPPPRHPRRGVRRRPPSGLSGSGPPCRRGGGAGWSPPAGGRRRRRPRRPRPRPPAPAPAAPAAGAPCSAAASTPRPAPSPAAPPPASASAIGNFGMPQYGGTMHGVVVYPKANTKACKPFADFGLSFNPKAGGLPVFLLVDRGDCYFTTKGWNAQT

SEQ ID NO: 113182 - protein, 335 aa, Triticum aestivum
  Clone ID: PAT_TA_7600.pep
LNLSLMVSTKENEEKLCTAFTITVDAKEGTTTGVSAKDRAKTVMTLASPYSKPEDFNRPGHIFPLKYRDGGVLKRAGHTEASVDLAVLAGLPPVGVLCEIVDEDGSMARLPKLRLFAEKNNLKIVSIADLIRYRRKRDRLIERASVARIPLRWGNVRAYCYRSVIDGIEHIAMVKGEIGDGQDILVRVHSECLTGDIFGSARCDCGDQLAMSMERIEKAGRGVLVYLRGHEGRGIGLGHKLRAYNLQDDGRDTVEANEELGLPVDSREYGIGAQILRDLGVRSMKLMTNNPAKYVGLKGYGLSIVGRVPLVTPITTENQRYLETKRTKMGHVYSN

SEQ ID NO: 113183 - protein, 226 aa, Triticum aestivum
  unsure (1)..(226): unsure at all Xaa locations
  Clone ID: PAT_TA_7601.pep
MASIAPSSSSVAVLRRQPVRFLGGSDVSKQAKGSVSYSFPTNSRNANMKSVGLKIAASLKKNSGLPADGCLENDDTLSLKSTSVRAQDHPTTNSVIPVDSVVAAEIISTDLSCVVDTLSNEEDDAELDLDSPTEGFSSISEAIEDIRQGKLVIVVDDESRENEGDLILAASLVTPEAMXFIVRHSTGIVCVSMKENDLERLNLPLMVSTKENEEKLCTAFTITVVC

SEQ ID NO: 113184 - protein, 206 aa, Triticum aestivum
  Clone ID: PAT_TA_7602.pep
FGTSGDREYRVMAPVIPAEATTAWDPIGGGASAAPRAEASKPRDPIRRGISSGGAAGAPDWEEVKAEARRIIRRSTDRKRCWKQMKRRAEEMMRVNPVKILPDLAGNVKMGDYYGDKSEVQKYGRGCNSLDLIPSGTGGPILGASSMETSTIVQDYREIYSVGDMDEEERNQGRSPICTIKENREISGILFWNLPIYDPLIFVKKK

SEQ ID NO: 113185 - protein, 74 aa, Triticum aestivum
  Clone ID: PAT_TA_7603.pep
MRTCVVVTIKLNGHDDPSSAANFFYPVSGQSFMTDDALDQVFSPPLLLESSLFPDAYEDLLAPLSETDAALMEH

SEQ ID NO: 113186 - protein, 98 aa, Triticum aestivum
  Clone ID: PAT_TA_7604.pep
TRRTPSIAMAWCTKNIGKGLLAATKVLICLCLVTMLVLSSEEMKSDACDKDWSLTWDNSSCILRGTCNKPCRRENFERGICKKLFHCMCYRHCNTESI

SEQ ID NO: 113187 - protein, 86 aa, Triticum aestivum
  Clone ID: PAT_TA_7605.pep
FTDNIPRVFPSGLGAKIFTGSWEVPPVFKWLQHVGKIEDAEMMRTFNMGVGMVLVVSKEAADRIIEQSSPAYRVGEVIQGKGVHYV

SEQ ID NO: 113188 - protein, 175 aa, Triticum aestivum
  Clone ID: PAT_TA_7606.pep
PRVARRDRRPPPPPPVVVQPPVLPPPPPPARPKAAQMGSSTSADGGGASVFGGFMGSSVPQGRAPMLDQGQMHLQSLMNSLAGGGNGGGMFGGANGRGMIDPRLYDMDQHEVKFSQGRGGAGGDVTRDFLGVGGRGDMMRGMSVARGENHSGSDMSFLEAEMKSASSPFNGGRMQ

SEQ ID NO: 113189 - protein, 153 aa, Triticum aestivum
  Clone ID: PAT_TA_7607.pep
SRLMPSSFFSVPRSPGGCPDVFAGFEDLGRCEEPGHPSPAACAPSRCEPCAPPRAARRTSSLPWSSGRRTEGRASSALEQVMSSPVAENKSSAASWCGKSMLESAGTQPPGRHLTPSSRCSRGARARTAAAQWRKRGPAHRRWPASFRCRRGG

SEQ ID NO: 113190 - protein, 232 aa, Triticum aestivum
  Clone ID: PAT_TA_7608.pep
QSIIVENHPAVTMPTTSDKELLQAHAELWNLTFSYLKSMALECAINLGVPTAIHRCGGTASLPDLLATLPIPESKKSYLPRLMRFLVASGIFTVDVPATGECANVGATSTYRLTPLSCLLVDGDDTDAHQRTSLSPFVLSQTNKYHVTAAMHFSEWFTSDEGSASAEMPYMMANGTNPWAIMARDPKLNQVFNAGMAADTQFAMNFIVSNCGEVFEGGYLDSDVAGGTGTAA

SEQ ID NO: 113191 - protein, 72 aa, Triticum aestivum
  Clone ID: PAT_TA_7609.pep
NHPSLPTLSHGRCLPSHDGGSAACSSCWEACGILTMGSGVLPKELPMLWCPYCCPGNTCIGGHLCALTYGFA

SEQ ID NO: 113192 - protein, 70 aa, Triticum aestivum
  Clone ID: PAT_TA_7610.pep
LCCCRLNRNNDVNLCDVTILLYNTNCTISINIVLFINFSGLNFHFCTSFNVHIVPQRLYVYFFYCFAQEN

SEQ ID NO: 113193 - protein, 468 aa, Triticum aestivum
  Clone ID: PAT_TA_7611.pep
TGPEFPGRPTRPPFPSPPFPDQSTPPPPAAAAMDSLKRALPQAQGSPRRNPRAMEGDENATPRRPVAAGSASPQRKKVLGERNGAGRGEGAASPAKAALTPPPSTGGGAGTYDPKTNYTTPRPDFLRYDPKRSREIILRLGREVEGDSSSATSGTELSEVLSSGSSAARGSDSECDDADEEEVVPAQGRGGRWARRLLLLLLSSACLFCYIYCMSSAPFPATNSEEPISFVGLNGSMYDVGVHEVVPLLGPIQYEHEADIDQTVVGDSEDGILLHGPGASPSNFMAVAMMGMADDCPNVAFGEFTCQIGDESSEILDVLNEDSGIGELKSEASMRPLENAEESSEVVCSGGDVTAAPFGSTHSDDLDEDRLGLVPQETGGDESKQSMPQLVTMDEILESESVKVVSDDKGLETERLDQEEFDSLGYENTAEGAKKLVDMVKILWSAVEPHLLKMLACLSVAGLVTVMI

SEQ ID NO: 113194 - protein, 315 aa, Triticum aestivum
  Clone ID: PAT_TA_7612.pep
MEAADLAADGRIIKADFTDAGAYQLRERMREKLREFEGSAEDSIADYVIVLLRNGKRKDQARKELHIFLGVDDSALFISWLWDHLSLNLHLYVQTQEQEVENKDDEIPKELSGRHKSPEVHARRDQTPLEHTSESNTTIRSRNKRDWKGTGREGNRNFPLRSVLTDILHGEEKKLQKSTEIRQPPSSNQRNGRKRDREDEPQQTKRELPSRPVLGASRRLLQFAVRDAVKAVQQTSSSTEPSSKRLRSVVSTVSTDNQHGKMSQRSTDSLHDRRSERATDSLHDRRSERSADNPNDKRVERKRQILQVPGSRFSS

SEQ ID NO: 113195 - protein, 89 aa, Triticum aestivum
  Clone ID: PAT_TA_7613.pep
LGGEGRSRPAPHLPCYRALYLWRSSEERVAVDLHLVFLATAHCTCGVARRRGSQSTCTSSSLLLPVVFELRRVLGLRLSLRVGVWLTTR

SEQ ID NO: 113196 - protein, 440 aa, Triticum aestivum
  Clone ID: PAT_TA_7614.pep
IPSTQYDGGVVAIDSEKEFYRLQGDLYSLCRAKFMRLAYLIGYGVEIEKSPVNSASLSMLSWPKPATWPSIPPDSSAEVMAKEKTILQAKAREKLFDIQRKPLPLEPSSLLREANRRRAFLSVGNLSELYDSVDGSGLAPPSKLSPNKSSSNLMTRTMSGPATSETSLPVDRPMRLSEIHVAAEHALKQTISDPDFMTSLSSPEEFESRYMELTKGAADNYRRSWWKRHGVVLDGEIAAIFFKHGNYDLAAKSYEKVCALYSAEGWEELLADVLPDLAECQKILNDEAGYLASCVKLLSLESSLFSSKELQAFQSEVVRLAHSEMRHPVPLDVSSLITFAGNPAPPLELCDGDPGTLSVAVWSGFPDDITLESLSLRLSAFSSADEGLKAIRSTDARVLVPGRNIITFDIPPQKPGSYVLGALTGQIGKLSFRSHGFSQD

SEQ ID NO: 113197 - protein, 551 aa, Triticum aestivum
  unsure (1)..(551): unsure at all Xaa locations
  Clone ID: PAT_TA_7615.pep
LFLHGRFSEVIVFRFPHVAIFSLALVVRYESLQXTVNSGLSSEILQQGTDDSLKEKTLQGERLLFLLETVVETRSIRDFTFSYSVYSGDVSGGVLVQRSIFRHYDDRDIFSICLLPGNNQNRRFFRWAVVFIVDTSGSMQVKPIENVKNAISTAVSELEEGDYFNIVTFNDELHSFSSCLEKVNGKTTENAINWMNSNFVAQGGTDIMHPLTEALALLSDSHGALPQIFLVTDGSVEDERNICHTVKTQLTNKGSISPRISTFGLGSYCNHYFLRMLASIGKGHYDAAFDTGSIEGRILQWFQKASSTIVADISIDVTKHTQEFEVDCEYIPDISAKYPLFVSGRFRGELPETLYAEGYLSDMSKISIELKVQHIKDIPLDKVLAKQQMDLLTAKAWLSENKQLEQMVAKMSMQNGIPSEYTRTVLLQTIMEKIDPAQQGKRKPKKPEEPSATPLQGLTLGFGNVPATTENLTSGFGDMRAPDKFEMFGKAVGGCCGRVADSCCCCMCFINCCSKMNDRCAIVLVQMCAALSFLGCFECCTELCCGGGGSD

SEQ ID NO: 113198 - protein, 147 aa, Triticum aestivum
  Clone ID: PAT_TA_7616.pep
MAAAAIRAQINILIATMFNTGLVDDAFLQLQRMREQGRVTPAHVVEVMNHFLNEAERIINDITGLMNGPEVDFDKVDDLVQQLKVACSSVGAKRLNLCCVQHFSPEAKTKEGYLAALGRVRFQFCDLRSMFKIIMELEQHFAACGPK

SEQ ID NO: 113199 - protein, 148 aa, Triticum aestivum
  unsure (1)..(148): unsure at all Xaa locations
  Clone ID: PAT_TA_7617.pep
RSSTTGEGERLPSPIVEDDEAVDEDDEPSPQFEADLKALERVPGKRLAISSYHVNDQDVVRRRYIDLGACQPKSHKFEIRDFSGHPRRFCPSWFKDHMWLXEYSVKEEAAFCFVCFLFKDKTKSPGGDAFVNGGFNNWNMKSRLKRQK

SEQ ID NO: 113200 - protein, 182 aa, Triticum aestivum
  unsure (1)..(182): unsure at all Xaa locations
  Clone ID: PAT_TA_7618.pep
RTRGCGDPWPPLRLPRSSSSYPSSAPPPGSSPAPXPAPPPTPPKPVIPYPTTPPKPVMPAPTTPPKPVMPAPTTPPKPVMPAPTMPPKPVMPAPTTPPKPVMPVPTTPPKPVTPPPVTPAKYAPKPVLPPPATPTKPVLSPPVTAPKPVTPPIAMPPMTALAPAPWDXPGYGSNPIPVCFPL

SEQ ID NO: 113201 - protein, 178 aa, Triticum aestivum
  Clone ID: PAT_TA_7619.pep
MKRQARSPKNEDSGSDDGGDCGHELQVQALECALQEQPLDHKPHLQVAAMDGYTYRSLLNQGNKEPFRDDRQLGSSSAEEQQSPIEQAIQSMPTNIKRTENFSDKEDYMLVLAWLNISMDAAQGNEQTCSTYWQRMHCYFHENRNFESDHSQNSLLQRWSTIQEHVEKFCRCYDPCWA

SEQ ID NO: 113202 - protein, 90 aa, Triticum aestivum
  Clone ID: PAT_TA_7620.pep
LALYLVMAISRRNASFVCVVAVMLVMATVMLSCDAAPKESCHGLEDGCDEPKCKEYCVLTCYTKGSHCRAEDCCCLIAAKPMVDVLRRHD

SEQ ID NO: 113203 - protein, 195 aa, Triticum aestivum
  Clone ID: PAT_TA_7621.pep
DPRVRPNVPDPSGRLPIELAALNGTREDVEILFPVTSCIPTVHDWSIDGIIHHAKSVSMKQGDYSNLRRIEELKSLGVKSVKRNDYSTAATMYSMAMEHDPHDATLFWNRSLCWLRMGDGHNALQDALACREMRPGWPKACYRQGAALMLLKDYGGARDAFLDAAKLDPQSSEIKAALREAMNSLEISHGATKTT

SEQ ID NO: 113204 - protein, 67 aa, Triticum aestivum
  Clone ID: PAT_TA_7622.pep
ERQPDSYCANNFGSLSSNDFVVAVFAFCNFVQYLIHQLLSNGYAWFQIIGSLSFVVSQTSIFCLDNV

SEQ ID NO: 113205 - protein, 260 aa, Triticum aestivum
  Clone ID: PAT_TA_7623.pep
FPCSKLTLTKGNKSWSSTAVAAALELVDPPGCRNSAREITSSTVLLLVAGVLVHVLPTTCTAVRGFSLPLVANHGGGTYRVDADGFMVVNTTSFHHRPFLTAPLRYMYGVAVTIGTGHGKSTHFLVLDTANSLPWMRCAHCLPVQRQRSPVFDPSHSSSYRPLHPTNPLCRPPNRVHPAGDKCSFHLPREAHGFVGVDTIILGNPTLPIHGIAFWVCARPPQGVRQPKGTVSASLGLGAMGRGLGLTLPFIYWREFKGGP

SEQ ID NO: 113206 - protein, 170 aa, Triticum aestivum
  Clone ID: PAT_TA_7624.pep
RPAPHASSSFSRVTSLSPSNPRPAPVSLPRRRPDPTPPRRHSPSPRPIPSQPPSIFLSQKKPPPISRTSPVIAPLPSLPLASAPVPDLTLPGASSPHRGPPLAPPLLPIRLELRRTASHARSRPSAVSRVLGWAAPSPPARLRWALTTPLRLLPRPHGAGPIPLGKVEAL

SEQ ID NO: 113207 - protein, 114 aa, Triticum aestivum
  Clone ID: PAT_TA_7625.pep
NVVPTHNPNAAIPSLHLGSRGKGSCHVDGAKSNGGSIVVPYLFATVYPAATMGTGCRSHVIVNGLRFAFVIHLACVKLKESPVEYTSSRGSSVIQRNTIMELVHVVTRRGCSLV

SEQ ID NO: 113208 - protein, 124 aa, Triticum aestivum
  Clone ID: PAT_TA_7626.pep
FPSRTTVVQVSGNQNLPATPAQLRLACIPRIRQPFLRMPYHPHNRQITSSFDSYVVNEGSCRSTQNSASTCLSDRGYETLTLSWYHSENTGRSQIGLQNYPWPDSSEHKMHPQTLPPHCVQIRP

SEQ ID NO: 113209 - protein, 397 aa, Triticum aestivum
  unsure (1)..(397): unsure at all Xaa locations
  Clone ID: PAT_TA_7627.pep
IRHEEDAEPPVSTSTLIYVFVALAVASSLCILIRALFLVTAAYKTATLLFNKMHMAIFRAPMSFFDSTPSGRILNRASTDQSEVDTNIAYQMGSVAFSIIQLVGIIAVMSQVAWQVFLVFVPVIIICFWYQRYYIETARELQRLVGVCKAPIIQHFAESITGSTTIRSFGKEHQFVSTNSHLMDAYSRPKFYNAAAMEWLCFRLDXLSSFTFAFALVFLISLPTGIIDPGRARLAVTYGLNLNMLQAWVVWSMCNLENKIISVERILQYISIPEEPPLSTSEDKLPRNWPSQGEIQLRDVHVRYAPQLPFVLKGLNVTFPGGMKTGIVGRTGSGKSTLIQALFRIVEPTVGQILVDGVDICTIGLHDLRSRLSIIPQDPTMFEGTVRSNLDPLNEVQ

SEQ ID NO: 113210 - protein, 212 aa, Triticum aestivum
  Clone ID: PAT_TA_7628.pep
MGALTDSRKRVSADHRLLPSFPSSAPSPSKKPKLSPLLPTAPPPPLPSSSHIPSSTSSAAPGPNSSTAFASTSSSSSAFSSLPHSRHRRLPPPPPVQRSIHAPLRRIRAFRLGNTRSNSDPSSYSPSPPPQPLGLDQYVDLVNSVTHPPPLTPPAYVPRGAKATVEVVAVDDLGDIKQDEEERDEEDEVKGEVVVRKVPLYKDLYEASSRQR

SEQ ID NO: 113211 - protein, 97 aa, Triticum aestivum
  Clone ID: PAT_TA_7629.pep
MVLRGAALESPMKVAALVELFNLRRALREFAAGRSHMCPLSFFLGVWAHTKSNNLHGPTNRKTVNCDKKMKNLLLGTSLVELSELPMFVSLHFSKVF

SEQ ID NO: 113212 - protein, 128 aa, Triticum aestivum
  Clone ID: PAT_TA_7630.pep
GIVWLYNIVFYFPLDIIKFFIRYALSGKAWDLVIDQRIAFTRKKHFGKEERELKWAHAQRTLHGLQPPNAKLFPEKAGYNELCQMAEEAKRRAEIARLRELHTLKGHVESVVKLKGLDIDTIQQSYTV

SEQ ID NO: 113213 - protein, 162 aa, Triticum aestivum
  Clone ID: PAT_TA_7631.pep
RPRVRPRVRPRVEGPPPLPFLCSGHPISVEPDAPSTSTGGGGVAKSVRNGAARVAPVGVRADHGRHHPRRRPRLLRHAPHRDLLQGEDGGEAAEVRGAHARQGEGGAAAAGRGAPRGPGAGLAGLVIFSRPLVPARLPELLLHNLAAQSFRRRAPPASTVVL

SEQ ID NO: 113214 - protein, 207 aa, Triticum aestivum
  Clone ID: PAT_TA_7632.pep
QAVQKYMAATPMATIFFSASVFMLLSVTTTAQAGGSGGGKPKATNLMVEACKSATFTNPYGDPDIEQFCLTTLQSDNRSTKAKDLRDLQLVAVDILRGRVTTIVIKVKKMLENIKKGTVPMRVLSLCEVDYDTVVSVINKCDAMIRDYQGDEGGLRSIKLVRWMDMAYDRVHECSSELVDMPAVGALVNENDELGMLVKLNTALVAP

SEQ ID NO: 113215 - protein, 168 aa, Triticum aestivum
  Clone ID: PAT_TA_7633.pep
AATPSFPASAGTLPQDFPAGMRVLVVEDDPNDLEHLTQILERCGYKVTAKASPREALKEVEENGEGFHFDIIMTVVHGGEEGDGFDGFDLLERVRDRYPVIIFSADYSKEMVMRTINEGACDFLPKPMCYQEVRNIWFHVDMQRGLEVDDPDEGVEGPSNHENPPEIK

SEQ ID NO: 113216 - protein, 97 aa, Triticum aestivum
  Clone ID: PAT_TA_7634.pep
VSWPLIKHGAKVDQVGYLKAFLIPTDPVSILRPSSNESNSYSYSAESIIKNIQGRDFSKCQIMIHYSCKYLPASKHVRSQLAHASAHASAHASADAW

SEQ ID NO: 113217 - protein, 134 aa, Triticum aestivum
  unsure (1)..(134): unsure at all Xaa locations
  Clone ID: PAT_TA_7635.pep
MASFNAAGAGAANPNPNKSLEVNPPPGDSVSSLSFSPKANHLIATSWDNQVRCWEGQPGGQCQAKASISNGQPVLCSAWKDDGTTVFSGGCDKVVKMWPLLSGGQATAFSWHEAPVKELAWIPXMISFVSGFWD

SEQ ID NO: 113218 - protein, 148 aa, Triticum aestivum
  unsure (1)..(148): unsure at all Xaa locations
  Clone ID: PAT_TA_7636.pep
WKXHNVEADKRLNYNIYVQNMTHSKLRYTVDNPLHASVSTICSFLVCSNVTMSPETHYEITTHFHSYWAMSEHLDSMNLDTHGSCLVALLRLDGMPRVLAQCVPVGLVPDPAQEEGARPVARVVRAHQGQILNTKDRLAQPRQVLNAM

SEQ ID NO: 113219 - protein, 191 aa, Triticum aestivum
  Clone ID: PAT_TA_7637.pep
HLTIQLNCVPAREECSAKGATEFAIRASYSTLHYRYDFCNSRAKYVEDAANHNEEQCEVPQMKLYPRFNNHNTHDNDDEVQRRWRKLSEEDKRGDHEKEPHPCRPPPPPWRRRGRSGVEEVHRPREPILHVPPAGGWFDLVCLITLVNRVLCTVCVTWSALPFPYLFLLPIPHYITTCVDICTGVLVYSGL

SEQ ID NO: 113220 - protein, 203 aa, Triticum aestivum
  Clone ID: PAT_TA_7638.pep
MQFTHYTPGITLPPAAVAVELRIIEGDDEIKDRVVMSLSKRYDGAEQPLCFHGSMCSAELSLGRLAATVQATIVGVRVGKGRWPFECGGRVTCSLYSAEVGDHSCDEVVLLDSAEKIPEDGLDGYISLSRSVVSVQLQGRLKVSIQAYGRSEPPVDVEFHPQDCNISMGSCFVYGSKVDITVAWSQLVRDKMDLLIEGYSTQA

SEQ ID NO: 113221 - protein, 105 aa, Triticum aestivum
  Clone ID: PAT_TA_7639.pep
SRHSSSEEMLEGTGHPNNLGFGTSPREAQLPDFLHHATLAVCSLAGLLQMAGDDDCVRTMLSFRSWRLSSRRTRLLLGVKRRVTRRIQSPNCISVSIAGWTPVPL

SEQ ID NO: 113222 - protein, 358 aa, Triticum aestivum
  unsure (1)..(358): unsure at all Xaa locations
  Clone ID: PAT_TA_7640.pep
GPLXSNYDSAEDRGILGPLLSDIKMILKDKDYNYNILSRRFENSIFLNRLPLMMQRENFKYEDLEYGLYKSLSSAAAALADDCDVCLVSSFEEKKLIELHFGSKMPCLTFGQSTGLTFTSGVILVSQDSFKTNEERWFVALTRFRKVPNFVNISGVSFEGVAMRFKDRALGLFLTGQAKRDYIFDMLPGNPKFIEGFSMRLGKDEDIVENKLVGDPWLKASMFLGQYPDDQEAEILEPCVEEGLSKVHIPLCEEEMLRVQWIDKIVAKEKRETRCGFETTEQFRDLESKGCGVIKSNFPEQWGSIYPRHSNSDDVTFLMAVRKRLRFSNPMKESSRWHTAKPFGEFLLKKFEDGAFFH

SEQ ID NO: 113223 - protein, 110 aa, Triticum aestivum
  Clone ID: PAT_TA_7641.pep
TSTIFQSRDDGELFFLDCFSEGRGIALSMICIRPENAREQEFVYELKTPVGNGDRRPWLQMQSTARNTSLRHGLGEKEKVFLLVPKDLPGTEDGNVEVCIRKLGHQRDSV

SEQ ID NO: 113224 - protein, 68 aa, Triticum aestivum
  Clone ID: PAT_TA_7642.pep
MGGSSACDGTLSTPTKFNASAKALVTKWRGIDVDDALPDWEWRPCRKMGVPSETEGFVALEGVYRIGA

SEQ ID NO: 113225 - protein, 79 aa, Triticum aestivum
  Clone ID: PAT_TA_7643.pep
VCRAPAPSSSAARSRMKLWMVRAATTMLLWTCVMQLTAVGETWGPQVLKGWPSRLTAPEEAAAVRPAVIERAALPSRKT

SEQ ID NO: 113226 - protein, 254 aa, Triticum aestivum
  unsure (1)..(254): unsure at all Xaa locations
  Clone ID: PAT_TA_7644.pep
IDRLKRDKQLLMAEVVKLRQEQQNTKARLKAMEDRLRGTEQKQQQMTSFMARILXNPEFLKQLIAKNGMRKELHDAISKKRRRRIDGGPEAYAVGASSSSLDQELPVVFDSHGSVELLAEGSVPVELLADGIPPDLEGSVDLLGDEIPPGLEGSVALLADGLEGSVELLVDGIPSDLDGSGIDSNGVTEPQDYGLGTCEAQQNRAPGLFHDNFWEELLNKGLSVENDEPVNVDGMDVLSEKMGYLIPNSPTLST

SEQ ID NO: 113227 - protein, 126 aa, Triticum aestivum
  unsure (1)..(126): unsure at all Xaa locations
  Clone ID: PAT_TA_7645.pep
MDGQGKEGGGGAGSECDVVGRAFVEYYYXTFDANRAXALAALYGGTSVLSFEGHRVAGAEEIGLKLAQLPFEQCRHSICTIDCQPTPSFPGGILVFVSGNLQLAGEEHQLRFXQMFQLVPNEQGSF

SEQ ID NO: 113228 - protein, 275 aa, Triticum aestivum
  unsure (1)..(275): unsure at all Xaa locations
  Clone ID: PAT_TA_7646.pep
GCHQLGWLRTGPWTVQRVKVGAEGKCGGCGCRLASVDIDMEDTQKFADSISGLALERETKANFSQFQEWLEAHKEYEAIVDGANIALYQQNFAEGGFSLVQLDAVVTELRDRYSGKWPLVILHNKRIAKLMETASNRHLIETWRANGALYTSPSGSNDDWYWLYAAIGLNCLLVTNDEMRDHIFELLGSSSFFYKWKQRHQVKYTFNKGKAVLVLPXPYSSEIQESETGSWHVPIEEKSGDERARTWLCIGRTDLSKPPREPPVANGVAQDLSPS

SEQ ID NO: 113229 - protein, 152 aa, Triticum aestivum
  Clone ID: PAT_TA_7647.pep
FERPPGQVCPKHWDDADVFNPERWPLDGPNPNETNQKFSYLPFGGGPRKCVGDMFATFETVVATAMLVKRFDFQMAPGAPPVEMTTGATIHTTKGLNMTVTRRIKPPVIPNLEMKIVSDSEGSTSSTAPVAVSAASIASGEGQQVEVSTSQV

SEQ ID NO: 113230 - protein, 121 aa, Triticum aestivum
  Clone ID: PAT_TA_7648.pep
HEEPFPNHNSRQSRRASPSSSPPPAAARIPRIIVPNSPSCFSSSQNHISSLRLLGGGWLEASLAQAGRSSGAADVGGRVPDGAVIVAPPRRIEEGPGSHPRPFWMHLPSEFLLPNSAPLSI

SEQ ID NO: 113231 - protein, 223 aa, Triticum aestivum
  Clone ID: PAT_TA_7649.pep
KKDKTNKTKCLSGSVKRELKKQKPRKEDSDGDPPNETAQEEQEAPIEQEKIVIALEEYEKMQERKKSQEASKPEERRAAAVDFEGLQLLEKKKIEDDAKLKAENVRKAKEAAAKEAKPRKAISIQEYLKPEDGSEYVPPTPLRRPQNGGYRGGRGNGAYNGCSSRDSSSECRVYNAGRGHNSIVFHNAEAKANANDSGAPRRVEGYNGEHHHGGYHLPARWVQ

SEQ ID NO: 113232 - protein, 99 aa, Triticum aestivum
  Clone ID: PAT_TA_7650.pep
PRVRGSIPIVRKTGGLYDTVCDVDDDKDRACEQGLEPNGFSFEGADSNGVDYALDRAITTWYDARDWFHSLCKRVMEQDWSWNRPALDYMELYHSARKN

SEQ ID NO: 113233 - protein, 390 aa, Triticum aestivum
  unsure (1)..(390): unsure at all Xaa locations
  Clone ID: PAT_TA_7651.pep
MPYLQPPRPHPHPHPTSRLSRASPPSPFPFFPAGTSRSGRLQPVPVSGHSASRVSKGKFAVAAVTLDDYLPMRSTEVKNRTSTDGIKSLRXLITAVKTPYLPDGRFDLEAYDSLINTQINGGAEGVIVGGTTGEGHFMSWDEHIMLIGHTVNCFGANIKVIGNTGXSNSTREAVHATEQGFSVGMHPALHVNPYYGKSSTEGLISHFKEVLPMGPTIIYNVPSRTSQDIPPPVIEALSCYSNMAGVKECVGHERVKCYTDKGISIWSGNDDECHDSRWKYGATGVISVASNLVPGLMHSLMFEGENAALNEKLLPLMKWLFCEPNPIGLNTALAQLGVVRPVFRLPYTPLPLEKRVEFVRIVEAIGRENFVGQKEARVLDDDDFVLISRY

SEQ ID NO: 113234 - protein, 89 aa, Triticum aestivum
  Clone ID: PAT_TA_7652.pep
SGEERSPGASQLDALFCHSPRGRGISSERGRAHRLQAVGRQRSRRRYFRRRRFPVVRGRARSRGRRRSWKKLRDWVSSLWVLLTISESS

SEQ ID NO: 113235 - protein, 125 aa, Triticum aestivum
  Clone ID: PAT_TA_7653.pep
ASVLRGGDHERVARERISWGRSVDRVRRRGARLLPEEAGLRQGQGAHGSRRGVHRRRLSPDLWAHAGAAAVCSRHKRTVRVASIHNVDLMLQSDGLVSLMKDTTMAISLAAFSATTELDLASFEK

SEQ ID NO: 113236 - protein, 212 aa, Triticum aestivum
  unsure (1)..(212): unsure at all Xaa locations
  Clone ID: PAT_TA_7654.pep
SYXYSSCAASHSKSFSIFSDTHPASTFPIHSTRASPHYHLPRSICALAQPALQLSTCSIQGKEILSRSPCLFFRPSLTFLSCPVASPSVYQEHPWWLQLPRRRLHQVQPGDGRIHPPASTPHLVHPRALLLRQVHKIHSCRERGALRPDCMDPGRIDAVRRCPASLARARAPRLPPRCADPGGAPASTAAPLRPRCTKPACTPMPGAPSLWP

SEQ ID NO: 113237 - protein, 92 aa, Triticum aestivum
  unsure (1)..(92): unsure at all Xaa locations
  Clone ID: PAT_TA_7655.pep
GSXKNGXFYXQGLXGPSXXTRLDTFXTKFRGGXPXIXLPRXQELVRFTXXXRMWSPXSESCVWADXPLSIYXXIVLISPSPXXXFPFLGSSY

SEQ ID NO: 113238 - protein, 279 aa, Triticum aestivum
  unsure (1)..(279): unsure at all Xaa locations
  Clone ID: PAT_TA_7656.pep
RLETGTTPIAKXPYKMPPHVLIELKEEIYKSLIKGSIRPSCSPWGAPSLFVKKKDGTNRLVQDYRPINQATIQNKYPLPRINDLYDQLAGSSVFSKLDLRLGYHQIRVREEDIPKTAFVTRYGSYEYTVMSFGLTNAPATFSRLMNYIFMDYLDKFVVVYLDDILIFSKNEEEHAEHLCLVLEKLREHQLFAKFSKCEFWLPEXPILGHVISKDGIAVNLERLHVVLDCSPPKRKRQKFSPAPLRGWVTTRSGSATGIAQSPPSWLASPHTSTPSCLSV

SEQ ID NO: 113239 - protein, 63 aa, Triticum aestivum
  Clone ID: PAT_TA_7657.pep
QLYIHIFKQSYKRQQPYYIIRQQALLHVMWGRTNMCVRSLVPTTFLNPKPQANEMVSRRADAT

SEQ ID NO: 113240 - protein, 153 aa, Triticum aestivum
  Clone ID: PAT_TA_7658.pep
SPQDFAVGMSIYEASTAGPPFSFPALATPSPFRQTHLLRLHFAYVGITLPLTIWPVPQVGHQMLRTCHIMLGYGGNETIAWATSHGPRQLKIRGEKSCTPACVRGWARRAFACASAPGPPHLNMTGRTDGVGKTLDRETAASGITRPLCRHGS

SEQ ID NO: 113241 - protein, 189 aa, Triticum aestivum
  Clone ID: PAT_TA_7659.pep
WIPRAAGIRHQGTATTSTATVLVILVILSCGLPAGHANAVFISRTCKKTNNAALCKQVLQLNQDSVKASTVHDLASIALGIATSFTTFQANNIRVGAKFNQGTPVGDALSVCLRAYSDAEDDLRYKAKRSFDRGDYADASKIVMGAKAAGYVCDNTLKRIKKDFHAEVDRYMKERCGVAAELIGLLIHK

SEQ ID NO: 113242 - protein, 155 aa, Triticum aestivum
  Clone ID: PAT_TA_7660.pep
MLAPRAAFRVLAVRGTCVQGLASCHDHLAGKPFPTPPAREREKLPTEEILSLPMFKIFTPGNPASVSYIKFLAKDGALVDFYYVLGSVLESLDAARSGLSIKLMQEGRMRGQAFVTFPSVELAQRALNLAHGYAFKGKPMIIQFGRSPAATKTSS

SEQ ID NO: 113243 - protein, 62 aa, Triticum aestivum
  Clone ID: PAT_TA_7661.pep
YFDITICMISLFSLAILITKEGGNLYFSYCLLLLVKKELSDPSSCVCLLLDPAHLLARAEFL

SEQ ID NO: 113244 - protein, 44 aa, Triticum aestivum
  Clone ID: PAT_TA_7662.pep
VFSNINLAISCIAYHDHVAIFAAVVKCIICTFPVFLFLLGRIRR

SEQ ID NO: 113245 - protein, 150 aa, Triticum aestivum
  unsure (1)..(150): unsure at all Xaa locations
  Clone ID: PAT_TA_7663.pep
MAAPMLNQPNGLLANMFAAGLLDDQFQELQMLQEGSAPDFIVKVVSLFCEDGERIIGEIAKLLDKPCVDYDKVGGFVHQLKGSSASLGAQRVKNSCIQFQQCCQEKSRDGCLNSLQSVRNDFYDLCSMFKXMLQLCQQVQALILKYRLER

SEQ ID NO: 113246 - protein, 61 aa, Triticum aestivum
  Clone ID: PAT_TA_7664.pep
NLISIFAERATCQNLWSLKQVTETQIRYNIGLHIVSTVWDPPVIGRDIFTFSKTPDVSLPP

SEQ ID NO: 113247 - protein, 137 aa, Triticum aestivum
  Clone ID: PAT_TA_7665.pep
CGVHRTSPFFSPRRGDAPGWRLRAMVPLEQRQRARRLLWSPWILRRTPSPFLGVMVVRPQPWCGFVYTTAPSPLGSCDARRMSIRITTGGTDGPCRRAWGMETAKLYSLQCCFINALILWDGGFHKRSYIMGRREYV

SEQ ID NO: 113248 - protein, 180 aa, Triticum aestivum
  Clone ID: PAT_TA_7666.pep
ANSTSSPRLYNGKPSHHPAHETGKHLHVQQQRSKTGTKGVIGGAVSAVPSATTCPSLAELTGRRGCQPPERRCCRAQGRAPMAYCRVQIVRPPRLSVQEQYNPWWLHSAPESARLQMLYVLLEPHGALARCCLMLEDHGSLARYSVLENRSLQRSKLKSSHVLAHELELRQKKLNHHHGT

SEQ ID NO: 113249 - protein, 288 aa, Triticum aestivum
  Clone ID: PAT_TA_7667.pep
MEETPPQPQAAHASPPFPAIFTPPSALSSTSLRGSPTVPSPAHFSTPPGPPVFSSPLRPAAVPFRTTPISPQAVPLASRTASSSSSVSLPTSSEPHTMNGAATPHSHAPSVAPSLEDSSIDSPYVLFSARKVLKQKKLLNAPSLGFGALVSPGREVSPGPEALERDPRRCLNCGAYVNLYCDVLIGSGQWQCVICKKLNSSEGEFVVSSKQDLVQWPELMSSTVDYVHPRNRRPGLIPVPVLRVSGPIFILIDECLDEAHLQHLQGSLHAFVDSLPPTARIGIISYGR

SEQ ID NO: 113250 - protein, 150 aa, Triticum aestivum
  Clone ID: PAT_TA_7668.pep
SARGLLPIVSSCPYPISYGDDINKYVVGTGRPRSLQRLSCLLLRCSRPAAQQLPFLTSVSSFPYPYSVWWHARLAAQMSVMPTADSTRWRSSGRKAAKSAPEPGVFFGGGAGGLSFSWSSEVGVREDTRGWDEKGTGEGFGSGQMLYVIC

SEQ ID NO: 113251 - protein, 81 aa, Triticum aestivum
  Clone ID: PAT_TA_7669.pep
LSKFLNTILGCLTSMSRTKRNISSHQYYSFVNLARAGAPVMFWNYPHHIIIVLTGQQAKYSLSTLYLWKAYLELGKVIQKN

SEQ ID NO: 113252 - protein, 74 aa, Triticum aestivum
  Clone ID: PAT_TA_7670.pep
NFWPVFIPLIENLLQTEATRKVVLGVKNHSLFLIALSGRKWLQRETKGMIHLRLLPFWFFPREKRVSDRGGQMI

SEQ ID NO: 113253 - protein, 240 aa, Triticum aestivum
  Clone ID: PAT_TA_7671.pep
EHFCFLVILPLLGLAMALQLTAPCQATQPQPQPIYDTEDHALTGDNFYNLMPVDLLLNGQCVNHSSIWKSGCPRNVNLALCDDSTSSRSVAVSIKLAAATNGSDKEASPRLSTDVVIEFGDTVNKCKQRLQWYVGAGITHNLHVTVGHFINTEGSDVLTDGRDQKFIFRVERYHGAYKLTSCYAPGCKHEPCGCRDLVLYKYNKKWWLVVKEKGWQGLPLVVVFEKCPRPCFPPKGLPHE

SEQ ID NO: 113254 - protein, 283 aa, Triticum aestivum
  Clone ID: PAT_TA_7672.pep
AGPPARWRAGTSPARACRVPTAGEAALRPPSSYRSPCDASPVVVTRRLGCRGRADRLGLRSPDAGRLLPLARSSAPGPRPWRVRRQAVWPRFALQVPGVVPAAVPPARGRSGRSPGHRAPARSLAVACCPARRAAACCGLLTVSTRVGGVPEVLPDDMIVLAEPDPEDMVRAVRQAIDILPGIDPQIMHRRMKKLYSWDDVAKRTEIVYDRAMQSSNTNLLDRLPRYLTCGAWAGKLFCLVMIINYLVWCLLEFLQVFLFYLGISYFMEIDEIITGFLSLSAC

SEQ ID NO: 113255 - protein, 264 aa, Triticum aestivum
  Clone ID: PAT_TA_7673.pep
MRKTSLPPLSCWLLQAILRHVLQCGPGIMDKHIENLLHKDQRLYLLSQSTKNSYRSNYDNLFETGQTRQSLPLQPMPTGTMTLGLNDSGALQGVHFQSSGQRAPLKEDMLNWKYFLGTPLGSQPTSMSNSNAGIMYSNFGNRFDNHISSWNLSPSADYSSLREMYDLNGSHTLLPSNSNLSSETMTLEQLRENLLSDNEIVNVVDEEDLMSMVNSLSCLIGKSSHSQANNNLVAPPPLDLEPTQVINVPPPGSSPPWTEWPGSP

SEQ ID NO: 113256 - protein, 132 aa, Triticum aestivum
  Clone ID: PAT_TA_7674.pep
SHRSLALRRPRTDSSCFAAADPFDAANPFAAADLIATIRLRSRRRSRRYDQLGEPPPIPFRIRRRSPSRAQSTRSSAKILSPSSCYGRGSAARRCGAWQRREGGQEQRGRVLPGGRRVARHGRVTQLPVPRA

SEQ ID NO: 113257 - protein, 167 aa, Triticum aestivum
  unsure (1)..(167): unsure at all Xaa locations
  Clone ID: PAT_TA_7675.pep
VAGRGGPRGRGHGRPVGPSPAADQPLVRISGRRNDLYTLVMTDPDAPSPRRPALYALLLSVPVAPPPGAPATRGDLLGPVVGPPPPAGAPRGVLVLPXLGPRPPVGIHRYVLVLFEQKTRFPYVEAAPPEERAYFNTRAFAANHELGLPVAVVYFNSQKEPSGHRRR

SEQ ID NO: 113258 - protein, 180 aa, Triticum aestivum
  Clone ID: PAT_TA_7676.pep
MGAFGSKDNSSGRHHHHCNQDHSKNAAPGGKDRFAKFGDDYHTLEQVTDALSHAGLESSNLIVGIDFTKSNEWTGKVSFHNRSLHAIGNTPNPYEQAISIIGRTLARFDEDNLIPCFGFGDATTHDQKVFSFYPENQPCDGFEQALGRYREIVPQLRLAGPTSFAPMIETAIGIVDSSGG

SEQ ID NO: 113259 - protein, 81 aa, Triticum aestivum
  Clone ID: PAT_TA_7677.pep
AAIALVLLFLTLGGEAELCKQRSRTFKGRCTHNDNCFAICLTENFTGGYCHGVVERHCMCTKKCGEPPEEPEEPPLPEMMI

SEQ ID NO: 113260 - protein, 114 aa, Triticum aestivum
  Clone ID: PAT_TA_7678.pep
GSLGPCLMLGTTPFQTSLLLDAKRISPRDWNYVPLQFSIQTFLWLELSSDKIVLVSGCKMYFLLQLRKRVSKKGKPRASLKFQKDYFLRYLSPANLSSTQGWSLERHSLRGSSD

SEQ ID NO: 113261 - protein, 269 aa, Triticum aestivum
  unsure (1)..(269): unsure at all Xaa locations
  Clone ID: PAT_TA_7679.pep
XDXLXXXXTLXKGNKSWSSTAVAARSRTSGSPGLQEFGTSYNTRPSLSIPLYLPLPKDSSRFVSSLLTMAIMPPTSIFFSVIVFMLLSNAINTQAGGSGGGKPKATSLVVEACKNASGETQDPDVTKEFCLSTLQSDKRSAEAKDLPGLVLVSIDILKGRVTDAGVKVKKMLQNAKKGTMAMYALSICELQYENVVSTLNICQAMIKDHQGDKGVLHSLRLPYCVDISGDTSRECQTALEDVPGAEALQTDNEEAAHSVQPQHRLGCTI

SEQ ID NO: 113262 - protein, 385 aa, Triticum aestivum
  unsure (1)..(385): unsure at all Xaa locations
  Clone ID: PAT_TA_7680.pep
KVVRGRGRNKXRKWTMDEDEELVRALCEVSTDARFRAEGGGFKNCYTQGIESLLAQRLPGRGIKASPHVDSRLKVLKRKFHAIKEMLASPGFSWDGSRKVVRCEKQRYDEYCKDNPRARGMYGVPFPHFDVFDAVYGKDRAAREVVEVSEEATADMENGNTSEAGDDEGEEDRXSNGPSGRSLDATSSYKKQERCKNGGKRKRAESNCPSPDTLKDVRGHYQRASQHVDTMAEAMELFKDVHRHFQSVVQHAGAMAAAMEAFKGAHDQFQSVVQNASTAATAMEQFKDAHDQFRSITQNGSATEAVIEPHADLRERLSPEVPQQDARVRAIAEMQKLGFTGSEVVSAASVFAKEPDQMGMFLALPEIYRREYILKMLNGGQSLHF

SEQ ID NO: 113263 - protein, 154 aa, Triticum aestivum
  Clone ID: PAT_TA_7681.pep
PAAAYDGVEPQLKPLRPQQCAAVGRPRRPDLGIPLHKSQLLYYCAPPSPTKPRRIRERPTSLTPQCHRPEGAPRRRERSQGEPYPTALTSPLPARQCQNKILKQHYLQPRRGRTLSRTPPRARRLTGGDGDQRRQHAWKPPLASGERPRDFHRV

SEQ ID NO: 113264 - protein, 207 aa, Triticum aestivum
  Clone ID: PAT_TA_7682.pep
TRLAAPAKPPLPSPHEARECDDEAHQERQQRSQNQQAAQPLQQTAVESRGRGRRREGGPSRRRRAAVFSPRSGPSISFLSPRCSPPADPASPGRRSFHSARGGERERRLWTNRGKAKGGVEILRVSALGAPGSWISSSSRSSARPGRAPGVRERPWSATRRPTEGMWLRRATSSRRTLRRPQGLGVANGGGAWCGQRGRGGWGGRGG

SEQ ID NO: 113265 - protein, 165 aa, Triticum aestivum
  Clone ID: PAT_TA_7683.pep
DADSGQLSIPFFRPAALSILSRIPVVIPVQMAASAMCSQSCGSPLPWLLRPPLLPLVVLPPVYPGVGPTSGRALVGSPAAGCRAGCLRGRGCIPRPLSPCVVLRRIGLFAPSLLLVCVLGSSLGDFVGHVVPGVPLAYVPASFLVEATGPVASLGRLCTVSCIPH

SEQ ID NO: 113266 - protein, 216 aa, Triticum aestivum
  Clone ID: PAT_TA_7684.pep
MPPSGLLSYIPTSLSSILPVRGCAAPPSPSPPTPPASPAPSKMSPSVKAADRAELARVFELFDRNGDGRITREELEDSLGKLGIPVPGDELAAMIARIDADGDGCVDVEEFGELYRTIMSTGGGGGQKGSSGEEAAAEEDEDEDMREAFRVFDANGDGFITVDELSAVLASLGLKQGRSAEECRRMIGQVDRDGDGRVDFHEFRQMMRGGGLAALA

SEQ ID NO: 113267 - protein, 151 aa, Triticum aestivum
  unsure (1)..(151): unsure at all Xaa locations
  Clone ID: PAT_TA_7685.pep
TKVSEHVFPTMSLGWRGLQRGWRRRPSSSGLQTCRWRPAAHQCCRLLSWCNSTPQRRTPSTHRPPPGSWSWEQGYRIPPSAPATRRCDRGRSSPGSRYRSSREAYRDLLLFEACSGGSGGRRRSGTAAVRRRRRRGVGRAKDQXSLVPNSS

SEQ ID NO: 113268 - protein, 171 aa, Triticum aestivum
  unsure (1)..(171): unsure at all Xaa locations
  Clone ID: PAT_TA_7686.pep
MLRRHKGRESASSSDSTFYQLRPDCAHNVPDTKFKIKIGKTLSVRKWHAAFTHHGSLHIASVLNRIQSGGVHPAIRGXEVWEFLLGCFDPDSTFDDRDHIRQARRIQYARWKEQCKHMDPHVGSGKIITAPIITEDGVPIKDPLGLLEAATPGPSKLVDYPMEMTPTTPDG

SEQ ID NO: 113269 - protein, 219 aa, Triticum aestivum
  unsure (1)..(219): unsure at all Xaa locations
  Clone ID: PAT_TA_7687.pep
QIRHEAREQVIRELXKIVTDWAKTVACEERVPPRRVTATVLTYGSYTLGAHGPESDIDALCVGPCIANLPQHFFVVLRQILKCRPEVSGLQTVENAKVPLMRFRFSGISVDLTYAQLPVLDAVQAINTSSPQYLRRLDSRSWKSLSGVRVNEQIVQLVPNQEKFQVLLRCIKLWARRRGLHCHLLGFFAGIHLAILAAYVCQKFPNATANGLFTMFFEI

SEQ ID NO: 113270 - protein, 115 aa, Triticum aestivum
  Clone ID: PAT_TA_7688.pep
MRTGILIIIIFATIVVAYPFATSAEEEWYPIGDPDNEPHVQELGGWAVAEHVKQAHDGLKFINVVSGAEANAAGVKYRLDIKALKNNGQPGAYRAILLEEVRDNERTLISFEPTN

SEQ ID NO: 113271 - protein, 145 aa, Triticum aestivum
  unsure (1)..(145): unsure at all Xaa locations
  Clone ID: PAT_TA_7689.pep
SSSRLLQPFCETHSRIIRGCVLLHGLVFMPDSKLGHLGPVQCPQTFWKLLPQLSSPHQRMKHPVLEQLQGIEIGCVLTAFLQSLSSMTPLPQVASRLMFKAVSHSMANSVACECNPTKSRDYATHSYCSVFWFKLNXKTTASCKF

SEQ ID NO: 113272 - protein, 309 aa, Triticum aestivum
  unsure (1)..(309): unsure at all Xaa locations
  Clone ID: PAT_TA_7690.pep
SLEESKTSEAHSDAINHLRNIPGNDSCAECRSPDPDWASLNLGILICIECSGAHRNLGVHISKVRSLRLDVKIWEPVIIDLFXVHLGNDYNNSIWEALLPKEGQGMDESNSAIXSWEKPKPTDAFSIKERFIQSKYXDKLLIAKDANQITIGILEAIRTNDVRAVFRILVLADASPNMTYDELNNDVNHVLPVTDRKLFDPASCEKIEDSGRPEGCLQGCSLLHLACQHGHPVLVELLLLMGADINKRDFHGRTPLHHCVQKSNDALTKHLLKRGARTTIKDGGGLAALERRMELGAITDEDLFILFVR

SEQ ID NO: 113273 - protein, 64 aa, Triticum aestivum
  Clone ID: PAT_TA_7691.pep
KRKSKNFKDELALTLKDVESLFPVATPDQPPEEGDKDHGDSLRSLPPSVAAGLAAEMRAINGAT

SEQ ID NO: 113274 - protein, 192 aa, Triticum aestivum
  unsure (1)..(192): unsure at all Xaa locations
  Clone ID: PAT_TA_7692.pep
VTVSDSEGYLFDGDGFDYVKYTLIRNIKAQQRSLKEYLKTFPRAKYINDAKPWGERCDIAFPCASQNEIDQGEALSIISSGCRVLIECSNMPCTGQAVDILRKAKVHVAPAKATAAGXVGELELNPEFSLMQWSVEDFENKIQEAVKQTYDRSMKAAQEYGILKENPESLVHGANISAFLNIAQAMTDQGCV

SEQ ID NO: 113275 - protein, 151 aa, Triticum aestivum
  Clone ID: PAT_TA_7693.pep
APLPHIAAGGRRRYTLVLAWPRLHEVVLDPAGAEPFTRAHASIPAYAYYNQDREANEVMLRAMTSVSEPFMDVLLDGYCPGGGFEGVATLVDVGGSSGACLAMFMRRVPTIRQGVNFDLPDVVAAAPPITEPNNEKISAWGLVNKIGGGED

SEQ ID NO: 113276 - protein, 49 aa, Triticum aestivum
  Clone ID: PAT_TA_7694.pep
HVKNASMGKFNTFTRKQPRHVNNTILPREQSTGNLKRFDYDTTLFPIVT

SEQ ID NO: 113277 - protein, 105 aa, Triticum aestivum
  Clone ID: PAT_TA_7695.pep
ALLAYGFFHRGLIPGLCFGAGLGITLFGMAYMFVHDGLVHRRFPVGPIADVPYFRRVAAAHKIHHMDKFEGVPYGLFLGPKELEDVGGLDELEQELARINRTRSI

SEQ ID NO: 113278 - protein, 128 aa, Triticum aestivum
  Clone ID: PAT_TA_7696.pep
MRTTSFLLIVVVVIVYAIGVPATGCGESMGTRLWNTTGANGWEPIKNINDKHIQELGNWAVLEFSKRVNCLVKFNKVVSGRQQLMSGMNYELIIDVAHFEGKDGKYKAELHEQELTKKRQLLSFMKVN

SEQ ID NO: 113279 - protein, 249 aa, Triticum aestivum
  Clone ID: PAT_TA_7697.pep
MASVQLCGAAAVGAAGFAGKGAAAVEPRRVAAPAARRGALRGLVARAATVVAPKYTTVKPLADRVLLKTKTAEQKTTGGILLPSTAQSKPQSGEVVAVGEGRTIGDSKVEVGIKVGAQVVYSKYAGMEVELNDSNHLILKEDDIIGILETEDVKDMKPLSDRVLIKVAVAEDKTAGGLLLTNSVQEKPSVGTVVAVGPGHLDEEGKRIPLPVSTGSSVLYSKYAGAEFKGADGTNYIVLRVSDLMAILS

SEQ ID NO: 113280 - protein, 111 aa, Triticum aestivum
  Clone ID: PAT_TA_7698.pep
PPLFLFRNNYLIHLYMIWPYKELSSISTTLVIATHNMHQAYSGLHGPYSYMYMDCTRMLDTHVHHLRVHQKRFPSGHFANHAGHTIGHVCLLPYFLVLVAMAWQSTKPWSL

SEQ ID NO: 113281 - protein, 177 aa, Triticum aestivum
  Clone ID: PAT_TA_7699.pep
MSMVLLLILMSIEKNKGIQDDPLELFYNLIESLIDEQKNTIRKMGLGSLLELKCSFSPIGIYHWLAFHFDTVTRTINLENSFLFNITPNTIQIVLGIPMGKKILDKNCSTENYILVHDIIKWEGNSPSVKDLCSMIKPDMQIDMFTKTFFLLAMASFLCPSSDSLASSQYYSVALML

SEQ ID NO: 113282 - protein, 113 aa, Triticum aestivum
  unsure (1)..(113): unsure at all Xaa locations
  Clone ID: PAT_TA_7700.pep
GPIECVKSHVXKKVVIHEFRGKQSENEFLEFVSSSAEKLRSLLVVITREMFASAWDFSISLPNEVNEVIVKAGALTRGAWACEDCQLVVAGPKVVDGWSFRRASDPSVKDPFR

SEQ ID NO: 113283 - protein, 77 aa, Triticum aestivum
  Clone ID: PAT_TA_7701.pep
GKSVDYWDVVAVPWDDDVLLLVKFDDCLLQVDIHGKLVASFCRRGLGPTNLRIKQTLVQHAFFPTLEGYVVNSLPFV

SEQ ID NO: 113284 - protein, 79 aa, Triticum aestivum
  Clone ID: PAT_TA_7702.pep
GGIPRIKGVKLRGVIASFTKWPLADSQVLSVNRSPTILTPSQCTYLWQNKRSTHKVLSQSHRPTFVSTHESTEKMKILA

SEQ ID NO: 113285 - protein, 201 aa, Triticum aestivum
  Clone ID: PAT_TA_7703.pep
PALPLALRQGASLQEPPPAPPAGSLSAMSSARRPGSQALVRAPATAAAPGPGKECPPEVGPDFSPPTTRLGPPPWAVIAGPPPRPRRRRSTSRPGSACSDRAPWSAFPEEPKAQAAVKCARPRSVRTLRASQSNKAGSLNQSKANSGADPFAFGQDSFKAVPSGTVPSEMSNLGNASQSLNTLKAEVEKDAPYQPAGWTGF

SEQ ID NO: 113286 - protein, 363 aa, Triticum aestivum
  unsure (1)..(363): unsure at all Xaa locations
  Clone ID: PAT_TA_7704.pep
VIAKHDQIVSGIDWSRSSNKIVTVXHDRNXYVWTHEGQDWVPTLVIFKLNRAALCVQWSPKENKFAHGSGAKSVSICYYEQENNWWISKVIRKKHESSVTSVAWHPNNIHLATTSTDGKCRVFSTIIKGVDTRGSFSSFLKDXLAINTASTHSKCFSCLILSLFLIRGPQAGASVDWKFGEQIAQLDLSPTWAFGVRWSPSGKTLAYAGHSSMIYFVDDVEGSPAAQNLALRDLPLRDVXILFVSEKMAIGVGFDCNPLIFAADETGLWSFVRYLDERKVTPSTSKASQLPEALGKLYGQSRQGSSSDTVEPSKPRGGAHENCITCIVPLRKGSESIVKRFSTSGLDGKIVVWDLENHITIPK

SEQ ID NO: 113287 - protein, 102 aa, Triticum aestivum
  Clone ID: PAT_TA_7705.pep
AGQLLSMEEDLVTDLDDDSWDLVWRDLRLKATFLYIDLSRVISRSENDERRKALTLLANKFFYCTDELCDAVTSRSVPVVKMCYNDTAQALRELLAALAPPQ

SEQ ID NO: 113288 - protein, 114 aa, Triticum aestivum
  Clone ID: PAT_TA_7706.pep
KHYQLLLRSSMGPIDCFLISDHQGVSDPEQVAQDNLGHASTAGGSDAPRPVDDHPSQAPEKGEGDTVGKHTSEPSSTHEPMSGILKILLPDTDVDADYWLASDIDATMTETWAT

SEQ ID NO: 113289 - protein, 231 aa, Triticum aestivum
  Clone ID: PAT_TA_7707.pep
ARHIFLYPIISTTLDFSIFEGILATLGTMGTLEASIIFMLLSMIVSAQAGSSGSGKPKATDLMVEACKNASIDYYIATVPQEFCLLTLQSDKRSTNAKDLHDLVFIAIDITKARVIAASGMVKKMLQNAKKGTVTMRVLTLCEVDYEQMASILNICDAMIKDYQGYKGEMRSHELAGCVAEAYSPAAYCQTELNDAPKEVALVKENAELQMLVHMSANFLEPLTLPEEMLF

SEQ ID NO: 113290 - protein, 243 aa, Triticum aestivum
  Clone ID: PAT_TA_7708.pep
APPPPADGPAALPPPPGTDMTGICFRDQLWLNTYPLDRNLVFDYFALSPFYDITCNNESLRSRQIHPLDMSQLTKMTGLEYVLSEVMEPHLFVMRKQKRTNSEKSDPLLAYYILDGSIYQAPLLGSVFASRISRAMHHISKAFSTACSKLEKIGNAETEADAAASESKAQKETIDLKELKRVDHILMSLQRKLPPAPPPPPFPDGYVPSEQEKGPDDLLASEPLPPAIDPIIDQGPAKRPRFQ

SEQ ID NO: 113291 - protein, 208 aa, Triticum aestivum
  Clone ID: PAT_TA_7709.pep
MAPAALSAPVLRVSPQSAGRAAAAAPAGGLRFGQTACLHSGHSGQTVLRSKVLLQRPVGQRRRSALRSSVDDSKATDDKVEFGYSRKDVLLIGVGVTLLGYGLKSGLEFVGVDPLQAGNVVQLFIVLGMTVGWISSYMIRVANKDMTYATQLRNYEKQVMEKRLESLSEAELQVLLEQVEEEKERLPPMRRDQGITINRKTEDQTTAN

SEQ ID NO: 113292 - protein, 268 aa, Triticum aestivum
  Clone ID: PAT_TA_7710.pep
LPASAHWEQVPAALPVIIFTLVYHDIAPVICAYLEGDLARIRLAILVGSLVPLVSLLVWDDVALTLAASSTDPNSLGILDKLETEWSYAVVETFSLLAVGTSLIGTLLAASQFFIEQMTNLAPSAKIDEAASEEEGSTQLGWPTLLESNRLSFVATGAVVVPTMLIAAAVPDSFSIATDIAGGYCMTILYGLLPPLMAWSIVSKLSDQKAGLGQVEAASTAGKERVSFTGATAKPVLVGMGVFSVLMVFQQILQDLVSFNTYLLSWAS

SEQ ID NO: 113293 - protein, 70 aa, Triticum aestivum
  unsure (1)..(70): unsure at all Xaa locations
  Clone ID: PAT_TA_7711.pep
CHRRRRCPVPCTYLLRSSTSRTGTFDRARCSVNIYPCACFPGNNGAXRVPASLDARKEKMVNVAVAAKKK

SEQ ID NO: 113294 - protein, 131 aa, Triticum aestivum
  Clone ID: PAT_TA_7712.pep
DEHAAETKAGGRWRNQRVSSGSPSSMYSALKKDAAHIQYRYGGSSRATSLNTVPDPLLSSFVGSFIDDDADSRKDAQEELLEKVIEKSDASEQKAEESAEEPLLPEEKEERTKRSQFVQGLVLSLMFDDIL

SEQ ID NO: 113295 - protein, 188 aa, Triticum aestivum
  Clone ID: PAT_TA_7713.pep
AQAAMASTVATVAMALVMLAAVSSDILPVVDAHTGLISRTCKKTKTPAICVAMLRADRRTDGAMNLYGLASNALLIAIDTVYNNTRAIVDLFKGKEGTPEGGALDVCNQAYLEADNDLELQARLALDFLDYAGASKVILLAKDAGDMCEDAFKAINKKSPLTDMDRQMTERCGVTADLMDLLASKRSE

SEQ ID NO: 113296 - protein, 190 aa, Triticum aestivum
  Clone ID: PAT_TA_7714.pep
PWTFRGRIRTSALFDNQNWMLYQAPVQPCVSYTSICILSKPKEMMLTFRSDEVICSSHNNKEKMEYVVSYLKKVRSHSSLGPSCMHVAGLSMGSMALVNTNKAFDALLNYENCSFRCMPKHLRLTIHSLETSSLICIVTYSLYGKLHVHNVFVPCVMRSAVGYIPLWIIVSYKEWIIHLNYYTSINADDP

SEQ ID NO: 113297 - protein, 400 aa, Triticum aestivum
  Clone ID: PAT_TA_7715.pep
MGRRSGGRKLPFFSAASTSPSTKRTRSARRLPSLPKPSSPPPPSPTTPPPAPQTTTSPPAPSPGGSAAVAGVSGKVGKKKAGARLWMRLDRWGSSEILELDKASIIRRAGVPPRDLRILGPVFSHSSSILAREKAMVINLEFIRAIVTAEEVLLLDPLMQEVLPFVDQLRQHLPLRSLVGGNGEHGGDSNGVKQDGSPGDQVPCLNEATGAEHELPFEFQVLEVGLEAVCSTLDSSVADLERRAIPVLDELTKNVSTKNLERVRSLKSDLTRLLARVQKVRDEIEHLLDDNEDMAHLYLTRKQAQNQQVEAIMTSAASNSIVPAGASLPRLNSSFRRSVSIATSIYLDNDVEDLEMLLEAYFMQLDGIRNRILSVREYIDDTEDYVNIQLDNQRNELIQL

SEQ ID NO: 113298 - protein, 85 aa, Triticum aestivum
  Clone ID: PAT_TA_7716.pep
RTMEIPFSEKKEEEKQWRDKATVRHSNSDSKKKSNEHNMIQQSPCLVPAKPWPESCVQMSHYPCRAWVPINRPYASASGSRPAAR

SEQ ID NO: 113299 - protein, 557 aa, Triticum aestivum
  unsure (1)..(557): unsure at all Xaa locations
  Clone ID: PAT_TA_7717.pep
HLTRTVHHLLLRYPLPLRPRPPIAQRPPPPGQPLPPAGACRQPPACPSRRRLPSGTPGAYTTSRPPPPSSHLTSAVSADEAAPIEQENAASFVGDPERGTLAEESGRSDGGLTSRWREMHCCNDCDGLLDPIDRTLRGELIRYGEFSQACYDSFDYDRYSRYAGTCKYAQDSFFKDVGLAGVGYDVTRYLYATSHARFPSFGVQKHNPSDDRMWSETGTFIGFIAVSTDEETARIGRRDIAVAWRGTXSPKLEWIADITAFLKPIGQFGLPCPDPSVKVEEGFAELYTSKNPDCKYCKYSAREQVLAEVRKLVERYTGQGEEVSVTVTGHSLGAALAVLCAYDIAETRANVSTGGAKAPVCVFSYSGPRXVGNPMFRERFEGELGVKALRILNVHDSVPKVPGIFTEAVLPMPLLRVAGALGLPSVYSHIGVELALDHKLSPFLKDVFDLACYHNLEAHLHLLDGYQGRGKEFKLGGRDPALVNKAADFLMDEHMVPDGWRQELNKGMVRTEDGRWMLPHRPRNVEEHPEDTDLHLAELGLAAAVTAKATAAATANV

SEQ ID NO: 113300 - protein, 70 aa, Triticum aestivum
  Clone ID: PAT_TA_7718.pep
LSYPGKGDRNLLYLEGCQVTLGSTRLLPRRVLPLCVGKVLLYNIFASLSCFVKVLTWWTAFHARPSEHLQ

SEQ ID NO: 113301 - protein, 629 aa, Triticum aestivum
  unsure (1)..(629): unsure at all Xaa locations
  Clone ID: PAT_TA_7719.pep
RASPDDLDPQLWGDRSGPVPPGPGPRRPPGAAAPPLVPNGRSARGGGQAPPARPSPSVSSRSPPVPDAVPPGVAQPPGRSGGLVPRLNLPLRQAPAYVQPSGHQYTRDNRGRPRPCAGAYEEKFGARTPAHIEEIRRDVVLKYTEGLCWVMHCYYDGVSSWRPPDPDRYAPLPSVVSSLGLPVTPFELGPPLKPGXELYTAFAKSGDXSSFLERRLLMTEADAPFTVFYPHVSEVXCRHSRFPGSGXAPLPLVGGASCRTDCKGRVLPLPPVAARRIWVADFWLFVNGALPISPYIYSLSSKFGHLPEIERNEIKEDLNPVASGGMNGYISLCGGDPCPPVFRSPVDGLEDIMDNQVICSIYKLPDPHKHIARPPPGVIIPLKIVEAGDLKPPPVLWHEDNGRRPYDNNRKHCDNSSRQNPAGSIRGRQLGEAAHRLVANSLNVCGGGQYPPARPYQTIMNGMHYPNGMPPRMEQPAGRSGWHVPSDNLPNGQAPAYAQRSGHQYTRDNRGRQQPYARDSHSDSRGAGRHPSGYHQNSSNAYSSHTAPPSSGFGRYGQPPSYAGGYAGGVYQPAPYAGAQQWQQQPPHSSYSGGGAPAARPNSRPQQSQNRYSNLDRTSNRRPPGQGRY

SEQ ID NO: 113302 - protein, 279 aa, Triticum aestivum
  unsure (1)..(279): unsure at all Xaa locations
  Clone ID: PAT_TA_7720.pep
KLCLEVEEAKVQELIXKSVADTGAKFIVSRAAVGDMALHFCERYKLMVLKVSSKFELRRFCTYYWGAIALLKLSRPIGDEXAYADSFSVEEXSVIEILFSEATPIHDGLRLSTRXGSTDSILDDLERAVDDGVNTYKSMCRDSRIIPGAAATEIELAKRLKEFSLKETGLDQYAIAKFGESFEMVPRTLSENAGLGAMEIISSLYAEHAAGNVKVGIDLEKGACEDASIMKIWDLYVTKSFALKYSADAVCTVLRVDQIIMAKPAGGPRPPQQGGIDED

SEQ ID NO: 113303 - protein, 128 aa, Triticum aestivum
  unsure (1)..(128): unsure at all Xaa locations
  Clone ID: PAT_TA_7721.pep
SEGESFVLADWAWSLVRRGKTLDVIQEGMAEPGPTKVMEKYVLVAALCTHPQLHARPTMEQVVKILEADSAPGPLIIPDRPLPVVANLADIERSVSXSTGSGQLFSPSGFRSFIHRDEDATPESPKET

SEQ ID NO: 113304 - protein, 75 aa, Triticum aestivum
  Clone ID: PAT_TA_7722.pep
LLATFSGHLLFLASSQQDCDCAFLSAWSDLQAPSARAGMIRMQDVACIPKNPHPRLQNLPFLPEIPIPPHATSLP

SEQ ID NO: 113305 - protein, 122 aa, Triticum aestivum
  Clone ID: PAT_TA_7723.pep
YPARGVLREAPLGLLSFAPSSLALPAAGAALCLPARAASISRPVFGCPGPDIRGAWEAAAASYSTALGPPASIEALKEWISFPLAPADCGCRNPGVVFRPRAPGRRHRSSPQASTPTHHLNL

SEQ ID NO: 113306 - protein, 184 aa, Triticum aestivum
  Clone ID: PAT_TA_7724.pep
YPRRSAPRSGDIPQLLTLVPERDGEIWRQARRDGAPLPEPIPPPATPRLPPPQQPSRHLRRAEARDERLLGRAVPAAPGGGRPVAGGARVLEPLPAVPGRGRRAHRAQFPHSPQRSRRPRPGQAGGHRFGPRSPEPNRRYPLHHVPRGPALRRGSPHSLVLALSPGKLVSFIYHLSNYPLVSFI

SEQ ID NO: 113307 - protein, 188 aa, Triticum aestivum
  Clone ID: PAT_TA_7725.pep
NSELSGLRYIFSLLPLCPMDPFCQVGSFSPVTNELSFSMRSSSSTRPTNSIHILRRRRLSPLPRRTFHADLCDLRARYSACGRLPAAGRRGTSCRPCSSLALTITPPIPSPPPPSGCSDLSSPPHGCVPSPLAAPPWLIRWANSITLSALPSLAPLARTKLPCASPSGPHQIHLNFDRCFSFLFMAFF

SEQ ID NO: 113308 - protein, 126 aa, Triticum aestivum
  unsure (1)..(126): unsure at all Xaa locations
  Clone ID: PAT_TA_7726.pep
PLFFSTLRSDGSPSPSTSYTRRKHKERFIHAWPPERRTHGWSSSRRRRRSRRTHRRRRGTCPPPRAPSRGPRSCAPRSSPRPPAPARPARPPXXPXPARRHPHPFFFVFRRSGPXPPRRCQRTRPX

SEQ ID NO: 113309 - protein, 220 aa, Triticum aestivum
  Clone ID: PAT_TA_7727.pep
DFARLNALAEGEVFPPMVLGVTNLFFLRSLKSVPNVVSVGSPNPNSTRVLPAGGQSPASPNGSNGTPVRLKLDKLAINKFSPTSLLNSIKLRREGPLSLMTEHKEALWSTYVPTTKPDTSVLNRLIDAGVSPRIEESMSVVNNEILRRHFLELTTNFLSPFGPYLRTTTPLEGSSPFVDPPLLPPFHADEFVNGLASRGPGKFLSKRMKSNWLDLYRKFL

SEQ ID NO: 113310 - protein, 169 aa, Triticum aestivum
  unsure (1)..(169): unsure at all Xaa locations
  Clone ID: PAT_TA_7728.pep
AAPPHRPLRPVGARWAPRHNFSGWAKLNGPFYKGXDYLAFYHPDKKLDVVEVDKRGFDLCDTRNPIHRYPGGGTRRGTTFVLLSEAKFYYFTCSVRYFCPAGMRLDIPVQERRRDDTPGTAMVESSATSPVPGPRGNSEGERDGQGRGRSDRGVQGTKWPDMESPRPGP

SEQ ID NO: 113311 - protein, 384 aa, Triticum aestivum
  unsure (1)..(384): unsure at all Xaa locations
  Clone ID: PAT_TA_7729.pep
HIGALILICCIALFARKPGVAKSGINDFGGLRPTALSIVYRLNNKIYSAITNAVKDSGGLKERLFRTAYNAKRQALVNGRNPSPMWDKLVFNKIKARLGGRVRLMTSGASPLSADVMEFLRICFGGEVLEGYGMTETSCVITTMDXGDKLIGHVGSPNPSCEGKLVDVPEMNYTCEDQPYPRGEICVRGPTIFRGYYKDEVQTRDVIDNDGWLHTGDIGLWLPGGRLKIIDRKKNIFKLAQGEYIAPEKIENVYAKCKFIAQCFIYGDSFNSFLVAIVAVEPDVLKAWAASQGIQSEDLRQLCVDPRAKAAVLADMDSIGKEAQLRGFEFAKAVTLVAEPFTVENGLLTPTFKVKRPQAKAYFTKELADMYAQLRDAESARQKL

SEQ ID NO: 113312 - protein, 137 aa, Triticum aestivum
  Clone ID: PAT_TA_7730.pep
RLELWFQNAMVSVSTFVAMFLAVLAIVSSSLLVAHADTDFISRTCNKTNNTALCIAVLTAKPQSSHAPTEHDLASIALKIATNTAKHNVKVISDLSKNNQSTHRGSLQLPSASRLTLKPLSALEIYADLYFERRVLL

SEQ ID NO: 113313 - protein, 214 aa, Triticum aestivum
  unsure (1)..(214): unsure at all Xaa locations
  Clone ID: PAT_TA_7731.pep
DGLLADYASGIAAXPGSGWTILRGAGTEDDIRITYRKNNDDSNNAVVSVCASFHLPVPLKVTFDLLRNNLLRPKWDVLVNGNSVREEVAVCKGVGAGIDDVVSILHLKDPPTGENRDNIMILQNSGYDVSGAFMVYCPVNIQLMNEIMSPSDTAASNKVSLYPTGFHLLPVEDTALGLGEGGATLVTAGFQIMLKLAPWAPACILRSASNGRPV

SEQ ID NO: 113314 - protein, 32 aa, Triticum aestivum
  Clone ID: PAT_TA_7732.pep
FFFEAEDLPHRLIKEKRISQLINGKPGENRYI

SEQ ID NO: 113315 - protein, 223 aa, Triticum aestivum
  unsure (1)..(223): unsure at all Xaa locations
  Clone ID: PAT_TA_7733.pep
PLSPPDPSPTPSPSPPRPSPRALSREPRPLRPPPPPPPAASPPQLPRPPRPPPSPPPPPPPPPRPPRAGPPPPPPPPPRXPGGRFAPFLPPPCPGSASESISPTVRPPCYKPESVSILHGFVPPRRPIPRHLRPLPPTAPELPPSQSDRCALDLPPLAPXSASPPTPHPPNXHAPRPSPSRFGAPRRINALHPLPRPAGPPPRPAPLRPSRRTESPGLGLGDV

SEQ ID NO: 113316 - protein, 174 aa, Triticum aestivum
  Clone ID: PAT_TA_7734.pep
IIQKKMSNSYASPYTTTVLMASMASVQCGVIAVAAEHRLSAWALGFDIRLIGSLYAGVVASGMVIAVMSWCIQVRGPVFVSMFSPMMLIIVAVVGWGILGEKIRVGSMIGAVFIVVGLYTVLWGKGRDIVATETTEDDEEKKIGGGEASNGAVDGAAVSRPCPAADRHEATGQP

SEQ ID NO: 113317 - protein, 274 aa, Triticum aestivum
  unsure (1)..(274): unsure at all Xaa locations
  Clone ID: PAT_TA_7735.pep
SAPGGGLVYFAGLKGXYEIVVHHYIQQGEARKALEVLQRXTVPEDLVYKFAPDLIMLDAYXTVESWMMARNKLNPGKRLPAMMRYVSEPHAKNETHEVIKYLEFCVKDLNNEDPGVHNLLLSLYSKKADESQLLQFLDTKFGSGQANGPEFFYEPQYALRLCLQAKRMRACVRIYSMMSMHEEAVALALRVDLELAKAEADKVEDDEELRKKLWLKVAKHVIEQEKGVKRENIKKAIEFLSETNNLLKIEDILPFFPDFVLIDDLKEEICKSLK

SEQ ID NO: 113318 - protein, 94 aa, Triticum aestivum
  Clone ID: PAT_TA_7736.pep
EKVIEKTNKGPAGWTSSSTNSCSPLSPFFTTQLAERSRSGTGEGENPMAAKGMYSLFFCELGACPLVGDPTTATAHRTPRWWPGRAESRVSQNC

SEQ ID NO: 113319 - protein, 99 aa, Triticum aestivum
  Clone ID: PAT_TA_7737.pep
KLFPSTQQLAKMRTTQMLLLAIAILVLASDALMEASADISIDPVTCTSKIMPSPTPCENQSCNKTCVEGLGYLAAGWCVTQGCMCMYCPLPPRQLANGH

SEQ ID NO: 113320 - protein, 644 aa, Triticum aestivum
  Clone ID: PAT_TA_7738.pep
IRHEGATTMAALFEMASKKYTQHRCLGTRKLISSEFIEAADGRKFEKLHLGEYQWNSYAEAFKRACNWASGLIKMGHQLDSRAAIFSDTRAEWIIAAQGCFRQNLTVVTIYASLGEDALVHSLNETQVSTLICDSKQLKKLPAVSSKLHSLKHVIYIEDEPVEADTLNQLKHLTTLSFNAVEELGPTRPPDRGLPSSTDTAVIMYTSGSTGLPKGVMITHGNMVATIAAVRTTIPNLGTSDVYLAYLPLAHVFELAAESVMLASGVAIGYGSALTMTDASNKIKKGTKGDVSVLKPTLMISVPAILDRIRDAVFKKVAEKGGITKKLFDVAYKRNLGAIEGSWTGSWAPERFIWNSIIFKPIRAMLGGHIRFILCGGAPLSSETQRFINICLGVPVGQGYGLTETCAGAAFSEWDDTSVGRVGPPLPCCYVKLISWEEGGYRISDSPMPRGEVVIGGHSITKGYFNNEAKTNEVYKVDERGIRWFYTGDIGQFHPDGCVEIIDRKKDIVKLQHGEYVSLGKVESALQTSNYVDNIMVYADPFHSYCVALVVPPHQALEKWAQNSGISYKDIEELCHNDQAIKEVQQSLSKAAKAARLEKFEIPAKIILLPEPWTPESGLVTAALKLKREQLKAKFKDDLNKLYQ

SEQ ID NO: 113321 - protein, 285 aa, Triticum aestivum
  Clone ID: PAT_TA_7739.pep
MPTPTPTPLVLPRIRAVPEEGGAEEVGEEHKGDALVVAATTVASLDDLGKVEAQGAEEEVEERLGDALVDVSVAHQVKTEAQGNEGAETEGEAQGNEVVETKVEAQGEEGAELKDDTQGNEAAEMDVDKAGNGDDHTEARVDGDKGSLLKEESDNGGDDKKDANGEDELVSSLAGEGENQNLSDKVSNNSFMFDYTRGGDDSGTEEEQAEFIKELDRFYTMKLMEFKPPKFYGEGLNCLKLWRQVTGLGGYDQVTSCKLWRQVGESFKPPKTCTTGFMDPSATSL

SEQ ID NO: 113322 - protein, 92 aa, Triticum aestivum
  Clone ID: PAT_TA_7740.pep
LCLVHLRPGKSPACTFDADRSLDDFKPWAGFHQPPHQTEVAARQGLARPHPDYKAPHGLFGRLVKFDQLLQLVAQGHRVFGPSILRPEQLFC

SEQ ID NO: 113323 - protein, 219 aa, Triticum aestivum
  Clone ID: PAT_TA_7741.pep
SRCCQGINGSQPVSKIVILKPNPGKGIDQTVTSSARYLHQQPSTSQTPEYSGRETSKFSIKEVRRRFRIVTGETRRERNAAPADDLQRVSRWHSMIATKKSSGYHTQGSLADKSASNFKNDIARPSTSSKQKQQNGGETEISGHIAVPQDDSIFYKEAKKHLTDMLKDNNKSGNYPTAQVSKSLEGMLSLPHCDVSSPRNSRSGKCHTDLSPEETDSCL

SEQ ID NO: 113324 - protein, 574 aa, Triticum aestivum
  unsure (1)..(574): unsure at all Xaa locations
  Clone ID: PAT_TA_7742.pep
RGYIGLEYFGRTVGIKIMPLGIAAEHGYFLRWSRDDEWQTCALASDFGWMEMVEPVMNLYXGINGWILQVEHAKRFRWKGKDLEAIAFEIPQSYNRINGELERSGYQTNRFIYRDVSILLKSAPHAITEGVVAETVRIAMNETRNQYIVCRQGTPRWESSSEVTGPKKSMLVVSEFIGCSPSLSGAIRVNPWNVEATAEAMNEAISMSDQEKQLRHEKHYRYVSTHDVAYWSKSFIQDLERACKDHFRRTCWGIGLGFGFRVVALDPHFTKLNMDSIVMAYERSESRAIFLDYDGTLVPQTSINKTPSAEVLRIINTLCSDERNIVFIVSGRGRDKLGRAAASCPKLGIAAEHGYFLRWSRDEEWQTCAQASDFGWMEMAEPVMNLYTESTDGSYIETKESALVWHHQDADPGFGSSQAKEMLDHLESVLANEPVSVKSGQFIVEVKPQGVSEGVIAEKILISMKERGKQADFVLCIGDDRSDEDMFENIADIIKRGMVAPKTPLFACTVGQKPSKAKFYLDDTFEVATMLSALAEATDPEPMTGSTDELATAMSSIDIGGERSQSRGRPFDGL

SEQ ID NO: 113325 - protein, 131 aa, Triticum aestivum
  unsure (1)..(131): unsure at all Xaa locations
  Clone ID: PAT_TA_7743.pep
IESRIRQLLPPLRSHLSRRSSSTPEFLVEGTRSTPACGEGGKPPLLCGASALKENKGAAGKQSGCWKQXCLPMGPQSRAFXFQKIRVVRFPNXDSLXTKKIXXGKLAXGQNSXKLIVVPGSILCQQKSLQL

SEQ ID NO: 113326 - protein, 292 aa, Triticum aestivum
  unsure (1)..(292): unsure at all Xaa locations
  Clone ID: PAT_TA_7744.pep
HESVPSLCYSILFYFLVHQSPRWLLVRGRKQDAIETLQQIASLNGNSITSSFSMLHACTMNNDTAEESGGDSVFATLHSMWERPWALRRLAAIMTASFGVGMVYYGMPLNVGNLGSNLYLSVTYNALAELPSSILSWLLMGRINRRSSVIALTGAAGVWSLACVIIPQGAARMAAELLSFFATCTAFNVIMMYSIELFPTSVRNSAVGLXVRQALVLGGVAAPVLVALGRERSFLSFGVFGLXXSGCFGMFAACLPGTRGKGMSDTMDEEEHKEAAVAACTVDDADCNSDLV

SEQ ID NO: 113327 - protein, 121 aa, Triticum aestivum
  unsure (1)..(121): unsure at all Xaa locations
  Clone ID: PAT_TA_7745.pep
FSTRPGGLRLRPRSGGPVLVSAAAAETKCPALCPVLLFVGTLXAAAXVAXDXDERFLREMEINKAILEENEASSEEAADGGGEYVVNGDEAALPAAEKEQVLVTATGTGTRARNRPKREVY

SEQ ID NO: 113328 - protein, 93 aa, Triticum aestivum
  Clone ID: PAT_TA_7746.pep
RLPVVWSAILWQFFFLGAVGVIFCVHTLFAGILIAVFIPVTEVLAVIFLHEKFTSEKGVALALSLWGLASYSYGEYSDAKAAKKKAALDAQAS

SEQ ID NO: 113329 - protein, 132 aa, Triticum aestivum
  unsure (1)..(132): unsure at all Xaa locations
  Clone ID: PAT_TA_7747.pep
MQPPQPRPEDYSLKETTPCLGGFMAAGDKRTSTYDLVEQMPYLYVRAVKAKDLRAKDGSGSCDPSVEIKLGNYRCTTRQFEKNTNPEWNQVFAFPKECIQSSYIEITVKDKDDIIGRVIFDLSEXPKRVPPD

SEQ ID NO: 113330 - protein, 238 aa, Triticum aestivum
  Clone ID: PAT_TA_7748.pep
MEPGRKPRLLDLCIRSAVDNLRTLNSVDIVAEELLKRILPHCTLEQLTHIESCTHADLTDVTDVLWKRFFQREFGEDNMNLAIKRMKENGVRYKWKKLFEARTEKQKQVEARMSAGLKNKYQAANAAKQSKQIKVCTKIPPNSKRSFWGGSGSSSLSNSSYKSPILKKARMEVDSRAKMQAAIQRNTFARSSQPARLTFPSEQTSRTTTIHRPNSTITITKPTGPNRPIQKQNTRPKF

SEQ ID NO: 113331 - protein, 184 aa, Triticum aestivum
  unsure (1)..(184): unsure at all Xaa locations
  Clone ID: PAT_TA_7749.pep
SGAAARTRDPTARLQPLPGSAPARATDPRPPPEVPRTGGRQPRRHPTVPRAPNATSPXDPSMRSPLPLAVAPMLPPPPPPPPPPPTCPPRGAPSPHRAAAPPAWPRQREARCPSSSPGTGRTPPSRGTRPRGWRASSFRGPTRSPLTSAAASSTRSSSGRPPPLRVSFPSCARDLRCPWFIPWT

SEQ ID NO: 113332 - protein, 131 aa, Triticum aestivum
  Clone ID: PAT_TA_7750.pep
MAVLGIQLNAISIVNLVMSIGIAVEFCVHITHAFMIGIGDRENRVRQALSTMGASVFSGITLTKLVGVIVLRFAKSEVFVVYYFQMYLALVLIGFLHGLIFLPVVLSLCGPPQKTMKPIEQSQTPPSNEQT

SEQ ID NO: 113333 - protein, 88 aa, Triticum aestivum
  Clone ID: PAT_TA_7751.pep
PTNVREKQPLMGAEDFSFYTEAIPKTYYYFVGMPNETRGPQGPHHSPYFTINEDTLPYGVAMQASLAARYLLEHQPVTAAKVEPPDEL

SEQ ID NO: 113334 - protein, 457 aa, Triticum aestivum
  unsure (1)..(457): unsure at all Xaa locations
  Clone ID: PAT_TA_7752.pep
MSKTKGNHAVRFTLYFSMAIDAGLLRVALVLIAAAATWAAALDDPAGLLRRAKEAEFMDWMVGVRRRIHENPELGYEEFATSELVRGERDAVEIPYRHPFAGTGVXATVGTGGPPFVALRADMDALPMQXTVEXEHRSAVRAKTHGXCGHDAHVAMLLGWTKNSPENPRQLKGKSARPLQXAAAGGHGPRNGRSSSRGSALTPDHVGPARGLHVVPPAASVGLAVGPIGAAARGADGEAVGGDVEEQHQAPHHTIDPILAASNVIVSLQQLVSREADPLDSQVVTVGKFQGGGXAFNVIPDSVTIGGTFRAFLKESFNQLKQRIEEVIVTQASVQRCSAVVXDFLDKDKPFFPPTINNPELHDFFAKVGSEMVGPNNVREKQPLMGAEDFSFYTETVPKTYYYXTRGPXQAPHHSPYFTINEDALPIRCSHAAXLAARYLLEHQPATAAKVEPRDEL

SEQ ID NO: 113335 - protein, 242 aa, Triticum aestivum
  unsure (1)..(242): unsure at all Xaa locations
  Clone ID: PAT_TA_7753.pep
CFLARSYGEDAKSKSNLSQLSPFVPPVIDALICASDLARETPYRLLACPYKALSXIVRVRPLPRLASLSGXIGLMSHIMRRLNTVLHGHGAISSLKRKNQLEVLLCGLLNVLIHKLGSSKKFTLKWSAKCVLLLLCPLLTRDSTSARDGAALAIGALAHAIGGDFGQHMPMLLQYFSVKRLFPVYLEVMCDICQVLGKKGKKEEVVPSFDHIMDVLCQGMTELTLQPPILSSIGQIALALGE

SEQ ID NO: 113336 - protein, 118 aa, Triticum aestivum
  unsure (1)..(118): unsure at all Xaa locations
  Clone ID: PAT_TA_7754.pep
TNSPRIVESWTAPVVSDKPWSVIVGGGGVKSLLSVWEPPIMYLVWKILGTLGRYVDNESILSKLFTPVALLRALAPPPLPPPPSGRSSSFLHQPFVVLLVPTSSASKCRYMXXLEGEX

SEQ ID NO: 113337 - protein, 97 aa, Triticum aestivum
  Clone ID: PAT_TA_7755.pep
SLSYQRHKQVRMKIAALMLLLTLAYLVLGSNADTNRRCTFKYLKKFCGCQEDCHRILMCPENKECNLEAHIVGKLCRCTMCIDYSKAPIKETMMLTS

SEQ ID NO: 113338 - protein, 182 aa, Triticum aestivum
  Clone ID: PAT_TA_7756.pep
LTGPEVIEEVIYGLESGILFGISPGISKMGFVMSEMGFPKIVVPAAISCSVACSAVGFVYQTRGLKHGRAIVVSTCTSVASIVSGVVAGMVALDEHLPTAPAGRFFLLLGWFFIITGVILLVTSTRVIARLPKPVQKFLKSNMERSHSIRRPGSARGKDSNQSTTIHASTLHILTSTGKEKA

SEQ ID NO: 113339 - protein, 280 aa, Triticum aestivum
  unsure (1)..(280): unsure at all Xaa locations
  Clone ID: PAT_TA_7757.pep
MPAKGDVGIISNIISEAIRIHKDDHCHDHVSNESPSLGIDPPHDDVEHGYYDEDDDSDFDLDDAMRHFGLMANLRGYMAGGKEWVLDSGCTDHMTGDKDMFPELAESDGPRXYVTFGDNSKGKVVGLRKGAISHDSSIQNVMLVESLGCNLLSVSRLADFGFNVPFTEVDCQVFRRDNHNMVFXGIRRGDLYIVDFTKKAQPRTCLIAKSSKGWLWHRRLGHVCMRNLYKLIKGDHILGVKDVIFDKDRLCSACQAGKQVGGSHPVTNIMTMRRPLELLH

SEQ ID NO: 113340 - protein, 79 aa, Triticum aestivum
  unsure (1)..(79): unsure at all Xaa locations
  Clone ID: PAT_TA_7758.pep
XVRLVVLRFLLLVRLLDPNPAAMAEYCGKGAYRQPFCFDAWCKGLCWTKAALIEGGHVKDAWCYKTPLDAICVCLFCSK

SEQ ID NO: 113341 - protein, 243 aa, Triticum aestivum
  Clone ID: PAT_TA_7759.pep
MASRSSADEPSSLLMEENAVQVSVDAKLTVAAGRGNCQQLKDLLSTEDSKTMLVVMAPSIQASTVKPLPEVMSPLLLSSACSGAWQDLEFLLNRGHVRPHPSMNSSTKFHDLLTAYGSHSCSDKGASMQKASDDVEALLNLPSGSTVSLLDGVTIEGGTALHVVATYGESDGFLRSADIIHSKANHLLFAHNKNGDTPLHCAARAGMSRMVRHLITLARDENTGVNRVKELLEIENSLKETAF

SEQ ID NO: 113342 - protein, 144 aa, Triticum aestivum
  Clone ID: PAT_TA_7760.pep
LAPHITRGSFLTRLVTAEIVSPYHGDSHQVRVWGNPTAPSDSVTLRASPVISASGREINLPHIAAGWSLLPHPSLVAQGRIFRSGPDGRTSRPAVRSRRIRRSARGEKSHPGPHRVWRAGFPAAPWPTTQRVPLFWDSHQYGCG

SEQ ID NO: 113343 - protein, 167 aa, Triticum aestivum
  Clone ID: PAT_TA_7761.pep
MSGVKKVTDVAAKAGKAIDWDGLAKMLVSDEARKEFANLRRTFEDVNHQLQTKFSQEPKPIDWEYYKKGIGSKVVDMYKEAYDSIEIPKYVDTVTPEYKPKFDALLIEMKEAEKTSLKESERIEKEIAELKEMKKKISTMTADEYFAKHPELKKKFDDEIRNDYWGY

SEQ ID NO: 113344 - protein, 147 aa, Triticum aestivum
  unsure (1)..(147): unsure at all Xaa locations
  Clone ID: PAT_TA_7762.pep
MLVSDEGPEGVRQPSAAPSKHVNHPAPSTKFSQEPKPIDWEYYXKKGIGSKVVEYVQREAYDSIEIPKYVDTVTPEXYKPKFDALLIEMKEAEKTSLKESERIEKEIAELKEMKKKISTMTADEYFAKHPELKKKFDDEIRNDYWGY

SEQ ID NO: 113345 - protein, 320 aa, Triticum aestivum
  unsure (1)..(320): unsure at all Xaa locations
  Clone ID: PAT_TA_7763.pep
QEFGTNFAADDYSSVEGPSMERLFEKGGIFCTSNVTTMVFTGSTVGGGSAVNWSACIRTPGEVLQEWSRDHGLPLFAGQDYQQAMNSVCDRLGVTDECLKEGFQNKVLRRGCEALGLPVDAVPRNSSAVHYCGSCNFGCPTGDKRGTDTTWLVDAVLHGAVILTGCKAERFILQSNSGKNGRSKKCVGLLATCMSNGITKKLRIEAKVSISACGALMTPPLLRNSGLKNRHIGRNLHLHPVSMAWGYFPENKQAVPITGKSYEGGIITSMHRVTARTIIETPAXGPGAFAAMVPXWESGRDMRERMSRFARTAHAFALVR

SEQ ID NO: 113346 - protein, 412 aa, Triticum aestivum
  unsure (1)..(412): unsure at all Xaa locations
  Clone ID: PAT_TA_7764.pep
MGIEVVLQSSKEELDSSIVPPSSDNMETPDDKGDRLTELSGTINAESSLGAQSDNGISEPLEAADVNGDIEHDDSSATGHAEQNDDEPVADEASPIIIEKGDVVQHCVEISAHEQENQETFPATETAASDGYSVTSMEDVQPKKGAQSEPGDVSGYPPDLPSDKNSTGNGNVYENAKCVLTSSTKKMKRSASATTRKPLQATNRNSHPDDWNASTLTNSKSSNGKTTTVPSSPVFRCTERAEKRREYYSKLEEKHQAMEEQRIQLEARLKREQEEAPXGYSRKSLTFKSXPIPSFYHEAPSPQRLELQEVAQPTPTPXPEPLGKEKKSPPIEHLHSIPGGKSRRARAPGCPRAREQTRQPLANTNKQASKPTTSKQQTSLASNSIEAARPCPKVIGAQVCNFPFFFPRNTGQ

SEQ ID NO: 113347 - protein, 182 aa, Triticum aestivum
  unsure (1)..(182): unsure at all Xaa locations
  Clone ID: PAT_TA_7765.pep
LRARTAAPGLPPPLPPAPLRPPPPDPPQPAQSGCRPAPLRPPSPTRPQPPAFPPAPPPRAPPDRRPSPLRPSTPLAPHGXAPRLPPVPXSPSSASPAPPCSARTPSTSLSPSPPFPARTRPRPSKSPALLAASAGAPGFPGRGFRVSCRYRVELLNDTHQSDFQVLSLEDYQDPRVLPEQSN

SEQ ID NO: 113348 - protein, 145 aa, Triticum aestivum
  unsure (1)..(145): unsure at all Xaa locations
  Clone ID: PAT_TA_7766.pep
LIQGPTSSCCRPGAASPRCSAGTSARGRPSRTASGSAAPARVARAPPQFVEGIIREFKQQTKKAIAVYPNSGEVWDGRAKRWLPVECFGRKSFDVMARRWQEAGPGGVAGAGRPAPXTIRAVSKDAQEQERPVISSSEVQSRGLV

SEQ ID NO: 113349 - protein, 101 aa, Triticum aestivum
  Clone ID: PAT_TA_7767.pep
SARGSLVRWATPQLHDIDALSKMVDPALNGMYPAKSLSRFADIIALCVQPEPEFRPPMSEVVQQLVRLMQRASIVRRQSGEELGFSYRAPEREGDARDISF

SEQ ID NO: 113350 - protein, 199 aa, Triticum aestivum
  unsure (1)..(199): unsure at all Xaa locations
  Clone ID: PAT_TA_7768.pep
MHLLLTIHELLPASRDDGREQPSVDPPARLRLAVAASTAGRPAALPPTSSPGGNMIVCVAVVGHQNNPLYLQSFTEADDALKLHHVVHCSLDVIDERVNNPKKSAPTLNETFLGLLYPTENYKVYGYLTNTKVKFLMVTTDLDVKDADARNFFRKFHAAYVDAVSXNPFHVPGKKIASRSFXAREVSTIVKSFGSGTVG

SEQ ID NO: 113351 - protein, 249 aa, Triticum aestivum
  Clone ID: PAT_TA_7769.pep
ANSARGFVISKKKDRSLTSPQYQRRSVLEQANNSDFVPFVPFPPRDFAKKDAPAESTPDTGIVSESSPSADKLPETNAPSRHSGNSPNTSQVIGPQGSSITSNENSNRNYSQQSSSPGGYTRGGSSSQQYQQQPYGVGDRSAGTPNSGAWNPNYSQGTSTDVRGGSSNYQRQQQPHEGGDRSRGTSNTGALNTNHSPGRFNDGRGGASNYQHQQQPHEAGGRSSGTSNTGAWNTNYSQSHGRVNDQRWI

SEQ ID NO: 113352 - protein, 358 aa, Triticum aestivum
  Clone ID: PAT_TA_7770.pep
METTESEPAPELPAEEEMALIRDITAAAEAHAKEGDIFFLITNRWWQSWIDYVIHDLAGVPSNGSHHHEFGSNTPRRPGAIDNTNLLDDMASEVSDMQIELHDTLVEGRDYILLPQQVWEKLHSWYGGGPTLPRKAINTGLSQTDLAIEVYPLRLQLLLMPKGEQAVVRISKRVTVDVLRKKACEVFDLVPDEVCIWDYYGRTKHALMDNLEKTLDDANIQMDQDILVEVTTDANGSLDGACMSSIQEDYFGSTSTYLMTNASKSGCLNENLASLCYGSRSYSSSLMQSQYLRSSSGDLDNVPGTVGMTTRGSPSGLTGLLNLGNTCFMNSAVQCLVHTPEFARYFREDYHCEINWHN

SEQ ID NO: 113353 - protein, 491 aa, Triticum aestivum
  unsure (1)..(491): unsure at all Xaa locations
  Clone ID: PAT_TA_7771.pep
RPLLXAFNGTLPGALSNLTQLVALNLSNNSLSGRVPDLGLPALQFLNLSNNHLNGPVPGSLLRFSDASFAGNNMTRSAPVSPAVPPQSLAPPAAGAPAKKRTRLSEAAVLAIIVGGCVMLFAVVAVLLIAFCSRRGGDEGSRAGSGKGGDKKGRESPESKAVTGRAGDGNRLVFFEGPSLAFDLEDLLHASAEVLGKGAFGTAYRALLEDATTVVVKRLKEVSAGRREFEQQMELIGRIRHDNVAELRAYYYSKDEKLLVYDYYSRGSVSNMLHGKRGLDRTPLDWETRVRIALGAARGIAHIHTENNGKFVHGNIKASNVFLNSQQYGCISDLGLAPLMNPMTARSRSLGYCAPEITDTRKSTQCSDVYSFGVFVLELLTGKSPVQVTGGGNEVVHLVRWVQSVVREEWTAEVFDGELMRYPNIEEEMVEMLQIAMACVSRNPERRPKMLDMVKMIEEVGRNDSGTRASTEASTPVGEARNKAESSSAAP

SEQ ID NO: 113354 - protein, 552 aa, Triticum aestivum
  Clone ID: PAT_TA_7772.pep
MALPSPSPSPRCSSPPPRPRWLIPPPSCPDGWQISPDRAKCFMHISTSLSWDGSEALCRNFSGHLAALSSVQELNFARSLCGAASSGCWVGGRRHNTSGSVGGWKWSDNSSSWNETAFPGEPLHPNCTGARCGLAPCDDMCTLVTSKHTALTGKKCAESHGLICMMNHEDRCYHDHCHKEYFIVLIVVSGLILSTTLAVVVWLLVYKRSKKRKRSREASGASATALVPPLWKVFNSEELRSITKNFSEGNRLPGNAKTGGTYSGTLPDGSKLAIKRLKRSSLQRKKDFYSEISRVAKLYHPNLVAVKGCCYDHGDRFIVYEFVANGPLDVWLHQIPRGGRSLDWATRMRVATTLAQGIAFLHDKVKPQVVHRDIRASNVLLDEEFGSHLMGVGLSKFVPWEVMHERTVKAATYGYLAPEFIYRNELTTKSDVYSFGVLLLEIISGRRPAQSVESAGWQTIFEWATPLVQSHRHLELLDPLINDMPEIGVIQKVVDLVYACTQHVPSVRPRMSHVVHQLQQLELKSAASEQLRSGTSTSATSPMLPLEVRTPR

SEQ ID NO: 113355 - protein, 146 aa, Triticum aestivum
  Clone ID: PAT_TA_7773.pep
MAFTARMKDLMRKYGKVALGVHVSVSVASVSGLYVAINNNVDVDAIFRKIGISAPGTAAGDAALPAPSPGAGDGALPLPAPAVVVGQEAPPRRPGELAASSGGALALAILCNKALFPVRVPITIALTPPIARLLARWKLVKSLKQT

SEQ ID NO: 113356 - protein, 400 aa, Triticum aestivum
  Clone ID: PAT_TA_7774.pep
MKSLLGEERSFIIESDDDDEEDPAHRGDGVGHGDDGSSSDSSSCATPRGGGGDSQPNSYTNQWPQSYRQSIDILSNVQSPSLGFLGTPTLSWLSNSFLNSSFLNSSFRGKTPEIVSNLVKPLIRPTTSDEQQQHIQQHEDIRKSSQYLLPSRKPSLQQIPEDQKPLVVGHEVSPYQQCSYTQGAMNGINVLCGVGILSTPYAIKQGGWLGLVILVVFALLAWYTGVLLRRCLDSKEGLQTYPDIGHAAFGTTGRIAISIILYVELYACCIEYLILESDNLSKLFPNVHLNIGGLTINSHVFFAILTTLVVMPTTWLRDLTCLSYISAGGVVASILVVICLCWIGVVDMSASRTKDCVKPPGNPIAIGLYGTLPGMGVPNIYPLEERNSSFIHCMGFTIVT

SEQ ID NO: 113357 - protein, 174 aa, Triticum aestivum
  unsure (1)..(174): unsure at all Xaa locations
  Clone ID: PAT_TA_7775.pep
VDPPGCRYIGVCSLVGSISVMSVKALGIALKLTFXSGTNQLIYPQTWAFTMVVISCIITQMNYLXNKALDTFNTAVVSPIYYTMFTSLTILASVIMFKDWDRQNPTQIVTEMCGFVTIFSGTFLLHKTKDMADGLSNSSSFRLPTISSARSFKQTDEYSEGVPLRSSDSFRSLH

SEQ ID NO: 113358 - protein, 105 aa, Triticum aestivum
  Clone ID: PAT_TA_7776.pep
GENNQALPNPAVQGKSYQPTPNMKTIHMVLLLAMVLVASSSGGMAGKAVGPQYFQDTCSAVIPTGTKCEAAKCKADCARQFKGGVGGCAAHGCRCIYTCTFPSSM

SEQ ID NO: 113359 - protein, 155 aa, Triticum aestivum
  Clone ID: PAT_TA_7777.pep
MSRLDYSKWDHIEISDDEDETHPNIDTPSLFRWRHQARVERMEEQKKEREQLEKGKQAHKQKLQEVEQKLKTQALSEADAKKMSMTKEELKKQEEEFQKKERELLKKEKEQPWNIDTICKEGFSKSVINKKANDDDKNKTEEELFEEQKLFQQKK

SEQ ID NO: 113360 - protein, 161 aa, Triticum aestivum
  Clone ID: PAT_TA_7778.pep
MVLKTELCRFSGAKIYPGKGIRFIRSDSQVFLFSNSKCKSYFHNRLKPAKLAWTAMYRKQHKKDIHAEAAKKRRRTTKRPYSRSIVGASLEVIQKKRAEKPEVRDAAREAALREIKERIKKTKDEKKAKKVEVTKSQKTAGRGNAPKPGKAPKLGGGGGKR

SEQ ID NO: 113361 - protein, 118 aa, Triticum aestivum
  Clone ID: PAT_TA_7779.pep
MDGEDTGNLYIIDAHLQGEYLGAEPALPYLSPYMRGENLLVGANFASAGVGILNDTGVQFSSSTRTNTHMLESCICIYNNAMLILLVFRLQFLYIYYNVDPTFRPSFSYRINISVKKK

SEQ ID NO: 113362 - protein, 72 aa, Triticum aestivum
  Clone ID: PAT_TA_7780.pep
TIKSNHKFTMKIFMVFALLVASTTITTATAQLDPRIHDQERPQQSFLQQQPLIQQQPYPPQEPQQPLFPQKK

SEQ ID NO: 113363 - protein, 221 aa, Triticum aestivum
  unsure (1)..(221): unsure at all Xaa locations
  Clone ID: PAT_TA_7781.pep
HEEKSEKGEEPAVEEQREKGVFIRSQSRSGGREYPRAGMRPCLHRPEEIEVLPQLLRAELRGEEGPLLPQRREPLRLSRFHALPLVGFRSHGGGSEGDRRRWLRRXQGAPVPASSSACDSTAPPAVLLPGGPPAARGGELPLFPLLIKRDGADVSPFRINKPPTISPTTPHSTRAVMGERGGYGARFGGAHPPGAPPLAWAWPVLRSASCRASARGLLSVY

SEQ ID NO: 113364 - protein, 274 aa, Triticum aestivum
  Clone ID: PAT_TA_7782.pep
YVLFQSIKTWVSLRPRGVSATAINSFIRGIGITRCDNSLIRVDRLEYHIREELNKTASRTMVVLHPLKVVITNLEDGKVIDLDGKKWPDAPADEASSYYKVPFSKTVYIEKTDFRVKDSKDYYGLAPGKSALLRYAFPIKCTEVIYGDNPDDIVEIRAEYDPSKTSKPKGVLHWVAEPAPGVEPLKVEIRLFEKLFLSENPAELKDWLGDLNPHSKEVVKGAYAVPSLATAVLGDKFQFERLGYFAVDTDSTPENLVFNRTVTLRDSYGKAGPK

SEQ ID NO: 113365 - protein, 177 aa, Triticum aestivum
  unsure (1)..(177): unsure at all Xaa locations
  Clone ID: PAT_TA_7783.pep
TRPRKPPRRRNALPLDPLPSPPPSSLRSLAPHLLPSXPRLSFPRSRXAPPTMAGKRLRAPPDLLDPGPHAHQRPPNRARPLHCSAPPPCRRCLDVQPTPXSPPTPRWSWPPHPPTPPLQIRAAGEPSRSGHGTIHLPACRAAGARVRVSRPWVLYSSPTWGDEEDEPSGTCVFQPLL

SEQ ID NO: 113366 - protein, 70 aa, Triticum aestivum
  Clone ID: PAT_TA_7784.pep
ITQQIKLKAIPSFLLCSRMKQGNMLPKTARHPNPTSQSVLWSIIIKAKEQEEGMSTLHPILQLQGRDVDA

SEQ ID NO: 113367 - protein, 205 aa, Triticum aestivum
  Clone ID: PAT_TA_7785.pep
SARGGSEGSCAEGRKRRIRSCACYLPPRYQIFQMSRDSSERNVSGIDHIKHYKNIISELLLGKEGTFSTGVAKQTEVVMAQYNRKAGEDSLPLFMEEIRGLSKCAMERLKHALHKVFTILNDEVDEIFGYIFALSEFRSEKLPSNHGSGSYEDSIAPPSVKKQKTVTVSTIDAYEESHGHIDSDIFAQLTRDIRLIEESGKTRQE

SEQ ID NO: 113368 - protein, 199 aa, Triticum aestivum
  Clone ID: PAT_TA_7786.pep
GPEVIPIDEFIEWHCVRCTGSDRWFPALHCLLRLAFVDEHGNLFVPFQWNGEVEDGEELPWWMTHLGTADFSKTCTRDRVCNTCGGAAFCEHCCGEHHRGHDTCAAATDETEGSVAPAGYRRDSFCIGCGLAFCSELCAHHAGGDGHEIIPVDVYGDRHFLRCTGSEPVVSLRLRRHRDLRRQGRQPDGARGTKAVHDP

SEQ ID NO: 113369 - protein, 135 aa, Triticum aestivum
  Clone ID: PAT_TA_7787.pep
IGSGSTNTAEGLLERIENTGRSEKAPAHRWWLQVESLAHGTISGGGRRKAFTGAGEIEEKGELPRIQIQVAPPREWGRNTHQSRRICWGIGVVGSDSFPGIDSAETRVGGWGGGRGLEQLFSRKFPYAWAQACSP

SEQ ID NO: 113370 - protein, 184 aa, Triticum aestivum
  Clone ID: PAT_TA_7788.pep
EDWILLLVFFACEGYSVCTNIRNSDRTGGFVSSPFYPWAYTSNTICSYYIMAPKKHVVAVQFTYFELQDVVLGNMTDYLKVMYGRKNSEIPPQYFYGSHSPFNFTSTTQRLRLKFVSDYRINLYGFHATYKFVNIQTHCDTTKLPGNVTSCSDVVNEYATECLASCPTNYSTISGADTDMDLFK

SEQ ID NO: 113371 - protein, 126 aa, Triticum aestivum
  Clone ID: PAT_TA_7789.pep
MMFLACCYNDPDMLIDPETIYPTRADCTDAPKSRFKPMPRRTLSPRRWKLLFNEEGCLDAAGMIMRVQRGGVHPNIKGEVWEYLLGCYDPKSTTEQRNQLRQQRRFVFELLCTLRRAVHSTPGCGR

SEQ ID NO: 113372 - protein, 195 aa, Triticum aestivum
  unsure (1)..(195): unsure at all Xaa locations
  Clone ID: PAT_TA_7790.pep
MEAPLTVQIVEFNTKVMQEELKKLGLKVNHHEANITFLKSEIYAIEESIADLTIKRGKKVVASSNGTSVQEAEQRTIESICNQDKTAASLICQLKKRHSTQISTMPMMKDVLGVVATLGKTNDDNLSSLLSEYLGIDNMLGLVCKTYDGIKSLETYGTEGNIDKKSGFHGLGGSFGKLLHGRFTXFCLENIRPIS

SEQ ID NO: 113373 - protein, 257 aa, Triticum aestivum
  Clone ID: PAT_TA_7791.pep
EPPAQDTISNLPDAVLGEIISLLPTKDGARTQILASRWRHLWRSAPLNLDCRGLNHGDELVGALSRIISSHQGPCRRLCIHADLLDAPSTTVDSLLRSDALGNLQELEFSCFERPPPASIFRFSPTLRVVTIECSNLPDSTVQGIHFPLLQQLGLEFVCISECSLHSLIASCPVLESLLIHRSFGFACIQINSLSLKSVGLDSYAVWENNKVALQLQELIINNAPCLERLLLLHQETGLHISVIAAPKLETIGFLSD

SEQ ID NO: 113374 - protein, 137 aa, Triticum aestivum
  unsure (1)..(137): unsure at all Xaa locations
  Clone ID: PAT_TA_7792.pep
SAMLRPVFFLFFAAPSMASLAWCSIFMSFDTXCKMLFFLSMFLFASLVSRPTLFKRAMRRFSVAWWAYSFPLTXMALASAEYAQEVREPAASVLMLALAVLSVLVTLALMVFTALRPNDLLPHDDPFFAGTLPPRAS

SEQ ID NO: 113375 - protein, 248 aa, Triticum aestivum
  Clone ID: PAT_TA_7793.pep
RVPIFSYGSGHMLNDITSSCWFTYLLVFLTDVGLSPSDAAIVMLSGQLADGFTTIFVGELIDRFGHFKLWHAGGSIPVAISFSSVFGSCLPCKLTGTNSSTLETVGYSIFASIFNVGWAVTQVAHMSMVNCMTSNPTSRVALVSCRNAFTMVANLSLYGIALLIFTLMRSVSVLVQYRWIAYTAISIGCCFVVAFLIGTKEPGLIQPSQDKSLSRISWAHWFKKVLYYLVVLVYMCSRLVSYCLQAIF

SEQ ID NO: 113376 - protein, 198 aa, Triticum aestivum
  unsure (1)..(198): unsure at all Xaa locations
  Clone ID: PAT_TA_7794.pep
VMFIYVIVPLCYWRFNTFDARRFPIFSNQLFTSTGQKYDTTKVLTADFDLNVAAYDSYGKLYLSPLFAISIGSGFLRFSATIVHVLLFHGADMWRQSRRAIGAAAKLDVHARLMQRYKQVPQWWFLXVLLAGSIAVSLLMCFLWKEQVQLPWWGMLFAFAXLAFVVTLPIGVIQATTNQQPGYDIIAHFMIGHLKLGG

SEQ ID NO: 113377 - protein, 155 aa, Triticum aestivum
  Clone ID: PAT_TA_7795.pep
MVTAESLRAELSSKTPPFGLRLWIVIGISIWVVIFCILGFMCFWSIYRRKPKKSVDKIPVSQIPDVSKEMPVHAVRQHALVENYHMQESHTLPVHENPHEKDSGLVRAHSGRADNLSQCSSAYQCDRAGSAYSGDEGSSGNARRQYSQYATVSAS

SEQ ID NO: 113378 - protein, 167 aa, Triticum aestivum
  Clone ID: PAT_TA_7796.pep
IRHEACRSPERRRRRRWYLDRSWLLGMQWRMRRRAFWAGAATLCPIRPLARPIRPSDRSRRACVSWIKGWAWLMASFPGRPATPSALEAVRRVGRPQWRGGFVHDIQFWGRGDESPAVVSSCTMQSLRHSGPALANTTIRVGWKRRYMLIVLSPWANLYLLDRIRTS

SEQ ID NO: 113379 - protein, 86 aa, Triticum aestivum
  unsure (1)..(86): unsure at all Xaa locations
  Clone ID: PAT_TA_7797.pep
ARWXXCLMESALKSPRKDEHVVACSHRRWQAFRLSRRSNRMHSIDWTILSSSHNDPMASDVIAPSAWTIFGCTNGKHTNCLSFFII

SEQ ID NO: 113380 - protein, 103 aa, Triticum aestivum
  Clone ID: PAT_TA_7798.pep
MSGRDKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 113381 - protein, 128 aa, Triticum aestivum
  Clone ID: PAT_TA_7799.pep
SCRCSRTSASSSRRRPSSSLRFHRSCSPATRADHAHPSAAPYFCHKTTAHPPAGSSSRPPWPQHLPASPPPLLAVVHGHSEDNKFEAFFNSGCSFCKRRSQLFVRSPWLPAPRLKLFSWPYEAFFVIR

SEQ ID NO: 113382 - protein, 119 aa, Triticum aestivum
  Clone ID: PAT_TA_7800.pep
EILQCSKRSEPRPGRVMNFGIWLRYDSRSGTHNMYREYRDVKVASAVTACYRDMGARHRARPGSIQIMRVEEVAANKCKRKHVQQFQDSKIKFPMRRTVLSKKQQNAPRFTTNKPNLFF

SEQ ID NO: 113383 - protein, 225 aa, Triticum aestivum
  unsure (1)..(225): unsure at all Xaa locations
  Clone ID: PAT_TA_7801.pep
MVMMAQKTKEAEITEQDSLLLTRNLLRIAIYNISYIRGLFPEKYFNDKSVPALEMKIKKLMPMDAESRRLIDWMEKGVYDALQKKYLKTLLFCICEKEEGPMIEEYAFSFSYPNTNGEEVAMNMSRTGSKKNSATFKSNAAEVTPDQMRSSACKMIRTLVSLMRTLDQMPEERTILMKLLYYDDATPEDYEPPFFXRGCAENEAVNIWNKNPLKMEVGNVNSKHL

SEQ ID NO: 113384 - protein, 99 aa, Triticum aestivum
  Clone ID: PAT_TA_7802.pep
AARTETASGGERRAYRRSLERSPMGGDEEMLPYQGDGDIDFADGDGGPREPDGRFRNRMEHRARGEQEDGFRYRGPQGGCRDGNPNDSRSKKRRRYAAA

SEQ ID NO: 113385 - protein, 227 aa, Triticum aestivum
  Clone ID: PAT_TA_7803.pep
TPAATGSANGQPNRRRRNGFNQGRRRMGVRPRRTDREDSVRRTVYVSDIDQHVTEQKLAEVFSNCGQVVDCRICGDPNSVMRFAFIEFADDVGARAALTLGGTILGFYPVRVLPSKTAILPVNPKFLPRTEDEKEMVSRTVYCTNIDKNVPEDVVKNFFEGICGEVARLRLLGDYVHATCIAFVEFVQAEGAILALNCSGMLLGSLPVRVSPSKTPVRPRSPRAMLH

SEQ ID NO: 113386 - protein, 147 aa, Triticum aestivum
  Clone ID: PAT_TA_7804.pep
MPLVSLRAKLNTLLAVMYASGTLDEQFKQLRAMEEDGGAPPGFVAEAVTLFIREADRILTELAALMKQRVVDVDKADALLRQLKGSCISIGAKQLSVSCTYFRQFYKEKPKGCLFVLTLLRNEFYDVRNKFQTMMHLEQQIEACSPK

SEQ ID NO: 113387 - protein, 330 aa, Triticum aestivum
  Clone ID: PAT_TA_7805.pep
MALQRAASVLAAALAFASILITGPVQSVGVCYGMNGDHLPSPAEVVQLYKSNGITAIRLYKPDVQTLRALNGSNIAVLIDVADETVTRLASSVPGAQLWVRFYIQHYPGISFRYISVGNELTGAATQNIVPAIKNLNAALDAAGIKGIKVSTAVRLDVLASSSPPSSGVFKDGYMNQVVALLGTTGAPLLVNVYPYFAYIGDQKDIDLNFALFQLSSTVVRDGGLSYTNIFDAMVDAVHAALRKANVQVPVVVSESGWPSAGGVGASVANAQTYNQNLINHVGKGTPYRPQPLEAYVFAMFNENLKPGAETEKHFGLFNPDKSPVYPIRF

SEQ ID NO: 113388 - protein, 127 aa, Triticum aestivum
  Clone ID: PAT_TA_7806.pep
SGGGMTKVWSTHQRMDYHRRAGPTKQSAKRPRNNYTTATPSQEERKEGTNTKESRRQESGPERYKIIIRKVPHHMFIQDRIMHEQSIMKKVISYRNNRQLSCGPFIPPQVVITHARVELEARLIFAA

SEQ ID NO: 113389 - protein, 67 aa, Triticum aestivum
  Clone ID: PAT_TA_7807.pep
CSDFKALNWHICQQQAARSMSSWTRIAPEITRPRPNPVQPHLPRHCIHNPRRPTTSLWEEPSISIYP

SEQ ID NO: 113390 - protein, 123 aa, Triticum aestivum
  unsure (1)..(123): unsure at all Xaa locations
  Clone ID: PAT_TA_7808.pep
SPLAQIALCWPVLXGLXPFHSWRRSLNHLLACSRPASLLQLLTPTTSPARPTPLLPPRGAGLRHCFLPSPSELAVIVEYLRVGACPDPPLHQPLPRPKIGAVRAAAANKGEKMDLEGGDRRLW

SEQ ID NO: 113391 - protein, 84 aa, Triticum aestivum
  Clone ID: PAT_TA_7809.pep
LGPIRHEAAVTVEALQVTRLADMRPDAHPGPYFHPFPFAGAGGEKKRERVPNDCVHSCLPGPIDTWNEILLQMVKRWRGASSSR

SEQ ID NO: 113392 - protein, 136 aa, Triticum aestivum
  Clone ID: PAT_TA_7810.pep
MNWKLLFVVCLMMMIINSDAWRRRRRRRSSRRRRRWRVVVKWAGHAYRVYKWVRGDTDLNALRQLKDEDTDAYNKAMKEMQNDLTSKFGSDEAEKMVAEMDQFLSDKTIDLDQAFDHDDTEEPNIEDEMIGTSDNE

SEQ ID NO: 113393 - protein, 81 aa, Triticum aestivum
  Clone ID: PAT_TA_7811.pep
IRKLKKAGSISPHASESKDPCVDEMSLILGGEHKSGCILSENRGQAQRIWNGYQQSRSRAPPRLLTLCPRTGVGAWMDSPQ

SEQ ID NO: 113394 - protein, 235 aa, Triticum aestivum
  Clone ID: PAT_TA_7812.pep
MVLAHTSKVVLGCVAFGIFWVLAVFPSVPFMPVGRTAGSLLGAMLMVLFRVISPEDAYAAIDLPIIGLLFGTMVVSIFLERADMFKYLGNLLQWKSRGPKDLLFRVCIVSAIASALFTNDTCCVVLTEFILKVARQNNLPPQPFLLALATSSNIGSAATPIGNPQNLVIAVESGISFGQFLLGVFPAMIVGVLTNAAILLCYFWRYLNVEPADQKRGGVVFTGPEVVGDDEVTSH

SEQ ID NO: 113395 - protein, 271 aa, Triticum aestivum
  Clone ID: PAT_TA_7813.pep
FRRKQQSKACLATLMNAKGFRDMGSRPCPSPGAAGAFSGRCTRFHLGSSCFSLTPTTATGCRCYCSCSLVPLVHSLAGAPASTWAVAASPRRPPPLRAAAATALARWRRMLLLAEALCCRCPGPGRESRLTPWLPPQTAVFCEERNFKAAKASPPLAPMTLLFLRLFQRCCPATVGHPLGATLARNECTPARRRQWRWRCGKSRRRQAGRAKSRPRPRRHRSASHEARLHLQELRAVALDPSVSRARPPSPSSGELLPRSPHLPSLVPNSS

SEQ ID NO: 113396 - protein, 149 aa, Triticum aestivum
  unsure (1)..(149): unsure at all Xaa locations
  Clone ID: PAT_TA_7814.pep
MAPRKAKVEKTEXVVQLGPQVAEGENVFGVAHIYASFNDTFVHVTDLSGKETIVRITGGMKVKADRDEASPYAAMLAAQDVAARCKEIGINALHIKLRATGGTRTKTPGPGAQSALRALARSGMKIGRIEDXTPIPSDHTRRKGAAEDD

SEQ ID NO: 113397 - protein, 256 aa, Triticum aestivum
  unsure (1)..(256): unsure at all Xaa locations
  Clone ID: PAT_TA_7815.pep
RRRLYREVTLALRAGLRDAGADFSFLRARGLRGLLGFLRATAAAPDDSQQQLLLFRHSQSIPDLQGIPVLFQNSLHQPKDPAATLDHIFGVEPTKITSPSTDSEIALALRVLEGCCLLYSRCTALAHKYKAVQVLLNILASRGPTEQGVCLDALISLMLDSPSNQIDFEEYSGLEKVAELLKDIQVEEHIRXEMRGIFTVAHRACLCEGKHSHTXADEKLTRGAVCVTHMGSEPVWIHPRCRAEADGPANTSEESR

SEQ ID NO: 113398 - protein, 186 aa, Triticum aestivum
  unsure (1)..(186): unsure at all Xaa locations
  Clone ID: PAT_TA_7816.pep
EKRKYPSHLVNPSFLRCLTTAPPPPRPAPPRTTPPLPSPQIRSDCRRLAIFPEPYKNPAVAAAAAATYGGGRGVYEEQERLRDRDSEQEPVGQSAADPRLSEKAGXVCLVGFVGGTEKKERKKGRSWEASTTGSEMQNNDLRKKSAAEIDFFTEYGDTNRYKVLEVIGKGSYGLVCSANDTQTGEK

SEQ ID NO: 113399 - protein, 162 aa, Triticum aestivum
  Clone ID: PAT_TA_7817.pep
KLLAVGGRYDMLMENAWDKTHKTKPPGAVGVSIALEKFLPNNPSSDVGLPRIENSISVLVCSKGGGGLLNERMELVAELWEANIKAQFVPQEDPSLQEQYEYASDHDIKCLVFITEAGLSQTDLVKVRHLDARKEKDVEKEEIVKFLSEAISLQFKNPTIWS

SEQ ID NO: 113400 - protein, 164 aa, Triticum aestivum
  unsure (1)..(164): unsure at all Xaa locations
  Clone ID: PAT_TA_7818.pep
CWECSREPARKAARRPGHRRVASHHHPIGSRGAQIRQPRQWLPRRRTEQASRWRPRARGRRRGRRRRREEGCWGGWWRGLFGGREDYEKRLQYLSKEEAAVHARMRRRTQFSRRTVRNIIVLSVIAEAVAVGYAIMMTRDEXLTWQMRAIRVLPMFVLPAIXSV

SEQ ID NO: 113401 - protein, 205 aa, Triticum aestivum
  unsure (1)..(205): unsure at all Xaa locations
  Clone ID: PAT_TA_7819.pep
LRLRAASSRPSWWVLLGDRGAGKTSIVVRFAKGLYYECQESTIGAAFFSQALPVSGGGEDATVRFDIWDTAGQERYHSLAPMYYRGAAAAVVVYDITSMNDSYIRAKRWVDELQRQGNPHLVMALVGNKVDLEKKRKVGTQEALXYAERNGLFFLETSAKTAQNVGELFYELAERLVKVRPNHPAGMVLHDGQRGVGGRWFCCSG

SEQ ID NO: 113402 - protein, 101 aa, Triticum aestivum
  Clone ID: PAT_TA_7820.pep
AGPGQRGGVAPVIGGGGAAPVPVSPETAAALANDVSYGVVSLRVVLLGRVRFVSGPFRTGWRSMYARGDLLVGVRKAPGNVGAAAVPEAPLFGNPSCNVDV

SEQ ID NO: 113403 - protein, 192 aa, Triticum aestivum
  Clone ID: PAT_TA_7821.pep
MQDEIATADQGTASQADSPARTGSGASLDGSESATGSVPDTLTRREPLETAPRASCGSAQERTAPASPGGRPRVEDVVDSACVAGGSPSGGLSMEVGRPDSPVAAHDGPADSRSETDRSAPDAAAGARSSAIFVPQPRQPSQPPSQAHTRSKSGIFRPKEYKDGCIRWAGFCSTGEPTLCKRLWYQSLVRIP

SEQ ID NO: 113404 - protein, 191 aa, Triticum aestivum
  Clone ID: PAT_TA_7822.pep
MAGVSAASPAAAQIGSFLSKKPYAPPSWASHLALAPSHTFSLGHFPTPIHQWNLPNLPEGTEVWIKRDDLSGMQLSGNKVRKLEFLLSDAVAQGADCVITVGGIQSNHCRATAVAAKYLNLDCYLILRTSKLLVDQDPGLVGNLLVERLLGAHIDLVSKEEYGKIGSVALADLLKKRLLEEGRKPYVIPVG

SEQ ID NO: 113405 - protein, 208 aa, Triticum aestivum
  unsure (1)..(208): unsure at all Xaa locations
  Clone ID: PAT_TA_7823.pep
MHSLFAMTLNTSTIMFKNPPRSRHRPSPTPLPPLSRPSPVPPPPPVGAQSPPRPCQESPPPLPPHHRSAPASPLGPTRRPPGPPDSLPRLIDGLQSGLDSHDIVSIQNAKGLGXAMNTXEELKFVKDIATATGIVLDPVYSGKGAYAMLKDMADNPSKWKGRKVLFVHTGGLLGLYDKVDQMSSLAGSWRRMDLEESVPRKDGTGKMF

SEQ ID NO: 113406 - protein, 376 aa, Triticum aestivum
  unsure (1)..(376): unsure at all Xaa locations
  Clone ID: PAT_TA_7824.pep
APVHVHRLVLGTVARHRAVSIPRRSGCPGHAGLHLFALGLPAAPFLPFRSAKSRSPPAPVAXGACSRVGDSYERDGVPRAARPSAGVGEEEGVEDGKDFSSDDSSDEQMENLAKEFGIKRYNWLVYMDKKVKEEEKRQKEIIKGDPSIKKMSRRDRRKASQSEREREREAVRSVGRVSYRDPYREQRRSPSYEAYSRGRRSRSRSRSHSPSSRRHTRGTHADSNYRSKAKPPRVEYITEFGGSEDASDLKVTGISPPSSPIRADIPNRSSGVHILEALHSDPASSLSMEQEKSAKILKPPASTSSALAKLKGASGGLGKTPQAEKKETPQERLKRIMSKQLNKQIRKDTAAETAKKREQERQRQEKLAEVGRHRAP

SEQ ID NO: 113407 - protein, 79 aa, Triticum aestivum
  Clone ID: PAT_TA_7825.pep
ICSMIPKYQGSVQHQKDTIVVVLDNLCTLFLHNIVVNYIVENYIDISVDTPAIHFTCVVMHRSYAPLPSALMWQAVISM

SEQ ID NO: 113408 - protein, 258 aa, Triticum aestivum
  Clone ID: PAT_TA_7826.pep
AILPIQIIRIGQLVILCVPGEFTTMAGRRLRDAVKNVLISGSNGDFGTNIHVVLAGLTNTYSQYVTTFEEYQIQRYEGASTLYGPHTLSAYIQEFQKLATAMVENKEVPTNIQPPDMLEKQIGLLPGVMYDSTPPGVHFGDVSSDVAANSNFRKGTTVNATFYSACPRNDLLTEGTFALVEKLNGNDWIPVYDDDDWSLQFKWSRPSKFSPRSFATLEWTIPEDAASGVYRLRHSGASKPLIGSIKHFTGTSRAFAVR

SEQ ID NO: 113409 - protein, 217 aa, Triticum aestivum
  unsure (1)..(217): unsure at all Xaa locations
  Clone ID: PAT_TA_7827.pep
PHHGGRFSKFSYCPFKPGTSLYSYLRFGNDIPSRPPAGVHRQSTPVLAPAENREAYFVKLAGITIXXNRLRSVTPDMFRRTAHGTGGCVIDIGTKMTSFVHAAYVHIEQAVRQHLEHHGAHIVVVRGHKCVQHPAAHVLPSMTLHFENGAWLRILPEHVFMPLVVSGHHYQCLGFVSSTDLTVIGARQQVNHRFIFDLHDTIPIMSFNAEDCHLEGA

SEQ ID NO: 113410 - protein, 322 aa, Triticum aestivum
  unsure (1)..(322): unsure at all Xaa locations
  Clone ID: PAT_TA_7828.pep
MPGSPPAQALPPAPKPRAKRHLLLLLTAPSLLALVLAVLFANSSNPLPRLIHLLLRSRSSLLSPPEPVSAADTSADAGRPPCVLWMAPFASGGGYCSEAWSYVASLDENAAAGVGANFTLSIAHHGDLESPEFWQGLPEQSKNLAYRLATAQCELSRAVVVCHSEPGAWYPPMYESLPCPPTGYDEPAFVIGRTMFETDRVSPEHVRRCNQMDAVWVPTDFHVSTFVKSGVHPSKVVKVVQAVDVTFFDPAKHAAFPLPIGFSVMASDDSTQNTDSSKXKXFVFLSMFKWEQXXXWDVLLTAFLXXFSGADDVVLYLLTNAX

SEQ ID NO: 113411 - protein, 114 aa, Triticum aestivum
  unsure (1)..(114): unsure at all Xaa locations
  Clone ID: PAT_TA_7829.pep
NLWWVSISEDVFSVVLSGCRVLGNLYLSEIRDVDCLSISSPSLRIIVISYLLEGKGELLIKEAPCLVRLLLSCPGGEIIRVLRAPKLEIFGXLSPCIXEIDIANIVFKGSIPSR

SEQ ID NO: 113412 - protein, 300 aa, Triticum aestivum
  unsure (1)..(300): unsure at all Xaa locations
  Clone ID: PAT_TA_7830.pep
ILCIVIMTADFGDFRNGAXQVIFDQFISSGEAKWLRQTGLVVCLPHGYDGQGPEHSSARMERFLQMSDDNPYVIPEMDPTLRKQIQECNWQVVNVTTPANYFHVLRRQIHRDFRKPLIVMSPKNLLRHKDCKSSLSEFDDLAGHPGFDKQGTRFKRLIKDRNDHKDLEEGIRRLVLCSGKVYYELDEERKKSDSNDVAICRVEQLCPFPYDLIQRELKRYPNAEIVWCQEEPMNMGAYTYINPRLLTAMRALGRGSIDDIKYVGRAPSAATATGFYTVHVQEQTELVKKALQRDPIKSPL

SEQ ID NO: 113413 - protein, 142 aa, Triticum aestivum
  unsure (1)..(142): unsure at all Xaa locations
  Clone ID: PAT_TA_7831.pep
SLNVDAAFYATEGAGATAAVIKDDKGVFLAAQCIFIPYASSVVTTEAQAMRDGLNFANSLGFLRVEAESDSLIVIEAXRGNQDGGTKLLQFLLSCVDVSVLIGKVKFKHCFRSSNQATHVLANYSFCNKTSSLARYESPGMY

SEQ ID NO: 113414 - protein, 135 aa, Triticum aestivum
  Clone ID: PAT_TA_7832.pep
KYIRLNLATPFCLTLPPFHNSCHGLTELKPQQELWNRGSTKHKSGNIDFHFGFFILSFQLSRRSQLVFTNPTRLLLTLHHNLVWTRPHRGKDIDSQVGSTFEQGAPHHHIHYLDISTWSWVPAICFVCSCQSLQR

SEQ ID NO: 113415 - protein, 78 aa, Triticum aestivum
  Clone ID: PAT_TA_7833.pep
VIILPCLITFSQAQRSDDMNSSKIQICLCQKNPPPCPNGLCFCCALEQDKCFRTSQECICGSACPPLEATSPHPLPLP

SEQ ID NO: 113416 - protein, 52 aa, Triticum aestivum
  Clone ID: PAT_TA_7834.pep
VNLQSEDGEFPQQEIMGVFNKNCMISYSQYRNIFPIWALGEYRCRVLGAGKK

SEQ ID NO: 113417 - protein, 126 aa, Triticum aestivum
  Clone ID: PAT_TA_7835.pep
KAMTRDGDVATGDEKSNYRRREKLRPATKKATTRDDDVATGDEKSYDRRRKKLRLETTTLQPATRKATTGDEKVGRPLRNIKSCNRRSIMLQPALSKASTGDDGNRGPPTMQPRKLQPVTKKVSTG

SEQ ID NO: 113418 - protein, 343 aa, Triticum aestivum
  unsure (1)..(343): unsure at all Xaa locations
  Clone ID: PAT_TA_7836.pep
MEYLKERMDIEQQFFAYDRTYWEDVWGSRIGRCGRFMDTTILSPXCNLHTTHLVASIPLLLSXGTTLQIYSVKIKDLRGLNWPLRVYGVIAARDTVDHNRNILFSRSEFNYQELNEQDPCLCLTGPSRAIVVSGHIDFEVELQVTDAAQSQTLISCRERYGSTDDFFSSLASVTDGGDGRTFLLSNQSCTTEVTLDQLDRSLQATIVGVRVTKGHWPFKHGCRVVCWWSSAAPICSRDTTCRRVVLFDHRGKGMRRGSDGYLHLXRKVISVESYGTLRVSIEAYGKSGRHIARKDSIDFPVQKCQTKTLTCPVGDGGATVEVTVAWSLLVKEKMYLSLVDCPM

SEQ ID NO: 113419 - protein, 217 aa, Triticum aestivum
  Clone ID: PAT_TA_7837.pep
MAREIAIILLMAVVLAAAMMVASSMDITDRDLTSEESLWALYERWSGHHNVRRDLRDKAMRFSVFKENARMIHKFNQGDAPYKLSLNLFGDMTDEEIDHTHGRCSDLLSDGGKPPQGRFTRGAVAARADLPPFVVGRFAGLAQRPPPAPRPGTQRACGASWACAPAPAVGPFNSIRTTSLKSLSVQQLIDCDKRSFGCRNGRVPSAFKYIIDNGGIA

SEQ ID NO: 113420 - protein, 115 aa, Triticum aestivum
  Clone ID: PAT_TA_7838.pep
LLFPDHRFNTYFAYCIAMELNRGCCGRRDSKREASTGGSLSELPYEVQACNGDRLTELPADLLLNILERVGMLDAIKTCRLSRKMQKLPTMLSQIVIDLSSHDLVQMNGVVADVT

SEQ ID NO: 113421 - protein, 100 aa, Triticum aestivum
  unsure (1)..(100): unsure at all Xaa locations
  Clone ID: PAT_TA_7839.pep
HCYLLHFMCYLAVYRRLMSFLFCLPFANRASDSGDLYIDFDRNRLIFLVACLVFQVTAMFIIFLPEHAYASHIISCISYMXXIMXLXHXSXXIXXPXXXV

SEQ ID NO: 113422 - protein, 110 aa, Triticum aestivum
  Clone ID: PAT_TA_7840.pep
TADGRSSAGIAINASPVMNGRVSTVGFSASTRAGFMEAFECGKEACSAGRAASGALDSDLGHRVVLPLMCGLFGYMACMLMTQRRQRTIEEPLVGQGGQKQAFHKPMIVH

SEQ ID NO: 113423 - protein, 191 aa, Triticum aestivum
  unsure (1)..(191): unsure at all Xaa locations
  Clone ID: PAT_TA_7841.pep
PPXAPCXVXXTSFPXXNCXLGXLXFXPXRTRRRRRSGAXSGFXVLVVLRWLSPNVIAARVADSMPERGLQIPVWVVPRRRHRRRLLLLLHPRGRPRCGRRAAAGGGAPPGVPGAEGLRRGELESTLPWMDGRCSIAIASFFLNCVNFFFKLVIFGELLAVAVSRHSTTCWGSLESLTCGAANQLARMSVLH

SEQ ID NO: 113424 - protein, 223 aa, Triticum aestivum
  unsure (1)..(223): unsure at all Xaa locations
  Clone ID: PAT_TA_7842.pep
PRVRLDPAAKAAAASVLASKLGADSGLRVHLGEEPNSDAAVVMSNNAEILPSDGLRNRKQPNARGSRTGSTTAAHTSAQGAESSPALNAGLENVQLTRAVEHYQGSGASDGGWIAKIAALLVGEDPSQSYALICGNCHMHNGLARKEXDYPHITYYCPHCHALNTSKNSMGQYSGSNSGPSTPVAPADVISATSSVVESELINMATVQELPKEEHAEKEVEAS

SEQ ID NO: 113425 - protein, 119 aa, Triticum aestivum
  Clone ID: PAT_TA_7843.pep
FDTFFTYRNPEYTIMHIIIHPSSRDYVRELRCKFSSVSQRAPPSAPAGGRHRDSERQDEVVPDVGVEGAEEVAELRQQCGEVAAGRHQGGERAEQEPHREQRRRRQHRRFDGRFCTRAV

SEQ ID NO: 113426 - protein, 76 aa, Triticum aestivum
  Clone ID: PAT_TA_7844.pep
KKTVLLDRKLIVELVDEYKNGTLSWTDFSSSVKASHTSRMGAPSRRQVIPDKPKEEDYFYANPHECLHQPDELSAL

SEQ ID NO: 113427 - protein, 229 aa, Triticum aestivum
  Clone ID: PAT_TA_7845.pep
SGVYNFFGKGKYEGDWVDGKYDGYGIESWARGSRYRGQYRQGLRHGHGVYRFYSGDCYAGEWAGGQSHGIGAQTCSDGSSYVGEFKCGVKHGLGSYHFRNGDRYAGEYFGDKIHGFGVYRFANGHCYEGSWHEGKKQGFGMYTFRNGDKRSGEWDFGTLKSPLPPTDPSVERAVQAAQRAAENAFHLPRVDEQVHKVVMAANRAATAARVAAIKAVQNRMDGKFCDTYV

SEQ ID NO: 113428 - protein, 181 aa, Triticum aestivum
  Clone ID: PAT_TA_7846.pep
TWLQNEWGWEDMKQDVRAISSEGARCGRRRRRRQWGAKGRAASSRASPRSPQLDPAPPLDRHKPPAPLYPASHPLYRAPLHLGWTRMLRPQLRSIPFLSSVSGTFLAHTCMWACLWTSLGPGTAGNSQALQLLIPGRKQRADHPRRIRLGGGGFFWLSFFYLWLLSILSRCTSKPPQTCNT

SEQ ID NO: 113429 - protein, 198 aa, Triticum aestivum
  Clone ID: PAT_TA_7847.pep
RGVPAAPCATPTSALRALCVVPVIVVRGGAGPRGVVRGAWWGGRAPCGPGIVGVPCCAPSALACPSLRPRGAVGCTGPAVLLPPPGAGAGRPHLPVPPASGGLRLPPAPPPPHDALRVWLPLSATLCPATFDGTAGGPVVALDQETAAALSLVSVTHVGRSLNASAHMIALSSEFHVNFCIVYSAPDSNWELYIDVRN

SEQ ID NO: 113430 - protein, 205 aa, Triticum aestivum
  unsure (1)..(205): unsure at all Xaa locations
  Clone ID: PAT_TA_7848.pep
XPTQSAISPPLSLLLTISWSAAARCFSSVMVDALRARSNQEAGRTAVAEDFALLVAIAGLGKRFGRSGDFPGKRRRGSGARRRGGNEGSVAGTILFVSQERLPRQHGEVETPTPHQSPRIDRGCRRLGPAALRPCPLDSPRSQVRAWLGPGGYCRCSGNEDTQTCLPAAHSVASSTAWYGRASASTTQDPREGPSLARRTAPRPP

SEQ ID NO: 113431 - protein, 116 aa, Triticum aestivum
  unsure (1)..(116): unsure at all Xaa locations
  Clone ID: PAT_TA_7849.pep
MAVVEPVPGGDVKLFNRWTFEDVQVSDISLNDYLAVTSMKHYTFLPHSGGRYSAKRFRKAQCPIIERLTNSLMMHGRNNGKKIMXAVRIIKDTMEIIHLLPDANPIQIIVCAIINS

SEQ ID NO: 113432 - protein, 63 aa, Triticum aestivum
  Clone ID: PAT_TA_7850.pep
SPLRRVNQAIYLLTTGARESAFRNVKTIAECLADELINAAKGSSNSYAIKKKDEIERVAKANR

SEQ ID NO: 113433 - protein, 210 aa, Triticum aestivum
  unsure (1)..(210): unsure at all Xaa locations
  Clone ID: PAT_TA_7851.pep
PWRSRSRCPGDDVKLFNRWTFEDVQVTDNLARTTNVAVTSTEALHISCRTPAATIGEADHAARRSDPIXERLTNLPPMMHGXRNNGXKIMAVRIIKHTMEIIHLLTDXANPIQXIVDAIINXGPREDATRXIGSAGVVXRRQAVDISPLXRRVNQAIYLLTTGARESAFRNVKTIAECLADELINAAKGSSNSYAIKKKDEIERVAKANR

SEQ ID NO: 113434 - protein, 292 aa, Triticum aestivum
  Clone ID: PAT_TA_7852.pep
TRPNRKRSAPYAGAFLVKDEEGTDPSIVASPDSSDNKTIDSLKGKELLKRLHEVGTLAQITSIQGDQVVLLGHRRLRITEMVEEDPLTVKVDHLKENTYNKDDDVIKATSFEVISTLREVLKTSSLWKDHVQTYIQHVGDFNYPRLADFGAAISGANKLLCQEVLEELDVDKRLKLTLELVKKDMEISKLQQAIAKAIEEKISGDQRRYLLNEQLKAIKKELGLETDDKTALSEKFRERIEAKKDKCPPHVLQVIEEELTKLQLLEASSSEFNVTRNYLDWLTVLPWGNYSN

SEQ ID NO: 113435 - protein, 101 aa, Triticum aestivum
  Clone ID: PAT_TA_7853.pep
RSTACSVATPPRKHLPPPARQAGSCASSRILCPAILGVYNPTYWMADSCHPVRLGRRHLNTWWCTPVQAQWRLLLPRFVGTAHIWRFSSCLLVQKVHDLHL

SEQ ID NO: 113436 - protein, 200 aa, Triticum aestivum
  unsure (1)..(200): unsure at all Xaa locations
  Clone ID: PAT_TA_7854.pep
LAMQMARAGATLLGVLLFALLAGFAAGEEDCYHDIIRCCNETIKKEGPYISPKPGLPPRGEEGGHALRLPHPHRLRRAGPSAQRSSSAAPTTPASTFPSGAYAEVSRPAPPTGAICRRRPTTTTRLLLGTVSRFAIRRRRPHTTTRLLHGTVSRCAIRRRRRPHTTTRLLLGTIMSFXHXPXSSXHHQPATTWNXHSFXH

SEQ ID NO: 113437 - protein, 137 aa, Triticum aestivum
  Clone ID: PAT_TA_7855.pep
SQAAAGPSHRVGRSVRRSWVAGGARAPGRQQACSGLCAPRPSAGRSLLGWLPPLPASAGSGGALGPPAALAPADGPPPLRPRSVLHPAERAWSFALPSALVASRCQCLDVIIICPVSASRGENCLKAKFIEVKKKKK

SEQ ID NO: 113438 - protein, 76 aa, Triticum aestivum
  Clone ID: PAT_TA_7856.pep
PRVRGVLPKYFHSEWSVAQFRLHEGEQYIVAFGHEKNTVAVVGMDGSFYRCQFDPVNGGEMQQLECHNFLKPSDQP

SEQ ID NO: 113439 - protein, 369 aa, Triticum aestivum
  unsure (1)..(369): unsure at all Xaa locations
  Clone ID: PAT_TA_7857.pep
DQDYGCFSALTNTGFRIYNCDPFREIFRRDLGPSPTAVPGEEAAQALHQPAVAGGGGGGIGVVEMLFRCNILALLGGGRXDAPHYPHTXRMIWDDHQSRCIGVAXSSRPPVRGVRLRRDRIVVVLXNKIFVYNFADLKLVQQIETAPNPKGLSSVSQQPGTIVLVCPGAQNAPIRVPHCGAWKTKFTAAHASRVAXFALSQDGRLIATASTRGTLVRIFNAAEGNLLQEVRRGADRAAVHSLAFSNNLHYLAVSTXDNGTIHSLXLKLHVGXSQADNPRPPPGADVPHISPSFAFIKGVLPKYFRLGXSVAQFSLHEGEQYIVAFGHEKNTVAVVGMDGSFYRCXFDPVNGGEMQQLECHNFLKPSDQP

SEQ ID NO: 113440 - protein, 63 aa, Triticum aestivum
  Clone ID: PAT_TA_7858.pep
DHPLAVKNISSLLLFLRGDNLLHPGSQLVLVHQLDTELLAAVSDGHLIALAPWMALVNLHFRA

SEQ ID NO: 113441 - protein, 93 aa, Triticum aestivum
  Clone ID: PAT_TA_7859.pep
HPRSQHEQRHRPHMPPCSPRTPSPQRPPRPPRRAAHLHRPTHSPELHRAAAGEQPPPPPRLRHGKHAQDTELMIPNVAAASAQRRSSSSSHLS

SEQ ID NO: 113442 - protein, 98 aa, Triticum aestivum
  Clone ID: PAT_TA_7860.pep
ASWAWGRSEVTTKRRRWRWWCSGTRCKAGERGGEEHEESEGVGQGAASHLEGLRGGKESSPARSKSWHSRRRALVWLCLLAEVEDGHAPMGWASTVAG

SEQ ID NO: 113443 - protein, 134 aa, Triticum aestivum
  Clone ID: PAT_TA_7861.pep
SSPPSLHCVLLSPFHLLPNFPSDPKRMGSIRRREYAYDADDEDDFYIRNDDDLLEAPTLTSEQMARAREEALYVLKTKSPEEAFKIFTEGSYYKIDGPPLAPEKEDKAPTTATPPTATANVKEQPQTTVPPSGK

SEQ ID NO: 113444 - protein, 111 aa, Triticum aestivum
  Clone ID: PAT_TA_7862.pep
GGGGVVQCALGGSMAMKGAAGRACRGSRGPEQRRGFRRGACQEPEGRWRGGSQGVHGSGVRFAAAEPPPLQPRRKQHNSTTTIVSPASSRQNLWTNARRCDLAPSSDLLRS

SEQ ID NO: 113445 - protein, 48 aa, Triticum aestivum
  Clone ID: PAT_TA_7863.pep
VKFLILLFTAKSIICLIFLPRYPNSYSQYIGFLGFDPETRCSCNPRYD

SEQ ID NO: 113446 - protein, 225 aa, Triticum aestivum
  unsure (1)..(225): unsure at all Xaa locations
  Clone ID: PAT_TA_7864.pep
VVLSYKDMSXTNSYGLIRGLQFASFIVQYYGLVLDLLLLGLTRASEIAGPPQMPNEFLTYTDTKVETRHPIRLYSRYIDKVHIMFRFTHEEARDLIQRYLTEHPDPNNENMVGYNNKKCWPRDARMRLMKHDVNLGRSVFWDMKNRLPRSITTLEWENGFVSVYSKDNPNLLFSMSGFEVRILPKIRMTQEAFSNTKDGVWNLQNEQTKERTAIAFLRVDDEHMK

SEQ ID NO: 113447 - protein, 115 aa, Triticum aestivum
  unsure (1)..(115): unsure at all Xaa locations
  Clone ID: PAT_TA_7865.pep
TKSTKQNLSSLNSLLLRRSNQPSEDLDSFPEALPFLGFQATSWCLKMLFQHDNPATCSQTKHAQSLLFHFVFSGXKLHSAPSQHSKMHKSQQGLEYSSHKDAHTCPETSSQSARR

SEQ ID NO: 113448 - protein, 261 aa, Triticum aestivum
  unsure (1)..(261): unsure at all Xaa locations
  Clone ID: PAT_TA_7866.pep
MEVPAPIKTGSWSPEEDALLVALVRQHGARRWSVISAGVPGRTGKSCRLRWCNQLSPAVQHRPFTVQEDALIIAAQARYGNKWADIARLLPGRTDNSVKNHWNSNLRRCQRRAKAMAAATGRSVVARLLPRSSGSAVRAKMQQEEQVMVMNRSPPAVVHGAVTAVIDDPMPMLSLTLSLGLPQMAADKASEEAKAKAKEKXTTTSGVWGGNDVRLMAAIRQVVREEVERQAGQLLYSVVMATTAARVDGASSSDHPTNGHH

SEQ ID NO: 113449 - protein, 86 aa, Triticum aestivum
  Clone ID: PAT_TA_7867.pep
LRAERWEAAVTPNSRQALATISLQSVSNLYMFVTDTGCCRCRRKNHGRNAAPPKAQGVQTEKHKPIYVTGCLAGRTPTSGRKHKGK

SEQ ID NO: 113450 - protein, 144 aa, Triticum aestivum
  Clone ID: PAT_TA_7868.pep
LSFSREVAYEAVLFLKSGRSRTRSAHLYGKRKNKWQGVTRLPDRLRLGEQLRSSHSLTSTPPVLLHGHELPANLPRCSIAAPPSPVAALAAALGHRHDRLPVDLPGDGQLRGGSFMKQFSSSNKEGADAEAPVFRENEKPNGKE

SEQ ID NO: 113451 - protein, 257 aa, Triticum aestivum
  Clone ID: PAT_TA_7869.pep
MRPRRSPSAGRSSPESSNASQSSGSQSSGGMKNPDGSIPIPFTIHRGNPDRLTGLGSSYLEMPSGQENINLTKEDYPKLVLVIKDDDENQQMCLKIMKSLTHENVLGVHFWEKVEEGPYIRVHVEPYTASISTIISEAESLVDRRSKLVPSPAFEEIVSASIDGLDYIRESGYYHGNFSWETTLYHQEADKIVVKLANFEIKGPSLVECQVEDCISLAASLEWASQKLKKEYPNVKPHTCYIIDDLIRILKSFTMNS

SEQ ID NO: 113452 - protein, 196 aa, Triticum aestivum
  Clone ID: PAT_TA_7870.pep
MEATAIYDTRLGTWVMLSDGEDSTSAVFDRLLSHVFRLYRGVESVLCVGAAFGLCWAAWRYYERNSCLRSYGRDMTCSKQAANPVVGRDSEIDRVVSILCRKTKNCAALVGAAGVGKTAIAEGLAQRIAAGKVPAALAGARVVEVDLAAMVSGTLFRGMFEERIKSVIKQAEDSGGKIVLFIDEMHMLLGAGDGLG

SEQ ID NO: 113453 - protein, 114 aa, Triticum aestivum
  Clone ID: PAT_TA_7871.pep
ATRFATTRSLSAPPKQHSPRRVSNSGGAPGYTPSSCSNHVSGHLTKKRPGLPLEKLVRASSSKPLPCKTRSLCRRARHRVLRQHRSAQATEASQQDPAVHRLQCLPWTQQLRCE

SEQ ID NO: 113454 - protein, 86 aa, Triticum aestivum
  unsure (1)..(86): unsure at all Xaa locations
  Clone ID: PAT_TA_7872.pep
AXNSARGCLLALVVMSTTLLPSHVEGMIMDMKGTTVRTSCVVMKHCTIGQCQKNCSARGYDEDRSTCVSFEGDNCCCFKKGTPLPR

SEQ ID NO: 113455 - protein, 175 aa, Triticum aestivum
  Clone ID: PAT_TA_7873.pep
ESYKNRGRRRSMAAALRSAARRLWLGRGSLLQRTQAEGLFSPSRSRLVHTSEHAPTDLTREIQEKRDEVRNLVSKAVQKKRELYALGKADKNCETLGEHHMLPLALPYLSRQKVVPKPHGTLRTLMRFATRANALLDAAAHATIFILVTTAWVRARGGIGVKAQTVDEENQGRQD

SEQ ID NO: 113456 - protein, 93 aa, Triticum aestivum
  Clone ID: PAT_TA_7874.pep
MLSMSRVLARRLFSTAAPEGAAAASTSLARKAQNPLEELFEVERSTEDDQPAPHYGRGWKASELRLKSWDDLHKLWYVLLKEKNMLMSQRQML

SEQ ID NO: 113457 - protein, 145 aa, Triticum aestivum
  Clone ID: PAT_TA_7875.pep
MLALSRTLARRLFSTAAAPEGAAAAASTSLARKPQNPLEEFFEVERSTQDDQPAPHYGRGWKASELRLKSWDDLHKLWYVLLKEKNMLMSQRQMLASESMRFPNPERISKVRRSMCRIKHVLTERAIADPDPRRTAEMKRMINAM

SEQ ID NO: 113458 - protein, 281 aa, Triticum aestivum
  Clone ID: PAT_TA_7876.pep
MKKNMRLGGRNDVTQQQKTGQEPYRNARKKKANTIAITGCKAQLIVTKKDEKWVITTINLQHNHDLSPHTEVKYLRSHNYMTEEEKLLIRTFNAVKLPTRQIIAILSYLRGGNTPYTKKHVSNVRTAIGKESNQNDMMQVLTYFRKRQAEDPQFYYAFKTTKVSDDASKVLCIFWADGYSRKMYELYGDCLSFDTTFKTNRYTLPFAPFVGVTGHGQNCLFACSIIENETAAPFQWLFETLLHFMGGKSPSPIIPDEDDGMKTTIPIVFPHICHMRCFVSY

SEQ ID NO: 113459 - protein, 146 aa, Triticum aestivum
  unsure (1)..(146): unsure at all Xaa locations
  Clone ID: PAT_TA_7877.pep
FSLSLSRDLAWGSEQVLQKLEKLKHKKKRLVQSPDYFLMDVKSQGCFNMXLLQNETTVFSHSQTMVVCPGWETVLCRPTGGKARLTEGCSFCRKGNKGISRSSYGDLIYHCNGYCHTIDVFTGVEVSTPRLPSSAKCGKNSIRMAF

SEQ ID NO: 113460 - protein, 199 aa, Triticum aestivum
  Clone ID: PAT_TA_7878.pep
QECGTPPRHGRLQRRRSPAGGTKKKPSAAAAKGKATGKGKATSKAAPKAKESSLLKQKSPAEFFAENKNIAGFDNPGKSLYTTMRELVENALDSAESISELPDIEITIEEITKSKFNTMIGLVDRERVDEALYDDFESSKAREKRLAKEARFQETQAKNAALGKKVKDTPAARGKGRGEASFFRVTCKDNGPRYARMKI

SEQ ID NO: 113461 - protein, 116 aa, Triticum aestivum
  Clone ID: PAT_TA_7879.pep
MRTSLLLVVGVGIVISSIIMAATAMSMPGAWEYCNVDALKMQELGKWAVAEHVKMANDGIRFIEVWGCEEQVVQGVNYRVFLHAFHNSGEKGRFQAGVYEGASSSVRKLVSFGPVI

SEQ ID NO: 113462 - protein, 278 aa, Triticum aestivum
  Clone ID: PAT_TA_7880.pep
WEPPQMKALLHSVPVGRMIVLDLYAEVKPVWINSDQFYGVPYIWCMLHNFAADFEMYGVLDAVASGPIDARLSENSTMVGVGMSMEGIEQNPIVYDLMSEMSFHQRQVDLQVWVETYPTRRYGKSVVGLQDAWRILHQTLYNCTDGKNDKNRDVIVAFPDVVPVVRHAPGLYARTSKNYSTLASENSVVKDASNDAYDQPHIWYDTVAVIHALELFLEYGDEVSDSSTFRYDLRCSYCLIFGVKLLLFWLMFQYYDIAGGSIFTFCCFIDQPSICSAS

SEQ ID NO: 113463 - protein, 96 aa, Triticum aestivum
  Clone ID: PAT_TA_7881.pep
VGVWWTTKKSLLLKLSVYLLIIAMANCSRDIPDSVSDHPPGYIICGEITATWGKHLCIKHGTCNKPCRAEGYDSGYCAPFPWSTYCCCKNNCGESV

SEQ ID NO: 113464 - protein, 60 aa, Triticum aestivum
  unsure (1)..(60): unsure at all Xaa locations
  Clone ID: PAT_TA_7882.pep
LKGNISTEPMNIIRKKKKVQAGLTAWKTTTIINDDIKTKESIKPHEFTVQLYLVPNXLQX

SEQ ID NO: 113465 - protein, 153 aa, Triticum aestivum
  Clone ID: PAT_TA_7883.pep
AVQCSVVKMSHYPFDRSFHPGMSRCLLRLATDFRMDNRIVPWDELTGSDTIMNELAHELRRSGWRERTYEEVRKELFRLHERWKKVVEPKSETFRRTAAKNPFLWTEESEDEDYIFMPPLPDPASSKGKSSASSKCKSSASSKGKSSASTEGK

SEQ ID NO: 113466 - protein, 171 aa, Triticum aestivum
  Clone ID: PAT_TA_7884.pep
GTRAWEMRYLITYHSATVPLGNRSDLFLIMHSYVWEVLRKTDPGGYEYVMASLEYDPDWRNAVVNNEHLQKYYYADGGGLYESNAQLQGDEHRQVMRFNHDGQSHPLEHAADSSAPSGMLYNPVQLGHMYHANFARLTYSMQAALHAIDRLRCVGIKSLFSNDSKEYQEIR

SEQ ID NO: 113467 - protein, 93 aa, Triticum aestivum
  unsure (1)..(93): unsure at all Xaa locations
  Clone ID: PAT_TA_7885.pep
LVDIIMWXXFXIISSLLCSQTGKYAYLSSKETSNLVCVTLQRGCNEDKIEDFQVQDVRKEPCKRSRSCAEPLQPAKVSHCMQLNSSIPCLFQA

SEQ ID NO: 113468 - protein, 174 aa, Triticum aestivum
  Clone ID: PAT_TA_7886.pep
SSFGSVAACAAARVGEDVVENILVDDEILWTRCSAHQRKKLSVGKHQVFIHEDLLQKHPICTIFLHTIALRHHHTLTITTKVFALLLLLSAVAVAIGDVSLYNLRWDGDVSHYNLRWDDIRISVANGEGLNVVGHRVSAQVVSGRMDTGQRHCSCRPCRRRRSRRSSSSGVTSE

SEQ ID NO: 113469 - protein, 194 aa, Triticum aestivum
  Clone ID: PAT_TA_7887.pep
MVVLAASIISKSGKALASRQYVDMSRIRIEGLLAAFPKLVGTGKQHTYVETENVRYVYQPIEELYLLLITNKQSNILEDLDTLRLLSKIVPEYSPSLDEEGVCKAAFQLIFAFDEAISLGNKENVTVPQIKQYCEMESHEEKLHKLIMQSKINDTNDLMRRKVTEIEKNKIDRGKTGEGFAPTRTPNNFNDMNI

SEQ ID NO: 113470 - protein, 148 aa, Triticum aestivum
  Clone ID: PAT_TA_7888.pep
MSAAALRARLNNHVTSMFATDTVDEYFQYLQSVDEDGSSAPGLVAEVINLFIGDANSILNGIASLLNQTMVDFNKVDDLVHQLKGCSCSVGAKKVNLSCMHFHQFIEARSKEGCLMALALLTNEFCDVRDKFQTMMQLEQQIAACGPK

SEQ ID NO: 113471 - protein, 197 aa, Triticum aestivum
  Clone ID: PAT_TA_7889.pep
MAGSEGVRGLAASVGELHMEASPSREEGTNGHGNGDAAAVDDDVWGDASDSPGHDSDLKREWEHRQEQFHKMGYRDGITEGQKDVAQEGFNLGHRQSADVAFKWGLVRGITSALASLPDRLKEKLLLDAQRRGKLEDLHNSVQEISAQGALQLFHESTLQDNRRPEESKIQTIPKDLLLLLQECPDVHVSEELKRVP

SEQ ID NO: 113472 - protein, 241 aa, Triticum aestivum
  Clone ID: PAT_TA_7890.pep
MASRRERRLPPAPAFQMENPFSVKVLQVFTGAGVGCGVGIGVGRPIYLGMIPGLQQVMSATRGATDSFSGVTRHVNSALRKAGLKNIEAGIGCGVGIGHGFGIGIALKPRAIHGIQSSIAEVLSKLTSKLRDSSGETATADLTSGSLPTSGQTPNGMSMDLEAKAFKSNFQHTSSNEISQTARLMKLPWPRMGMQQRDDNRWELKRHWPLSRPVPRTINGIKGTCNHGTVCLLGGTQRKNS

SEQ ID NO: 113473 - protein, 66 aa, Triticum aestivum
  unsure (1)..(66): unsure at all Xaa locations
  Clone ID: PAT_TA_7891.pep
GTREVVNDILQXVDTDKDGKISYDEFVAMMKTGTDWRKASRHYSRGRFNSLSMKLVKDGSVKLGVE

SEQ ID NO: 113474 - protein, 161 aa, Triticum aestivum
  unsure (1)..(161): unsure at all Xaa locations
  Clone ID: PAT_TA_7892.pep
TRWGYTGRACVVRFYGLPPRKIVNLWPCQIIKTQGRFRPGKETLGPSTYLRSKVGRTLGRRLAFCSVXNFGTKGSSNLVMAFTSAQLLAAFSLALLLISSGAALKDCARIDIGECNQHKCITACIKLNFNTAICHNDAASEDSGGDVSLNEMGLYGSCVCC

SEQ ID NO: 113475 - protein, 105 aa, Triticum aestivum
  Clone ID: PAT_TA_7893.pep
MAENFQLQGRHGKSRVRVSRVWRRPAAAGGDVIVEWNVAVSIVFDCLPFYTFSDNFGIVGTDSIKNTVFVKAKECTEVVSMEEIAGILGRHFTSLYPQGSEATVT

SEQ ID NO: 113476 - protein, 302 aa, Triticum aestivum
  unsure (1)..(302): unsure at all Xaa locations
  Clone ID: PAT_TA_7894.pep
MAGRFDLQGRHGKSRVRVSRVWRRPADAGGHLFVEWSVAVSVVSDCLPSYTSDDNSAIVATDSIKNTVYVKAKECTEVVSMEEFAVILGRHFTSLYPQVSEATVTIVERPWERVAVDGKPHSHGFKLGSEKHTTEVTVKKSGSLLINSGIQGYSLLKTTQSGFEGFVRDRYTLXLPEKKERIVPTEVTAWWRYSFENISQLSAKPFFFTQRYHGCKXKILQDTFFGPSDVGVYSPSVQNTLFLXMAREVLTRFPDIASVQLRMPNLHFLPVNLGGKENPGLVKFADDVYMPTNEPHGTIEAH

SEQ ID NO: 113477 - protein, 293 aa, Triticum aestivum
  Clone ID: PAT_TA_7895.pep
MPRPEVQAPPEIFYNEAEARKYTTSSRIIEIQARISERALELLALPDDGVPKMLLDIGCGSGLSGETLTEHGHRWIGCDISRSMLDVALERETEGDLLLADMGEGLGLRPGVMDGAISISAVQWLCNADKSSHEPRLRLKAFFGSLYRCLARGARAVLQFYADNVKQTEMLVSFAMKAGFAGGVVIDWPHSSKAKKSYLVLTCGTSSVASLPKGKGENGEMCSSDDDDDGDESNDDQTVGTYGRNRSNKRQKVNKKNGRGKDWLLRKKEQMRKRGRDVPADTKYTGRKRKTRF

SEQ ID NO: 113478 - protein, 148 aa, Triticum aestivum
  Clone ID: PAT_TA_7896.pep
SARARAVSLCQCPPPPPRLLSPPRRRPAASAARPSGRLPVSRGGFLWGKKGRGFRLVGWDFGSSFERRFRLVFCDSESLCCDSCRPALPFLFPASTPRNSERPRRFFAPGLRPCKNWVGVGGVDAEIRGRTLSEREINNCCSKVDFYP

SEQ ID NO: 113479 - protein, 43 aa, Triticum aestivum
  Clone ID: PAT_TA_7897.pep
MAAPPARARADYDYLIKLLLIGDSGVGKSCLLSRFSDGSFTTS

SEQ ID NO: 113480 - protein, 1051 aa, Triticum aestivum
  Clone ID: PAT_TA_7898.pep
MLPRKREIVAGEVEDLQKKTRAGEGEVTREEGDAAMAGRGNEIDEDLHSRQLAVYGRETMKRLFGSNVLVSGLQGLGAEIAKNLVLAGVKSVTLHDDGNVELWDLSSNFFLSENDVGQNRAQACVQKLQELNNAVLVSALTGDLTKEHLSKFQAVVFTDISLDKAIEFDDYCHSQQPPIAFIKSEVRGLFGSVFCDFGPEFTVLDVDGEEPHTGIVASISNDNPALVSCVDDERLEFQDGDLVVFSEVHGMTELNDGKPRKVKNARPYSFFLEEDTSSFGAYVRGGIVTQVKPPKVIKFKPLKEAMSEPGEFLMSDFSKFERPPLLHLAFQALDKFRTELSRFPVAGSTDDVQRVIEYAISINDTLGDRKLEEIDKKLLHHFASGSRAVLNPMAAMFGGIVGQEVVKACSGKFHPLYQFFYFDSVESLPVDPLEPGDLKPKNSRYDAQISVFGSKLQNKLEEAKIFMVGSGALGCEFLKNLALMGISCSQNGNLTLTDDDVIEKSNLSRQFLFRDWNIGQPKSTVAATAAMVINPKLHVEALQNRASPETENVFNDAFWENLDAVVNALDNVTARMYIDSRCVYFQKPLLESGTLGAKCNTQMVIPHLTENYGASRDPPEKQAPMCTVHSFPHNIDHCLTWARSEFEGLLEKTPTEVNAFLSNPTTYISAARTAGDAQARDQLERVIECLDRDKCETFQDSITWARLKFEDYFSNRVKQLTFTFPEDSMTSSGAPFWSAPKRFPRPVEFSSSDQSQLSFILAAAILRAETFGIPIPEWAKTPNKLAAEAVDKVIVPDFQPKQGVKIVTHEKATSLSSASVDDAAVIEELIAKLEEVSKTLPSGFHMNPIQFEKDDDTNFHMDVIAGFANMRARNYSIPEVDKLKAKFIAGRIIPAIATSTAMATGLVCLELYKALAGGHKVEDYRNTFANLAIPLFSIAEPVPPKTIKHQELSWTVWDRWTVTGNITLRELLEWLKEKGLNAYSISCGTSLLYNSMFPRHKERLDRKVVDVAREVAKMEVPSYRRHLDVVVACEDDDDNDVDIPLVSVYFR

SEQ ID NO: 113481 - protein, 1038 aa, Triticum aestivum
  unsure (1)..(1038): unsure at all Xaa locations
  Clone ID: PAT_TA_7899.pep
MLPRKREIVAGEVEDLQKKTRAGEGEATREEGDAAMAGRGNEIDEDLHSRQLAVYGRETMKPLFGSNVLVSGLQGLGAEIAKNLVLAGVKSVTLHDDGNVELWDLSSNFFLSENDVGQNRAQACVQKLQELNNAVLVSALTGDLTKEHLSKFQAVVFTDISLDKAIEFDDYCHSHQPPIAFIKSEVRGLFGSVFCDFGPEFTVLDVDGEEPHTGIVASISNDNPALVSCVDDERLEFQDGDLVVFSEVHGMTELNDGKPRKVKNARPYSFFLEEDTSSFGAYVRGGIVTQVPPINSNPSASSAVAAAVIKHTHEIYSXPFTDLMRSRYAAYYSSVVSSTARGHVPKDVLAQLASMRACNDSIPEVDKQKAKSIAGRIITAISTSTAMATGLFCLELYKALAGGHKVEDYRNTFANLAIPLFSIAEPVPPKTIKHXAVVDGLGQTRHNIILKYFGIGCWQLEYEFLKNMALMGXISCSQNENLTVTDDAVVENSNLNRQFLFRDWNTETPKPTVAATAAMVINPKLHVEALQNRASPETENVFNDAFWENLDAVVNALDNVTARMYIDSRCVYFQKPLLESGTLGAKCNTQMVIPHLTENYGASRDPPEKQAPCTXHSFPHNIDHCLTWARSEFEGLLEKTPTEVNAFLSNPTTYISAARTAGDAQARDQLERVIECLDRDKCETFQDSITWARLKFEDYFPNRVKQLTFTFPEDSLTSSGAPFWSAPKWFPRPCVVQSSNHXLAAEIVEKVIXRLFNLSIPISEWAKTPNKLAAEAVDKVIVPDFQPKQGVKIVTDEKATSLSSASVDDAAVIEELIAKLEEVSKTLPSGFHMNPIQFEKDDDTNFHMDVIAGFANMRARNYSIPEVDKLKAKFIAGRIIPAIATSTAMATGLVCLELYKALAGGHKVEDYRNTFANLAIPLFSIAEPVPPKTIKHQELSWTVWDRWTVTGNITLRELLEWLKEKGLNAYSISCGTSLLYNSMFPRHKERLDRKVVDVAREVAKMEVPSYRRHLDVVVACEDDDDNDVDIPLVSVYFR

SEQ ID NO: 113482 - protein, 177 aa, Triticum aestivum
  Clone ID: PAT_TA_7900.pep
MASTIMAAASRAVVAKTPFLSGQGRAAGASPLRDIAAAANGRITMGNDLWYGPDRVKYLGPFSAQTPSYLNGEFPGDYGWDTAGLSADPEAFARNRALEVIHGRWAMLGALGCVFPEVLQKWVGVEFKEPVWFKAGSQIFSEGGLDYLGNPNLVHAQSILAVLGFQVLLMGLVEGFR

SEQ ID NO: 113483 - protein, 229 aa, Triticum aestivum
  Clone ID: PAT_TA_7901.pep
VCARSQGNDLWYGPDRVKYLGPFSAQTPSYLNGEFPGDYGWDTAGLSADPEAFARNRALEVIHGRWAMLGALGCVFPEVLQKWVGVEFKEPVWFKAGSQIFSEGGLDYLGNPNLVHAQSILAVLGFQVLLMGLVEGFRINGLDGVGEGNDLYPGGQYFDPLGLADDPVTFAELKVKEIKNGRLAMFSMFGFFVQAIVTGKGPLENLFDHLDDPVANNAWVFATKFAPGS

SEQ ID NO: 113484 - protein, 147 aa, Triticum aestivum
  Clone ID: PAT_TA_7902.pep
MLASQDGGVTELPNYHVWVIPVVPVNSDHDTRAAIYARGFIGTYPDSCDAFPTHPRTYDLLHADNLFSIYQDRCDITDILLEMDRILRPEGTAIIRDTVDMLTKVQAIAQRMRWDSRILDHEDGPFNPDKVLVAVKTYWTADPSEHS

SEQ ID NO: 113485 - protein, 562 aa, Triticum aestivum
  Clone ID: PAT_TA_7903.pep
TASTPGDLSMAPKVTAPPSLQASPHHSATISASSQSTNFLRPRSSAPSGTRSPYTTGFGAALNIETLVAAAERRDTSVEAPPSEVQDKIFFMINNISNSNLDAKAREFNEVSQDQYYPWFAQYMVMKRASIEPNFHDLYLKFFDKVNSKTLNKEMVKATYENCKALLQSDLIKSSSEERSLLKNLGSWLGKLTTAGTPTLRAKEIGPKFLLWRLWEERIMIAVIPFTSKILEPCHSSIAYRPPNPWTMGILSLLSEIYNLPNLKMNLKFDIEVLFKNLSVDMKDVKPTSLLKDRGREVEGNPDFSNKDVASSQTPVAAEVSSGVNPPIKHVDLQPEVNSTSRTLSLPTLYTAPVRLPPNSMVEDDKIALMMPEQVPSHTLTQVSSSQTPLVSLSPSPLSLTQLLSLIPHDEIRFKISSKLLPFGSQLQFSKIMGVALDKAIKEIILPVIERSVSIASKTTKEIILKDYATESDYSAANRSARLMVGTLAGSLAHVTCKEPLRVALLSHLRSLTQNLASNSETLERIVLVLINDNLDLGCASIESVAARKAVDSIEGEITQSF

SEQ ID NO: 113486 - protein, 99 aa, Triticum aestivum
  Clone ID: PAT_TA_7904.pep
TAMFFSTKTCIATIMVLALVLAHQGTVDSSRLFPNSHGCPDGYHLTCYVLRSSGVCRCMRDHRLVDHESTVARNSLVSPQIACPEGQVWIGKFGHCSVK

SEQ ID NO: 113487 - protein, 146 aa, Triticum aestivum
  unsure (1)..(146): unsure at all Xaa locations
  Clone ID: PAT_TA_7905.pep
XAXNSARGSNKSKVCTSVGSAACPPRLRWPYDNEGAVNPGKGQRVGSTVSCSFEICYGLCPAQEGEMAAVPENKIKVSRLAPVLLVHLASLVGLWRCVSGGSILGGFARIWLLFVYIRVSSGWIFSIFVILHREWLLFWCAGPICP

SEQ ID NO: 113488 - protein, 114 aa, Triticum aestivum
  Clone ID: PAT_TA_7906.pep
MSWLSFPTVELSSGQSPPAPFPSPSGQQATVEVRMREGQAVNIHMFCARRPGILLSTMRALDSLGLDIEQAVISCFDGFAMDVFRAEQCREGPGLLPEEIKAVLLHCAGLQNAM

SEQ ID NO: 113489 - protein, 208 aa, Triticum aestivum
  Clone ID: PAT_TA_7907.pep
ADAQERAAPSRLYLPLTQSSHLSLTLLLRLPNSPIRSARGIRRRSDATEFVPIQLLLLVRPSCGPASLSVSTRSTPLRHASSLRGLACTDLAWKYSYSSFADFCVRSHFSVFPVVRADLCLCVLSSPGPIVDGIWPLTSRPGRIPCLAKLLLNLLTISTFYLGLRKLQFSPTNRSDLFLSRSNFSFWVWCLRSSPNRSEIINHFPFLC

SEQ ID NO: 113490 - protein, 533 aa, Triticum aestivum
  unsure (1)..(533): unsure at all Xaa locations
  Clone ID: PAT_TA_7908.pep
MMVIQRACAFITYTSPADAWGESPIARRGRLIESRPRPVRSLLALAAPRRLHRRRRRAMAHRLLRDAQADGWERSDFPIICESCLGDNPYVRMLRAEYDKECKICARPFTVFRWRPGRDARYKKTEICQTCCKLKNVCQVCLLDLEYGLPVQVRDTALAINSNDAIPRSDVNREYFAEEHDRKAAPGEDYDSSYGKARPNDTILKLQRTSPYYNMKRALHGTASEAVPIQISSIPAHXRADPTDTSHLALHNIKAGSYAGNAPVAFKLFVISSDNRRRQPPNCGSVGSQNNGRLFVVAYLDLLKLTAIVGFYRATRFFLXNKLVIKGVRLKLMWGKPQAPRPDDDEAGRQGHVSHGGLLPRAVISQQHSSDQPQPPGMEGQQQVAPPGTGYFNIPPPPAVDQRMYPSMDPQRMGAVVRSQEGDGSKPGPQHAGQAQASSSSGQGYPMRPPLPPYYQGAQYPPYYPPPPYGGGYMAPPRMPYPPQYPPYRPMLAPPAHQQHGSSSQQPAPPPAGQQQAQAPPAQQQPPAAAAQN

SEQ ID NO: 113491 - protein, 147 aa, Triticum aestivum
  unsure (1)..(147): unsure at all Xaa locations
  Clone ID: PAT_TA_7909.pep
CRXFGTRPKAARPSLPPHSSQALSRRPMNPSRAPPASLLLPPPMACPELLLLRPHMLHHEHAGGEAHREDPGQLSLYRATPYRRNPVTRAANNGDAYGTRRCARSAPTRGCSRRRCTAPPRTMCVVAGTCDHWHILGSGTNIKQWLR

SEQ ID NO: 113492 - protein, 102 aa, Triticum aestivum
  Clone ID: PAT_TA_7910.pep
MFGRAPKKSDNTKYYEILGVPKSASQDDLKKAYRKAAIKNHPDKGGDPEKFKELAQAYEVLSDPEKREIYDQYGEDALKEGMGGGGSHVDPFDIFSSFFGPS

SEQ ID NO: 113493 - protein, 130 aa, Triticum aestivum
  Clone ID: PAT_TA_7911.pep
MFGRAPKKSDNTKYYEILGVPKSASQDDLKKAYRKAAIKNHPDKGGDPEKFKELAQAYEVLSDPEKREIYDQYGEDALKEGMGGGGSHADPFDIFSSFFGPSFGGGGGSSQGRRQRRGEDVVTHLKFPGR

SEQ ID NO: 113494 - protein, 165 aa, Triticum aestivum
  Clone ID: PAT_TA_7912.pep
LQNPQAEFKRIVSPLKFQTRCIAAFPDQQGFLVGSIEGRVGVHHVDDSNQSKNFTFKCHREGNDIFSVNSLNFHPVHHTFATAGSDGGFNFWDKDSKQRLKAFSKCPSPITCSTFNQDGSIFAYAVCYDWSKGAEKHNPSTAKTNIFLHSVQESDVKGKPRTGKK

SEQ ID NO: 113495 - protein, 73 aa, Triticum aestivum
  Clone ID: PAT_TA_7913.pep
LRSLYVLISESMSELEYLQPAVGIVLGFIGAKMIFDFCGYHIPTEASLAVVTTCLSGGVILSLRKASSEERDK

SEQ ID NO: 113496 - protein, 101 aa, Triticum aestivum
  Clone ID: PAT_TA_7914.pep
VTFVSSILISPSVFLNEVYWYLNYQQVEQIVFLSTLQHNFLNANSNESINIVGMDGSMHTMMYVLLILYLLDVAHHLLNFSILVLIDVVHDFAREHPFISC

SEQ ID NO: 113497 - protein, 416 aa, Triticum aestivum
  unsure (1)..(416): unsure at all Xaa locations
  Clone ID: PAT_TA_7915.pep
MASEVVRPSDAELLKAQADIWRLSLSYLTPLSLRCAVELGIPTAIYRHGGAASAAELVTALSLPSTKLPFLRRLLRLLAASGVFTVDKQSSEEERYRISPVSYLLVDGIPHEDHMNHTALXVLTCTSTRYIEAGIRLADWFKKDWSLTFKELHGATLFNERMGSLTTDFHDMRDRGLDKSXDELGIEAAMREFRDLFEGIQSMTYCCGNFGDDKGARAIVKAFPHIKCTVLAPPKIIATKPADGAMINYVEGDMFSFIPPAQTVVLKLVLHHLTDEECVKLLAQCRKAIPSRKDGGKVITGDIMIDHSGPMLETHXLMDIGMMTMTKGRQRDEKGSRELFTKAGFXDQLLLFVFFARTSSEVYPCRCTWTGPACLRTYLYVGGCLPSLAGLTSLGMWARVLADAWCPPVGANLDAF

SEQ ID NO: 113498 - protein, 173 aa, Triticum aestivum
  Clone ID: PAT_TA_7916.pep
MASAAVLRNAGSRRLFSYPTLRAAAIYVPSALPDAPAAAAAPAQPPPTAGTLWARSMATFTRTKPHVNVGTIGHVDHGKTTLTAAITKVLAEAGKAKAVAFDEIDKAPEEKARGITIGTAYVEYETAKRHYAHVDWPGHADYVKNMITGAAQMDGGILVGSASDGPMPQTKEH

SEQ ID NO: 113499 - protein, 162 aa, Triticum aestivum
  unsure (1)..(162): unsure at all Xaa locations
  Clone ID: PAT_TA_7917.pep
RERGRSAPCSPTSVTVSSSSSPAGRSSCPAALGFSIWISGTGRAWSWGPLGWPVPSEIFTLEITPAGQSRNVWVDILHTLVFVQAFLTMFSXLQLGLFYFSAGWVVXIMTLFHRALPCRETQATCPSEEMVLVWKGHWFWRRYIGDADVHVGANNGKGAAIA

SEQ ID NO: 113500 - protein, 205 aa, Triticum aestivum
  unsure (1)..(205): unsure at all Xaa locations
  Clone ID: PAT_TA_7918.pep
HSLFHSPLPSPPLPIWPTHLISYVEKRYSVGKKVTRPDQSRPAASLGPALPLLSSPRATARRTTHPDRRSTHHIYLPSFHPSILPSFLQAKQSSAEQREIQHSRQVEARCSPTPASASPPTLLPRSRRATHTRPRSSPTPTPTTPPSPLPPTPLXGATAATPSPSPSPSLAPATPTTSSRRCTRRRRRHVPPPGRHGAAIPDIRV

SEQ ID NO: 113501 - protein, 239 aa, Triticum aestivum
  Clone ID: PAT_TA_7919.pep
MHGGRREADEEGPPPLPLPLPLLHQQHQHQHQHQAAAAVATASNDDDDDAMYHHLGDMGQPSLISEYDLGAEGDLFKAPEPIIEEPLLALDPVAAAISMMSGGDNAMDDSIKVSDMGLSEVLYECEKELMEKSAIEETISELLDVKIPMLQVEDVPGELRASSSSTVAAGTGECSLQKSVSSGCLSSGDWMNGSAVRPNFLDFQGLDFEAAFGLRRAYSEGDIQKLGANTPRPGIAANV

SEQ ID NO: 113502 - protein, 217 aa, Triticum aestivum
  unsure (1)..(217): unsure at all Xaa locations
  Clone ID: PAT_TA_7920.pep
MSGRVFVLAAAFGVLLAAAAVSSRPVLTPLGTSRPAAGDLSVYFHADSCPQLETIVRSSVDAALQQNVRLTAGLLRLLFHDCFPQGLRRVHPPGTTASAGLXAQRWGWQQEAVQLGGKDIRGKGSRRRCXPPFSXCPDINGAGTRDARYPVPGGFLSTVPLGPLXTPAFNNDCSRRPPNTVDTAYASGNFTGLMFWQRKAIFGIAAGTTSNRLRFSR

SEQ ID NO: 113503 - protein, 188 aa, Triticum aestivum
  unsure (1)..(188): unsure at all Xaa locations
  Clone ID: PAT_TA_7921.pep
GSPGFGFVGERIEMAASDVEYRCFVGGLAWATDDHSLHNAFSTYGEVLESKIILDRETQRSRGFGFVTFSTEEAMRNAIEGMNGKELDGRNITVNEAQSRGGRXGGGGGGYVVAWRPRLRRCGRRDAWRLRVARYVARATWWWRATRGTWRGTESDGTENYRGPPAITRPRIYHQSYSLLCVHGLSAL

SEQ ID NO: 113504 - protein, 143 aa, Triticum aestivum
  Clone ID: PAT_TA_7922.pep
MEQQQVRGRRRRNGVLQVQDGSEIRSLVENKEAFTRFVDDRFRKLDADGDGRLSVKELQPAVADIGAAIGLPARGSSPQADHIYAEVLNEFTRGKQDSVSKPEFQRVLSDILLGMAAGLKRDPIVILRINGEDLSEFVESPRY

SEQ ID NO: 113505 - protein, 296 aa, Triticum aestivum
  Clone ID: PAT_TA_7923.pep
PPAVLLSPPPPPPPPLPYSPPHPMASARMEDRGAFGTKRSRNDVSVWEGDWNCLQCGNVNFSFRNVCNRGACGAPRPSPSPSPRMMPAPAGGGYDRSPLFYGSTGAPPPHIPLGSASYGAPYPHVGMRYGYGPPVGPHGSYGLISSYGQPGPMGGMGYAHGPELGRYGPELGRYGYGFRGSPMPVSSPWSDGALVENNNSTASRKRRGGPHGLSEGDWECPKCGNVNFAFRNTCNMKKCEEPRPTPGANSSSSSRKDKDTPEGSWTCPECNNLNYPFRTVCNRKGCSCSKPDSSSN

SEQ ID NO: 113506 - protein, 90 aa, Triticum aestivum
  Clone ID: PAT_TA_7924.pep
AQVLLMALIKNSGQAMCLLALVVMSTTSLPSLVEGRIIDTKGTMAGKPPCFVMKRCTLDLCEKQCLAHGYHKGQSDCISFTKNQCCCNRI

SEQ ID NO: 113507 - protein, 185 aa, Triticum aestivum
  Clone ID: PAT_TA_7925.pep
MAEEKHHHHHLFHHKKDEEQLAAGGYGESAEYTEATVTEVVSTGENEYDEYKKEEKEHKHKQHLGEAGAIAAGAFALYEKHEAKKDPEHAHRHKIEEEVAAAAAVGSGGFAFHEHHEKKKDTRRRRGRGEKNTLLRLIDLPISPPFAILLYNTSSPLFPVLFPLAPGSTLAATHLVTYQVLTRQN

SEQ ID NO: 113508 - protein, 105 aa, Triticum aestivum
  Clone ID: PAT_TA_7926.pep
LSYSSMLNLIRHSFTHYPHPHQELPWRLAPVHQPRMTSWIAAAAASCEDMTLAGFLASLGIPFHLIILVCALQVYSLRPELLDAQTDVSSTEAAAVILRWLEMVL

SEQ ID NO: 113509 - protein, 138 aa, Triticum aestivum
  Clone ID: PAT_TA_7927.pep
KDTKFNSTEECEASFQELKKRLVTSPVLILPDQRKDYEVYCDASRRGLGAVLMQEGKVVSYASRQLKPHEKNYATYDLELAAVVHALKTWRHFLIGNHCEVYTDHKSLKYIFTQKELNLRQRRWLELIKDYDMRLHFH

SEQ ID NO: 113510 - protein, 82 aa, Triticum aestivum
  Clone ID: PAT_TA_7928.pep
LLLSVATHSFRTRGVNVIFSSKAFVAGFVAYLLDNTIDRHEASVRRDRGYHWWDKFRSYRTDTRSEEFYSLPFNLNKFFPSV

SEQ ID NO: 113511 - protein, 166 aa, Triticum aestivum
  Clone ID: PAT_TA_7929.pep
GQPAASRGGSQPYRGHGRHPFPGPATGAAGRGTSGSGELQRRGWVVRGTVWQEGGGEETQRGRWQVGDLGELRHAQQSDTIVRVQVRKRLADALVLQCGGGLELVMHVSNRITDRTRDGLFDNLFLRRSASTGSYLCVLLCMYKPFFKTWQIGYFLRCSFCRSKEQ

SEQ ID NO: 113512 - protein, 85 aa, Triticum aestivum
  Clone ID: PAT_TA_7930.pep
GERATTFQGDYIIELGSTEPVVALFVGTLVKAYEGRRGASGSASCRWYINDDTSEMIDFHKKLQGKFSPIEKIVLQGQTTAMHLP

SEQ ID NO: 113513 - protein, 170 aa, Triticum aestivum
  unsure (1)..(170): unsure at all Xaa locations
  Clone ID: PAT_TA_7931.pep
XHQQGCCSIQKCIEHSDDEXKFXLLSNIISSALTLADEXLGNYVIQSILNHGIEWAASKIVDELEGHFGYLSIQKCGSHVVENCLKRAPQHMRDKIIQELINDPQLQHIMVDQYGNFVIQTALEHCKGPLHTTFVEAIRPHAAAMQSHMYGKRVLSKTYLKNKQHRVGVL

SEQ ID NO: 113514 - protein, 135 aa, Triticum aestivum
  unsure (1)..(135): unsure at all Xaa locations
  Clone ID: PAT_TA_7932.pep
HTGADGVLSAEPLLENPALFAGFRTKEWKEDGNEDGDGGLDPADLAIEYLKLCEQYPVPWRMIXRSHLHKLLGSCFRVHPQVREEFNAQDXLTFEGLHDXVKKLKELGGGIPLYRDPDLFTVTHRFTNGLAASNA

SEQ ID NO: 113515 - protein, 103 aa, Triticum aestivum
  Clone ID: PAT_TA_7933.pep
QVEEGICQVLSHLWLESEIIAGASGNAASSSASSSSSSAAPTSSKKGAKTEFEKKLGAFIKNQIETDSSVEYGDGFRAGIQAVEQYGLRSTLDHMRLTGSFPY

SEQ ID NO: 113516 - protein, 123 aa, Triticum aestivum
  Clone ID: PAT_TA_7934.pep
RNYSRHSPAPPYYTQQYNLKCNLLIQKKKAVSPLTASRCSRLSVHPACRCVPLPGSRFQRSAVHPQAPAPGLSSSSPLPCPPPLLLSSSSAIRAAGVLSPSKRISPSSESPFMLFFFFFPLFF

SEQ ID NO: 113517 - protein, 216 aa, Triticum aestivum
  unsure (1)..(216): unsure at all Xaa locations
  Clone ID: PAT_TA_7935.pep
PHVPVRIDRLVPRLLALPKKIQRSSLGQLKRFSLRELQVATDGFSNKNILGRGGFGKVYKGRLADGSLVAVKRLKEERTPGGELQFQTEVEMISMAXVHRNLLRLRGFCMTPTERLLVYPYMTNGSVASRLRDRPPXEPPLDWQTRRRIALGSARGLSYLHDHCDPKIILRDVKAANILLDEDFEAVVGDFGLAKLMDYKDTHVTTAVRGTIGHIA

SEQ ID NO: 113518 - protein, 266 aa, Triticum aestivum
  unsure (1)..(266): unsure at all Xaa locations
  Clone ID: PAT_TA_7936.pep
MIRREAKAKQLEKSNEDTRYTPPPIGPDPAADTKKPTDEAVCIWKNIYWKEFGLLASVWVAFLTLQVTKNYVATCSTWYWVLTVLQIPVSVGVSMYQAASLVQGKRALSSRANNQTSPKAHQILVYCFFGVTAGVLAGLLGVGGGVVMGPLFLELGIHPQVSSATASFAMMFSSSMAAVEYYLLKRFPVPYALFFTSLTFVAAIVGQRVARKLVNWLGRASFIIFILSSMIFVSAISLGGVGISKTTHKMARHEYMGFXNICNYHA

SEQ ID NO: 113519 - protein, 73 aa, Triticum aestivum
  Clone ID: PAT_TA_7937.pep
LNVYFASINNYVYSGATVFTGYEKHRYARSIQDKSFIGLAQAWSINAVCSAKKYFVVAPYEIKSSLDHHIFSF

SEQ ID NO: 113520 - protein, 243 aa, Triticum aestivum
  Clone ID: PAT_TA_7938.pep
MRRQGQYGEADINSMVAAQLHHYQAQQRVQKHPENSYTGRDPAQASAEHQYTPPKARQSQWDRGGPNAPSQVPSYAYNEAQGAGGAQSFYDGQRSDTKVGLEKQPSKESRDQPRTDRTETRYGIYNLPRTFEGLEQSFHEDIILLSKELQDAEDAENSRHMERLKEINTQYQEKLLALRARQANYRDEFLHKESLARQQQYQHASMSHYANNSAAGEQHGYHPTALPGEQHGYNPTPPAAAGG

SEQ ID NO: 113521 - protein, 197 aa, Triticum aestivum
  Clone ID: PAT_TA_7939.pep
QLSPQERETIDAIVKASDYPLSIVLVGVGDGPWDMMRQFDDNIPSRAFDNFQFVNFTEIMSRPIPTSKKEAEFALSALMEIPAQFKATMNLQLLGKQRGFPHRSVLPPPVSVYRQPSGCSTVKQTQSPGTSYGSPQKNASAPRQDSDVGDQQTCPICWSEAKNLAFGCGHQTCADCGKDLKVCPLCQRAISTRIRLY

SEQ ID NO: 113522 - protein, 33 aa, Triticum aestivum
  Clone ID: PAT_TA_7940.pep
FSEAREDLAALEKDYEEVAAEGGSDDGDEEEEY

SEQ ID NO: 113523 - protein, 105 aa, Triticum aestivum
  unsure (1)..(105): unsure at all Xaa locations
  Clone ID: PAT_TA_7941.pep
RDRDRSSRSRDRGDYYEVAWXRGDYGDYYHHSRRSSERNRNYDSDGSRCRRHRSRTRSPVREGSEERRAKIEQWNREREAPARQGSEERRAKIDQWNRERETAQA

SEQ ID NO: 113524 - protein, 314 aa, Triticum aestivum
  Clone ID: PAT_TA_7942.pep
MAEHLASIFGTEKDRVNCPFYFKIGACRHGDRCSRLHNKPSVSPTLLLCNMYQRPDMITPGVDAQGNPIDPVKIQGDFEDFYEDIFDELSKHGEVENLHVCDNLADHLIGNVYVQFREEDQAAKALQALQGRFYSGRPIIAEFSPVTDFREATCRQFEEHNCNRGGYCNFMHVKEIGRDLRKRLYGHLHRSGRSHSRSSRSPSPYRHHARDRDRSSRSRDRGDYYGGSLDRGDYGDYYHHSRRSSERNRNYDSDGSRRRRHRSRTRSPVREGSEERRAKIEQWNREREAPARQGSEERRAKIDQWNRERETAQA

SEQ ID NO: 113525 - protein, 181 aa, Triticum aestivum
  Clone ID: PAT_TA_7943.pep
MLASSRSALRSFPVREPPKILDGEGVATQKLIPRHMRNGGSLLDGHISAAVPVVDFSARLQPNEHAMDHRVSFELTVEDVARCLEKKTAISGDSGTASFHLAPTSNGDHHRESNEARAGLYVDETYHDLPEKARRSLSLRLAKDFNFNNVDVANVEPSVGSDWWANEKVAGMTSEPKKNWS

SEQ ID NO: 113526 - protein, 352 aa, Triticum aestivum
  unsure (1)..(352): unsure at all Xaa locations
  Clone ID: PAT_TA_7944.pep
MGPNPSLDMLAAAAGMESAAAAAAAEAQPRGRVVRIIVHDADATDSSSSEDESAPPPXPRCRRPRRSAGGSARSAAASWRPGGGTTRGRRSRRQPGRARPXVRYRGVRQRRWGKFASEIRDPIQGRRLWLGTFDTAEEAAAAYDAAKIRISGSRRPADGATGFPFSFPPPEPAKPTVLRLPMPQPAKPTILRLPMPQPAKRITSPPPPPPPPEPAKPAISPPPLPAKPFALPLKLRLKLSFNAQVKDKGWNWCSAGDVKEEEDGDCDGEAKVGDLSIAGEVKVEGGGCAGEVKVEGGGCADGSKEAGSSSEVKAVKPMWAMITGKRKKRSGCGTRVGALHASSVCVEEVGGT

SEQ ID NO: 113527 - protein, 1053 aa, Triticum aestivum
  unsure (1)..(1053): unsure at all Xaa locations
  Clone ID: PAT_TA_7945.pep
MLPSKTAPGAEAGGDNVGGGGTGGPSTASWPAPEVVEWVRAARDEIDYNLSMRHLPAVQQHIREAQGQAAQQVGRRHQVGGQGGRARVPEGPGHGSGLRGRGRKRRRYPPSVCLLQLDGPRKKTGSFVAYPKVRCLAKRISGSSAEALTLLASILVAVIFPDTLLDTGYKFDGYCHNHQPPISFIKSEVXGLFGSVFCDFGPKFTVLDVDGEDPHTGIIASISNDNPALISCVDDERLEFQDGDLVVFSEVHGMTELNDGKPRKVKNARPFSFSIEEDTSNFGIYVKGGIVTQVKEPKVLCFKALRDAMTDPGEVLLSDFSKFERPPVLHLAFQALDKFKKDHGRCPAAGCEEDAHSFLKIAAAINEASADRKLDTIDEKLFRQFASGSRAVLNPMAAMFGGIVGQEVVKACSGKFHPLNQFFYFDSVESLPTYPLEPQDLKPSNNRYDAQVSVFGSKLQKKMEEANTFVVGSGALGCEFLKNLALMGVSCSSKGKLTITDDDIIEKSNLSRQFLFRDWNIGQAKSTVAATAASAINPSLHIDALQNRACPDTENVFHDTFWEGLDVVINALDNVNARMYMDMRCLYFQKPLLESGTLGAKCNIQMVIPHLTENYGASRDPPEKQAPMCTVHSFPHNIDHCLTWARSEFEGLLEKTPNEVNSFLSNPAQYAAAMRKAGDAQARELLERVSECLNKDRCSTFDDCISWARLKFEDYFSNRVKQLTFTFPEDAATSMGAPFWSAPKRFPRALQFSAADQSHLNFIMSASILRAESFGVAIPEWAKDTSKLADVVNKIAVPTFEPKQGVNIVTDEKASNLSSTSVDDVAVIEDLLAKLQEYAKMLLPGFQMKPIQFEKDDDTNFHMDLISGLANMRARNYSIPEVDKLKAKFIAGRIIPAIATSTAMATGLVCLELYKVIAGEHPVEDYRNTFANLALPLFSMAEPVPPKVMKHKETSWTVWDRWSVQGNLTLAELLQWFADKGLTAYSISCGTSLLYNNMFARHKDRLTKKVVDIAREVAKVDVPEYRRHLDIGVACEDEDENDVDIPLVSVYFR

SEQ ID NO: 113528 - protein, 293 aa, Triticum aestivum
  unsure (1)..(293): unsure at all Xaa locations
  Clone ID: PAT_TA_7946.pep
MPWPLPPPRLAGAGRRGRGQPMHALARAASLLRRAVACPPQLGVAGRDTTLLAKILPNVYSNGYSTLMAPANEVLIPPELLSSKTVWTPDRELGQYEDLVARVTNFHNEDKGFMVLDGDVFDVPIRKDIVHRVVRWQLAKRQQGTHSTKTISEVSGTGRKPYKQKGTGRARHGTLRGCQFRGGATMHGPKPRSHAFKLQKKVRRXLGLKIALXARTAEGKLCIFEDLEVPSHKTKNIVQYIKQMDDTKKILLVDGGDIDKKLKVATQNLHYVNVIPSIGLNVYSRMEGTMIRS

SEQ ID NO: 113529 - protein, 261 aa, Triticum aestivum
  unsure (1)..(261): unsure at all Xaa locations
  Clone ID: PAT_TA_7947.pep
MMQLYSQPLLPKMHYVYPLSVTQLDVLRLQATHMVSTKLSRAEPPLRKEVVEYMLDVDSHMWSMRKSKANFFRIMKVLTPLVGTAQWFDTTRAWKNPLTTVLIHLLFIILVMFPELILPTVSLYLFLIGVWFXRRRPRRPPHTAPPVPQAATGSGEEDAGALEAGRRPRAEAGERKGRGRRRSTAGGVQGAVGDLATQGERLQSLLNWRDPRATAIFVTFCLIAAVVLYVVPFRMVAPTAGGGYRRKRTACCETVPCQVTS

SEQ ID NO: 113530 - protein, 150 aa, Triticum aestivum
  Clone ID: PAT_TA_7948.pep
RENSPGRVGSRSGRPGGELPTVGKGPTLMGTWRQRGHGQGPGSSTPRASGGLDDIIRILNNVNGKLDAKKACAGALKLQGKNVRKMQGQPAQPRRDGPRPPQETDPGPQLYHLDTDSKLYVNLDAELCCLETLKFQICTSQPTNQPVKCA

SEQ ID NO: 113531 - protein, 151 aa, Triticum aestivum
  Clone ID: PAT_TA_7949.pep
SISFVKPPAVVAALSLSTATCRSWSAAGADSLRCRLMSPRRPITLIVAAIKATNMLLASILYCWMQTTVITNYLQKEAAVYVIGVMPSPPSPTSMSFPLGKVLFPVLSASVCLLDFLLLYFFSYRSTLCQSTKLLCCLVSGRPFLSPLGLS

SEQ ID NO: 113532 - protein, 95 aa, Triticum aestivum
  Clone ID: PAT_TA_7950.pep
KIMMQPHSITRDHTCMLRESQTLTPIFLLNHNYSLAQPAYHHIYIANYCKESNLSFSVIYMKVCIISHLNTYHIRTKFITHTNCHYYYQLSKRYK

SEQ ID NO: 113533 - protein, 115 aa, Triticum aestivum
  Clone ID: PAT_TA_7951.pep
FLVVANFIDMSFDILDPERDSDKILTQISAVSYNFKMLFIASYPHCPFFNIQSFGIRHMKVTKLETRESVNTGIYVWKYFTSYNGIETDVFSKVHIILLFKTMFQVILLLNIMRQ

SEQ ID NO: 113534 - protein, 132 aa, Triticum aestivum
  unsure (1)..(132): unsure at all Xaa locations
  Clone ID: PAT_TA_7952.pep
MAASEAAAAAATPVTPTEGTVIAIHSLEEWSIQIEEANSAKKLVVIDFTATWCPPCRAMAPIFADMAKKSPNVVFLKVDVDEMKTIAEQFSVEAMPTFLFMREGDVKDRXVGAQRKTTRKLELHMARSSVMP

SEQ ID NO: 113535 - protein, 229 aa, Triticum aestivum
  unsure (1)..(229): unsure at all Xaa locations
  Clone ID: PAT_TA_7953.pep
IISGTSXMATPHVSGVAALIKSIHPDWSPAAIKSAILTTSDIVNSTGGSILDEQHRKAGVYDTGAGHVNPTRAADPGLVYDLSVTDYAGXICWLLGDSGLATIVRNSSLTCAKLPKVHAVQLNYPTITVSATSTPFTVKRTVTNVGPANSTFTVKVDAPRSLTVRVSPETLAFSKTGEKKTFRVSVSSHGLSEELHVEGSLSWVSEKHVVRSPIVAVSPRGDTAPDPSP

SEQ ID NO: 113536 - protein, 169 aa, Triticum aestivum
  Clone ID: PAT_TA_7954.pep
MEHKEAGCQAPEGPILCINNCGFFGSAATMNMCSKCHKEMITKQDQAKLAASSIDSIVNGSDAVMEPVVAGSNTVVAVAQVELQTMNVQQPADVAGPSEGVAAISKGGSRPNRSTPARRRFDLRDQRPVWDSSANDGFREHGGSAAVPRGPGQGNPRIGTKLRGSLVRK

SEQ ID NO: 113537 - protein, 230 aa, Triticum aestivum
  Clone ID: PAT_TA_7955.pep
MEPQGYVKNKASQSQSKTISGNDPFNSFVTDFDANNLHSGTTATGKTSELEAEVSNLKEQLKKPTSEKAEMTAKYEKLSAICRSQRQEIQELKRTVAETTPPPSSKVSSRMPELGSQRKERIEGTVWELEQGMLSGNSSAPSSEAKTWQAFPEAKAQARPKVDHATNGRQNLIRNTNAGPSSDAWGFGTSSGSTAAAAQMNRTNAQGSSSQRLSTGAAKKVDQPSGWAGF

SEQ ID NO: 113538 - protein, 282 aa, Triticum aestivum
  Clone ID: PAT_TA_7956.pep
MVVPEAAVDAEQHVERSTVPMVVPEAAVNTDQHVEGSTAPVVVPEAAVNADQHIEGSTVPMVVPEAAVNADQRVEGSTVPVVVPEEAVDTDQRADAVAAPMVMTEADVDADQRADSVAAPMVTTEAAADADHPIEDAATQDRKHGDDDGVVNVTPEEMRAIIEVIAETGKFWHDWSFLKRLLSLQLMQVLGEYSEAQMVIREDGQQQNSLFRETHSELFSQLNDALLRFEEGPPFTLQRLCEILLDPKGTYTKLSKLALALEKNLLVTSTITKCTEPYPTAH

SEQ ID NO: 113539 - protein, 215 aa, Triticum aestivum
  Clone ID: PAT_TA_7957.pep
ETLRSGSRSLLLELLHLGDVIIHCLFLRFTFNSLPCIPFGPVLLVEYARTVVIQFLNSGLLLQSVEKKIVPITRALRPGFCLFRVLLIFLMQTHGLVSGIVCLLAFTYLSTYERGQPSYWSCFTVGDVVSHRLILRFAFNLPRRIPLGCPFVGIYAQRMGFHISHRGLAGRALEGPVGSNARSPQAGPWLLQKVPQFPPADPCLVSRIVFLRPGL

SEQ ID NO: 113540 - protein, 88 aa, Triticum aestivum
  Clone ID: PAT_TA_7958.pep
TIFKIDVREPVRLAFNPKYLNTFAKVFTLSGQVKLFLSKTHPLMVECKIGQKGRIRCFVAPKVEPENQGEEEKKEAQKEEVINVGKME

SEQ ID NO: 113541 - protein, 239 aa, Triticum aestivum
  Clone ID: PAT_TA_7959.pep
MAPAPTTPSFLRPPPLHPHRIRLPAPPPSASFRLSEILGGRGLCNGEVGIRKELSSPTPPSPPPSTPSGDSSPGSAESDPPAVDPDAFEKEMMGLTGGFPGGEVGLKDFVAKNPPPPPKRTQTDGKASSAVVPAGRPRPPELPLFLPGMVVLVKNPNNAYHMYCGIVQRVTDGKVGVLFEGGNWDRLITFGVDELEGREKGPPMVNPKSVVLEALVEAMDEDEVAEKKKEEEGTAAIKA

SEQ ID NO: 113542 - protein, 182 aa, Triticum aestivum
  Clone ID: PAT_TA_7960.pep
RGKTVVSQYGQQILDLLLAETQPAKVCSQVGLCTFDGTHGVSPGSPLRAASWSRGSICRALGRPWVQAPRSLSSMPDSPIGLVHQLRSCLPCPMGESAVDCGSLASMPDIAFTIGGKKFKLKPEQYILKVGEGQAAQCISGFTAMDIPPPRGPLWILGDVFMGVYHTVFDYGKLRVGFAESA

SEQ ID NO: 113543 - protein, 110 aa, Triticum aestivum
  unsure (1)..(110): unsure at all Xaa locations
  Clone ID: PAT_TA_7961.pep
HEVDTYQDLSKLNRDPARVIYISGHALESXLQPGNCLPIXKPWELEAEDHSXLLILFPLLEYVXRQGVCDIRPXLASFEGRDMAAEFLERSXRVFEQKDSNTRRGRIWRR

SEQ ID NO: 113544 - protein, 233 aa, Triticum aestivum
  unsure (1)..(233): unsure at all Xaa locations
  Clone ID: PAT_TA_7962.pep
SCEAEVSGTLSRTTQQPPSPADSRRPPRPPAGRPPARSLARQVSLRPLAEASGRIGSPAMDWSAVTAEDLVAALREVDWSTPPRPVPEFFSRFTVPRSYSKWTSRLKCNLYYYRTNYFILIMFILGLGFLWKPVAILAAFMTGFSIAFLNDSFAVTFNEKVTRTVRQFSPHLAAKMRPPITPVILXRPSSKRSIHICGRPRWLFVLLFSAVSCMLWLTSCSLLTVLMGRFSML

SEQ ID NO: 113545 - protein, 75 aa, Triticum aestivum
  Clone ID: PAT_TA_7963.pep
SVFENNTHTCLGIPLRHQVVTHLIISLGHKWHPTGFPKSLLKILCLHHHAHSRPLLCSNYFSILSTPTGITLIRR

SEQ ID NO: 113546 - protein, 108 aa, Triticum aestivum
  Clone ID: PAT_TA_7964.pep
MDSLWHLGDELRGQPKVVEDRQWSLMTSKLAEITRSKGERMNTVPDAKQWDKTSYQLHDDSRIGHIGLMNLDLKMNEAAAMKLPFRGMPYNMNQMYLKGSNANSMSMR

SEQ ID NO: 113547 - protein, 155 aa, Triticum aestivum
  unsure (1)..(155): unsure at all Xaa locations
  Clone ID: PAT_TA_7965.pep
MRAAGAAVALLFFFLLAVPGEAAAALPRFAEAPQYRNGADAWAVTGAGVCDPGLVHIAMTLDAHYLRGSMAAIYSLLKHASCPESIFFHFLAAEGGGAXAXAELRAAEAXCFPSLRFKIYLFRAYAVVGLIXSGSVRASLEAPINYARNHLADLL

SEQ ID NO: 113548 - protein, 104 aa, Triticum aestivum
  Clone ID: PAT_TA_7966.pep
LKTVVDSDHLAAPAGKALLESIVSINELARARPGRCLANNELTCRLTLLPTGLLQGGEVVVWNGNHYFVKVANFWANRVSSDPPRLSLVHISSMDGTSPGGRPI

SEQ ID NO: 113549 - protein, 161 aa, Triticum aestivum
  Clone ID: PAT_TA_7967.pep
MAIDQCILVVKLADVWSCGVTLFVMLVGAYPFEDQDDPKNIRKTIQRIAAIQYNIPDNIRISDDCRQLISRIFVSNPLRRITMREIKSHPWFLKNLPRELTEAVQLSYFRRDNSVSAFSDQTTEEIMRIVKEARTLPKSSRSGYGYSEECSDEEEKEVESE

SEQ ID NO: 113550 - protein, 125 aa, Triticum aestivum
  Clone ID: PAT_TA_7968.pep
WLPPAPCLLPPSHTHPPRLVTAHMPSSYSPPDSSHVLRLPSLVRGLGPPPRLPCDWAPAQPGRRPTRALAPQFAARRAGPLQLPRAGGARWCGCLSRLPPPPSLPPPGGLAAACPVPVLLWFMDW

SEQ ID NO: 113551 - protein, 118 aa, Triticum aestivum
  unsure (1)..(118): unsure at all Xaa locations
  Clone ID: PAT_TA_7969.pep
MAATSSKSSSSSSSAQRAAAALLVAAAVAVSVLVVGAAAVCDMSNEQFMSCQPAAAKTTDPPAAPSQACCDALAGADLKCLCGYKNSPWXGVYNIDPKRAMELPASAARHAARLLAVC

SEQ ID NO: 113552 - protein, 98 aa, Triticum aestivum
  Clone ID: PAT_TA_7970.pep
LKFELKPRHLLWNRGSILLYLLYYLRLAIYNKRTCNNGLRTRLVFIREKTLAYVWSGFLYSLQLSAYSKNLCCNNGSRTKPVVVVVVVVVVIKTVLII

SEQ ID NO: 113553 - protein, 126 aa, Triticum aestivum
  Clone ID: PAT_TA_7971.pep
QDLVSLSLPLSVQTLAGFTMDQQSLVELEKAVAAAVAKEGGAVGFTGTEEQARAILRGVKMALEEAAAIGESPPLLRSLERFLAQRRSDQTSTAPAPRAGGGRPTGRRGLLHLRGIEGSGQLARPG

SEQ ID NO: 113554 - protein, 99 aa, Triticum aestivum
  Clone ID: PAT_TA_7972.pep
SFKHSGLANKKTVTIQPAAKDSAVVLSTTKTKKQNAPAKLSHKSVMRKEFRKMAKAVKNQVSDNYYRPDLTKPALARLSSVYRSLQVAKSGVKKKNRQS

SEQ ID NO: 113555 - protein, 312 aa, Triticum aestivum
  unsure (1)..(312): unsure at all Xaa locations
  Clone ID: PAT_TA_7973.pep
KXLELVVNYDVTNHYEDYVHRVGRTGRAGRKGCAVTFISEEEERYAPDLVKALELSEQAVPEDLKALADRFMSKVKQGTEQAHGTGYGGSGFKFNEEEEEARKSAKRAQAREYGYEEDKSDSDSDDEGGVRKQGGDVAAQAIAAAQAAAALAAARATSNAQQQVPATTAGSLLPLPVAPNQQNNEATQRALDAAYNLQKNLARIQAHAVPEHYEAELEINDFPQNARWKITHKETLVPIQEWTGAAITTRGTFIPQGKIVGANERKLYLFIEGPNESSVKKAKAELKRVLEDCANQALNLPGSAQTGKYSVL

SEQ ID NO: 113556 - protein, 131 aa, Triticum aestivum
  Clone ID: PAT_TA_7974.pep
VGHMAPFYVFPCGHAFHANCLIAHVTRCTSQVQAARILNLQKQLSLMDRKAAKDNGGTGNGESTVSSAPTVDKLRSQLDDAVASECPFCGDLMIKEISLPFILPGESVEKASWEIKPQPASQKILPMTMSI

SEQ ID NO: 113557 - protein, 565 aa, Triticum aestivum
  unsure (1)..(565): unsure at all Xaa locations
  Clone ID: PAT_TA_7975.pep
PPPRGCPCVLPGRVVLCPHQAPWRALWCSVFPGEGASRLSWRGSPLGFVQLFLVGSSGLIWPTGFAPPSRQSFPSQHASALNVSLSALAVRFLPVLLGGGLRTCLTWFRPLGPAPAPAFMISPKASPSTSSALPKMSXHTSSSKHLSLVTVICICIGALIGVLVIVLFICFCTFRNGKKKAPPVETPKQRTPDAVSAVESLPRPTSTRFLAYEELKEATNNFEASCVLGEGGFGRVFKGILSDGTAVAIKKLTTGGHQGDKEFLVEVEMLSRLHHRNLVKLIGYYSNRELSQSLLCYELVPNGSLEAWLHGSLGADCPLDWDTRMKIALDAARGLAYLHEDSQPCVIHRDFKASNILLENDFHAKVSDFGLAKQAPEGRLNYLSTRVMGTFGYVAPEYAMTGHLIVKSDVYSYGVVLLELLTGRRPVDMSQSSGQENLVTWTRPVLRDKDRLQELADPKLGGQYPKDDFVRVCTIAAACVSPEANQRPTMGEVVQSLKMVQRSTEFQESVPTPPARPNARHTATTYESDGTSSMFSSGPFSGLSPFETENMSRTAVFSEDLHEGR

SEQ ID NO: 113558 - protein, 408 aa, Triticum aestivum
  unsure (1)..(408): unsure at all Xaa locations
  Clone ID: PAT_TA_7976.pep
THSSLRSSGKGGRSIGPPIDPSAGKMNSLTATGSSSGAGSSGGGRGGEMRAADGEGYLRADGFDLVNLDMQLEKTRSRVWLDQQRGASPAQPXELLEWEIDLAKLDIQNQVASGTXGVADRGTYDGNDVAVKALEWGGEGQGCSSRRREGLEKGVGVRQPLDHCDCAXFVGASMGTSQLKIPASKKGGSSHGPGQRCVVVVEYQHGGTLKTLLFQHRDKKLPYKKVVQLALDMARGLSYLHSQKIVHRDVKAENMLLDRKKSVKIADFGVARVEAQDDDNMTGQTGTLGYMAPEVLEGRPYDHKCDVYSFGVLLWETYCCALAYPNYSIADISYHVXKLGIRPDIPRCCPKPLSEIMTRCWDGNPDHRPEMXEVVAMLERIDTTKGKSMTPAVPDHTSQGCSCFGFSK

SEQ ID NO: 113559 - protein, 225 aa, Triticum aestivum
  Clone ID: PAT_TA_7977.pep
SPLGPRVRVMVAPWERKGEAGERREARQGAEAQGNCRGERGVMKREGKSGEEERLRLLARMGGLCGLEGRCRPPLRFFFLPIDRPFIFALMRWSLSIGFVSNACQLRVLSRTVDVLQTKKKKAVHARADHLRHLSIYLLPWLLPGPGAPVVLAPWVLLLVGHGGSWAVACRLELNARKPPAVGTASSRPGGREGRKGNNREGRLEPNRHARSFFFFRPSVDPDAW

SEQ ID NO: 113560 - protein, 183 aa, Triticum aestivum
  Clone ID: PAT_TA_7978.pep
MASPAEETLAAEDTASPPPPPPARSPGFWFLGEDKSVHKALGGGKTADVLLWKDKKTSAAVVGGATILWVLFEIVEYHLLTLVSHVLIVALTILFLWSNATVFIKKSPPDVPEVQISEDLAVNIALALRADINKALALLREIALGHNLMKFLGVIVALWILSEIGELCELLRFMYIAVLILHT

SEQ ID NO: 113561 - protein, 138 aa, Triticum aestivum
  Clone ID: PAT_TA_7979.pep
YNGSRLIQNTTNSQMLHDTPSPHIQALGGYVPLCTGGGSWRTNRGVTPPSLSSIYHVVLRPTKHWPTACCCICTPRMLMPVVLCTTDNHQRLVVASACQHCYCPARLRRPRPSGPPPIITSGLLLHLHASTDAALLVI

SEQ ID NO: 113562 - protein, 124 aa, Triticum aestivum
  unsure (1)..(124): unsure at all Xaa locations
  Clone ID: PAT_TA_7980.pep
EQXTFPLQQQRKPQFPXPQPLXQYQQPLTQQPYPQEQPLPQQQPSVEEKQQLNVCKEFLLQQCNPEEKLSLLQSVIPFLRXKTSQQNXCXLKRLQCCQQLAXINEPSRXPAIHNIVHASSFNIG

SEQ ID NO: 113563 - protein, 102 aa, Triticum aestivum
  unsure (1)..(102): unsure at all Xaa locations
  Clone ID: PAT_TA_7981.pep
AGSDQGSASVPXGLQXPWGMGLMGNPSQGGGGMAFMPAGFGMMPDSSMNPGMQGRDFQGQADRGDGRGIQEQLPMVMQMQMSLPPPPPTQPPSAGQQSFNRT

SEQ ID NO: 113564 - protein, 120 aa, Triticum aestivum
  unsure (1)..(120): unsure at all Xaa locations
  Clone ID: PAT_TA_7982.pep
GITARMEHYGCVVDLLGRAGRLDEAMSVVATMPMRPXEVVLGALLAGCRIHGDVDMAEQLMQYLLEQDPGGDSNYVLLSNIYAGVGKWDGAGMVRGLMKVRGVKKRPGRSAVGDGGAVGG

SEQ ID NO: 113565 - protein, 171 aa, Triticum aestivum
  Clone ID: PAT_TA_7983.pep
MATSASTSGEWLKGALQELRERKGSSLEFDSDLISGLVSFCELAPPSDATSYLENFIGKEAAQDIIQEYLRRRGHIGSSNGTESFQSSNLQPYVKPSADAATTQTKKQTRTQKDSASSSSQSSKSQSGIAESQLPSKERVIERSGSSSKRSISSKGNLRDGTYLQNWYRGN

SEQ ID NO: 113566 - protein, 44 aa, Triticum aestivum
  Clone ID: PAT_TA_7984.pep
VDPASFVLYPVIPLFGFKLSVKTVITVAIRSEVFPNLNCKNGLY

SEQ ID NO: 113567 - protein, 233 aa, Triticum aestivum
  Clone ID: PAT_TA_7985.pep
MASRTAAVPEVALRSGDARPMPAIGMGTAQSPVVPDTTVKAVLEAVEVGYRHFDTASMYATERPLGEALAEAVRRGLLASREEVFVTSKLWCTQCHPHLVLPSLQESLQNLQMEYVDLYLIHWPISLKPGPVVFPVKREDAVPFDLEGVWRAMEECHRLGLAKAIGVSNFTTRHLDKLLPAATVPPAVNQVEMNPVWQQRKLREYCAEKGIHVAAYSPLGRQNWSGDGNAVLD

SEQ ID NO: 113568 - protein, 598 aa, Triticum aestivum
  unsure (1)..(598): unsure at all Xaa locations
  Clone ID: PAT_TA_7986.pep
PRVRVEHLFVGRLTKASCVNQEESDDIITVWGITIFVVTTRMNVDSTAIXIIDDAALNRVLDRDQVHEEEYLEDEEDDEFLKGFKVANFEYIDEAKALAAKEEARKKAEAEAASNKANYWEELLKDRCIEQEVEEIAMGKGKRSRKQMAAADEDDITGLHELSSEDEDYSYDDDVSDNDTSLPANVSGRKAQYSKKNSRNVDSLPLMEGEGRALKVYGFNHVQRTQFLQTLMRYGFQNYDWKEYLPRLKGKSVEEIQRYGELVMAHLVEDTNDSPTYADGVPKEMRADETLVRLAKISLVEEKVAAMEQGKITKLFPNYLMYEFTGLSGGRIWKGEHDLLLLKALIKHGYARWQYISDDRDNGLFETARRELNLPSANELISSQSNNEANGNLESTQEVQVNPTSLSQYRDIQRKIVEFIRKRYHILEKCLDIEYAVIKTNTPVPDDLTEQNVPMGHSPAVPDISEVLRELPPLVPISAKEVASDGSTDQAHLSHLYNKMCGVLEDSGPRALNSFCGDKAASASLANSLHQFEKVCEDVDRVLRVQENGAATPKEQVVDASVEEAKAPQVPSQDAGVVAANVVGPSTVKPEDKMEIDG

SEQ ID NO: 113569 - protein, 352 aa, Triticum aestivum
  Clone ID: PAT_TA_7987.pep
APTRPPTRPPTRPPTRQAQSLCRDDAWPRRQAVPEVALRSGGARPMPAIGMGTATFPVVPETTVKAVLEAVEVGYRHFDTASMYATERPLGEALAEAVRRGLLASREEVFVTSKLWCTQCHPHLVLPSLRESLQNLQMEYVDLYLIHWPISLKPGPTVFPVKREDAVPFDFAGVWRAMEECHRLGLAKAIGVSNFTTSHLDKLLAAATVPPAVNQVEMNPVWQQRKLREYCAEKGIHVAAYSPLGGQNWSGDGNAVLDSEVLAEIAKARGKTVAQVALRWIYEQGVTPIVKSFSKERLKENLGIFDWGLTDDDLRKIGQIPQKKIVRAETVLFSAEGEFTSADLADMEIVEE

SEQ ID NO: 113570 - protein, 179 aa, Triticum aestivum
  unsure (1)..(179): unsure at all Xaa locations
  Clone ID: PAT_TA_7988.pep
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRXLADNCTGLKXLVFNAVGGGTALGLGPPPKRCRYSEEIQLGSRVPPKFTRIKSHIP

SEQ ID NO: 113571 - protein, 101 aa, Triticum aestivum
  Clone ID: PAT_TA_7989.pep
QRLKAKAYIIPSFILAAWKKYAQPLVYSVINSFDEVGFDTHISICRFYWQVIKLWANIAAEIFVGEIDRDIQIHVLQDLAIDLQAAAVVAWSRLSAWMSSQ

SEQ ID NO: 113572 - protein, 196 aa, Triticum aestivum
  unsure (1)..(196): unsure at all Xaa locations
  Clone ID: PAT_TA_7990.pep
ESFGTGSDHIREKDGIWAVLAWLSIIAFKNKDNLGGDKLVTVEDIVRQHWATYGRHYYTRXDYENVDAGAAKELMANLVSMQSSLSDVNKLVKEIRSDVSEVVAADEFEYKDPVDGSVSKHQGIRYLFGDGSRLVFRLSGTGSVGATIRVYIEQYERDSSKTGRDSQDALAPLVDVALKLSKMQEYTGRSAPTVIT

SEQ ID NO: 113573 - protein, 357 aa, Triticum aestivum
  Clone ID: PAT_TA_7991.pep
MASSSATSGDDRPPAAGGGGGTPAQAHAEWAASMHAYYAAAASAAGHPYAAWPLPPQAQQHGLVAAGAGAAYGAPVPFPMYHHPAAAYYAHAHASMAAGVPYMAGESASAAGKGKRVGKTQRVPSGEINSSSGSGDAGSQGSSEKGDAGANQKGSSSSAKRRKSGAANTEGEPSQATTVQNAVTEPPLEDKERSASKLLVLAPGRAALTSAAPNLNIGMDPLSASPSSLVQGEVNAAASSQSNASLSQMDERELKRERRKQSNRESARRSRLRKQQECEELAQKVSELTAANGTLRSELDQLKKDCKTMETENKQLMGKILSHDDKMQQSEGPSVVTTLSIQVEAPEPHQGGHGKAS

SEQ ID NO: 113574 - protein, 241 aa, Triticum aestivum
  unsure (1)..(241): unsure at all Xaa locations
  Clone ID: PAT_TA_7992.pep
GMXAVXPRDGFPGFPAPGFRAVGGAVPLCACWPRPPPVHASTRRDCSIAATWVILWGIPVWRGGRTIVATHLKAQAQVIPQQDHFTKRILPKTLVVQEEYNEDDEDDESVAMASVALAMTARVSLFDSRNENITAKCLMAKATNKVTPNIKITVINHPSPMDSINELEGPNVEANEFEAFMGTLKGKSKKHFVALLEQLGEANDMIEAHEDTIYKMEGHSRDCAMRYRISPMLLGKSVFII

SEQ ID NO: 113575 - protein, 139 aa, Triticum aestivum
  Clone ID: PAT_TA_7993.pep
LLNYRMNYTDWNMVAQHPNFDNITKLFSFNYKPLTPYGGRINDTAMFWGMKFYNDLLNQAGPLGNAQSELLMRKDSETFTFQKGWAFPRRVYFNGDNCVMPSPDDYPWLPSASPLTKQPWTLPLLVFWTVLATLLAYYV

SEQ ID NO: 113576 - protein, 262 aa, Triticum aestivum
  unsure (1)..(262): unsure at all Xaa locations
  Clone ID: PAT_TA_7994.pep
ISIGSLHFRSFDITPAFTCSDTKTPCQSSWNFFEHLVGIEHQHIVLLLFASLRRRADEPRHESTIEPGVSAARPASVEEDGFSRCPGPVPRPALRPSSTRLLVGPQQDARPPPRTRTSPQPTPQTATTHEGRHARDRPRIRSCRGRGARAAVGRGSKHGNGASRAAPQPAAGTDGRAERRDERARRQLGGGHERESAAGDRGDRPKTAEHRRRRGGRAPRNPRRERRRSVARTMAETAGFRRXGRRRRRRRKKRRRERERSE

SEQ ID NO: 113577 - protein, 218 aa, Triticum aestivum
  Clone ID: PAT_TA_7995.pep
DSSKGKGFVFLSVFKWEQRKGWDVLLTAFLQEFSGADDVVLYLLTNAYHSDTDFGGKVHRFVNNSSIEEPVLGWAEVRVVDEHVPQSDLPRLYKAADAFVLPSRGEGWGRPVVEAMAMELPVIVTNWSGPTEYLTQENGYPLDVDRLTEVTEGPFKGHFCAEPSVDHLRALMRRVFGDQEEARRKGRKAREDMVERFSPEVVARIVADQIQQVVVSTQ

SEQ ID NO: 113578 - protein, 145 aa, Triticum aestivum
  Clone ID: PAT_TA_7996.pep
ARVTGRRRRLPQISPTLRNPTSPGDGGERMLRGSRRRRISPGGARGGPREAVQRDGYQRWRDGGGDGDLMLDLAVRVAVRSGGAAGRDRCWPAPDQGEARVEAPHLHRAGRGRPLARQRCRRPRRPPHRPRRAVVVGISGCFHCC

SEQ ID NO: 113579 - protein, 120 aa, Triticum aestivum
  Clone ID: PAT_TA_7997.pep
MEPGLASRVARSAAQPLSGCLSRHSLSPWLKIQNHIYPMPSLCHKVPSTAKCHTSMTTSYMETSDVTDLDWENLGFGLIETDFMYVAKCGTDGIFSKGEVLPFGPIALSPSAGVLNYGQG

SEQ ID NO: 113580 - protein, 90 aa, Triticum aestivum
  Clone ID: PAT_TA_7998.pep
WISLGNQADGTRGAADGPGARYKAAYPDFEVQPPSPPRASAPMDVDQSPPSRTPGASDGERPARVRHRESTKDRSCKDLLLFHYIVLVTC

SEQ ID NO: 113581 - protein, 92 aa, Triticum aestivum
  Clone ID: PAT_TA_7999.pep
MGLMQIPSGATEGGEGVGFMQFVQAVKQMLANGAELDIVDARLKGHFNHKQATVMVKIAISCLDERSKRPTMDQIARNLMECDDEDYHPAYF

SEQ ID NO: 113582 - protein, 152 aa, Triticum aestivum
  Clone ID: PAT_TA_8000.pep
DAVLDVLRCFPCLEKLYVIWDDYVKAEMKNVRQYEPLDPIKCLESHLKVLVLINYEGGEEDVGFAKFFVLNAEVVKEINFGVCKNIDIDMKWMTDQLMLLEAENRASQHARLKFGSSSASWFGSLDTRDLSIADPFSYCFVDRVDALSEAYL

SEQ ID NO: 113583 - protein, 193 aa, Triticum aestivum
  Clone ID: PAT_TA_8001.pep
NRGIPRGTILGSWLAWLRALVRCGLRPHAAASGRVGRQGRPPVRRGVWERPFSGGRAAAGSLAPAGGQQQPLPRRLPLVDRRISSGPAGAAASASAAGSAAAGSSAPAGAAASGSAAACCSAAGSSSGSAGAAASASASASASAGADSSGTTAGGGVSTTGASSAATTVGVWTSAVAIGGDEKADGYTKEWRG

SEQ ID NO: 113584 - protein, 254 aa, Triticum aestivum
  Clone ID: PAT_TA_8002.pep
GNITQERAFGTVSGQVLTHCSKSTFLRNTGLVVKAISSKLPHDQDMQGQNNVVSAPQTQVHSLTETLCETRRDIVRRGPGEQGRETGLPSKGREDQEARGPEGEGNGAAWDTSARKGKSPADRAEVRAMGRRMEPPACEGDGAPTAGMTAVVAVGANQTTNRASSPLLRKTGRDVRANTTKLPHEQDMQAQNNVISALQTQVHSLTETLCETRTSIVRCRQDMHGFEPDYQTFAMFFRSLGEMKTKVMVLHLTV

SEQ ID NO: 113585 - protein, 132 aa, Triticum aestivum
  Clone ID: PAT_TA_8003.pep
MGFDAFAAACCAIPVLVSVLAVRVAYVLCRSGLPPSRSRASGLRCLIVLGSGGHTAEMMNIVSELQKDRFTPRYYVAALTDNMSLPKAQVYEKSLIHVEGDREMIIENAQFMQIYRSREVGPSQTKHLQKKS

SEQ ID NO: 113586 - protein, 314 aa, Triticum aestivum
  Clone ID: PAT_TA_8004.pep
MVPLRVCHRLVHLRGLPSSLRLPLPSTMAAPQPGCKTLRPTTTSSPSPAGPATKRSRTMATDAAASPASAGCSAMKAEFTGHAEYLNALNDKRERLVKASRDVTMNSKKVIFQVHRISKNNKEEVLSKAENDLAAVVNQYIGKLVKELQGTDFWKLRRAYTPGVQEYIEAATFCRFCKTGTLLGLAEINDSLLALSDKSIEPLQINVLDYLLGVADLSGELMRLAIGRISDGEVEYAKNICAFVRDIYRELTLLVPLMDDNNEMKKKMEVMLQSVVKIENACFSVHVRGSEYIPMLGSSGESDYAFFGAADYDQ

SEQ ID NO: 113587 - protein, 179 aa, Triticum aestivum
  Clone ID: PAT_TA_8005.pep
LCYSPQAITKSNDGLLRLKTNKETIGGFSHVMFATGRKPNTKNLGLEEVGVKMDKKGAIVVDEYSRTSVDSIWAVGDVTDRINLTPVALMEGGAFAKTLFGDEPTKPEYRAVPAAVFSQPPIGQVGLTEEQAIEEYGDLVVYLSNFRPLRATLSGLPDRVLMKLIVCATTNKVVGVHMC

SEQ ID NO: 113588 - protein, 313 aa, Triticum aestivum
  unsure (1)..(313): unsure at all Xaa locations
  Clone ID: PAT_TA_8006.pep
MGQLTAAPGGGGDCLIKLFGKTIPVPDAGDKDLQHRGSSATAEPKVQEIAPQDSTGSPPQQPEVVDVEDPSLXKNSAADQQDEEQGDTANQKEKLKKPDKILPCPRCSSMDTKFCYYNNYNINQPRHFCKNCQRYWTAGGAMRNVPVGAGRRKSKSVSAASHFLQRVRAALPGDPPLHAPVNTNGTVLSFGSDPSTLDLXEQMKHLKDKLIPATRTENTDAPPVGSSAEGWAKAEESXQTNPKERVAAERSXNGAQHPCMNGGAMWPLGAPPPPARLTPTIALPLRPAAAAAGAAAGRRGAPRAGRAPCNYTS

SEQ ID NO: 113589 - protein, 96 aa, Triticum aestivum
  unsure (1)..(96): unsure at all Xaa locations
  Clone ID: PAT_TA_8007.pep
LEGGGETIEARQSNKLLNTHRQATARKDAKFGRNHQPPKSPRKNIYHPQETNSLVPECPNHHLVLYPQVGPTAVDLPTTAGCCWGVRGAVASSXXN

SEQ ID NO: 113590 - protein, 274 aa, Triticum aestivum
  unsure (1)..(274): unsure at all Xaa locations
  Clone ID: PAT_TA_8008.pep
RGRVYLVDLAGYKPGPAHEATRAQAIRQFGLAGGFDDDSVWFHKRMMERSGLGEXTHFPGWLMSIPVDMCLQTGRDESEAVVFGVVDKLLAKTGVRAEDIGIVIANSSLYSPTPSFVXAIVNRYPLRHDVVSHNLSGMGCSAGIIAIDLAKHLLQVHPDTYALVVSTENITLNAYLGGNRPMLVTNTLFRVGGAAVLLSNRRQERARAKYQLIHTVRTHRGASDRSYGCVTQEEDDAGHVGVSLSKELMSVAGEALRTNITTLGPLVLPLSEQL

SEQ ID NO: 113591 - protein, 225 aa, Triticum aestivum
  Clone ID: PAT_TA_8009.pep
GRSSRPGSWCPVRTHKGADDKAFRCVYQQEDESGKRGVSLSKDLMAIAGGALKTNITTLGPLVLPLSEQLLFFATLAAKKLVNAKVKPYIPDFKLAFEHFCIHAGGRAVLDQMESNLQLTEWHMEPSRMTLHRFGNTSSSSLWYELAYAEAKGRIRKGDRTWQIAFGSGLKCNSAVWRALRSVNPANPRDVAGNPWADEIHRFPVRVPNFSAIDPPTPSSDTTQQ

SEQ ID NO: 113592 - protein, 331 aa, Triticum aestivum
  unsure (1)..(331): unsure at all Xaa locations
  Clone ID: PAT_TA_8010.pep
VAELIRVHLPLDGLPVQPQSHAVVISRDVVAPHLSHVRRRDVRVPKCLFLIGPAAVLPCNRRRXGRPAKCRPGHIVCTSRSSPGCARRCVXTEEGHEGHAGISLPGARVAIPGEVLRSSITTRGALVDALSDAELLVRRLVGRKDINNKLKPYIPDFKVAXFEHFCIHAGGRAVIDELHTNLELSPPHVEASRMTLHRFGNTSSSSLWYELAYIXEAKGRMRKGDRVWQIGFGSGFKCNSAVWKCLRTVKTPTDGPWDDCIHALPRPHPGGRQAVRRHRRRAQLSAAGRTLHLHVRAPQNLELCGGPDQIKPISLSFALSSFPSSFFYLLN

SEQ ID NO: 113593 - protein, 87 aa, Triticum aestivum
  Clone ID: PAT_TA_8011.pep
TYSISSTDRAHNETKQQILQTEHITKLSNRYSTRKHISRAKDMTGRLFSVSSTHIYKQGGTSAGTDRVCKLLISSGPNTTGCGEDCF

SEQ ID NO: 113594 - protein, 457 aa, Triticum aestivum
  unsure (1)..(457): unsure at all Xaa locations
  Clone ID: PAT_TA_8012.pep
DRTSFPATSTASEILPNPSSEARITSPGNRLKNFLPAFELTNELVTELVSFTTPDSIPVATRPTPPTPAPPAPSALPLYPSLTPAGIAPPLIPRSPEYPGPAGPSALPLAHHAGPGAGRDPAVPGLPRAAGAVALRATRGRRRAAAAKAPPGPVHSPPARAVAALKPGPRHCPFRLRSPGSPAEPAPERLHHGLTLSVPVPRLDALLGPRTSFSAHSVALRAGLAGGVRGEVGAAAHRHPVPPNVEGYGSAVGRAGASGAENLANRILRRGGMTVVRHRCGQDMLHRGCQPCGSDAVVRXEYLGRSFVMCSVWRIYSXSAARRLACVVKVTSYVTSSLVNSKAGKKFFSLLPGEVVLASLDGFGKISDAVEVAGKDVLSTSSTVTTGLVSHKYGEKAAAATNEGLDAAGHAIGTAWAVFKLRQALNPKSVLKPTSLAKSTVKAGAAELRAKSSSKSK

SEQ ID NO: 113595 - protein, 118 aa, Triticum aestivum
  Clone ID: PAT_TA_8013.pep
IDCYVHTLAKVLGSEEEAKRKIYNVSCERYFGFGCGIDEETSNKLEGIPGVLFVLPDSYVDPEHKDYGAELFVNGEIVQRSPERQRRVEPVPQRASDRPRYNDRTRYARRRENQQQQR

SEQ ID NO: 113596 - protein, 230 aa, Triticum aestivum
  Clone ID: PAT_TA_8014.pep
MDPKAAARSKRSHTVHGRRTHQTPAAVAAHKQKRAAAAGGGGGGSSSSSAPRSRNLPSNWDRFEEEPEADDAVEWAGEVAPRSKGADFAFLLEQARAQPLEERGLGAAGRLASQDSPFDFMQASTSMLEAKAEGIMSWFEDDNFILEDDLAPDFEVPFLSMDLHALATKLSKIKLSQRLFMEEDLLPEDMAVASEDEDDEILIQLGTTLESDAKGSLVQHNFRDIKPGKD

SEQ ID NO: 113597 - protein, 154 aa, Triticum aestivum
  Clone ID: PAT_TA_8015.pep
KSFTVNSVHTMKLQLKDHEFFWNSKRKKIFFAYDVPQVFKNDLVKQKFAESPSMPDLPWTATWPTHELIPGQLMKHMLIYRGNNGLGSYNASDVEEFLRFISGMYSHENELKEKIPNLNVNKEVQRIYPCLWYDLKKAIRDAEEQADNAMAVDN

SEQ ID NO: 113598 - protein, 204 aa, Triticum aestivum
  unsure (1)..(204): unsure at all Xaa locations
  Clone ID: PAT_TA_8016.pep
IETXRHNATDLSGITISTGSVFPLHLRQAAQLDIEASFRLNTSDIAAHNEADIGYNCSTSGGATNRGALGPFGLLLTNGHSEQMAMYFYMSRSLDGDLRTHFCHDESQSSLARNVVKRVVGSTVPVLNGEALSARILVDHSIVESFVMGGRLTATSRVYPTEAIYEAAGLYVFNNATGSTLIVDKLVVHEMHSTPMQLDLFARD

SEQ ID NO: 113599 - protein, 240 aa, Triticum aestivum
  Clone ID: PAT_TA_8017.pep
HQQTENIGRQQQRETGRTNGRKGRATGGASPKRNKQKVAGARERVQQRRDEMAKEADLADAQQASEEGDPTEADAAPPREGWGDNRQAPAVGVGSGRPQKGRDQPVLERSAWHREGTCGGSGPPDPHQRPCTARSDEANPAQREGVGGQQTPAAAGTCRGKRAAGGHARRRGTPEEGGKGSRKNKRAQEDAGGDRKSERGLEKWKCAEALDERRAGTKKEEGRRQVRHKARCCFRRRSRE

SEQ ID NO: 113600 - protein, 75 aa, Triticum aestivum
  Clone ID: PAT_TA_8018.pep
LLQRADQTDGVFVRFLSVWVVTRSASVPFEIWVGSVPNAPTHICRHGRLTALFQQIAQILHYFIHKFCIISQANI

SEQ ID NO: 113601 - protein, 123 aa, Triticum aestivum
  Clone ID: PAT_TA_8019.pep
TNLRRSSPSGSRSSPSYSWIFNLNGISEMYKSYEDTNLWRIVENVPRGVHINFLKAERSLHRWALEDLQRIHTAEEVAADAWAEAWMHVLEDAGHWVHADNPDGLFRILSSTFRIETSLRGRE

SEQ ID NO: 113602 - protein, 61 aa, Triticum aestivum
  unsure (1)..(61): unsure at all Xaa locations
  Clone ID: PAT_TA_8020.pep
VRKRVAQSQANRMPNIERATLEAHQAGDFFCRPFKAFSVHYTEPXXSVQXXFPDPRHRALF

SEQ ID NO: 113603 - protein, 44 aa, Triticum aestivum
  unsure (1)..(44): unsure at all Xaa locations
  Clone ID: PAT_TA_8021.pep
FXQPXXLPQFKKIRNXPLETLPAMXNVYIPPYCTIAPVGIFGTN

SEQ ID NO: 113604 - protein, 210 aa, Triticum aestivum
  Clone ID: PAT_TA_8022.pep
HDRYETIKSLNIYSHLLFTYMDFPKHIFTTKPLNIGKYAGTKSSSPWCWNNFIKCIRDRAISGHGCLREGRSTEDAAPTAAGPVAADLAAAGARIWSPDKSRCGSCGSPEMEPGSSRDGDWRGRRLDVRGGARTAVGCGSRGRRLDVDREDGRSISGWSSRGGGAECKDGCMSGWSSAAAECELRDDGLTTGGARGRRQNCGSSTRTAAA

SEQ ID NO: 113605 - protein, 67 aa, Triticum aestivum
  Clone ID: PAT_TA_8023.pep
RLSIIMLSSKAASGAQARHDGKQSGLESYPTTPLFHFTVNNANCPKSDDVFLFHVVPSTGSENALMD

SEQ ID NO: 113606 - protein, 134 aa, Triticum aestivum
  Clone ID: PAT_TA_8024.pep
KSLTFKATPIPSFYHEAPSPKAEYKKVPTTPSQVTEAGEEEGGHEHLALIGGEREHEALLPRKPRQTRQQLQMPQQQQQATAAAGASHSKLIQEAAQLRTMPTSYRRSTSPCASCSICFLFLPQHFARCEIVGP

SEQ ID NO: 113607 - protein, 84 aa, Triticum aestivum
  unsure (1)..(84): unsure at all Xaa locations
  Clone ID: PAT_TA_8025.pep
PCGLXXKXXRGKQGNXXPPHHVLXQESLLSTEGDICSSIYGGRKCYSAGKTLLSLVSCGRSKFLGPASSINKETPDFYVENPST

SEQ ID NO: 113608 - protein, 374 aa, Triticum aestivum
  unsure (1)..(374): unsure at all Xaa locations
  Clone ID: PAT_TA_8026.pep
MALQVAGGAGCCGCLPLLGQRRTAAFRPPRAVASEGAAVEDGSKVMLGGSGVAVTKLGIGAWSWGDTTYWNDFEWDDRKLKDAKGAFDASVDSGITXFFDTAEVYGAGVSGAINSESLLGRFIKERKEKEGVEVAIATKFAALPWRFGKGSVISALKGSLSRLGVSSVESYQLHWPGIWGNEGYLDGLADAYEQGXLVKSVGVSNYSEKRLRDAHERLKKRGXVHLLSTQVNYSLIYRNPEEMGVKAACDDLGFSVAAPSPMALPALPALSTPAYPPSRPRRRIYTSDFLSKLQPLINKIREIGGSYDKTPTQVVLNWLICQGNVIPIPGAKNAEQAWEFAGALGWLLTEQEVEELRSMAREVKPVMGFPVEKL

SEQ ID NO: 113609 - protein, 577 aa, Triticum aestivum
  unsure (1)..(577): unsure at all Xaa locations
  Clone ID: PAT_TA_8027.pep
MGISTPSVPSPPHPRKKDQPRVRVAAAAAAAASALFPIPVAVSTGVAPELEEETAMATGVAPEPEKKTVVFPGWVMLDRFGRTYCHGDLDAACEEANKKKTAVEVVTSTGHHCFMSFTFSDHKLDDLLPRSTLVEPVVPSRLPAYPYVRATDEDLVLFEINIPRQPHDLPSDLFVYTAGRTPSVDQLPLYTEPMVSPFLMSKXSTQASCASRHNSYIVSDIKEGSHDCSMLAELCVFNSETEEWKVIEEVPAPQPQDQSNGGQFPILWSTDDVLACDGRFLCWVDYLSGVLLSDFSTIDSPVLHFVPFPGGKEYSEEVLLSRCFAGRFRSVSISHGIMRFVHIDNDFHERIHVDWRRRLERSQGHQQPPQKITIWTLNMRGGNSKFEWEPHREINLDCLWAQCDYRALDIGQRLPQFPVICVEDPDALCCLLRDEGTPGKAWMVMLDMNYAYLRSCTPYINQHPYDAGRVDVETHQNFFSNVPQLPTVFSNYLERPSVIRRDGDKVASKPSKKVKLASTPPEVAKKAKLAIHPPVQCEDLESDDWLDFGPVQVKDDVRRWCQVNSAKIGIDGMKMVY

SEQ ID NO: 113610 - protein, 215 aa, Triticum aestivum
  Clone ID: PAT_TA_8028.pep
RAAARLPVVVPIWFLAIVFPFFGPINSAVGSLLVSFTVYIIPALAHMITYRSAHARESAVEQPPRFVGRWTGTYVINAFVVVWVLVVGFGFGGWASITNFVRQHGPHGHRPRSYRSPRGRSPGAPWPIRGGPDSPAQHAPAPARRAGACCRHPRHGSRGRGRTGGRRGRCAGARREATSGGTDQSRSKSNAQRVGSELAVSFLLFFSWIQRDGDD

SEQ ID NO: 113611 - protein, 126 aa, Triticum aestivum
  Clone ID: PAT_TA_8029.pep
IQSGSAAVAQLEHPDMGVIPNITVGVTRHSASSPSSPRGSDRVRMGMGGGWSSRWPVSILGGSSSWRRWRASSAPTGAAAASPVLSTSSWGADPLVVIVDLVGKVRRSFARWPWRPAVRDRERERY

SEQ ID NO: 113612 - protein, 176 aa, Triticum aestivum
  Clone ID: PAT_TA_8030.pep
ANKFVGTSWCHLFFIQRLSDRVPSTETGKQNRHLGAEQRPGTVHARPPHARRQWKTAAAVARAPLRPRTSRGGAPPRRPAPPADNTEVDGWSRASPPVGPDQVTCRRASPGASRLGLPGRPRGRAGPSDLYLATDENATQEDPSRVAWSTMAGCVRAVPRASTCRSHFFVLEEKNL

SEQ ID NO: 113613 - protein, 133 aa, Triticum aestivum
  unsure (1)..(133): unsure at all Xaa locations
  Clone ID: PAT_TA_8031.pep
QHXXSNEIXQXXXXXXLXXXNXMQQXMIXGGRTEKVIANFLQSPLFQRDTKTDIRDAAVNLHGTDNVLQLVLKHQRVIEELRDENEKLRQVLIEELKISPSXKLQPDRTSGVKTYYPCSECFDCRRRSRKSNR

SEQ ID NO: 113614 - protein, 195 aa, Triticum aestivum
  unsure (1)..(195): unsure at all Xaa locations
  Clone ID: PAT_TA_8032.pep
MSDDGDSDICDGCIEAICCAFFVDSLGGKTLFRIVCAIVIFAVLATGFTLLVIAFVTRPVGVTXEDAALARLALANKNATATALAYDFSLAVAVRNHNWIMRAQHTAPLHAELLFAGARFARVGLAGAGGLVQPGNKEVYHATAAADSASVALGSXXVAEFVRESTAGVFHLELXXLXXVXXQPRHHLHRLHAIC

SEQ ID NO: 113615 - protein, 78 aa, Triticum aestivum
  Clone ID: PAT_TA_8033.pep
MGKLVSAALLLVLLLAATGEMGGPVAVAEARRCESLSHRFAGLCLRGHNCANVCRTEGFPDGKCRGARRRCFCTTHCR

SEQ ID NO: 113616 - protein, 87 aa, Triticum aestivum
  Clone ID: PAT_TA_8034.pep
CVMYTPLSSLLHGSCCATYGYRNFHPSVSTNPLPKKLLKREQNLRCNFFAWFSCFIFISSMTSVSVGSSTITVFSSLSRRYIDQQSI

SEQ ID NO: 113617 - protein, 308 aa, Triticum aestivum
  Clone ID: PAT_TA_8035.pep
MSPCQHCPLPPPPRSARSLPPPGTYLSGPLSAGPGPTSRRSGLRRAPEPPGVIRRSPPCHACRRRDVPKDGVARAWPSRGEIERTSPSWKGGIDSALEARLRASYCAFLRCLGFRLGLPQTTVATAVVYCHRFFFHRSHACNDRFLVATAALFLASKTEETTCLLNTILRASCEVSENQEFNLLPYMSRGQNWFELYRESVIQAEQMILTTLDFELEVAHPYTSLSSALSRLGLSHSVLFNVALSLINEGRRSSLWLQFKPHHIAAGAAFLAGKFLRYDITFHQNFWHEFKTTPHIVQDVVQQLKELL

SEQ ID NO: 113618 - protein, 98 aa, Triticum aestivum
  unsure (1)..(98): unsure at all Xaa locations
  Clone ID: PAT_TA_8036.pep
MASSRVMAASSQPPPSGSSDLARFRSASGIGSMNMDDILRNIYGEAPPFGAVAPADPAPAPXADARRTDDEVWKEISATGGLSAPAPATAPAGAGGGE

SEQ ID NO: 113619 - protein, 157 aa, Triticum aestivum
  unsure (1)..(157): unsure at all Xaa locations
  Clone ID: PAT_TA_8037.pep
XXGXXXLLXQDXVXGLQXTRXXGKXWIXVQPISGXXVVNLGDXGHFMSNGRFKNXDHQXVVNGQSSRLSIATFQNPAPDARVWPLAARGGEEPILEEPITFAEMYRRKMERDLDLAKRKKQAKDQLMQQQLQLQQQQQAVAAAPMPAATKSLNEILA

SEQ ID NO: 113620 - protein, 229 aa, Triticum aestivum
  Clone ID: PAT_TA_8038.pep
MAAAPSASAVSVRQRNAAAASLLLQDQQQEKHEAVDPVPPPPPPPRSTLYQALTSTASLANLLPTGTVLAFQLLAPTFTNHGACDATTALLTRILLAVLALSCLLASFTDSLKGPDGRVYYGVATLRGLWLLDYPPGAPTPPDTSRYRLAPIDAVHAALSVAVFGVVAARDKNVVRCFYGPSPARETEQVLDIVPLGVGVLCSLLFVAFPTRRHGIGYPVTNGAAGSST

SEQ ID NO: 113621 - protein, 434 aa, Triticum aestivum
  unsure (1)..(434): unsure at all Xaa locations
  Clone ID: PAT_TA_8039.pep
MAASSAPLLLLLYLAVVSPVAARAEDLLAAARAPETAAWLRGVRRRIHQRPELAFQEHRTSELVRRELDAIGVPYAWPVARTGVVATIGSGPGPVVALRADMDALPVQELVGWEYKSLEDGKMHACGHDAHTAMLLGAAKLLQSRKEDLKGTVKLVFQPAEEGSGGAYYILEEGVLDDASAIFGLHVDPALPVGVVSSRPGPFAATSGRFLATVTGKGGHAAGPHDAIDPIVAASSAVLSIQQIVSREIDPLQGAVVSITFVKGGDAYNVIPESAAFGGTLRSMTDEGLSYLMKRIREIVEGQAPVHRCSASVDFMEETMRPYPAVVNAEGMYAHAKEVAGRLLXGEGNVRVAPQAHGLREDFGVLPRRGIGGRLLXPIGXLANXSTMEPRPATHAPPPVIVGVARPVAPPFLAAVAIEYMKSTHRRKTNPTQK

SEQ ID NO: 113622 - protein, 165 aa, Triticum aestivum
  Clone ID: PAT_TA_8040.pep
MEAVRMGDASAACYEYMNSGLDSLLRGGAPLAVVRDGLAFEDRLLDSGNGGAACKGQIANADQEDEQCNSAVNSVGMNELRCLAAPEKRRAAGRPTSSREKAPYEGLSKRTRFCSICRREGHKRTTCPDRGDAPKKPRKPGKCKNCGIEGHRRNTCKRPLGFAES

SEQ ID NO: 113623 - protein, 243 aa, Triticum aestivum
  Clone ID: PAT_TA_8041.pep
LTTISALSPSDSWLPIVSSSIITCKRFRELGQSKVVLDSVSPLRLAVRLKSSSDSDDHFVQRCDGRGAPSTACYLLGMIPFYCLGSRGSGAALMAAAAVGGHREALYSLAVIQFNGSGGSKDDRDLRAGAALCARAASLGHVDALRELGHCLQDGYGVRRSLLDGRRLLIQANARELAAAVTTSASLLRAAAGSGKASRRHSCLLSDFGCRAAAPRGPARRMPPTGFLFEWFASRPAGRPKSK

SEQ ID NO: 113624 - protein, 167 aa, Triticum aestivum
  unsure (1)..(167): unsure at all Xaa locations
  Clone ID: PAT_TA_8042.pep
SCFGAGEGEAQQREADTGGGNRDETGSAQSAATDAGARGGEGGQRPIVGCGEGTGRASGDQKKKLLWGNXKSNPTETSTQWDSNLFSDRERQEKFNKLMGVKSNASASVQENKAVNKGEGPVAVKREAELDPDPEQGDVGGQRRREGRTVGLGLPGGQGVSEAAPTV

SEQ ID NO: 113625 - protein, 63 aa, Triticum aestivum
  unsure (1)..(63): unsure at all Xaa locations
  Clone ID: PAT_TA_8043.pep
XYNYSTIGQIHQSRRQNMSESKEAERNTYFDPEGLMSMAIFRNRLALTHPGSDALGACSLSSR

SEQ ID NO: 113626 - protein, 142 aa, Triticum aestivum
  unsure (1)..(142): unsure at all Xaa locations
  Clone ID: PAT_TA_8044.pep
PAPASLPHRRPDPTPRRRHLLRPVGCRRTARGGMPCPSRLLGLLHRRARSSCRWEGRKMVLLLSRCTAVTSTGGGQAKRDIHSSTSHPLFLTPSYLPPRSTTQLCSSLGRSDADAMGGTPLQPLLLFVAPDAMEGXPSNPAX

SEQ ID NO: 113627 - protein, 150 aa, Triticum aestivum
  Clone ID: PAT_TA_8045.pep
RKQMVLDDGTPFLAAPGPCQIGPLEQGWEGLVAVAPSSFFGDGMGLKAWAGQPKVPLAEEERLPRAHGGARSLADRPSLLKAAAESCRRHGLTQETNPFQQQMMNWLTQIQAAETFEKQQHQFPAPDNPLRKLIQQNSTAANTTMLALQP

SEQ ID NO: 113628 - protein, 347 aa, Triticum aestivum
  Clone ID: PAT_TA_8046.pep
FKYRVELRRIPLLVRPGNASLPALETCRAADFARDVWSGRWTRLARNDRCVDVDDAGRYRCLEPEHPCEAPWCDGPLGALESNGWVYSAHCSFKLFTGDAAWRCLDGKWLFFWGDSNHVDTIRNLLTFVLGVEDTSAVTRRFDAVFTNPSGEPGTLRITSIFNGHWNMSMNYLGLHSLRHKGFRQLVRSYFAGDDRVPDVVILNSGLHDGCYWSSVRAYVQATEYAAQFWAGVMAKVRARGLAVPRVFYRTTVATGGYARDLAFNPNKMELFNGVLVEKMRQHGVLTGGVIDNFDMTFPWHYDNRCNDGVHYGRAPAKLVWRDGKIGHQYFVDLMLGHVLLNAICNG

SEQ ID NO: 113629 - protein, 175 aa, Triticum aestivum
  Clone ID: PAT_TA_8047.pep
MAPLSSKAVALVALSSLLVTYASAGAGNFNDSAFTADPNWEDARATWYGAPTGAGPDDDGGACGFKNTNQYPFSSMTSCGNEPIFKDGKGCGSCYQIRCTNDQSCSGNPETVVITDMNYYPVAKYHFDLSGTAFGAMAKPGLSEKLRHSGIIDIQFKRSVACISSLVARILSGPT

SEQ ID NO: 113630 - protein, 98 aa, Triticum aestivum
  Clone ID: PAT_TA_8048.pep
PTRPNAVYMAILVEYENGDGDVVQVDLMESGRRGGGGGRWTRMRESWGSIWRLDSNHRLQAPFSLRIRNESGKTLVARNVIPKNWRPNTFYRSIVQYS

SEQ ID NO: 113631 - protein, 273 aa, Triticum aestivum
  Clone ID: PAT_TA_8049.pep
MAGLLSVKAIALAAVLAAAYVSCAAAEQPGAADLDASAVSYSSAWLPARATWYGAPNGAGPDDNGGACGFKHVNQYPFSSMTSCGNQPLFKDGKGCGSCYQIRCSSDKSCSGKTETVMITDMNYYPVAQYHFDLSGTAFGALAKPGLNEKLRHSGIIDIEFTRVPCEFPGLKIGFHVEEYSNPVYFAVLVEYEDGDGDVVQVDLMESRGPGGGKWTRMRESWGSVWRLDSNHRLQAPFSIRIRNESGKTLVANKVIPANWRPNTFYRSFVQYS

SEQ ID NO: 113632 - protein, 276 aa, Triticum aestivum
  unsure (1)..(276): unsure at all Xaa locations
  Clone ID: PAT_TA_8050.pep
VAVAVAVILCILVAHAHGCYAKHHAAPSAANSSWLDAKATWYGAPHGAGPDDNGGACGFKNVNLPPFSSMTSCGNQPLFKDGKGCGSCYQIRCLKSDHPACSGVPKTVIITDMNYYPVSRYHFDLSGTAFGAMAKDGRNDELRHAGIISMQFKRVPCKYPGLXTVTFHVEXGSNPFYMAILXVEYEDGDGXDVKQVDIMESRPNAVNGGKMAQXSGSWTPMRESWGSIWRMDSNHRLQGPFSMRITSDSGKKLVANNVIPANWRPNTDYRSFVQFS

SEQ ID NO: 113633 - protein, 276 aa, Triticum aestivum
  Clone ID: PAT_TA_8051.pep
MGSLPLPSLAVLAALLCFLAVGGAVDLNTTDPSPFDVDLNATDATKYWGPWTPARATWYGQPNGAGPDDNGGACGFKHTNQYPFASMTSCGNQPLFKDGKGCGSCYKIRCRKDMSCSGRTETVIITDMNYYPVAPFHFDLSGTAFGRLAKPGLNDRLRHSGIIDIEFTRVPCEFPGLKIRFHVEEYSNPVYFAVLVEYEDGDGDVVQVDLMEANSGSWTPMRESWGSIWRLDSGHRLQAPFSMRITNESGKTLVADKVIPANWAPSTFYRSIVQYS

SEQ ID NO: 113634 - protein, 214 aa, Triticum aestivum
  unsure (1)..(214): unsure at all Xaa locations
  Clone ID: PAT_TA_8052.pep
MDAFYSTSSAAASGWGYDTLKNFREISPAVQSHPKLXVYLTLCFALAXSSAVGAYLHXSPLNIXGGMLTIRVPCIGSRLAWSVLCAESMVQRGVRFGLLMGCXAVLARGRFSLGPLIELASSTLDPSXILVTSGFRLEPAIAISRMRSLGAAIIAKQQRXYLYLALACSPPGLPILLWLQFPTSXIFGHASGSFMFDVYFGHLAFLCYVVYDTQ

SEQ ID NO: 113635 - protein, 123 aa, Triticum aestivum
  Clone ID: PAT_TA_8053.pep
MALLTARPSTKGMSVPARFLHDAAGSRMHRFADPGTPYVTHNNSGLALSPRSAPVKKSLLNGFVSSSLNRPVRQSSPSKLVGNSSRRMSSPSRPRNSMGTSASTWDQQGRNSSGYGRRWVGGS

SEQ ID NO: 113636 - protein, 178 aa, Triticum aestivum
  Clone ID: PAT_TA_8054.pep
MDITQILLAAQSPDGNLRSAAEGNIKQFQEQNLPNFLLSLSVELSNDERPPESRRLAGIILKNSLDAKDSAKKELLIQQWVSLDPSIKLQIKESLLITLGSSVGDARQTSSQVIAKIASIEIPRREWQDLIAKLLSNMTQPGASAPLKQATLEALGYVCEEIPPEHLEQDQVNAVLTA

SEQ ID NO: 113637 - protein, 717 aa, Triticum aestivum
  unsure (1)..(717): unsure at all Xaa locations
  Clone ID: PAT_TA_8055.pep
CKPTCSIRLACATPPVARHNPWGKMVSPAVLLPDGEVLPAVIFGSAGNTHFIGNIIHTXIYAPFADAGQSCCCNLCTLLXGKLYNRLESXGRGLYAFVSSTILSCSKGAVAFVAPTEYMVRPPMPPSYFFLIDVSVSAVRSGLLEVVAKTIKSCLDDLLGYPRTQIGFLTFDSTLHFHNFKSSLSQPQMMVVADLDDVFLPLPDDLLVNLVDSRRIVESFLDNLPNMFQDNVNVESALGPALKAAFMVMGQIGGKLLVFQSTLPSLGIGRLRLRGDDVRAYGTDKEHILRIPEDPFYKQMAAEFTKNQIAVDIFSLSDKYCDIASLGSLAKYTGGQVYHYPSFQATTHGEKLKHELSRDLTRETAWESVMRIRCGKGVRFTTYHGHFMLRSTDLLALPAVDSDKAFAMQLSLEETLMTTQTVYFQVALLYTSSSGERRIRVHTAAAPVVTDLGEMYRQADTGAIVSVLARIAVENSLSDKLDSVRQQLQLKLVKSLKEYRNLYVVQHRIGGRLIYPESLRYLPLYILALCKSLALRGGYADVSLDERCAAGFSMMILPARRLLNFIYPSLYRLDEVLTVEPDMIDGALKRLPLTLQCLDTAGLYLLDDGFTFLVWLGRMLQPELMNDILGVSLSNFPDLSKIQLRECDNNHSRNFMAVLRALRERDSSCYQLPRVVRQGEQPREGFLLLSNLVEDQMAGTSSYMDWILQIHRQTQSS

SEQ ID NO: 113638 - protein, 203 aa, Triticum aestivum
  Clone ID: PAT_TA_8056.pep
GEVGVFGSGDVIDLLPGGRDIAVDSKNRGQYIDLLIQSLFMASTKEQLTHFAKGFSYMLVKPELRKLFFLSLHLEDLDSMLGGRIGTIDVQEWKEYTRYDGGYTQQDDQINWFWEAVTSMMVEEQRRLLFFWTSVEYLPFDGFRGLDLGSGLVISKASSKISEHLPSSSTCIYQLNLPMYTSFAMMLSRLQKITQEHVSNSFW

SEQ ID NO: 113639 - protein, 234 aa, Triticum aestivum
  Clone ID: PAT_TA_8057.pep
MADEYGRGGYGRSAAGDDYDNKTSNEGYDRREGGYNKSGADDYEHERSSGRGGYNKSTGDDEYSGAGYKKSGGDNYDTGYNKQSSNEEYGRNKPGSDDYDRSAGGYKKSGDDEYSGGGYKKAGGDDEYSGGGYKKSGGDDEYSGGGYKKSGGDDTEYGSSRDETEKYRKEEKEHKHKEHLGEIGTLASGAFAMYEKHQVKKDPENAHRHKIEEEVAAVAAVGSGGYAFHEHHEK

SEQ ID NO: 113640 - protein, 221 aa, Triticum aestivum
  Clone ID: PAT_TA_8058.pep
FGTRPRRLICAPPPWLLRYGRRRSTWIYGVERADQTAAHLAAANLFDFLVNWLDDFFMDQGDLHRRISRIVLKIRIDDLFLHGYVADCDAHSATVVACSKNIPVSLVNCTVTLVFPDGRKFSPNKHDIKIWDNVASIQCYFPGDVLNTNLVQSLEVCRTPLLMSENIYTYSAYEGDYTGIITPGYLISIHENYFHHNSCANIYSGDGALVINKNGELVGLC

SEQ ID NO: 113641 - protein, 148 aa, Triticum aestivum
  Clone ID: PAT_TA_8059.pep
MTLGSSGAGSSVVVPRNFRLLEELERGEKGIGDGTVSYGMDDADDIYMRSWTGTIIGPHNTVHEGRIYQLKLFCDKDYPEKAPSVRFHSRINMACVNHETGAVDPKKFSVLANWQREYTMEHVLTQLKKDMAATQNRKLVQPPEGTFF

SEQ ID NO: 113642 - protein, 107 aa, Triticum aestivum
  Clone ID: PAT_TA_8060.pep
VSDQSIDHMYMSSASIHSLAASFLLLMHPSSPRSNYSRCPTFPGTPKLPPTGEARGGAGSTRAEGGRAGGAGRRGGGACGGLEGIARRVGKGRLGVGKGKLRRVRPP

SEQ ID NO: 113643 - protein, 118 aa, Triticum aestivum
  Clone ID: PAT_TA_8061.pep
AKFKPGPSLQSMRPRVLLVAFAVLAALPLAHSQVANPWPSCDNCDSCTKSNSPGCTRWNYLSSWVFYRRPSARAVSCPPSGHKSFQCTNRINDFCESCCTPAAQSFSSLCIWIDAEKK

SEQ ID NO: 113644 - protein, 60 aa, Triticum aestivum
  Clone ID: PAT_TA_8062.pep
MRGKELARQRSEINAGFFYSNTEQGESMVSSERRQVDEHVNKIIELKIRFLEFYSWIRKF

SEQ ID NO: 113645 - protein, 134 aa, Triticum aestivum
  unsure (1)..(134): unsure at all Xaa locations
  Clone ID: PAT_TA_8063.pep
AGEAATVRGGRGGGGALGSRVGTSASSLPRRGTRAEAKGRRGCAPERQGTRGRLCYGLSQRVKPYICTMPLXLDGGWNNIQLKLSDRMKRGGAAARVQALPSSSSDMVEGETTVRGFPGGRSPGDIDAYRCDIH

SEQ ID NO: 113646 - protein, 125 aa, Triticum aestivum
  Clone ID: PAT_TA_8064.pep
TSSSKIISSMSKSYDEEDDEELQASIFPGCNSASRNQVPPFSSHTPTGANRANPLAVTPACAFVPRAIPRLTGVGTNWIRLLQGRSRSFGTDLGKNEHPRPPKLAEKMRPGEWSYWMARVGGLVP

SEQ ID NO: 113647 - protein, 210 aa, Triticum aestivum
  Clone ID: PAT_TA_8065.pep
VILFFYLVSTLLTSASRTAMAFPASLSLETSSAMFLASPRRPRSQFHSTCDSSLNLMKLSIWGSCTLLVHSLSSVWAAVARPMTPASQRPGWASLMPGWLSLWTAGLAVAVALRRSLAEVRAAIPTRLSSFALTFSLSRVIMEAQSSGKGVPAHNVLTLGLSPSASAAASETSLRRRRTTTTKKKEEETGVARASRCTRCPNGPTGRSPG

SEQ ID NO: 113648 - protein, 470 aa, Triticum aestivum
  unsure (1)..(470): unsure at all Xaa locations
  Clone ID: PAT_TA_8066.pep
MLAHPVSMEQEQHSSTVRKFTSYAWDERERWIWSSFHESQLAYKKNIQLGSLEKFELVNRSSPSYLSPLFVKHEKVYSPQFTVGPVGNILCVLEHEVSSIIACALAISEERRQDTTVVNEAEDARREHTKTMEKSYSFLSESSIGSSPWSSIDSEASISSSISSYSSGDLSGYDTSPLLSLVHPEIPVNGKVSLRGKYSVTSIYANQFYILRRKCCPSELAYITSLSRCKKWDAQGGKSKALFAKTLDDRFIIKQIKKTEFESFIKFAPDYFKHVYHSLDTGSQTCLAKXPGIYQVKQMRHGNGELQDLIALXHCLLGSNFVEDMNVSPIYIGGRTKHLLQRAIWNDTSFLTSVNVMDYSLLVGVDKQKNELVFGIIDYLRQYTWDKQLETWAKSSLVPKNVLPTVISPKDYKKRFRKFMGKYFLAVPDTWSPENSSGPYKSFGHSNNKLAEAHNGDNLLQHPIEADARI

SEQ ID NO: 113649 - protein, 394 aa, Triticum aestivum
  Clone ID: PAT_TA_8067.pep
MAGLHPQQIWVNVEFDGFYRDHNLDIEDYLLKLPKDYPIAYISSPDISFLKSIGGKLKGRAKLIFRCLADNVTETSVKKSYGEILKDLKSIKAFASGIMVPRNYVWPVNNNLYLLPPTSLVKDAHALGLEVHVGSFANDILTSYNYSYDPAAEYLQFINNPDFTVDGLMTDFPPTASGAVACLAHNEANALAAFGARPPIITHNGASGVYAGCTDLAYQQAVKDGADIIDCSVRMSKDGVAFCLGSADLIASTTAATTFMTKVVTISEIQSKSGIFSFDLSWSEIQSLKPELTGPFAQAGLKRNPAAKNAGKFFTLPEFLDFAKSSNVSGILIEIEDAPYLATRGLGLVDAVSGALVNASYDKESKQQVFIESDDSSVLSAFKKFPSFKRVLTV

SEQ ID NO: 113650 - protein, 121 aa, Triticum aestivum
  Clone ID: PAT_TA_8068.pep
QKVENPSRQPFSSTPRPPPPLLPTPSPPTPNALNTPPGRRHAGNRQRWSAARAQQKSTPNPNKSGQRIGSRKPSWPRRQRLDLLAVMWSRPSRRLYHRCGSTSPLPPGIPSRQDFNRFIRL

SEQ ID NO: 113651 - protein, 219 aa, Triticum aestivum
  Clone ID: PAT_TA_8069.pep
MYADRVSGRKRSVGDPLGAGGGGRGPRPRPGSAKTLRQVDGAWRRALYKDSVGTQSSSVPASRNLQAIQKSHMRQSTVDVKKSSVPDLREKLSGGQRPQLSRTGRIPLPVARPLQFQLFPAAAAAAVAARPVTEQVNAPAAPKQSHEKADASLDRLLKSLDLEKYSINFQAEEVDMKALVHMNEEDMKSLGIPMGPRKKILSALASKRKKSSRSLPPTS

SEQ ID NO: 113652 - protein, 239 aa, Triticum aestivum
  Clone ID: PAT_TA_8070.pep
SARELEYTDAKESLLQAARKAPTAARGFRIQCNKWAILVRLLLGEIPERTVFMQKGMKAALTPYFELTNAVRVGDLEVFRAVAEKFGSIFSADRTSNLIVRLRHNVIRTGLRNISISYSRISLADIAKKLRLDTKTAVADAESIVANAITDGAIDATIDHANGWVVSKETGDVYSTNEPQAAFNSRIAFCLNMHNEAVKALRFPPNSHKEKESAEKRRERLQQEEELAKHMAEEDDDDF

SEQ ID NO: 113653 - protein, 205 aa, Triticum aestivum
  Clone ID: PAT_TA_8071.pep
MLVGRATTPRAIAASHATGAAPSLAPRAGGRRAGLGILPGPTAPAHAPTATQKTVDGPSMKDWRGGRGAGQNIIPSSTGAAKAVGKVLPELNGKLTGMAFRVPTPNVSVVDLTCRLEKSASYDDVKAAIKAASEGALKGILGYTDEDVVSNDFVGDTRSSIFDANAGMGLSSSFMKLVSWYDNEWGYSNRVLDLIAHMALVTAKH

SEQ ID NO: 113654 - protein, 187 aa, Triticum aestivum
  Clone ID: PAT_TA_8072.pep
MAACIDGARRKQGSVGDVVVFAPGLRGAHGRGLVPSPGAPRAHNGPWDVVPSAPRVAGLARRGEAVAPETPRPRHANPRTRTAHQPQALARCLPGLLQCHSHAGALSLRAPFVRTNQKPPPVEAPRAVAGYEVLSVLHLMAMVCLLQANSLLLPRAYGDGYGPRVSEESRRATVDVFLKASGYLDCA

SEQ ID NO: 113655 - protein, 92 aa, Triticum aestivum
  Clone ID: PAT_TA_8073.pep
RRNESIKWERALVAAISARIPSVLIHLVTDPHQTCNCLSHTPATPTYASHIASLVLKRRYILFSGFYERKWRHFPLLRHMNMPRLEDKEIPE

SEQ ID NO: 113656 - protein, 131 aa, Triticum aestivum
  unsure (1)..(131): unsure at all Xaa locations
  Clone ID: PAT_TA_8074.pep
XAXNSARGNLSSIPFLSLSRRISPVAAAPAPLPHAQEPHRPTNHDTMPARACIGCTMRSDPSSSPPCVLADGGESRPGSYAADHPGFLRIQRGAGVVPGKDSSSTSRKRSICPGSRGSLVPVLEPGQKGRD

SEQ ID NO: 113657 - protein, 240 aa, Triticum aestivum
  unsure (1)..(240): unsure at all Xaa locations
  Clone ID: PAT_TA_8075.pep
RRRAGGAYSVSRLRRRRRPGPRFALTDGDSGCSSSAAAAAPGLAVPPGGGLSPPAASSFLTSTDWGYHLLVVQDYSRTKQATPTGEWISSRPFMVGGHKWCIDYFPNGYTESCANFISLFVNLLDDDAEEPVKGKFNSMLGYNMFMEKDVLEQSSHLMNDCFTIRCDIMLFSSKDAGGDKVLMSEIDQHLNNLLQTKVGADVTFEVSGEMFAAHRCVLAXARSKVFMAQLFGPMKEGTTT

SEQ ID NO: 113658 - protein, 116 aa, Triticum aestivum
  Clone ID: PAT_TA_8076.pep
CFLLSLSSLPHVEREREREEGSPLSPLSYQEPHFALQSSLRILAHLLIGFSPESQFGQFGASWASFRADICLPSETKVASFLHWHSQSRIFQQVVSFGCLGVAETYCRFSQAKCCI

SEQ ID NO: 113659 - protein, 155 aa, Triticum aestivum
  Clone ID: PAT_TA_8077.pep
KKENPASDDGGSTGIKGLLESPRSYYALSGGAGKAVSTGSKIALESPRTAEKPSAGDIVSMVMKRRRAMPRSDQQPSEAGRVKASGGIFGYMRESSGKQEKEKEGLASSGEGEKTQSKEGVVVAAASGGGEETGVAADAPVSAEQAKAGGAAVVV

SEQ ID NO: 113660 - protein, 397 aa, Triticum aestivum
  Clone ID: PAT_TA_8078.pep
MNRSKNGATSVADLTDDLIIEILSLLPVKSVCRFKCVSRLWYSLISHPEHRKRLPQTISGFFYPKHRLNDEYDVITFPTSDGVPRDQEQLFPDSSLPFLTGYRQILPKDCCNGLIFCLCWKDSPIDEADYVVCNPATEEWVVLPDAGHRSDAIAYRLGFDGAMSLHFHVFQILEDDEDYGYISGVNIYSSETGAWSYKENGWGDNEIQIVDMRGVFFNGMMHLLTCEFKILAVDTEGKTWRTISLLETMCVGNICLGPLAFIGQSQGRLYFINMRDNDSSKLSVWILEDYNGNEWIFKYNISTSQLFGELFGEKDVMLQRDYADLLLQRDYALIAIHPECNLIFFVWRCEDVLLSYDMDRGKARVICSLKEHSYHTFPPYLPYVPSFSRIGRPRVEA

SEQ ID NO: 113661 - protein, 226 aa, Triticum aestivum
  unsure (1)..(226): unsure at all Xaa locations
  Clone ID: PAT_TA_8079.pep
MYSTEDEHQHGHGYGDGDDAAEWKKVAELRAVVEAQDPAAKEEDDFSLRRFLRARXHNIGKASAMLLQYLSWRRVAKPHGSISADEVRERDLQRIRVRMQGLRTVSIRPMXISYWGHDNFPCPGRDPVEFKRYVTYVLDKICTRLPVGQEKFAAVIDMKGWGYANCDIRGYVAALEIMQGYYPERLGRVFLIHVPYMFMAAWKMVYPFIDDRTRKKFVFVTDKDLK

SEQ ID NO: 113662 - protein, 134 aa, Triticum aestivum
  Clone ID: PAT_TA_8080.pep
DRGGRGRPQNPGPISREAPEGRATPYPRRGGVEQSTKTGPRNNMQGVRRGSKQRGWAKTWKESKEDRNPMSAKVSLQPHECTYREKQTGGSAREGISIRNIKIRITWHINHLKLGYSRIAKFTVVAQYLGRDHA

SEQ ID NO: 113663 - protein, 129 aa, Triticum aestivum
  unsure (1)..(129): unsure at all Xaa locations
  Clone ID: PAT_TA_8081.pep
SCYIINTTQCSTNSCGWLLFPEVGAAALVLDHVEGSRHVSSALDIESLELVLGFAPFAIRGVVPTAPKGRENPPHKNELYLILREVARFYPVSLHFVADGVEALRLGYHKCEGEQRFPSHLRRGRXHAC

SEQ ID NO: 113664 - protein, 119 aa, Triticum aestivum
  Clone ID: PAT_TA_8082.pep
CRQAWNRARTDPPSSGRGAVQNRQVGALTASSWKQQRDHRQDRNGGQQLVRKIGDGARMLRSGTVAARVGWRLTSETRGAAGMLRCGAPAASSSGGWISIICCTLSQWREILTIMNFFK

SEQ ID NO: 113665 - protein, 266 aa, Triticum aestivum
  unsure (1)..(266): unsure at all Xaa locations
  Clone ID: PAT_TA_8083.pep
RPQHRCTHRVAFVFAPIVVLWLLSIGSARRYNIIHWNPXVCLALSPHYIVKFFKITGRDGWISLGGVLLAVTGTEAMFADLGHFTAASIRLAFVGVIYPCLVLQYMGQAAFLSKNMSDVHDSFYLSIPRTVFWPMFVLASLAAIVGSQSIISATFSIVKQCLSLGCFPRVKVVHTSRWIYGQIYIPEINWILMVLCLAVTVGFRDINIIGNAYGLACITVMFVTTWLMALVIIYVWKKNILLALSFLIFFGLIEGAYLSASFIKVP

SEQ ID NO: 113666 - protein, 41 aa, Triticum aestivum
  Clone ID: PAT_TA_8084.pep
ICYIYYFKYDRSSSKVHGHNNISSLLLRSQRNITVHCMMLK

SEQ ID NO: 113667 - protein, 234 aa, Triticum aestivum
  unsure (1)..(234): unsure at all Xaa locations
  Clone ID: PAT_TA_8085.pep
HIVFRYSILTIMDRADPMNSPRCLFGXTSVGEKAYVAGGTDASGNGCHRMNASCAXYDSVTHTWTPLPSMNRARKMCSGVFLDGKFYVIGGVTNNNQVLTCGEEYDLNRGSWRVIENMSEGLNGVTGAPPLIAVVNNQLYAADYSEKDVKKYDKLNNKWIALGKLPERSVSMNGWGLAFRACGDRLIVIGGPRTSIGGIIELNSWVPDGQPPVWNLVATRQSGNFVYNCAVMGC

SEQ ID NO: 113668 - protein, 105 aa, Triticum aestivum
  Clone ID: PAT_TA_8086.pep
RLEGLIQYPFSSFGSRPHTPLSSSSSSPFLPTRSTPGHAGSAHAGALVAVIAATTPGRCRATAASASLLVRRPLVPALLRLAPPPPLWLTSMREGNDGSARRPPS

SEQ ID NO: 113669 - protein, 192 aa, Triticum aestivum
  Clone ID: PAT_TA_8087.pep
TTIPSVFSKTYVTPRRPYEKARLDQELITLGEFGLRNKREVWRVKYTLAKIRKAARELLTLEEKDQRRLFEGNALLRRLVRIGVLDETRMKLDYVLGLKIEDFLERRLQTQVFKLGLAKSIHHARVLIRQRHIRVRKQVVNIPSFVVRLDSQKHIDFSLKSPFGGGRPGRVKRKNLRKGAGGGGAGADEDED

SEQ ID NO: 113670 - protein, 86 aa, Triticum aestivum
  unsure (1)..(86): unsure at all Xaa locations
  Clone ID: PAT_TA_8088.pep
KPEVEQPRMRSTQEILTKYKFNGLXIALQDAAAAAAHAKDKLMERQEKLAKMVEESAEFESEAENFATLGQQIRKSLETKRWWWPS

SEQ ID NO: 113671 - protein, 533 aa, Triticum aestivum
  unsure (1)..(533): unsure at all Xaa locations
  Clone ID: PAT_TA_8089.pep
SARGENGQYSADDVERLXALYNSLXEEYSWSSAVKRIPLDFLEGEKFHEAADNYVRPLLTKGVPSLFSDLSPLYEHPGKANILEQLFLKLEDSIRTSGCFPGSLQMEPPSTLMWTLLLVSQHYDRRSQYDIALDKIDEAILHTPTVIDLYSIKGNILQHAGNFSAAAALADEARSMDLADRYLNSECVMQMLQADQVGLAEKTAVLFTKDGDQHNNLHDMQCMWYELASGESYFRQGDLGRALKNFLAVEKHYTDMTEDQFDFHSYCLRKMTLRAYVSMLKFQNRLHAHEYFHKAAAGAIRCYMKLHDSPLKSSAEENDELSKLPAAQRKKLRQKQKKAEARAKREAEEKQEDETTSTNSSKSGKKQQARPVDLDPHGEKLVQVEDPLAEATKYLKLLQNNSSDSLETHILSFELNMRKQKVLLAFQAVKQLIKLDENNPDSHRSLIRFFHRINNLPAPGTDSEKLIWNVLEAERPDLRQLHGKSLVEVNINFLEKHNASLTHRAAAAEMMYLLEPDKKLQAIKLIEDSTNNT

SEQ ID NO: 113672 - protein, 143 aa, Triticum aestivum
  Clone ID: PAT_TA_8090.pep
MDIMQTSDSSHHGIVENSPYRTPYGRHVESGNLGGSWYFSRKEIEENSLSRKDGIDLKKESYLRKSYCTFLQDFGMRLKVPQVTIATAIVFCHRFFLRQSHAKNDRLTIATVCMFLAGKVEETPRPLKDVVLISYEIIHKKDP

SEQ ID NO: 113673 - protein, 116 aa, Triticum aestivum
  Clone ID: PAT_TA_8091.pep
PARSIRLAGPGKSTFHRPGKDPVAHYFVCRVMGLGATDEWARLARGPASQRRGRGVLLSMKSRAGSLVCCGQSIVGLSGRFLPCSFAPSGGASASTASGPICQSRGCVAVWSSLVM

SEQ ID NO: 113674 - protein, 267 aa, Triticum aestivum
  unsure (1)..(267): unsure at all Xaa locations
  Clone ID: PAT_TA_8092.pep
MRAGSYAQRKKNRSLGGSIWKVRWHFSKDGNLVTFFEYVKIAMASIQLTFFYSDPTDVVPHVLDTVHVSLIGPFPLAVGAAPGQPERRSQKSVPSTRELILEAIKKLKESSGSNKTAIASYIEEQYWPPADFQRLLSTKLKALVATGKLMKSNQKYRIAPSSVSLGGRSTKVHSTEDDKQNICIRQLTKPQVDAELDMMTHMNKEEAAAFAAKAVAEAXEVANAEAEEAARAAEAAEAEAEAAKAFLDAVMLTVQNKNAASAILRAC

SEQ ID NO: 113675 - protein, 99 aa, Triticum aestivum
  unsure (1)..(99): unsure at all Xaa locations
  Clone ID: PAT_TA_8093.pep
MHLHYVYFTLVCTDFTWTEWAPRLIVADMIDKWDLEDTPETEEKVLKMVKERYRGWRSTLSSTYKAYKTDAAXLANLPEDLQPEEWEWMIEYFGTDSKF

SEQ ID NO: 113676 - protein, 125 aa, Triticum aestivum
  unsure (1)..(125): unsure at all Xaa locations
  Clone ID: PAT_TA_8094.pep
IGYLLDLQPKEWEWMIEYFGTDSKFQDHSQKNTDSRKKQKTKHKIGSKTYSQLSFEKRNMETGEEPDCIVLWDLTHTKNGTWSNTESQDVYDKARXDVENKETETHGPLSRSKELARLDSRSRTI

SEQ ID NO: 113677 - protein, 482 aa, Triticum aestivum
  unsure (1)..(482): unsure at all Xaa locations
  Clone ID: PAT_TA_8095.pep
MRSCKPRLCSKESVLLISRMESIMAYKNQHGQPKFGTAEQSDNPVSANDMCSLAEWPSHARRNRERLQDEAGGQKKKGRGVLKGFKASKKRFANGSAKLNITFSEKLGGTVGMNYRTFKDDVVVIMKRKLPLIGVRTXSDIHPTIHRLIVADIIDIWNMEDTPETEEKVLKMEKERYRGWRSTLSSTYKEYKTHEDRLAKLPDDGQPDXRNSMNEYFGFDSKFQERSQKNADNRKKQKTKHIIGSKSYSQVSFEKRNLETGEEPDCIALWELTHTNNGTWSNTDSQKVYDQALEEVKNKEAETEGPLSSEQKNNVFQTAYKDTLECNSSQPRGYGYMAKTSTGSEKFRIQIEEQARATAATQERNSQLSQQVNDLEDQLQAERANTQERINLERAEREQLEERLKEERAERERLLQEERTSRLEFEKNMMAKFVELSKQIETQQTSSPNKTPGSRPTAISSNALIQAAARQSRMYKAMDPKN

SEQ ID NO: 113678 - protein, 227 aa, Triticum aestivum
  unsure (1)..(227): unsure at all Xaa locations
  Clone ID: PAT_TA_8096.pep
MAPSLTARPSPLPSPRLSFAKNHRLLLGVRCGSGSPGSGDDDASPVVRAAVSAVTELIRALSPQKPRQAVEAVDAESESLRSVDDVVAVLEADYRRAYFLTGNFTLGIYAEDCFFLAPTIVLRRKVXRYAQNLDLLVPFFDSPSLQLENIDKGSWVGPPLLFASASLRSSLSLPWLPLVAVGPSSASPFVEDLSVGAHPVSWDLPPLGAIGRFCVSPPGQSRTPAGV

SEQ ID NO: 113679 - protein, 471 aa, Triticum aestivum
  Clone ID: PAT_TA_8097.pep
MGTRMTVLRRLPIALSSALLEWILMLLLFIDAVYSFLITRFARLCKLPVPCPFCSRLDHVLGNEEPCFYRELICKTHKSELSSLAFCRLHQKLVGAESMCDGCSSSSLAPKVTPNNNDNTDEPAVDVDVLNATQGGDGVLHSPLTRMCSCCAQHFEQRSVSRFSQKSGELQYAKSPKICTDYPVSWQLDESFETNDIYHQSDHTSHERYSALQMTSDSEVEVPCADDARDSHPHEAYDMEERDFQEDAVFEIPGVPSPAVAKPSEMNVQEEQKVTDSGDACSADHVRNYDPDSVISGSQMEAEDISSRRRASQHGPLIAIEELSLEDATVPQIPVASVDELPKIICETESCQRTNDSSIDPYTSQFTILEQHYAVAADKNIKEAQGTEITAISSDVFHQRSTLANNPVTSEPVPKDYHYVASEDTYPKDNFRDVPVSQVSADSETLAEVEDNPKKAEWTGDTGIDGLTSHD

SEQ ID NO: 113680 - protein, 270 aa, Triticum aestivum
  unsure (1)..(270): unsure at all Xaa locations
  Clone ID: PAT_TA_8098.pep
MASERNGDGGKERAGENGNGGGVSLELPEIRYTKLFINGAFVDAVSGKTFXETRDPRTGDVIASIAAADKEDIRPGCQXAVEAASIIFNHGTWPRMPGSERGRIMMKYADLVEGHADELTLLESLDAGKPCTVTRXVDLATAVRSLRYFAGAADKIHGETLKMSRQFQGHTLREPMGVAGLIIPWNFPAIMFFSKVAPALAAGCTMVVKPAEQTPLSALYFAHLAKQAGVPDGVINVITGFGPTAGAAIASHMDVDMVSFTGSTAVGRLI

SEQ ID NO: 113681 - protein, 232 aa, Triticum aestivum
  Clone ID: PAT_TA_8099.pep
MSAGWRTLLLRIGDRCPEYGGTADHKEHIEICYNVLSREYEHSKDDIFEFLLQCAEQLPHKIPFFGVLIGLINLENEDFAKGVVDATQANLQDALHTENRDRIRILLRFLCGLMCSKVISPNSIIETYETLLSSAATILDEDAGNASWQPRADFYVYCILASLPWGGSELFEQVPDELERVLVGIQSYISIRRHFDDIAFSVFETDEGHSSNKKDFMEDLWEHMQLLSRNGW

SEQ ID NO: 113682 - protein, 168 aa, Triticum aestivum
  unsure (1)..(168): unsure at all Xaa locations
  Clone ID: PAT_TA_8100.pep
MESAGNDRRGAALGGLAVLPDELLCAIVDLLQPTDIGRLACVSSVMYILCNEEPLWMSKYLSVGGHLEYKGSWKKTTLSRLSLCSGNSELEQKARHFDGFNSLFLYRRXYRCFTTLSSYSFDNGHVERKDDLSLDHFHSQYDGKGPVLLGKLAETWPARTKWAIQQLV

SEQ ID NO: 113683 - protein, 161 aa, Triticum aestivum
  Clone ID: PAT_TA_8101.pep
NFFLLRAIVCRSNLSFLGQCVDMYLLFWGVCSRGLASQRLLASRVRKEMGLRLFRPRFSCCGARSLAGYRSGAPSVARGTRTAPSLSASRRARLEETCTFSIMVFFLWMNPGIINYDFIFLYKGSTQEADNESEYIREERTEYMYKREGFKSSSHVLNFIK

SEQ ID NO: 113684 - protein, 201 aa, Triticum aestivum
  Clone ID: PAT_TA_8102.pep
NRSAATAPLYVPFLPDAQASWPVPVVVTPHGSFCCHVNSHGAFCKLRWSVGLSPQRSPRPEDCRPRRALLNFHLYAMPTKPITTARFGLACRSPDHYCRGAFLVGSYYPGTVRCFQLLADDGVITSRGPAPSENPWASCCRRHRCLSRRGNLATEATQMWCAKKNSLLMLLQQYHGGQDAPTMPGACPGRSGEPRWPQSPQ

SEQ ID NO: 113685 - protein, 86 aa, Triticum aestivum
  Clone ID: PAT_TA_8103.pep
HIPPFIGWLKWLNYSFYCYRLLLGIQFRDGGGVYDCGGGALCPVADFPAIKAVGLNNHWVDVCVMALLLVGYRVVAYLALDRLQPR

SEQ ID NO: 113686 - protein, 227 aa, Triticum aestivum
  Clone ID: PAT_TA_8104.pep
CKMVTVHGFANGTNDGTANRKIKRLFNSSERKNPTNFQFERHVARLESRQQQQPRRCIFTTILPIEFFHTSSEPTSPEDSLGPSSSSPSIIFLHFSVADEPLRKYSSNQRLLAERSTSSNSMSNSGFSDNTSTKTRVDARHTTRRKSKKKNKKQKKHFRKPADGSEITCAESNGSTPSVDMVDSCEGSTLSPKHVGDILFEETFSPSSSVKEASEKAPDSENDNEYN

SEQ ID NO: 113687 - protein, 254 aa, Triticum aestivum
  unsure (1)..(254): unsure at all Xaa locations
  Clone ID: PAT_TA_8105.pep
MNRDHLGLISSPGGGGHYIVAQLQQILGHGKAILLRFSSRAGEWGSAVLRLPPPARLLAPNRVVSHAGRLWWVDLSWCLLTCDPFADEPVLTAVPLPEGKQLKFMEAWGVLDKYRCVGVSSGKLRFADMYXGNSAAQVSVWTLADPDTTEWKLEYEATFAENWDDXGYKATGLPRKIPVLALIHPXTPDVVYFFLDEHLXSAVDVRACKVVECEVYELVAPPSEHVATSFIHAWQLPRALSSAKKTEGVVNDEL

SEQ ID NO: 113688 - protein, 60 aa, Triticum aestivum
  Clone ID: PAT_TA_8106.pep
IRHEGSACVMCAILVATGVAENWKDAENVIRGRRKIKMNALHRKTLEDWSKSRVVQKKDN

SEQ ID NO: 113689 - protein, 221 aa, Triticum aestivum
  Clone ID: PAT_TA_8107.pep
MATASTMSLLPISHLKQMQQQRRTRLAGALPGKVLVLGRRRRHVVPRARLFGPAIFEASKLKVLFVGVDEEKHPGKLPRTYTLTHSDVTARLTLAVSHTIHAAQLQGWYNRLQRDEVVAEWKKVQGAMSLHVHCHISGGHFLLDLIAPLRYYIFRKELPVVLKAFVHGDGSLFSQHPELEEATVWVYFHSNNPNFNRVECWGPLRDAAAALRRRERHRRLP

SEQ ID NO: 113690 - protein, 93 aa, Triticum aestivum
  Clone ID: PAT_TA_8108.pep
DEPSNSPSLYGDCQSSWPELITGTEIPRSPSPVLGIGRRFFCRNREAGTGIACRWRREIFHAWTGFGIVGAWHQESQATGDAFPIHTSERRLR

SEQ ID NO: 113691 - protein, 123 aa, Triticum aestivum
  Clone ID: PAT_TA_8109.pep
HCPTRPRTRGAASPSPFLATSPPVASRSPDPSLLAPAPLLPARSDSPLVQPRLPAHAPPCARPCPCRRPEAWRPCPRPPASLAAATAAQSPHQSSGLKTTLSSVMPPGSRRRALPFHEHRIGG

SEQ ID NO: 113692 - protein, 353 aa, Triticum aestivum
  unsure (1)..(353): unsure at all Xaa locations
  Clone ID: PAT_TA_8110.pep
RGRGRGTSTTTLERFPKLPHVASTGHFNLANPRPTTSEVITLWYRPLELMLGPTHYSVGVDLWSVGCVLAELLLGXEPIFPGRTEVEQLHKVFKLCGTPSRRLLGINLKLPHHTFKPYERCMAQKFKDLEPSTLSLLETLLSIDPDMRGTATDALNSEFFRTEPHACEPSSLPRCTPCLGTDIKPDARKHKRKLRANGSVERQTNTRKPVSQNHGRRRVFTPDVNNKPHXKPKVAWSXRGTSTTKLERFPPPHLDASIGHSIDSSADVTTNEFFSSSVVELKKMPSLLFGHVKSYLNSPKKGMHKAKPSLTMAPSTVLIGAFRPYSLGHPMEVRRKNRDQLRAKGKIPVGLVK

SEQ ID NO: 113693 - protein, 154 aa, Triticum aestivum
  Clone ID: PAT_TA_8111.pep
VHPSTHAVDCRTEPGKKRIRLKSQSSTTATLHKIQACSGAVNGQRWEQLLRQARRHRASRHGAWRDAVRRHPRGPELIHGDLYGLHDRLGSSLMGACRASKSGPAAGRSGRGGACSRRRRRRVLPTAAATGEVARGTSTGNTRCSRGRKRSGSA

SEQ ID NO: 113694 - protein, 240 aa, Triticum aestivum
  Clone ID: PAT_TA_8112.pep
VNADGTPITAVADVKAAGGSNPVVNRAKAIRDKRRADKGSKLTSKITKEVVEKLNYKPLTDSVASEGQLSEVAEAFAALGVTDAEMPVVALQIARRAADSSSSNVQNFEESASTAKEISLTDLLTAIRNVTTLRRFCAFYAPDVWNSMLLEDSPPANWDKKGFLFSERFAAFDFFYGVESRAAHYTDGLVRDPSDAERLANHSIMEVKMFRIEDAKSTSAGTVAEVTGGKARERPSLNIH

SEQ ID NO: 113695 - protein, 273 aa, Triticum aestivum
  unsure (1)..(273): unsure at all Xaa locations
  Clone ID: PAT_TA_8113.pep
MAPAAAAAPAPAATACSSSASSARPPSTASSSSQSPPRRTVPALLLFTSLAALRSLSAAGAPDADAASGRPLKDVSFENPEVTFAPSSMGGIFCERIRISGMPRWQFQSYANQIHVRMNVSHSMPEKFHWKIQICFHGNASTGLCQCEMGEWQALQGGMWNAVKSPYASRYVDVKLTDKKSTVFSLSIQEELQKWRLACLGIGFVLLFLSPIVSKWAPFYYSSSMALGILLVVLIVLFQGMKLLPMGKKGLFYLTIYGSVXGVGSYAAHYFSS

SEQ ID NO: 113696 - protein, 256 aa, Triticum aestivum
  Clone ID: PAT_TA_8114.pep
SISTACATSNHCFHSAADQIRLGRADVMVAGGTEAAIIPIGLGGFLAGRALSQRNDDPGTASRPWDKDRDGFVMGEGAGLLVMESLEHAMRRDAPILAEYLGGAVNSDAYHMTNPRPDGCGVSVCIRQSLEDAGVTPEEVNYINAHATSTPAGDLAEVNALKQVFKDPSRIKLNATKSMIGHSLGAAGGLEAIATIKAITTGWVHPTINQFNPESAVDQFDTVRSVKQQHEVHVGISNSFGFGGQNSVVVFAPFKP

SEQ ID NO: 113697 - protein, 291 aa, Triticum aestivum
  Clone ID: PAT_TA_8115.pep
MGKKAIRYAVVDAFATEPFKGNPAAVCLLEDDNAADERWMQSVATEFNLSETAFLVRDFSRRASAAPLFHLRWFTPVTEVDLCGHATLASAHFLFTAVLPEHGMIEFMTKSGILTAKKVPPPGGAGEAHGKLFIELNFPMIDFLGCNEMPSIPETLNGAPVVSVHKSAADGDLIVELSSAQEVADILPNIDEIKKLSCGGIMVTGPAPAGSGYDFFTRLFCPKFGMDEDPVTGSIHCVLGPYWGRKLGKQKLTAFQASPRGGTLYLELDDANRRVKIQGETVTVMTGTLLA

SEQ ID NO: 113698 - protein, 99 aa, Triticum aestivum
  Clone ID: PAT_TA_8116.pep
THKGSHHTHASITHAQRPPSLGTHAHIHPYINHARRKHIHADRLYAHQPKLSPSSTPPTPRLFFPLLNLHRKSFVDRGRRRSFINMLIFAKTVGLDGKL

SEQ ID NO: 113699 - protein, 249 aa, Triticum aestivum
  unsure (1)..(249): unsure at all Xaa locations
  Clone ID: PAT_TA_8117.pep
HASGKICDQIFEGGNFNKDQCFAEMATNSVVTLLSFGDAVAKSKRSPEKLFVLLDMYEVMRELQPEIEVVFEGKACSEMREAALGLTKRLAQTAQETFADFEEAVEKDASKTIVQDGTVHPLTSYVINYVKFLFDYQSTLKLLFQEFETGSETESQLAVVTTRIMQALQNNLDGKSKQYKDPALTHLFLMNNVHYMVRSVRRSXAKDILGDDWIQRHRRIVQQNANQYKRVAWAKVLQALSVQGAPGST

SEQ ID NO: 113700 - protein, 193 aa, Triticum aestivum
  Clone ID: PAT_TA_8118.pep
AVGSGSTGCQARVSEPSKCLYLIVDTVVLMVNSCKVGKLHNLQQELVRKVTLLLYEVWSKVRLLQSSADCTNGKDQLQSRPYEISEAIFRLSMDLACPAHLEPDEVRKSFFGQTESDVEKFALMYWENSPYLYRKRQSGLEGDAVFTALHNAFDLRTPDAIVESFIRGLVSCPAIASDELNIDSFLDEVHDSL

SEQ ID NO: 113701 - protein, 156 aa, Triticum aestivum
  Clone ID: PAT_TA_8119.pep
GCGRAPGSRSCCLLRGRRACRACGGPSSARAWAAGPRGVSGPPRAWGWGGWSGEGKHRAMLTYSLEERKIGACESCPPLRTANKQHCLPERRASAWPALGCGWSAGSWVGFPPTVPADSLHVRLAGFRVVCRPFRPPIKQPFRSNRCPSCKLALFC

SEQ ID NO: 113702 - protein, 248 aa, Triticum aestivum
  Clone ID: PAT_TA_8120.pep
AARRSKRQRRRHHESEAPSPSTVSPRGAQITTRRRTSTPAARRRPRPAPGAPPPGRAPPPAAAAPTPVAGAGVVKGRSCKGCLFYSSVLRSKGRGPVCVGVTRGIPQVPDRMVGEIELGAIQEGRNLSNFKYACAGYSIYLDDKDSSTVKGEKHAELPICVGVELLTDRAPTKQAPAHVTKQAPAHMKKDATQAHGHKPALTQADFITKFQRNAGLVASGVVRNMNKVGTYVKDTVDDILYPYRKRPK

SEQ ID NO: 113703 - protein, 173 aa, Triticum aestivum
  Clone ID: PAT_TA_8121.pep
MASQISGTIASSGVCYNDKHRMPCKLKALRCVASDCLPLEVEVRKWMNGYHIIRSFPNDRHWKTNAKSNGYLLQQGPNVRCHSYGSRSASETTECNIPEDGNNPYRDFDEHPRGMSHFSDSQVAAQEKTLYSTQGLSKACQFVYNDAKFVNERAQSDILLLSRGITRLNKRAS

SEQ ID NO: 113704 - protein, 54 aa, Triticum aestivum
  Clone ID: PAT_TA_8122.pep
MAAAKAALEKMRAFWDSQCNNEENWAVNYKVLKAAGIFAGSVFLMHNFGHNMVI

SEQ ID NO: 113705 - protein, 317 aa, Triticum aestivum
  Clone ID: PAT_TA_8123.pep
MATPSPSSSLLLEGRPPGLWPPPEWKKKMKPEEVTRDWAELPRDALLLVLEKLHQVDVLLGAELVCRPWHRATRDEPSLWRRIDLRLSHLPDPSSYRFHPMGHAAIQRSRGSCETLYSEGAIDEEAISLLKESALFLKSLRLINCILINDRISLNISHLVMLEELEISNYGVHKFSSTCFAVGYSCPHLKRFRLSSSCFIKRPVWGAIDCEVEGITLMRGLRSLQLFAQTISTTGLAAILDSCVQIDSLDIRHCFHVEMGDELMSRCSKFETLRLPHDSTDDYDLEFSAPDMNTESPRPRPVRNYGDDGCAFLEDVY

SEQ ID NO: 113706 - protein, 100 aa, Triticum aestivum
  unsure (1)..(100): unsure at all Xaa locations
  Clone ID: PAT_TA_8124.pep
KXGSSSREPMRRVRGNRRSGGSSQGEASEGIRRSSGCLQAPVQYTLEEGLERPTPCVNYSMFDEMWSVVLNGDSWYHVSGRKSLGKEKGDELTASCATEA

SEQ ID NO: 113707 - protein, 91 aa, Triticum aestivum
  Clone ID: PAT_TA_8125.pep
MSKMVQTEAGRTIPKFGAWDVNNPASADGFTVIFSKARDDKKAPVNVHKASKSADGKDARPDSKMNQSYSNSRPNTSKKWFCCVSPSPTQP

SEQ ID NO: 113708 - protein, 125 aa, Triticum aestivum
  Clone ID: PAT_TA_8126.pep
MASSTLKPGVPITLQELEPSSEMFKQGASLRVTGILQSYDVDSAVAVIQDGSARLKIDTQNLRDISFRSNSTFQFIGELLIQPNNDAILQARVGRNVDGLDLNLYQQSLIIRRQHEAKLLSSRRP

SEQ ID NO: 113709 - protein, 92 aa, Triticum aestivum
  Clone ID: PAT_TA_8127.pep
GETSPLLSLPAKAQSLVLGLTGVRRRPSFSRPLPCVQASSIGVPCSRAAHALGLTCHFITCFVVYSLSLWTHPSWTLFQVHHREALQVLGRA

SEQ ID NO: 113710 - protein, 171 aa, Triticum aestivum
  Clone ID: PAT_TA_8128.pep
TPPLVSRCRSPPAPDRHGRPFCVGVDGRSSSPRAPSTPPYSSLPRGCRLRPGCSVPPDAGVGSSAVPPVSFGCFWLRSLLVTQVGVGATGLSGRSPDASAPAATPTRGLRRQKRRPRSTPSFATRRQPSVIGGSYGGLEDGDPFGWATTTAAGARAHTQPVHTQLFLSGAD

SEQ ID NO: 113711 - protein, 147 aa, Triticum aestivum
  Clone ID: PAT_TA_8129.pep
IVEPNPPVLVLGGFEAVWSPFFAGRHRALSGKTLFVGGAAPSTSNASHAFRPPLRESRPHLRLRRPPPALPFVLIAARAGERHNGADRARLLGFVAGALARRQAPHDHAASTSTSVGVAATARSAYHGSLVDGEKGERHGKLLAGVL

SEQ ID NO: 113712 - protein, 191 aa, Triticum aestivum
  Clone ID: PAT_TA_8130.pep
MGRRLLLPHTRRLMLFLRPMRYSASATATATAGSSRDPLHVCVVGSGPAGFYTAEKMLKGHEGVRVDIIDRLPTPFGLVRSGVAPDHPETKIVVNQFSRVAANPRCSFFGNVTLGSDLSLSELRKTYDVVGLAYGAESDRSFGIPGEDLRGIHSAREFVWWYNGHPDMCNLAPDLTNTDSAVVLGQGKCCA

SEQ ID NO: 113713 - protein, 66 aa, Triticum aestivum
  unsure (1)..(66): unsure at all Xaa locations
  Clone ID: PAT_TA_8131.pep
FFFCLLQQLQFIXDYFVLYNLRPNTATGSHTVTRVTCANQTNFVSLIQVLQLKNKKIREKKNRPHF

SEQ ID NO: 113714 - protein, 113 aa, Triticum aestivum
  unsure (1)..(113): unsure at all Xaa locations
  Clone ID: PAT_TA_8132.pep
SCPSWIEVDGRRQSTRKPYLGHHARRTRHGWLLPLLPSSRRVEERGGDEEGPPRRAGRAGLELRPSSRFRIRHCSPPPPLPLMLWLRASGGFSRITAFPDXTGSRRGGNCRGP

SEQ ID NO: 113715 - protein, 217 aa, Triticum aestivum
  unsure (1)..(217): unsure at all Xaa locations
  Clone ID: PAT_TA_8133.pep
GCRFXTRERMDDWKSKQGIYGAADPDDMDADVPLNDEARQPLSRKVSIASSKVNPYRMVIILRLFVLCVFLRYRILNPVPEAIPLWLTSIVCEIWFAVSWILDQFPKWYPIDRETYLDRLSLRYEREGEPSMLSPVDLFVSTVDPLKEPPLVTANTVLSILAVDYPVDKVSCYVSDDGASMLXFESLSETAEFARKWVPFCKKFNIEPRAPEFYFSR

SEQ ID NO: 113716 - protein, 182 aa, Triticum aestivum
  Clone ID: PAT_TA_8134.pep
PRVRNSSVVPRQELATAVASRPPLPSLEVSGVNRSNGSMKRLLRRLSRVGRGRRLRSRRVPAAPARLRGEGLLHGFIFVLLVLRRAKARPRRAGAGGPRAVVRRRRGRPRGALRRAGRGSWATRRSRPCFGAAAHDVRLRAPSRAAQPLRRGPPPLSYCTSTILRPAVLVGILLLLLRVPGS

SEQ ID NO: 113717 - protein, 143 aa, Triticum aestivum
  Clone ID: PAT_TA_8135.pep
GRWRRSVVASLPGGTIRGAWKQGWRLLQVWLRLVAAFCASSSAGLRCAVFFFSSCLDVRLAVLVARSWERCGCGLSSGSSCLRCSVGFVHAALGELPTSRRYDALRARARRLWSSLEGESDGLLAGSAGVGDVAMATVAGAAG

SEQ ID NO: 113718 - protein, 257 aa, Triticum aestivum
  Clone ID: PAT_TA_8136.pep
TPTSRSWPSGPPTCRKAGQRPTPPCSSSSWARPTLPCAPRRRSAASWLRSATGWPCSWRSRRSCSRRPRKRRKDKETALLAEFASEPSSWTDKEAMLSSGFHEIEDLVDDFFPGHSDATNQAIEADREGQRADGAKIAADSPRTLNEQILSIEACLRPAHWMLRRLQRVDAQAIAALWPDMQAPRTPSRTADWLEVAAGRLEAWKGSSARDGARRALEFVKAWYPGLSLAQLATFRLEVKEICPRGNNKVIIYFLIS

SEQ ID NO: 113719 - protein, 141 aa, Triticum aestivum
  Clone ID: PAT_TA_8137.pep
PTSSSPSRDPLCLARRHRSPSRRLRLSSPSRRCRLCPRSPSLRCRLRLRSPSSLLIRRSAAHRWTSRERSGLGSRPGVATAELLAGYLLCLLALAVAKATTLLWVMHRRSTPRCHVAPPRLLPVLQEEEDAYEVRLWLSSP

SEQ ID NO: 113720 - protein, 165 aa, Triticum aestivum
  unsure (1)..(165): unsure at all Xaa locations
  Clone ID: PAT_TA_8138.pep
LVDVIQDWXKTERYKAIIKSGTVEPRPGVLRLMDEVKGAGIKLAVCSAATKSSVVLCLENLLGLERFNGLDCFLAGDDVKVKKPDPSIYITAAKKLGLESKNCLVVEDSVIGLQAAKGAGMSCIITYTPSTSNQDFKDAIATYPDLSNVRLEDLKLLLQESLVTG

SEQ ID NO: 113721 - protein, 142 aa, Triticum aestivum
  Clone ID: PAT_TA_8139.pep
MKNGIANDVIVNSINVNCANNMQNPKLGDSSFAMSTTCCNDHDWGDSSYDLENLFKSHDEYEIDKNVCNIESGFGIVSTLDPTYLENVQYYEIFDKSGFGEVMTLVNVNPTILEECQLRMHVDRVDNMLCDSYNAEFAYDPT

SEQ ID NO: 113722 - protein, 222 aa, Triticum aestivum
  unsure (1)..(222): unsure at all Xaa locations
  Clone ID: PAT_TA_8140.pep
MAGVGSAVRRLYLSVYNWVVFVGWAQVLYYAVTALLAGGHEGVYAAVERPLQLAQTAAVMEILHGLVGLVRSPVTATLPQIGSRLFLTWGILWSFPETQSHILVTSLVISWSITEIIRYSFFGLKEMLGFAPSWLLWLRYSTFLILYPIGILSEVGLSYIALPYMKVSEKYFVKMPNKWNFSFDYFYTCVIAIGVYVPXGGPHMFTYMLAXRKKALSNAKTA

SEQ ID NO: 113723 - protein, 598 aa, Triticum aestivum
  Clone ID: PAT_TA_8141.pep
LCKEWSAEEFEELIHKTFKDVISVDLATASNLDSSTSKRRLNRGFAFVRFSSHGAAARVLRIGSRTDFMLGGILHPAINWAERESNVDADEMAKIKTAFVGNLPANANEEYLKKLFGHFGEVIRVAVSRKGQYPVGFIHFGSRSELDNAIKEMDGKTVSGPNRGPSFKIQVSVARPAVENDNKRSREEVKTRRSNVSGATPPRSPRPRGHDSIERQTKAPRLSNRVSDVTDPYEAAVNSLPSAVNELLLRILRLGIGSPYDIDIHCIKSLSELPESGAVAVLNQFLITGSDKRNKGEYFLSLIAKRSGEAFGAAQILQDTTYLSRNSEIQTKRYRHQDYDYTASGSSRYSSLGGYPSSSYVDDPIVSQSRRYAEERPAVVRYPEPRLRREEVLLEPRPNIGRQLDRIYTQEQSYNERSAHEARQDTGRHLDRRDIHEHSYKERSAHEPRQDTGRHLDRRYTQEQSYNDRSAHETRQDTGRHLDRRNIHEQSYIERSAHEPRQNTGRHLERRYTQEQSYIERPAEAVLSRERRLVSATGYATNIEPEFKSRSSAEYSAEHQQMRFVPYPGEPCKFDPFTGEPIRPEPSLRRSGSLYCPD

SEQ ID NO: 113724 - protein, 41 aa, Triticum aestivum
  Clone ID: PAT_TA_8142.pep
DKTSQEPQERHVDVFSCSSRGCKQRSEFMDEKVCKVALVLT

SEQ ID NO: 113725 - protein, 462 aa, Triticum aestivum
  Clone ID: PAT_TA_8143.pep
MVDSSAGGKMSAHGGGGGGRTRVGRYELGRTLGEGTFAKVKFARNVETGENVAIKILDKDKVLKHKMIAQIKREISTMKLIRHPNVIRMYEVMASRTKIYIVMELVTGGELFDKIASRGRLKEDDARKYFQQLINAVDYCHSRGVYHRDLKPENLLLDANGTLKVSDFGLSALSQQVREDGLLHTTCGTPNYVAPEVINNKGYDGAKADLWSCGVILFVLMAGYLPFEDSNLMALYKKIYKADFSCPSWFSTSAKKLIKKILDPNPNSRITIAEVINNEWFKKGYQPPRFETAEVNLDDINSIFNESGDPAQLVVERREERPAVMNAFELISTSQGLNLGTLFEKQTDSVKRETRFASRLPANEILSKIEAAAGPMGFNVQKRNYKLKLQGENPGRKGQLAIATEVFEVTPSLYMVELRKSNGDTLEFHKFYHSISNGLKDVMWKPEGSIAEGDETRHRRSP

SEQ ID NO: 113726 - protein, 512 aa, Triticum aestivum
  Clone ID: PAT_TA_8144.pep
MARSGGGCCPSMDLMRSEAMQLLQVIIPTESAHLAVSHLGDLGLIQFKDLNADKSPFQRTYAAQIKRCAEMARKLRFFKEQMSKAGILVSPMQSTETPLDFDDMEVKLGELEAELTEVNANDEKLQRAHNELLEYSTVLQKAGEFFYSAQRSAAAQHRQMEANQSGETSLESPLLEQHVVPDASKQVKLGSLSGLVPKEKAMAFERILFRATRGNILLRQESVDEPVTDPQSGEKVYKNTFVVFYSGERAKAKILKICDAFRANRYPFPEDLAKQTHTVQEVSGKISELKATIDMGLAHRDSILKTIASEFEHWNHLAKKEKSIYHTLNMLSVDVTKKCLVGEGWSPVFAANQIQDALQRATLESKSQVGSIFQVLNTKESPPTYFQTNKFTSAFQEIVDAYGVAKYQEANPGVYTIITFPFLFAVMFGDWGHGICILLATLYLIIREKKFASQKLGDIMEMMFGGRYIIMMMSIFSIYTGLIYNEFFSVPFELFAKSAYACRDSSCSDSTT

SEQ ID NO: 113727 - protein, 96 aa, Triticum aestivum
  Clone ID: PAT_TA_8145.pep
LMGREILIADLTGGLHISGLTWRREHEKTVQYLEGCRLQARSISTPCVVVRRRDHAYCSLVLALQDVPGRMLYARHGRARHGVELSYMANIPGPAE

SEQ ID NO: 113728 - protein, 142 aa, Triticum aestivum
  Clone ID: PAT_TA_8146.pep
SDVFSFGVLLLEILSGQRNSGFHQHEDFLNLLGYSWQLWEGGRCLEILEASIAKEIHAAEARRYINIALMCVQEHADDRPTMSNVVAMLNSEGVILPEPKHPAYFNLRVSKEDESGSVLDSHNDVTICSNNDVTITEEPDGR

SEQ ID NO: 113729 - protein, 122 aa, Triticum aestivum
  Clone ID: PAT_TA_8147.pep
NSDEGEAGEALHLLNSLQELNFWKCWKLQRLPAGLTKLASLKILHIWGCPAIQLLSKDGLPSSLQELEIRDCPAIKSLPKDGLPSSLRKLQVSNGISKELKKQCRKLKGTIPIIIDYNNDDY

SEQ ID NO: 113730 - protein, 280 aa, Triticum aestivum
  Clone ID: PAT_TA_8148.pep
GSCFNLPSYACIREGPDHAPRFKATVTFNGESFESPGFYPTLRQAEHAAAEVALNELSKRGPSSSLAAKVLDETGIYKNLLQETAHRAGLKLPMYTTIRSGPGHTPTFTCTVELAGRIFTGNPGKTKKQAQKNAAMVAWSELKQLPLVGEAASSSSPSDHDEEQEQVTVTRTLENLNRKNEGKASHQKEKQQSNNRPQSRRSYPKPYVSFYGSHLQNQMYPNVAPEQAMYHMWNHGASSTCRSPIFRWFQLWATQGFNRHQLCAPCTLLHLEGSLPCQPA

SEQ ID NO: 113731 - protein, 271 aa, Triticum aestivum
  unsure (1)..(271): unsure at all Xaa locations
  Clone ID: PAT_TA_8149.pep
AARPTIRRLDSERKLLTYSQEAPTEPEKPAEEEKEEPTKLEQEPVPDPTPEPXDKLLAMETTGDLLNLDEEVNPFVVDLDEHNALALAIVGPGDGSKASTCQNLFSGSTSGWELALVAAPSRFTSQPMETKLAGGFDIMLLDSLYEDSARRQQITXVTYNGSLGQANNPFETNDLFAISNSFAPPSNVQLAMVTQQQQYFQAQQHQQQCYYQPQLQQQQQYFQSQQHQHQYFQQQPQYCVHPAGTYNPFGDPFTDLVTLDAPPKQGNLTLL

SEQ ID NO: 113732 - protein, 244 aa, Triticum aestivum
  Clone ID: PAT_TA_8150.pep
CISRWSGPSCRSATPAPSVEIECPVGGGYGLAVAGAPRLQVVLKVEEGPAELCITRRFGVVDDLERRLQFAMVAYVAGSRRVLSMDRVKEMLESTLDIAPELISVHRHCSEDFLMVFSSAALRNRVSACPSIEDRGDRLVFRPWNRQSQAVHSIPGFKVWLELEGIPPHAWDRLVVEDLLGSSCKLDAVASRQLPARTCPRSRSWRGWQTRSASLRCAGWRFRSRARSGLRHCFSTRCSYTWMR

SEQ ID NO: 113733 - protein, 228 aa, Triticum aestivum
  Clone ID: PAT_TA_8151.pep
MAEAAAQRLLAASTKIVGAGRNYISHAKDLGNPVLKEPVLFLKPTSSFLHAGPTAGPIEVPEPLESLHHEVELAVVIYRRARDVPEAFAMDFVGGYALALDMSSNDLQSASKSAGLPWTLGKVQDTFTPISAVVPKSAIANPYDLELWLKVDGELRQKGLTSDMIFKIPFLISYISSIMTLMEGDVILTGTPPDGVGPVRVGQKINAGITDLIDVEFDVERRKRSFSY

SEQ ID NO: 113734 - protein, 136 aa, Triticum aestivum
  Clone ID: PAT_TA_8152.pep
HRQHSILGDKQEKRLQGYLYTTMWSAAKEHDVQNFLHESRIRIFLFVVAAAAAASCWLSLRHPMACEAHRHLAVMQKMPNSRGLQRKDCGVCMSRGGAVLLLVLFQPQCSTACAGGGLFLWVAVLRPCSSGEVLHA

SEQ ID NO: 113735 - protein, 129 aa, Triticum aestivum
  Clone ID: PAT_TA_8153.pep
RIVGCRCRPHHYHPKTLARPPCRAPCSLNPPTESMVAPGSLDVRRHVPISSCGVVLAASPPTDVNATGDLTESASGLPLPASAPRHPNLPFRSKGNPKQEPGTGPRLFPSALPKEAENQESLVPNSARG

SEQ ID NO: 113736 - protein, 359 aa, Triticum aestivum
  Clone ID: PAT_TA_8154.pep
MLQGLGDEDDVRAPLPVRRETLYGDTPMIVTRPNATVAFRNFEEEARQSAWDSEQNATSSSRDNLASLYRPPFDLMFNGPFDKAKLEASSLDKWLLINLQSTEEFSSHMLNRDTWANEAVAQTIRSNFIFWQVYQDTGEGRKVCTYYHLVSVPAILLIDPITGQKMRGWSGMVYPDSLLEDLMPYLEKGPKEHHAAQPQKRPRKVDQETSMVRQGKTAVESEDEELARAVAASLEENKGAGGSDAADEKSNPVEETEPSLSVKIEYPPLPEEPKVSRDLLCRVAVRLPDGRRIQRNFLHTDPIKLLWSFCSSQVEEGEKRAFHFGQPIPGAAINKLQYGSEQTFKEAGLANSMINLLWD

SEQ ID NO: 113737 - protein, 82 aa, Triticum aestivum
  unsure (1)..(82): unsure at all Xaa locations
  Clone ID: PAT_TA_8155.pep
MRGVSGATAATYGQTGASDRGAGPGLSFHLLWLWLGIGGGEACSIALRHTMSRCFPFPPPGYEAKPRSEHKDLLXKENHKAX

SEQ ID NO: 113738 - protein, 185 aa, Triticum aestivum
  unsure (1)..(185): unsure at all Xaa locations
  Clone ID: PAT_TA_8156.pep
MNGRXXDXGLAMLYDHTADPETXHVVGTIGYLAPEIGRTSKATILTDVFAFGIFVLEVTCGQKPIMQGSKDDQLMLADWVVEHWNRGSLVETVDTKLQGEYDVDEACVVLKVGLLCSHPFPEARPTMRQVLQYVNGDMPVPELVPAHLSLQMLAFMQNEGFDSYIMSYPSSVESINSLTSLVHER

SEQ ID NO: 113739 - protein, 174 aa, Triticum aestivum
  Clone ID: PAT_TA_8157.pep
MSNGKPTYNSDSSYMSSIPVCCFLRAMQPTSSLLRWTGDLHKIFLEAVEYQGGPYEAKPTAVKEKMEAMGVTGLTIWNIKSHLQRYREKCNLGPEPPRDVRGTASPRKAGDNVFGSLMKPSHPEYRVKSDAAMNLTGMEMATYLLMDDTEMVDTAFSADELQVMEKELMNAIRA

SEQ ID NO: 113740 - protein, 116 aa, Triticum aestivum
  Clone ID: PAT_TA_8158.pep
IEEINQRNQTIKQITREASNYLEEVHDASNKIHGLAAIALDHVSSVSLFDFRQAILEIHDAVVALQNTTSTARVSLEEKGMYSDDDVADPVYSGVSGDETDEYYHHDDYGHYVRSP

SEQ ID NO: 113741 - protein, 167 aa, Triticum aestivum
  unsure (1)..(167): unsure at all Xaa locations
  Clone ID: PAT_TA_8159.pep
FXXCCSKQSFIEGPPRGALEEGLGPQKNGSSPRARRGQRRRESGKGSPIACPNQQPGDSLFFXPARPQFIEILFALHXPVDXXHFXFPSVENYRFVVIVMRXEVYCKHVIYIGVFFXPCLRGSVXESXPLFRSXSGXEIGIDYLEXLVHCCSISLNISKLGKSIKDC

SEQ ID NO: 113742 - protein, 118 aa, Triticum aestivum
  unsure (1)..(118): unsure at all Xaa locations
  Clone ID: PAT_TA_8160.pep
SRXGTLQCIGNSRELKTKYGGSYVLTITTTAGEEAEEEVAKLVQSISPAVSRVYRISGTQKFEMPKQEVRISAVFHVMESAKSRTTVLAWGLADTTLEDVFIRVAKESEVSSVTSSAR

SEQ ID NO: 113743 - protein, 157 aa, Triticum aestivum
  unsure (1)..(157): unsure at all Xaa locations
  Clone ID: PAT_TA_8161.pep
GAGGTVRDEEESGTATPKKLHAHSSCTAHTREQLRSAGRQRRSHRRNSPSVVRWSGDGRIRGWRAIGALSNCIEEALEEPGAAMAAGSVGGDALATTTPGEHLALVGGGGHHGRAGGRWLGARPSRIRRRGTTGGQGHGTSGRWRRGDSGSHRXPXQ

SEQ ID NO: 113744 - protein, 286 aa, Triticum aestivum
  Clone ID: PAT_TA_8162.pep
MHYRMVEAEFSKFGSIKPRGIQVVHRQADGFCFGFVEFESEKSMNAAIEVFKVRFGSYVSYVEEKRTPKRVVNGVTHSEYNGNARGSRVLPDRGGYHGDNFRGQGAGFVNNGNYRDGDNFRGQGPSFGNNNNYRDGENFRGRGAGFVNNGNNYRDGNNMRNDNRNQNEYSGHGRGPQGNDYRQNDSRQNRNDYRQDGNGYRQNGDDYRQNRDGYRQNGDGFRQNRDGYRQIGDGFRQNRDGYRQNGDDYRQNGNGHHQPRPVHNGNGNANGRPGRFNGPKQIAVTA

SEQ ID NO: 113745 - protein, 45 aa, Triticum aestivum
  Clone ID: PAT_TA_8163.pep
LLASSSVTNDQTSMPHSYHTRGHHLLRQEHGAKQNLCVAVRIFEF

SEQ ID NO: 113746 - protein, 101 aa, Triticum aestivum
  Clone ID: PAT_TA_8164.pep
MPAALPPTLPEELVEEILLRIPPDEPAGLLRASLVCKSWSQAVSHRGFRRRLQDFHRAPPVLGFLHDWDDEDIPDFISATVSPFSLAVPDSWLWQAVDCRH

SEQ ID NO: 113747 - protein, 135 aa, Triticum aestivum
  Clone ID: PAT_TA_8165.pep
KNTFRWSDAEACVAVRKYPSVLRKSKESLKRRSEFLVSEVGLEPVSIAHQPVVLSLSLEGRLRPRYYVIKFLKENGLLHRDPSFFTAVKITEKVFVEKLISPHKEAAPHLAEDYATACKGEAPTNFIFRWTRNRL

SEQ ID NO: 113748 - protein, 355 aa, Triticum aestivum
  unsure (1)..(355): unsure at all Xaa locations
  Clone ID: PAT_TA_8166.pep
PPPRPAAAAMDAAALETLILDLHAIEAVKLGSFVLKSGITSPIYLDLRALVSHPRLLASIASLLSSLPATRPYGILCGVPYTALPIASVLSVDRGLPMLMRRKEVKTHGTAKAIEGAFRAGDTVLIIEDLVTSGASVLETAAPLRAEGLVVADAFVVVDREQGGRENLAANGITLHSLMTLTEVLAVLLKHGKVTEEKAAEVKQFLDANRKVTVPGAAKPKVVRKGFPERAALAKNPMGKKLFEVMEAKQSNLCVSADVGTAKELLELAEKVGSEICMLKTHVDILSDFTPDFGAKLRSIAEKHNFLIFEDXXFADIGNTVTMQYEGGIFXXLEWADIXNAHVITGPGIXXGLKL

SEQ ID NO: 113749 - protein, 380 aa, Triticum aestivum
  Clone ID: PAT_TA_8167.pep
LTRRPPLRARARVPAPPVPVPAPCPPPAPPPLALSAPLGRGSPPGLGPAADWLCTGSAPPPPGGPVAARPLAPLPPTSPAWCRPGCAPLAPGGSRRAIARCSRAAGGLQSRFRCRGPLKARAARAWPSRLAPACISRPASLSRAGVGRPLSMQDFFMIFSRLFMVSSACPSGPASALAWALGVRFSALPSRGGLGAPPLAPCLGSQRQSNHKVMMGSFFHVPSNDTELIIRLIAGRFPRGCPLPCGRPCGCTCAVATDGGGCVPADLGARLCGPRVGSGPGNPPAIPARTLATWPSRRAGPRGPRGCPGPRGSWGARGPGGAPPHGGAAHVGGGADLFVWAVRFHSVGGFHTVGMLLALFPRFGLVPPLRSCMSSCIVPV

SEQ ID NO: 113750 - protein, 271 aa, Triticum aestivum
  unsure (1)..(271): unsure at all Xaa locations
  Clone ID: PAT_TA_8168.pep
RVAARGSANAGPGDAPSXLLEVAGVELGFNYPMPIVELHLARECLDDAISTXMWQLATAEKLAQVDGEVVEDNLSHIXSFDVPKVVLKELSPRAPHCDQKVPTDDGRNLELQPKELKGTDKQTICVDVIKASKMEDSGSMANSPISRKRSSSGSVFNVPSYSSSVEVRSRNQHPGGYLVGSSKYILQKAERNCVGKAEDDDSADSCTWPATALRKPTTCLAAAWPLESPGQRGGQAQRSHLPAPPPRPMLDVAGVLPGFFCPIPFIYVTYN

SEQ ID NO: 113751 - protein, 429 aa, Triticum aestivum
  unsure (1)..(429): unsure at all Xaa locations
  Clone ID: PAT_TA_8169.pep
MAGNEWINGYLEAILDSGASGGGGGGGGGSGAGAGGGGGGGGGGDPKSSSSPRGPHTIFNPTTYFVEEVVKGVDESDLHRTWIKVVATRNARERSSRLENMCWRIWHLARKKKQLEIEGIQRMSARQNEQEKVRREATEDLSEDLDEGEKGDIVGRPAPSGAPGKKFQXRNFSDLSVWSDENKEKKLYIVLISVHGLVRGENMELGSDSDTGGQVKYVVELARALAMMPGVYRVDLFTRQVSSPDVDWSYGEPTEMLTSGSHDAEGSGESGGAYIVRIPCGQSNKYIKKESLWPYLQEFVDGALAHILNMSKVLGEQVGHGKPVLPYVIHGHYADAGDVAALLSGALNVPMVLTGHSLGRNKLEQIMMQGRMSKEEIDATYKIMRRIEGEELALDAAELVITSTRQEIDEQWGLYDGFDVKLEKVLRAR

SEQ ID NO: 113752 - protein, 203 aa, Triticum aestivum
  Clone ID: PAT_TA_8170.pep
SSEPAEPEEQEEESAQEMFPVEDEGARLEADQGQSALGMSEAKDGPAEMEEQQEQSALGMSEPKDEPAEMEEHQEQSAQDMCGPKDEPAEMEERQEQSALDMTEAEDKRVEMEVHQEQQSALDMSEDEGGAAEMKGHQGKSAEDVPELKDGAAEMEVTPEPAKEEPAEMEEGHKRPADGIHEAKEDPAEAHAQQAQATMPRMA

SEQ ID NO: 113753 - protein, 78 aa, Triticum aestivum
  Clone ID: PAT_TA_8171.pep
SRSGRATDRSLRPCIIRRLCSGRYRKQRLRRCLHQPPNPANNNNQKEHTQQLLNRFIDPCCIHLQNGPCNFSVAFSAS

SEQ ID NO: 113754 - protein, 317 aa, Triticum aestivum
  unsure (1)..(317): unsure at all Xaa locations
  Clone ID: PAT_TA_8172.pep
RYASQKAEEGKEGASEMADAAAGKTEDAPADKARESEGAAAEKARQHGHGVRXRAGEKADTAWTRTRKPGEGAPAKPRIARAIGTGQGGNGASTGGGRRRRGARRLMSAGTNGRRRGVGRGEGAKAYMVDKKEDARRALAGSVKDSKGETNESAWQQGPDVRRRAAEKAEEVRQRTHQPPEEGRSKSATENILGSAQGLTEAFKEKMTMPTDVIERKVAERKGTPTDASRGEALNADDVMLRVKEADQMTGAGFNDVGKMGEEGTGMKAALRADDEEDVMLRVKAADQMTGQAFNDVGPMGEEGTGWGPALRARKDA

SEQ ID NO: 113755 - protein, 68 aa, Triticum aestivum
  Clone ID: PAT_TA_8173.pep
KNGTWRMCVDYTDLNKACLADPFSLPCIDQIIDVTTGCERLCFLDTYSSYHQIKMVVEDLEKITFITP

SEQ ID NO: 113756 - protein, 294 aa, Triticum aestivum
  unsure (1)..(294): unsure at all Xaa locations
  Clone ID: PAT_TA_8174.pep
MHEDERSLMHGGEVSLMQMGETSHVPSTLCTNQPIEVPEFSDQQLDQQRQMDVEATPIVDKCRNGKGLERLTKELGSKIIIQVAEGKKRPDKPAXAAKLASQGGVAARXHLPLLPHFKEYKANGHHIDSFIGKVAINFDMDTPRVRVKYACIDILKTALKNRRHHLKKKHFDNVPANLVSVKSLDKNVTDAEWQRLVKMWSTPRHKETCQSNKENRSKVKFHQKTGSRPYISHVHALKEARKGEELTALYLFKECHNGKKTGFSWPVKKAIADMEKAIGQGVPEGRGPKNVACC

SEQ ID NO: 113757 - protein, 335 aa, Triticum aestivum
  unsure (1)..(335): unsure at all Xaa locations
  Clone ID: PAT_TA_8175.pep
EHYSRGKPLTTLSSTTLPDESSRQGSCIRFWPDKEIFTTTIEFDFSTISSRIRELAFLNPELTITLTKEEQDAQVQHNEYCYAGGLVEYVAWLNNDKKPLHDPIAFRKELDGIIVDVSLQWCSDSYSDTVLGYANSIRTVDGGTHIEGLKTSLTRTINSFAKKSKIMKDKDISXLSGEHVREGMTCIISVKVPNPEFEGQTKTRLGNPEVRRIVEQSVQENLTEYLELHPDVLDSILSKSLNALKAALAAKRARELVRTKSVLKSSSLPGKLADCASSNPAESEIFIVEGDSAGGSAKQGRDRKFQAILPLRGKILNIERRDEAAMYKNEEIQNL

SEQ ID NO: 113758 - protein, 74 aa, Triticum aestivum
  unsure (1)..(74): unsure at all Xaa locations
  Clone ID: PAT_TA_8176.pep
PARASSSSRNRERENTTEXPRRCLRGWRSPRSSPVCHVQVPNVLNLCMFRFDSEFEKQVLTVSRSTVKRAFRYT

SEQ ID NO: 113759 - protein, 344 aa, Triticum aestivum
  Clone ID: PAT_TA_8177.pep
MAQDSWDADKISLDVYIHDYLVKRNLQNTAKAFQAESNLSPDPVAIDAPGGFLFEWWSVFWDIFISRTNDKHSDVATSYIETQSIKAREHQSSLQQQQQHPHSQQSAQQIQMQQLMLQRQQQEQQQQEQTQQQQQHPQQQRQQQRRQQKQQQRNESSYLPTSPQNGSVSADPPTQPNTVTTSSLSAKAYEERMKISAQRDTLDEASVKQRFNENAGQLLESNPASLLKSAAFSAQASGQIFQGSAGGVSGTLQQAQARNLQLQGSTQEIKADSNATLNLRGAGADGSLLGVPGTNPAGHNMTLKGWPLTGLDQFRSGFLQQKSFMQNPQALQHLQFLTQQQQQL

SEQ ID NO: 113760 - protein, 134 aa, Triticum aestivum
  Clone ID: PAT_TA_8178.pep
IRHEATLNDILDKDVENDSVKKQGSHSGNLRRVRLGLGLIKALFEQFLATEGGSLYDAATTAYGQVCAPFHSWAIRKAVGAGMYTLPSREQLIMRLNETDCSVQKEMRRYIDASSPIIEYIDNLFLSRNIVLDW

SEQ ID NO: 113761 - protein, 119 aa, Triticum aestivum
  Clone ID: PAT_TA_8179.pep
QTGSQVVAPSSPSPIASWERRPVPGKKCCFHQNGSLVPASWHCACLPHDRGNTPRLWWQHALSVVVAPLRPVAARHTGVRCRESHDSSLPWRHCSIPRRAVQDVIEARRPPLQHLALVP

SEQ ID NO: 113762 - protein, 153 aa, Triticum aestivum
  unsure (1)..(153): unsure at all Xaa locations
  Clone ID: PAT_TA_8180.pep
FFXPRHPASDAQRVVHTIMPLMALLETPKTKPVEIRQDLTPLGGRRGRRPAPQASLLLAPQRTTPTPHGLARRPGLAQNRLQARSCHLRLHRIRRRGARRARRAREPQAGHHWPLARHRVCDRGGIARSRCHANGGEWSPGPGVASGETGGLR

SEQ ID NO: 113763 - protein, 132 aa, Triticum aestivum
  Clone ID: PAT_TA_8181.pep
RPRTRGAQTWRARSHAIPTSFPVQISLAFAPTIPADPVRHPPPEKPTTTAAKQCHGEARIHVRPPGDGADNEGRRRGMLRRPQGHPGGFLPSLHPPLASPSHLLCISSTPCMPFCTLHTLLNMIGLWEHYSF

SEQ ID NO: 113764 - protein, 81 aa, Triticum aestivum
  Clone ID: PAT_TA_8182.pep
ANEMGPNTRVNCIAPGFVPTRFAGFLTTNETIRNELIERSILKRLGSVEDMASAAAFLASDDASFITAETIVVAGGTQSRL

SEQ ID NO: 113765 - protein, 142 aa, Triticum aestivum
  Clone ID: PAT_TA_8183.pep
MDVKCRRLEGKVAVVTASTQGIGLAIAERLGLEGAAVVISSRKQKNVDEAVEGLRAKGITVVGAVCHVSNAEQRKHLVDTAVKNFGHIDIVVSNAAANPSVDSILEMKESVLDKLWDINVKASILLLQDAAPHLRKGSSVIH

SEQ ID NO: 113766 - protein, 345 aa, Triticum aestivum
  unsure (1)..(345): unsure at all Xaa locations
  Clone ID: PAT_TA_8184.pep
EPRVRAGERESEWAAAGGGWRWRAAGDXTGHRRGGSCRRRSCSTISAXRFVLNVPKEDLESFERILFLLEQAHWFYEDNSVEHNPSLKSLSFKDFTSLMFNSCAALRPYRAHLDDIYKDFTHYKFRVPVSGAIILDDNYDRCLLVKGWKSSASWSFPRGKRSKDEEDHTCAVREVLEETGCDVSKLLKMDDHIEVSIGQQRVRLYIITGVKEDTVFAPQTKKEISEISWHRIDDLLPASDDAISRGVNGMKLYMVAPFLTGLKSWIGTHRSQVYQKSDTSARGTVWKAKNPSGVFVPVENPVITRAGSDAQNPVITRAGPGTQNPVITRAGSGTQHVHNRPDNDS

SEQ ID NO: 113767 - protein, 303 aa, Triticum aestivum
  unsure (1)..(303): unsure at all Xaa locations
  Clone ID: PAT_TA_8185.pep
MMRISGIAAVSHINARFHREKTAARSKGNTARPAMDVKCRRLEGKVAVVTASTQGIGLAIAERLGLEGAAVVISSRKQKNVDEAVEGLRAKGITVVGAVCHVSKAQQRKPLLDTAVKNFGHIDIVVSNAAANPSVDSILEMKESVLDKLWDINVKASILLLQDAAPHLRKGSSVILISSITGYNPDAALSMYGVTKTALFGLTMSLATEMGSNTXRVNCIAPGFVPTRFAGFHTTNESIRIELIERSIIKRLGRVEDMASAAAFLXSDDSSFITAETASVAGRNIIKTIDKFSGVNQLQCHDQ

SEQ ID NO: 113768 - protein, 104 aa, Triticum aestivum
  unsure (1)..(104): unsure at all Xaa locations
  Clone ID: PAT_TA_8186.pep
NLRSDHDPVLLPAGELERDGDAVHHAEPVVLLVDIVSDFSILLLDFIAGCYCCRAIGVVFWAARRRGRRAGLEADDEVVQGSGRAGGAGGPXPXXGPSKGPGXF

SEQ ID NO: 113769 - protein, 264 aa, Triticum aestivum
  Clone ID: PAT_TA_8187.pep
DPGMKGVLATRVSGSADLYQVNQRKPHHGLHVIIAHDGFTLCDLVSYNLKHNDANGEGGRDGCNDNFSWNCGVEGETNDSNVLALRSRQMKNFHVALMISQGTPMMLMGDEYGHTRYGNNNSYGHDTCINNFQWGQLAERRYGHFRFFSEMIKFRQNHPILKRDRFLSKNDVTWHEDCWDNLESKFLAFTIHDHNSGGDIYLAFNAHDYSVDAVIPPAPQQKHWNRVVDTNLESPNDIAPEGVPLTGSGYRIAPFSSILLKASP

SEQ ID NO: 113770 - protein, 277 aa, Triticum aestivum
  unsure (1)..(277): unsure at all Xaa locations
  Clone ID: PAT_TA_8188.pep
RHPFSALQVAKAYMDNVFKLHGPPEAMVSDRDRIFTSKVWQELCKLTHIKLNISSARHPQTDGTTERVNQCMELYLRCFVHNCPSKWVEWISLAEFWYNTSYHSTLKSTPFEVLYGHKPRFFGITNVADSTVTDLAQWTRDRAVMVALLRXHLNRARQSMKEKADQHRSDRAFAVHDWVYLKLQPYALSSVAARANHKLAFRYFGPFQVLQWVGEVAYRLALPEQARIHPVIHVSQLRAAVPPSTMIMLELPTLDEDLLQFQVPTAILQRRMVQRVA

SEQ ID NO: 113771 - protein, 157 aa, Triticum aestivum
  Clone ID: PAT_TA_8189.pep
LVLRPTAARSFGGWPVVPGFWTLKNHPHESTQIRMFALSCMKGSQACSDAALLVKKAALLGITIEAGLMTRNLRDKYYDSNVSYLNRLIRRFALEVVRQKFDGSLEHSAHDDYRYDFVARLEEDAENHCRDSLVNSDPASEEKGNVASCASTCSNGN

SEQ ID NO: 113772 - protein, 141 aa, Triticum aestivum
  Clone ID: PAT_TA_8190.pep
IKVYFESPFVTSLFKRDGKLGIQKDSAFMTETVIEYMQHDMIKLPINANNTHWYLAVVNTKKHEVQVLDSLCWNSDRDDLAHTLRGVQFHLDLLKSQNLVKDNWKDIDLTEWKITEQLQKAIQKDSYSCGLFEEVAGGSRG

SEQ ID NO: 113773 - protein, 199 aa, Triticum aestivum
  Clone ID: PAT_TA_8191.pep
RHEGLPSATICSNAIMHAGTTVDTFLRENLEWLSRATNWAKFSATAGLGVIHRGHLQQGRALMAPYLPQSGAVGGGSPYSEGGALYALGLIHANHGEGIKQFLRESLRNTSAEVIQHGACLGLGLASLGTADEEVFEDIKNVLYTDSAVAGEAAGIGMGLLMVGTASEKAAEMLAYAHDTQHEKIITGLALGIALTVYG

SEQ ID NO: 113774 - protein, 84 aa, Triticum aestivum
  Clone ID: PAT_TA_8192.pep
LQPRVILFLLTCYISVLYNISKLSLLKIVHLFSDARTSLERESGLRVSPIRSQRRCQTMRRYQRCTGRRCFLEPQCVHLLSTCC

SEQ ID NO: 113775 - protein, 232 aa, Triticum aestivum
  Clone ID: PAT_TA_8193.pep
MEAKTGNSGMLYHELQVRQLCGLHALNTALQGPFFSEGDLMEIAADLDARERKVMSRAGGVGAGDFLAEGQGSHNVSDNGDFGVEVLKRALEVWDLQFIPMYSQAAAGSQSKPELETAFICHSQNHWFCIRNVDGGSCNFDSLYPAPEYLSQFFLSDYLDNMRGPGSNIYVVRGTFPRDCPSDNNDFGQWLRPEEAKIITHSRFKAQQKQQSNTAIVMASRRYLSGGSGLRG

SEQ ID NO: 113776 - protein, 173 aa, Triticum aestivum
  unsure (1)..(173): unsure at all Xaa locations
  Clone ID: PAT_TA_8194.pep
PQIGRTRGGIRRTWPHAIQRPGGARIPRLSGRTSPSFLRSWCTQGGLSVNHLQELCFRKGGIYIKLGKHIAXLVYVPTMRAPMQKRCPVSSYEDVYEVFNKEIGEXLPQTVQHDHLVDTSVIDIATVDLVVNALHYIFPTFDYRESGPNSTSLSQNKVGGTIERDQLDSSSGN

SEQ ID NO: 113777 - protein, 376 aa, Triticum aestivum
  unsure (1)..(376): unsure at all Xaa locations
  Clone ID: PAT_TA_8195.pep
WVIRQKLCKGCILSLQTVVWSRITLSNLSGAPGAAGRRRPLVWFRALLLLHSHDLSHARSXRTMSLVPVFLFEQPGMVMSPQMLGQTGHYLASFLVNSLGALRKSLSAPQKTSEVAPARRDALVPALARAIDARSVYAHGEVSRDEGPAAGKVTKAIXKERVEVKYFWGTTLYHLEXSLPFRLDDIPSNCRRFWEAVKGSEVRKVLDAPEEVKCVPMKNVLEPGDIPTLGELGLSAPPAMAQDSKSAAGSNLIGGEAEALERLKKFAAECCMQPNKAVKDSTQNSIYGANFSCKISPWLATGCLSPRFMYEELKKHAIRAIPSKDGDGTSDAGTNWLMFELLWRDFFRFVTKKYSSAQKTSEVAPATGCTPAPAFA

SEQ ID NO: 113778 - protein, 109 aa, Triticum aestivum
  Clone ID: PAT_TA_8196.pep
SPPAPPSPSASLAVPYPAPRAPLQAPARHMLRLLQIYEVMRKETSHQGFEATSPTREIQLFASKLFGFTRRKRSVFLRSHLIDTITDWFLFLQQFDTAGRMFIFPQSTR

SEQ ID NO: 113779 - protein, 238 aa, Triticum aestivum
  Clone ID: PAT_TA_8197.pep
LCTPHILSHVSVREVKGLRSRRRSRIRRHRQARQTQQPRFLFERRCKGKPWAPCNLMKLWPFISSSSSLGEVRHLATREAGDDNRRCFNALTLGGAADAATVGRRCWNHLARCYNDMEEMLQPTDGDAGTGQGRRCIHRRQKLHPWPDVSCIHGWQSCIHCWRKLHLSPAGLRRQAKGVGTGSRRSCCQRCGKRIDLSWNLLRLISPCIFCWNLFRFLLELFFNFAAIQEEVVLSPPG

SEQ ID NO: 113780 - protein, 135 aa, Triticum aestivum
  Clone ID: PAT_TA_8198.pep
GFVCERRRRPTTSGGPAKRAPHQGKVVTSKSTGRGVGVVSCSRARPGRRGSWAWRRPTGDEALCYVHEQRSQVQENRQHKISRANIFSIIQFYREEGRQEHEGEILCKIKFRNTWYRRHFCSLYITQGCAEVEFH

SEQ ID NO: 113781 - protein, 183 aa, Triticum aestivum
  Clone ID: PAT_TA_8199.pep
LNLKRAEKARLLVQKIPTMIDNLIDKTFAWEDESNTPFLYDGVRLVAILEEQKLRRVQKEEDKKRYRDQKKLQNLLLKEKELIFGSKSVPRKTSSFNRRTSGHHPNGNGAGFMTPMPRRVSAGSATPELLTPRSYSGRYNNYFKENRRMTAAPLNFSTASKDDSMSSFASISGSEPGSPLVLH

SEQ ID NO: 113782 - protein, 204 aa, Triticum aestivum
  Clone ID: PAT_TA_8200.pep
MRGRDAMMVDTSPYKEDGSLEIEYSNLLDVRLVKGSEPVSADLSTPIRETGKEGKSPVGEPVALDENKGKVHSQNGTSVPALDENKGKVHSQNGTSVPPDSSKGPEAPPENTRDKAWEASSEVPNGKPDDEAEGNNGWGAWKQNASTSAWSYRAQRSTALGPTLALLRGNNGRGGGRGGGRGGGRGGGREGGRGGKPNNRKYGK

SEQ ID NO: 113783 - protein, 100 aa, Triticum aestivum
  Clone ID: PAT_TA_8201.pep
LWLFPPRDIPLMPEARVSVPPTLHSTEEWDRPSPHEKRPKDGLRRCLAPHGLLYFPPPPATGGPHRQAAPCPAYCQPVADSVCIRRPTSTKRTIPRCVQR

SEQ ID NO: 113784 - protein, 264 aa, Triticum aestivum
  unsure (1)..(264): unsure at all Xaa locations
  Clone ID: PAT_TA_8202.pep
MSPSTYPLEDENVNPTANWKLSAPAPAKKSWIPAGFGGSGKHDATIDIPLYDPKKREQELLSWEEDLKRRERDIIQRENAMNRAGVTIEVKNWPPFFPVIHHDIANEIPTHAHQLQYSAFASWLGIVVCLSWNVFAVLVESIHGDVRRLSRLAIIYAAFGCPLSYILWYRPXLYQAMRTDSVVTFAQFFVFYSVHVGLCVIAAIAPPIIFMGKTLTGILVAIDVLNTDMFVGVLYLIGFVLFTAESLISIWVLERVYIYFRGHR

SEQ ID NO: 113785 - protein, 156 aa, Triticum aestivum
  Clone ID: PAT_TA_8203.pep
MDEQDDKNTKAELKLCGDIAVKRKNYRGASAFYSEAIELDPSDATLYANRSLCYLQMTEAGKALRDANTCIKLRPEWLKGYYRKGAALMSFKEYKEACDAFEAGLKLDPGNTEMEKVLQEAVEAMKKDDMAKKRENASSHPAREKQARKGRGRNTR

SEQ ID NO: 113786 - protein, 277 aa, Triticum aestivum
  unsure (1)..(277): unsure at all Xaa locations
  Clone ID: PAT_TA_8204.pep
MDLSTTSVMAAKAYSYKAESLVKEYLLADAYVSYTAMLXGILMCKMVYDITHLSQAHSSTSVMASLTKAQKXEWDNRGISTXVHAIFITXMSSGNLVFLPRLFPPELLGPGPFPSSNLSNITLAVSVGYFITDIAMIFWVYPSLGGMEYVLHHFLSLVSIVYSVNSGEGQLYTYMVLISEGTTPGINLRWYLDTAGLKRSKAYVVNGSLMVVAWLVARIILFIYLFYHIYFHYDDVMQMRTFSRVLIFGVPTILLIMNTIWFAKILRGLKKTLTKRE

SEQ ID NO: 113787 - protein, 74 aa, Triticum aestivum
  Clone ID: PAT_TA_8205.pep
AFSNVSKPLTSHHTLFFFRSRSHADTDIQYSTVQYSTVVGGGDGAHPSPSSQSLAEQQHRLRLPLLPEAVERVA

SEQ ID NO: 113788 - protein, 125 aa, Triticum aestivum
  Clone ID: PAT_TA_8206.pep
ATARSLEMRRSRLAAVSPDAAAKSVGKTGGDASKGCHCCHKPSKSPEHSVAIDVRAGEQRESPTAATCAPAKKVEVTGSVNGPAAPASSSGASVGCCPRETDSTEACKKMAPADLVLNICTTFGL

SEQ ID NO: 113789 - protein, 159 aa, Triticum aestivum
  Clone ID: PAT_TA_8207.pep
VYQKVTADNEKPSGIGPADSKTDTSLFSNKDQEPTSSDNFGAATEFSDSAVPTEAEKSGKSGIQFLEESLPTNSEPITVSAHTTSMQGGVGGVESEKSKPDLLLSNIDIREMSNKKLSAAAPPFNPSPPAILSPLAVSVGLPPPGAVPSGPWPMNISMH

SEQ ID NO: 113790 - protein, 184 aa, Triticum aestivum
  Clone ID: PAT_TA_8208.pep
MEKSAAGSAGARNVSMDKSFLQSNSCKKRCLCDWISGLPDEILVSILDKLDSKTAVGTSLLSRRWRRLWRLVESFHFSEVVLPDNYCWVRLGPMRYYLNTHRDHHFVESLQWFTRLKRETPLRRLSLVFSGSAECSDVVNSAIASAAQHGISEIDMAIVVRMEYEFPWWLFSVYRSSLLTSLSL

SEQ ID NO: 113791 - protein, 95 aa, Triticum aestivum
  Clone ID: PAT_TA_8209.pep
FFLKQKIILVPAKKYTGSSKNKKLVQQKMATLSCSSPSSRLQLRRARLQLPTFELRWIQHSLLLDVASPARHRPCSTSTSWLQQTGAPVPAKNSD

SEQ ID NO: 113792 - protein, 67 aa, Triticum aestivum
  unsure (1)..(67): unsure at all Xaa locations
  Clone ID: PAT_TA_8210.pep
ACTHSSTPRXEEQEEGRRGEGPEGRPWRLWVLREHQLASSWLVIQIQVSRVYACMRVCRLYGIIKIV

SEQ ID NO: 113793 - protein, 108 aa, Triticum aestivum
  Clone ID: PAT_TA_8211.pep
GIMWQAPAYTILGAGEVFAAIGVIELFYDQAPDSMRSLCTALAQLAVAAGNYLNSAVLGSVASATGWIPEDLDDGHLDYFFWLMAVLGALNLLQFLLCSIPAMRQSGR

SEQ ID NO: 113794 - protein, 126 aa, Triticum aestivum
  Clone ID: PAT_TA_8212.pep
IPKHENVEQELNWGLINSWMAVWPHGSGKRPEPFHALATKFSMMAYRAGRHADWMRHDRPEPWRRSDNKVADCRFSSGSGSPRGDDLNGAPSYPSTSGMCGGYAEKPIHSCVGTASEHASCRIRHE

SEQ ID NO: 113795 - protein, 228 aa, Triticum aestivum
  Clone ID: PAT_TA_8213.pep
TGLGPPRTAVARGFYAPPGAVRPLVVPWPRSSSPWTVAGGVVKLVFDRNQIVQPVSGLGVMLRDDLPANRFLVEQGQQIWRYLVPVQTGLLMVIRYIVGRRTERIRVFKLEDKDDQLRWIEQDDLPGHKVFIGHGCSRCYEVGDEVLSIYFYDDREELRMPQYYFRDDSGIATSLEIFPWPVIMGKSQIESVFMGESQIESVFMGDSQIESVSECSPPAWWLHKCPRA

SEQ ID NO: 113796 - protein, 188 aa, Triticum aestivum
  Clone ID: PAT_TA_8214.pep
DEPLLKILDLPVLVVLDEAYVEFSSLQSRMTWVKKHDNWIVLRTFSKRAGLAGLRVGYGAFPLSIIEYLWRAKQPYNVSVAAEVSACAALQNPVYLESVKNLLLQERERLYNLLKGIPYLKPFPSHANFILCEVTSGKDAKKIKEDLAKMGVMIRHYDKKELKGYIRISVGKPEHTDALMEGFKALKL

SEQ ID NO: 113797 - protein, 352 aa, Triticum aestivum
  Clone ID: PAT_TA_8215.pep
ADPDLAAAVCGADFLLTRLLEDSGDPGWDIKDCRCGHLLLHNRRTKQIAAYNPLTQALDIFPHPPRETCGPRYLLYRIIFPKEDQRAFHVVCFRRRKSCRGSRLRISVFSSVSREWQCFSWVCVQNLTPQPRKDGGDVWSYIATLVSGSDRLAYWKDKDQAYMVVLNTPTPHLSPMGLPPPSEDYELGRTKDGKLCLVCIDDVYANKGTLAVWFCRVDSDGSDEWMPHKVFPLSAFIDVTMCSEEYDVMVQVVMVLDGFVFLSVSYARYTECLISFCLETENVNKLFTHTLDCNIHPYFMVWPPSLVRNEEDSDTKLTSDNVTDDGPVGIEATPSVFGLCEEKTPSTSFIHL

SEQ ID NO: 113798 - protein, 150 aa, Triticum aestivum
  Clone ID: PAT_TA_8216.pep
RHEGHIAGDPIRPPRLEDAGLEDCALPQESIAEAFSLAALAVSSRLPHLSLSDDEDEGDDPLAPRGGCVEAGPTCGAIPESLVGGGRGSECHADEVMVVAGRGDEEDRVVVVVGQELGQEKGCAEGTREGEQRKVEDGIVEKAILVKDFA

SEQ ID NO: 113799 - protein, 560 aa, Triticum aestivum
  Clone ID: PAT_TA_8217.pep
MAPPRMLPPMVPLLAVSALMGCSRAAGYTSGLRPTSFPKGCLIGTATSTCQVGMGEAYCRDLASLLERTPRPRAPKAWPGEAKEEGTTDVFNTFTRPVDLPRTRYFDAYRFSISWSWMFADGVGKVNKEGVTYYNNLIDYILKQGLTPYVNLNHYDIPLALQKKYDGFLSPKNATIFADYAEFCFKTYGDRIKNWFTFNEPRIVAALGFDTGTNPPNRCTKCAAGGNSATEPYTVVHNILLSHATAVARYRNKYQASQKGKVGIVLDFNWYEAATNSPADQAAAQRARDFHVGWFLDPLLNGQYPKTMQDIVKERLPSFTPEQSKLVKGSTDYIGINQYTATYMADQPTPQQPPTSYASDWHVQYIFQRNGVPIGLKANSNWLYIGPTGMYGCVNYIREKYNNPTIIISENGMDQPANLTREEFLHDASRVEFYKTYLAELKKAIDEGANVVGYFAWSLLDNFEWLSGYTSKFGIVYVDFTTLKRYPKDSAYWFKNMLQASGPGSSKDGTVTSGGTQAGSGVSGSNMAAGGSATSSSPRVLLSLLVCLYLVLPSIFMLSF

SEQ ID NO: 113800 - protein, 196 aa, Triticum aestivum
  Clone ID: PAT_TA_8218.pep
PRRPVPAPPHPRPAPPPPHGVWYPPDYPYQQAYYNQMQQYYSQHYGQTSPSTSPYPFMGFMTSGQNPRAGFSPLHLLAPPPPSFPPAPVRSNAAKLLSAVWPNIPFNITIPIHGVHDKWPESKGRLLAIAAASCAGRRSFSSRPRVLSTAAPSLPPNFKTPVAPSVQSQGQSEDVSGPQPTQDIIGGWRLQTQDYQ

SEQ ID NO: 113801 - protein, 235 aa, Triticum aestivum
  Clone ID: PAT_TA_8219.pep
AAGDVPAPSALSGWPRTTGMYLFVMNIRSVFKLDELGSEVLRIAVPASLALAADPLASLVDTAFIGRLGSVEIAAVGVSIAIFNQVSKVCIYPLVSVTTSFVAEEDAIISKYLEENNSKDLEKAAHVHSDACNVPASGGDTPVCANSCIPTECADLSNQGCKRRYIPSVTSALIVGSFLGLVQAVFLIFSAKVVLGIMGVKHDSPMLEPAVRYLTIRSLGAPAVLLSLAMQGVFR

SEQ ID NO: 113802 - protein, 132 aa, Triticum aestivum
  unsure (1)..(132): unsure at all Xaa locations
  Clone ID: PAT_TA_8220.pep
DQRRGTPLHSAIHAPRCKTPNTTATARTNDTRESVARRPSDTDLTRSEDQQEEQATCSPTPSIGAPPGWRKSRSKLFRCGAVQTSDAAPLKTNYAYPISLPDRNSQGPRQLPPLERQRETDEDPASCRIXCX

SEQ ID NO: 113803 - protein, 278 aa, Triticum aestivum
  unsure (1)..(278): unsure at all Xaa locations
  Clone ID: PAT_TA_8221.pep
VLKKRTFRVPLKGHCXKTAGPASTLSKELYSEAKSRLDVLNKKDAERRRTAELKNNLESYIYSMKEKLEESTDMLAVSTEQERESFTEKLSEVQDWLYMDGEEAQANEFQERLDQLKAMGDPILFRMSELKARPAACGSARLYLTELQKIVKNWETSKSWLPKKRVDEVVSEADKLKAWLEEKEALQKSTPAHSSPAFTSEEVYQKVLTLQNKVSSVNRIPKPKPKVEKKPAAKEEANKEKTDSSESASSESESTEKSSESDASEKTNDSEPESHDEL

SEQ ID NO: 113804 - protein, 159 aa, Triticum aestivum
  unsure (1)..(159): unsure at all Xaa locations
  Clone ID: PAT_TA_8222.pep
RITPHPIPGPLNKPKAPGPQSTLCAQEPSLPLGTHGAPAAINSHSPHSATNYVPPVDTKARARQSGXAVSVGNQCEAEWFELMEQPLGREIPDRIVDMDVTLLLRELVSDAMRLALTTLSEDGGHKKRRKVAEDDDDEEEEAPRGHRQKPRSFKKSSRR

SEQ ID NO: 113805 - protein, 227 aa, Triticum aestivum
  Clone ID: PAT_TA_8223.pep
ANSARGLANRVGESSSSSSSASGAGKDSGSFECNICLELAQDPVVTLCGHLFCWPCLYEWLHVHAHFPECPVCKANVEEDRLVPIYGRGKTSAEPRPSSSEGPQIPSRPSGQRRATAPPPDHRDHYPHPNQNPWFPGAGAMAGGRWGNYTFSAAIGGLFPLLNFQVHGFPPAYGPAAGIPYGYGHDFHGWHGHGFPPQAPQGQQVDVYLKMLLVLVGVLVIASLIAF

SEQ ID NO: 113806 - protein, 111 aa, Triticum aestivum
  Clone ID: PAT_TA_8224.pep
TPWYKFFHKVIHIDKGNLHGTSDKLHNTSRKKRQTTLEHPRSTMLYTAYLNREIFMSCTGGAPIELHDLQLLNRTPASTSACRMIYPHHDEISQDYPGLSAKAIYSLNTSV

SEQ ID NO: 113807 - protein, 390 aa, Triticum aestivum
  unsure (1)..(390): unsure at all Xaa locations
  Clone ID: PAT_TA_8225.pep
MGFLFSKYLARRGTRISKRRSGQRVGGRERKRRRHHLYLDFDDWSLGYSIRKVDSSPGSRRQSAVRRLPRPFLRLQAPHGSPEYFASPLAPTSCRCIPGLPLATACYPGACILTLDVRSRXITFGPRLENTITLCPRWKNPINPIYLAVDNKLFTLSKHSFEILSLDLLSPVPPDRSGRVRWSWEVLTKQPFKVRNVTSYALNPYSQSFLVSTTKKAIADTFAFDTVKLSWKQVGKWALPFHGRGHFDPLLGAFVGLSKDPDTFGQLYFCYMPSSDTGHTPKSKLGKMKLLSEDPAERHVSATLVYMGRRSKFCLIECVSIEGDSADQELKEEGVMPRPPPGLYRLTTFSLSHDMNGDPTTGGSCRVQYYKVPEATTPTFLFADPVVFWM

SEQ ID NO: 113808 - protein, 130 aa, Triticum aestivum
  Clone ID: PAT_TA_8226.pep
PSRCSVSPAGPPPLPPARWAAPCGAGPLRQVGRRRRQVARPRAVALARRPRCSVAQGGPRSPAPCPSPRPSARGRAPPPPARGPSAPPSVALIGRFPQRRNIVQRFCTRYPLVFHAQIKLYKCSGEDIYV

SEQ ID NO: 113809 - protein, 212 aa, Triticum aestivum
  unsure (1)..(212): unsure at all Xaa locations
  Clone ID: PAT_TA_8227.pep
ARRRRLHPRRPKPNHGEGEVTTTGYCPPRSNRGVAGRVPPAGPPPAPSPPPVPAPPRPELSPLPRPLPRRGGGRGARGPRHQPLPGPPAGAGGRPPPAHRRPHPRDPLPPPRQIPPPXKCVSGVLAPPHRRTPPTARSAPPPPLASAPPPSTTGAPAAAPLPRPTALPRSTFPSLTCTITSTAASPSWTPAMASFSTVAIRRRWRVGMISVF

SEQ ID NO: 113810 - protein, 182 aa, Triticum aestivum
  Clone ID: PAT_TA_8228.pep
MSLRRAVGFLLTRRLSSRVIPRTAPARSFHSLKDLPIGGAAGVAAAAFAGVGALAAVQYFRKGSDDDEPATRKKGEFIYIYKEEEMEELFENWIKEFNKTYRDKKEKAMRFQVFKETMKWIESQPPSSHKSLFPGNCFADLKSEELPCSQSCIHGLDDPNSEEYRENKFVTENVKGGFFCNL

SEQ ID NO: 113811 - protein, 167 aa, Triticum aestivum
  Clone ID: PAT_TA_8229.pep
DRASGGGGSEAFSSQHPSPQPGIHSRRRRSGILTRDGGGTQEEDGDQVREDGGRPGDGDGRGAQERAGEDQEASGPTHQELNGVETEEEDGEGFQQGDRDGVRQRAGNGGETQQGARETQEGSVPTQQEVPLHQGPGDAKDTLDSAGDTLDQGASTPHGHEAVGDGD

SEQ ID NO: 113812 - protein, 405 aa, Triticum aestivum
  Clone ID: PAT_TA_8230.pep
GTRARPGAVEKVISGRWHLSKPSSPPASVSAPVLETQVVPPEMERSGLVGTRGFDTATERPRALAVRELDGAMERPRSVGLRGLDVAMDKGVEPVRPASHEGRVGEGKIGEVPERPKLKLLPRSKPIESPAPSPTYMEEKQVLPVPVIASVMQVEVVHEARQNVMVAKTGVAGADAESRATVERPRLNLKPRSNGVGQSGESAAKERPSLFGGARPREQVLRDRGVDALASDLEITSPVGRPKNEFAKVEQKVEAMTINPSGEKAESFAVGHRGPRNADRKDYRRDTDRADAYRPTRRDENRKVSRDVEKQPEQQRPEPETWRKPVEPPKPEVTAPRFGKAATALELAQAFSKSMSDTVPQSRLTSVPSPRVPPSPGARDQVGFSRLTDNGALHSGSSQRKINGY

SEQ ID NO: 113813 - protein, 223 aa, Triticum aestivum
  Clone ID: PAT_TA_8231.pep
MDAQFESFRAQLDGSSALRDRIRAVVSEVESASRAASAALLLIHQPVPLSDVLGKAKAQVEVIKGLYSQLAEILKECPGQYYRYHGDWKSETQSVVSMLAFTHWLETGGLLTHAEAQEKLGLGSGEFGLDVEDYLTGLCFMSNDFPRYVVNRVTAGDYDCPRKVLSFLTDLHASFRMLNLRNDFLRKKFDGMKYDLRRVEEVFYDVKIRGLVPGESKQEVAQS

SEQ ID NO: 113814 - protein, 135 aa, Triticum aestivum
  Clone ID: PAT_TA_8232.pep
FFFNEHHSINIYCSKNDWILQHKLLYLHSIHQQIQNKTIFHKPNGLHFSTVHEFDLDAAPPCNHTVCLCSPEQQQPAATPLLLPFSMDRSTPTPPWTSARSSSRPPPRQSSPPSSGRWIGSRIPGSIGPHQLRQP

SEQ ID NO: 113815 - protein, 121 aa, Triticum aestivum
  Clone ID: PAT_TA_8233.pep
AQPKFKDQKKYHELVDPLIKREYPAKALNQVVAMASMCLQEEDCVRPMMGDVVMTLGFLMMLPPDPPAPEPEPAPAPEPVPEPAAAPKKDDESRRSGSSSSSSDDDDGGDEDEEEEEEEQS

SEQ ID NO: 113816 - protein, 119 aa, Triticum aestivum
  Clone ID: PAT_TA_8234.pep
EKATWALKWNMSLLTIVYSAILNTAAKFVMISWVVTQRGPTYPAMFCAVTVFFTTILDSLLLGNDLSVGSVLGMFMILAGLYLFLWGKRKESVPPSEENPKEQMLFQSGDKNDKSVANV

SEQ ID NO: 113817 - protein, 148 aa, Triticum aestivum
  Clone ID: PAT_TA_8235.pep
RPRGEQEGTSVSDNAARVTVPEPRHVSVISSPIPAVSQAPTISKSTPGYQNYTPAPTTSSGVPSSVVPPPSQASSAQRMQQASPAVAAAIKPIAVHQSRKASLARFLEKRKDRVSSVTPYPLSKSPLVSSGTFGSASTPSRLSSAKSL

SEQ ID NO: 113818 - protein, 134 aa, Triticum aestivum
  unsure (1)..(134): unsure at all Xaa locations
  Clone ID: PAT_TA_8236.pep
EHKEDTRLQERKHRPGEMRREGEKGSTCRAVTEDAAGGTDQNHEHPHTVDQPAREKKQIRDELQVTRTERSRTNKHVQIEEHRNRPAHKQQERVHKDKARGMGSPQILLSNPVEAPSGAVVRQTRARPRAEXPA

SEQ ID NO: 113819 - protein, 72 aa, Triticum aestivum
  Clone ID: PAT_TA_8237.pep
LQFSTRKYLSVVHPIPVYICDISLLLNVKLISSSLCRSLVYFTCTFHICIAPGKKKKNLYCCITEVNLFPCA

SEQ ID NO: 113820 - protein, 128 aa, Triticum aestivum
  Clone ID: PAT_TA_8238.pep
MAQESCDLNKDEAETRKPSSSTPSPPSPTTPPPPTAQIPEPQPPQKHADAVSMAMAAAPLSPVLFVNRCNVCRKRVGLTGFRCRCEKLFCPRHRHSESHDCSFDYKTAGREEIARANPLIRAAKIIRI

SEQ ID NO: 113821 - protein, 91 aa, Triticum aestivum
  Clone ID: PAT_TA_8239.pep
MLDCFFLLFCFASKDGQEQSTAQPFVFLSGVNNWCIKERKGMIIHIPKVSSAAQPLRASVLVSSVPLLQNAPLMQISLHADCLVQKLFLTY

SEQ ID NO: 113822 - protein, 127 aa, Triticum aestivum
  Clone ID: PAT_TA_8240.pep
SQVSSDSPTSEAIHSPEAHQEDHQSGAKKGWARGRGKLHIVAPHSPQSAPAGAVGHFDPSSPRQASQKCPLSPRQVSQKCPFSPRQPPQGPRMPDGTRGFTMGRGKPAASSVAARTVAAPPPAPVLV

SEQ ID NO: 113823 - protein, 184 aa, Triticum aestivum
  Clone ID: PAT_TA_8241.pep
MRTLLSTFASPGDIVFQILPLGFCSLQEDVIHASVDDIERRLQEITVSDMSEKDDHESNLMLSGKDIAVWIMVSSASVAEYQHDLRAKEHNARWRLALLANNKVLMGNVFDSRATSVDACGNHGFVGTRGGFLYMWELSSGRKLTSTQCFNCSRVSCVAVGAKSSVVAVADDGCQLLLYAQKRV

SEQ ID NO: 113824 - protein, 321 aa, Triticum aestivum
  Clone ID: PAT_TA_8242.pep
SYYGGNFVKDVCIDDGQPLPRKISEDKVVDEKSSPNFDCQMIHANGAPTYIEKDCAAKSFHKPKPEAVLPVNFAPDSNNEKRYSSCEKHGPEGKSKATNFGDLSEKKISLEELLRLESAEECLHKGAISSETSKNHMLSFHGEAVRQVSANVGHGVEVIASKTSGLVNDTVSSKNNIDDCSVTTSEECDAAASFDARGLNLIVHYNPFVGHGSLEDTCKPECSTSAISDAASTGPICTFEKTDTISAEGFNEVEITEPRVDALSSLGSEIRSSAKSNDQNGSIMGETITNKMHETEAATTSSAENVEPNGANGENSKEHGT

SEQ ID NO: 113825 - protein, 171 aa, Triticum aestivum
  Clone ID: PAT_TA_8243.pep
MLYTRDGRTLVVSSRKWRTVTEEGTFSFDTKKMEWTRHGDWQLPFRGQAHYVSQLDAWIGMCHHKGGIGHLCSSDVVPVAAGATTLPRWKLLGEERLFDPDSPLHLGATLVHMGGTRFCLVESMWHKADEDVRQRKGKESGMYVGPPQVVIRMTTFDVQYDKDGELLLQSR

SEQ ID NO: 113826 - protein, 494 aa, Triticum aestivum
  unsure (1)..(494): unsure at all Xaa locations
  Clone ID: PAT_TA_8244.pep
ERYLSGFTKVEDNRYSMKIFFEIRKQKYLEALDRHDRAKAVEILVKDLKVFASFNEELFKEITQLLTLDNFRQNEQLSKYGDTKSARNIMLMELKKLIEANPLFRDKLNFPPFKASRLRTLINQSLNWQHQLCKNPRPNPDIKTLFTDHSCAAPTNGARAPPPANGPLVGPIPKTAGFPPMGAHAPFQPVGSPSPNAIAGWMTNPNPSLPHPAIAQGPPGLVQPPNTAAFLKHPRTPTSAPGIDYQSADSEHLMKRMRVGQPDEVSFSGASHPPNVYSQEDLPKQVVRTLNQGSNVMSLDFHPVQQTILLVGTNVGDIGIWEVGSRERIAHKTFKVWDIGSCTLPLXRCLWSPDGNILGVAFSKHIVQTYTFVPNGELRQQAEIDAHIGGVNDIAFSHPNKSLSIITCGDDKLIKVWDAQSGQKQYTFEGHEASVYSVCPHYKENIQFIFSTAIDGKIKXWLYDCLGSRVDYDAPGHWCTTMSYSADGTRLFSC

SEQ ID NO: 113827 - protein, 110 aa, Triticum aestivum
  Clone ID: PAT_TA_8245.pep
PFCISPVGRRLGRHARFGFRASSAEAVNWEKKQEISNTRDKKAAEDTGLKALYDDGFGSVTMKDYLEAVRNMPKDDGGPPRWFCPVECGRPVVANPPLLLFLPGWSKRCH

SEQ ID NO: 113828 - protein, 213 aa, Triticum aestivum
  unsure (1)..(213): unsure at all Xaa locations
  Clone ID: PAT_TA_8246.pep
PFSXEKLCVWLVQLLMALDYLHARHILHXRDVKCSNIFLTKDQNIRLGDFGLAKVLTSDDLASSVVGTPSYMCPELLADIPYGSKSDIWSLGCCIYEMTALKHAFKAFDMQTLINKINKSVVAPLPTIYSGAFRGLIKSMLRRNPDHRRSAVDLLNHPHLQPYVLEIQSKSSPARNMFPAILPNRHEKNKTTCSDDEDNCKPQYIKSQSFKVQ

SEQ ID NO: 113829 - protein, 171 aa, Triticum aestivum
  Clone ID: PAT_TA_8247.pep
GRQARPAQPEAGLYSTSAMDSRAPHRLSGASLPGAVPAQELRVEAASSLLLPNGASHVNVRSPWMKTTGPCLTASPRASPLPPLDPSSDFLNPSGTSPLPPPPHRVRVQGFEGEVYGAIFMWSIRNLFFSNDFSNGEGVHIKFYDFWLRWSSKKYISLTGLIVLHDDESRI

SEQ ID NO: 113830 - protein, 314 aa, Triticum aestivum
  Clone ID: PAT_TA_8248.pep
LNCKSMDLVLSSRFQMSDPCHGLVCAYDLKGAVEVLNPTTRIHLRLPVSELQSLASEYFLGPVPSTKEYKVLCIHHRVRFLTFEVCTVGTQSWRAVRESAGLLKTTKAVIVNDVMHWLLLDEISSNFTRNILSFNLTDEMFSETAVPDAVKDRELHLFEGGGKLHLLAMPGEGSAPKTSEIWVANSTCAVWDHMCNVAFVLPLGMRPLFLHNNKLFYCNQRRFYYVDLQDGSGSYLNMPFGECIISAGIFVESLALHSVTGLVDSRTTLQSPHDARSFPIGRGPSARGAGSSSAGPRRSFKKAKSNINMQWRLA

SEQ ID NO: 113831 - protein, 93 aa, Triticum aestivum
  Clone ID: PAT_TA_8249.pep
NFYNPLVQVKQMLIALLGESEMRLSDEIVETILDKTFSDADTNQDGKIDRTEWENFVSRNPSLLKIMTLSYLKDITTTFPSFVFHSEVDDIVT

SEQ ID NO: 113832 - protein, 162 aa, Triticum aestivum
  Clone ID: PAT_TA_8250.pep
STRKSSRLALFKNTRKENLFANRIFDLFDVKKRGVIDFGDFVRALNVFHPNFPVEEKIDFSFKLYDMDGTGFIERKEVKQMLIALLGESEMRLSDEIVETILDKTFSDADTNQDGKIDRTEWENFVSRNPSLLKIMTLSYLKDITTTFPSFVFHSEVDDIVT

SEQ ID NO: 113833 - protein, 243 aa, Triticum aestivum
  Clone ID: PAT_TA_8251.pep
PDVPRPTPGVSASVFGVSPTSLQCSYHQRGNSVPTILLTMQRKLYPREGLKIEGIFRINAENGQEVCVRDQLNSGVVPDEVDLHCLAGLIKAWFRELPTGVLDTLTPEQVMHCNTEEECALLASMLPPVEAALLNWAINLMADVVELENYNKMNARNIAMVFAPNMTQMADPLTALMHAVQVMNFLRTLIVRTVREREELATASMTLQSCSDSPNDQDEPQMPEHLEKPFACSIQERADHPDD

SEQ ID NO: 113834 - protein, 169 aa, Triticum aestivum
  Clone ID: PAT_TA_8252.pep
QEAKSKRKVDVAKEVASSSKKPFAVGRRVRFQHRWMPVPAIFVAGCSTADAWFHQKLHHTKNRRLVAASGSAGSSILRHGSIVLPPWFAAPVSVVTVPVVGNAMLGWLQHRWTPSPAPMDAPVSSTRSATPPQGRRHAVVSSAAPRQSHEHGEGAGHVLPLARAMTGEN

SEQ ID NO: 113835 - protein, 108 aa, Triticum aestivum
  unsure (1)..(108): unsure at all Xaa locations
  Clone ID: PAT_TA_8253.pep
HPLPNPKLGALRRSPLPNPSSHPPRSKRPSSPTPPPPPPPGRPRGGASDGSLXSPFPLPPSPPPLSPPKPLLAPAQIQASPSSPTPPPTPPGSSRGDHGGAAPGKGDP

SEQ ID NO: 113836 - protein, 273 aa, Triticum aestivum
  unsure (1)..(273): unsure at all Xaa locations
  Clone ID: PAT_TA_8254.pep
RHEAXSKAVLREVAAYLLDHDGFASVAPTALIKISRPEMETTVASIQRFVAHHYDAGELGPSRFSVTSVHRVGILDVRLLNIDRHAGNILVKNPPTSGCAVDGKHVGXAPLELVPIDHGXLCLPEKLDDPYFEWLHWPQSSRPFSGAELDYIASLDPFKDAEMLREELPSLTEPAIRILTVCTVFLQRAAAAGLCLADIGDMMTREFSSAEEGLSALEALCKKAVDSIDTQSPKRVSFGVLGGEEWVAFMEKFEQLLPPAFEDKKRGAGVALN

SEQ ID NO: 113837 - protein, 108 aa, Triticum aestivum
  Clone ID: PAT_TA_8255.pep
MATAFKAFVNSPVGPKTTHFWGPVANWGFVLAGLVDLNKPPEMISGNMTAAMCVYSGLFMRFAWMVQPRNYLLLACHASNETVQLYHLSRCARAQGYLDSKKEPEAQQ

SEQ ID NO: 113838 - protein, 150 aa, Triticum aestivum
  unsure (1)..(150): unsure at all Xaa locations
  Clone ID: PAT_TA_8256.pep
MPLACFLPTPIPISPPLGSPSPSVGLPLRHAAVDTSTRGMATAFKAFVNSPVGPKTTHFWGPVANWGFVLAGLVDLNKPPEMISGNMTAAMCVYSGLFMRFAWMVQPRNYLLLXACHASXNETVQALSFISLCLGLTGYLDSKKEPEAQQ

SEQ ID NO: 113839 - protein, 112 aa, Triticum aestivum
  Clone ID: PAT_TA_8257.pep
MASFGEAPAGNAASGEKIFKTKCAQCHTVERGGAHKQGPNLSGLFGRQSGTTAGYAYSTANKSMAVVWEENTLYDYLLNPKKYIPGTKMVFPGLKKPQERADLIAYLKKSTA

SEQ ID NO: 113840 - protein, 174 aa, Triticum aestivum
  Clone ID: PAT_TA_8258.pep
LMHLVKHQCNIMVITAIITITMVMKATGIWLLVLFPVHTPRYVAPPPSGCPYGNRAKSRVPVAPAAEPVANDHRFTHPAASPPHPLSPSSVRHPPRDPNMHSRPPVPSPPVLPEPPLPSVSFSHAHPPSEHGTGTGPSAGMSVAPAPHSSNASRRLSCQWVLVPLIYTLLWSLL

SEQ ID NO: 113841 - protein, 191 aa, Triticum aestivum
  Clone ID: PAT_TA_8259.pep
ASTALHDASMQLQRLPARLHCNSGQPPARLHCNSGRPRRYCITTLAARQMLHCNSGGPDDVESQHRRSPEMLRCSSGGLMMLHQKPASPRLHCNVLHRPSAARSSPSACITSDYCSITFCYNPRRQPAAPRRRMVIWPLLRSSSPHHRLQRAQGEACDLPLPCNYVDCRDEGGLQHHRLLLPPASLHRRPL

SEQ ID NO: 113842 - protein, 301 aa, Triticum aestivum
  Clone ID: PAT_TA_8260.pep
MKLAPRGRTFARTTLLARLEARLIQMQKDYWSGNAHRIGYVGARSFRSPETGRENSPEGSPGAQPSPGHSGKDYPKQRNAGKSYSASSKKSGKTSTPFSCQQAEKSARTKRSAGSILHGLPDTSDDSDSEFVNTPSLSSKSHILNAHRKYFQNENTSLATPASNGTTEKERSITKSQLAEPNARSNVDGHSIDDHEPVIKQLRDENASLKERLLIVEEATSQELVMERDKVKSLTERLEDLQRQLDTANKEQEALIDIFSEERSRRDEEEENLRQKLKEASNTIQELLLEKSNAGRKGQKV

SEQ ID NO: 113843 - protein, 72 aa, Triticum aestivum
  Clone ID: PAT_TA_8261.pep
GLCARRSIRRCSGSSRHTVTAFCHVNIQSSCTIFHIGEKVWSLPNFWHVFHAPCIDGWLIKHGSCPLCRRKL

SEQ ID NO: 113844 - protein, 136 aa, Triticum aestivum
  Clone ID: PAT_TA_8262.pep
LSQTCVSVSLAAMKMSGLTSSIHEYLSVHCKDYGNTEDADVSQDCSQVNHNRKFTARSNSQTAATAIPAPKSSRTSLCMEDEPCKINATAKENFEGSESVTYVLVFDEVSSIHGSWSVAPIHQKRADNPTVREEVQ

SEQ ID NO: 113845 - protein, 61 aa, Triticum aestivum
  Clone ID: PAT_TA_8263.pep
LVERFVWLIPLTNKFDGKMSAFPGQAGDGSVDVEVCLAPDTMGRLLCDDEFLQFVSHAPSP

SEQ ID NO: 113846 - protein, 174 aa, Triticum aestivum
  Clone ID: PAT_TA_8264.pep
SLGAGAGRRAPHLILPPLLHVGDVIRVPVLVSRKVYPYPQGPTIVELLFFLVLIRSTRNRLRRLALAVPAGWSPAPCPTARRRAPHPLASFSGPPCPDPAPWPPRRREIDPRDRFTGDKREELTFSSTLRDLLPPPTRTDREAIFRRAPRRSPSMNGRRRGDLLPRGRASCRIP

SEQ ID NO: 113847 - protein, 207 aa, Triticum aestivum
  Clone ID: PAT_TA_8265.pep
IQNWEAPFFFPKVCIGLTIFQEIGLGKDTLKLEAAKDVLKGAPGSKKPGNDKSPGKDGDAPPQKPEIPDNEFEKRIRPEVIPPSELGVTFDDIGALADIKESLQELVMLPLRRPDLFKGGGLLKPCRGILLFGPPGTGKTMLAKAIANDAGASFINVSMSTITSKWFGEDEKNVRALFSLAAKVAPTIIFVDEVDSMLGQRARCGEH

SEQ ID NO: 113848 - protein, 100 aa, Triticum aestivum
  Clone ID: PAT_TA_8266.pep
KIRSEINPTTITRTTSTTYSSNLRLQITTTSRGAAYNPQLQAPTQLTRAGAEGKLPNYEEDGLEHPFHRSTNNNTTSPTTATGNHEQKHAKSESTYRNFT

SEQ ID NO: 113849 - protein, 336 aa, Triticum aestivum
  Clone ID: PAT_TA_8267.pep
MSFFFRAASRPRSSQQDLVRSIKDSLLALDTKTGAKALEDVEKNIFTLRQTLSGDGEVEPNQDHVLQIALEICKEGVLSLFVQNLPSLGWEGRKDLAHCWCILLRQKVDESHCCVQYIENHVDLLDFLVVCYKNLEVALFSGFMLRVGLLCPSLPKYILESNSFELFFQYVELPNFDIASDALNTFKDLLTRHEDAVSEFLISHYEQFFELYKRLLTSDNYVTGGQSVKFLSEFLLEAPNAQIMKRYILEVRYLNIMMGLLKDSSKNIRICSFHIFKVFVANPNKPRDIIQVLVDNHKELLKLLHALPASKGEDEQLDEERDLIIKEIEKLVLLSV

SEQ ID NO: 113850 - protein, 130 aa, Triticum aestivum
  Clone ID: PAT_TA_8268.pep
MALAAAASSVGVASVALLLLLIANASASDASLEARRALPGREIHLEPIVYPENAQSTVGSSPWRRSAEETPPSPANNSLVLAAKRTRRNDPSANNTMYGGGWNISEMHYWASVGYTGVPFFFLALVWFVG

SEQ ID NO: 113851 - protein, 157 aa, Triticum aestivum
  Clone ID: PAT_TA_8269.pep
CVADQTILFIRPFPVFQNCSIRSTVYEMRGMNESGRWIDRAGDDLCTPMSIVSHTYEVHSSDMYIAMPSWIDRLMCTLPWHRGALAPRRCLGRTVRAGLWGADRRRRGGPRGGAPWGRGVAAPVGALPRRAGRGRPAPPGLARRVERALLLLAVGVA

SEQ ID NO: 113852 - protein, 114 aa, Triticum aestivum
  unsure (1)..(114): unsure at all Xaa locations
  Clone ID: PAT_TA_8270.pep
RRPTVHPRHRVILAVDPSPTRPDRDLGRRRVAPLTLPRPRLRPNLPTRNPRRRRPRRPASPAPPRRRPGCSTWTRTPLPLSSLDRMGVEIDHLNPATNMRTARAVLPDGXXLNI

SEQ ID NO: 113853 - protein, 72 aa, Triticum aestivum
  Clone ID: PAT_TA_8271.pep
SLPSNNNAQTLGDQRGNSLSTSHHSRRSQAAHLGQDRPDQLSLRGWTPRTLALDRFMTPSPPADAALREGLG

SEQ ID NO: 113854 - protein, 240 aa, Triticum aestivum
  Clone ID: PAT_TA_8272.pep
MAEVVQVHKDWVGSFPSGKKITVVFVIGGPGSGKGTQCAKIVSQFGFTHLSAGDLLREEVKSDTEQGATIKNLMHEGKLVPSEIIVRLLLKAMLASGNDKFLIDGFPRNEENREAYEKIIKIEPEFALLIDCSREEMERRILHRNQGRDDDNMETIRRRFEVFQQSTLPVIQHYEKMGKLRRVDGDRQPDMVFEDVKAIFAQLNTQANQGSNVSRAQTNPFKSWFLDIFCSCFDVADRRN

SEQ ID NO: 113855 - protein, 159 aa, Triticum aestivum
  Clone ID: PAT_TA_8273.pep
HEGTEERDNKVSEFEVWQGLANLYASLSYCRDAEICLQPTRPLKTYSATTLHAEGDMHGVREQTQHALAAYLNALSTEVDHVPSKVSIGALLSKQGPKYLPVARSFLSDALRLEPTNRMAWFYLGQVHKHDGRLAEAADCFQAASMLEESDPVESLRPL

SEQ ID NO: 113856 - protein, 76 aa, Triticum aestivum
  Clone ID: PAT_TA_8274.pep
TGGEVRPEALCAVRTRVAEMGISLDVAKGAPGWPPVKKTRAPATSTADQDRPRSSLGSLLWSHLGKLSNNFGLIRS

SEQ ID NO: 113857 - protein, 189 aa, Triticum aestivum
  Clone ID: PAT_TA_8275.pep
SSTNHACLFVCRPVFELQEDKLAEPHAGGTKQTRREGREGAADGSWQDGGHQYPRTTSHTPSYSSSFLSAPPHCTSTHRRTEDPAGGRPVELAGSGAVAVVITGVPMNCLTLTPTTASHTAELHIHGRQTGRTIPATVATVYLLAHRRRPRRRDPAHIGPAMGGSWRWRKMALHRIPSIRPARRHGERR

SEQ ID NO: 113858 - protein, 360 aa, Triticum aestivum
  unsure (1)..(360): unsure at all Xaa locations
  Clone ID: PAT_TA_8276.pep
SPLPSAVLYHPLPPPRLSDAMSHRPGDSRRPXRPARAANSAPSSSPATATRRGMASLPPRLLVGRSSVTVGTLVTTVVADAADLGETLIGLXGILWVHLGTADMIGVFLFSAXSKDRXAVVYQLYPFSFISLTIXFGFGAXASASPGFNLVLVPFTLYXYIGAFGALEKMRAEVVXGNSVAFIKLRDWPTTLAILGVAASFAGKAYGQVGQGLPVAASXGLGIVMGLNLLEVVELQLPSFFSDYDPRAAAANLPSSVQAYLAGLTFALAASPCSTPVLATLPGYVATSRDPIVGGSLLLTYTTGYVAPLLIAASFAGALQSLLSFRRYSTWINPISGAFLLGGGVYTLLDKLFPATSMVM

SEQ ID NO: 113859 - protein, 276 aa, Triticum aestivum
  unsure (1)..(276): unsure at all Xaa locations
  Clone ID: PAT_TA_8277.pep
MAPDSNGSGYIGVEEVLMGSLLQGGIGGSIDDDLFVRAVDDRAVLPPPEAMRDEGTLRREWRRQNRLRLHEEERXERERRAEIIAEAEEFKKSFLERRKLNCQRRRTHNRDKEKVFMANQEKFHKEADQQYWRAIAELVPHEIPGLEKRGAAARKKELEKKPNIVVVQGPKPGKPTDLSRMRQALARLKQNPPPHMVPTPPPAAKEENKDGDKDAKKDGGKGPKQAEEKKDGKRAAGEGEKKAAAGVGGKAATGGGNAAAAAPPADKAPKQPATKK

SEQ ID NO: 113860 - protein, 185 aa, Triticum aestivum
  Clone ID: PAT_TA_8278.pep
MKSLKQGQFLSILTQAARHHAAQLSFFRKGLKYLEALEPHVKAVAEKQHIDYHSNPSESLLKELQVVEDMKDHCDQKREEYETMRSAYKDKGRSRHPKTETFSPEQLQASYLEYQEDATLFIFRLKSLKQGQFLSILTQAARHHAAQLSFFRKGLKYLEALEPHVKAVAEKQHIDYHFSGLDDDT

SEQ ID NO: 113861 - protein, 176 aa, Triticum aestivum
  Clone ID: PAT_TA_8279.pep
MASSALGSSKAFSVSPIFGSSPITTAPSSFGMPNNGSAMSISPSSAVFSFTSATPTIPDPPSSTPLFGSTIPTIGFSTGTGQMTVGNNQTLSVTAPPFGFQSNSLSTPAFSGFQSNSLSTPAFSTPATQFASTSTTSPGIFQFGQQSQASSGVFSMGTVRDNDKSGRRIVKVKRKK

SEQ ID NO: 113862 - protein, 239 aa, Triticum aestivum
  unsure (1)..(239): unsure at all Xaa locations
  Clone ID: PAT_TA_8280.pep
GFFAIETVLXALFAENSPPFTTAMIILASVISSTVSNVLLGEKAAFIVPXLPLYLILGMLCGVVSVVFRQLVVWFTKTFDLIRKKFGLPAVVCPALGGLGAGLIALRYPGILYWGFTNVDEILHTGKSASAPGIWLLAQLAAAKVVATALCKGSGLVGGLYAPSLMIGAAVGAVFGGSAAELINSAIPGNTAVAHPQAYALVGMAATLASVCSVPLTSGLLLFELPKDYRILLPLLGAV

SEQ ID NO: 113863 - protein, 170 aa, Triticum aestivum
  Clone ID: PAT_TA_8281.pep
SPWLLACNSDRLDVSIAPEDAARRRRVPGDARAHPAGSGSSGGGLAGGRVRGPGHPRRGHLLGRKASPEMGHAPRRLVSALYVKPPWVPVEVRIGQKWRRANVLRQADRRGLCLVSIRGPAPESDPIMVPLSTIRIPSDPPVARKRPDTRPNFRVKKPRDTGDATEGSSD

SEQ ID NO: 113864 - protein, 123 aa, Triticum aestivum
  Clone ID: PAT_TA_8282.pep
MQTRQKFARVDTQELKSRIAKKLGHQRAEQYFNSLKKFLSFKLNKDEFDKICLSVLGKENIKLHNFLIRSILSNASLSLGPPSKQTVTGNSQTSMVSNGPLGNGALPAKMGRSITSRDRKFAD

SEQ ID NO: 113865 - protein, 377 aa, Triticum aestivum
  Clone ID: PAT_TA_8283.pep
RHEAQTLRRTERRCRSVGGVDDYTEQDSPQATGHHGCPEDVSSSSPTLPVIASIASEKKKQRRDREQQPAASLPDDIIIEILSRVHYKSLCRFKCVSKQWLDLCSGLDTHKRSPQALSGLYFLDEEHQGLSFHGLTGGGPRLVDPDLSFLRKSYESLEVTQCSSSLLLCMCWKNSYSPRGECDYVVCNPATEKWTLLPLIECMDQADVERYLGFDAVKPSSFVVVAPLTDIYQLIRKVAIYSSGTERWTYVESGWASDTMVGDQDAIFLNGIVHLTTCGSSIVTVDIEGKIWREIRVPHFDAIGLSQGCLHAWRVDVLNGCQLSLWVLQDYDSENWTLKHTVNVLELFGSHCRKDHESYMVLAIHPNCNPFSLPMGR

SEQ ID NO: 113866 - protein, 197 aa, Triticum aestivum
  Clone ID: PAT_TA_8284.pep
GNPIHITKFKQVDVVRNRPEEGNKLLSDVPLLGANNLAHSNIVSKVERANEKLDVPSKPPAVPNKDLKNGFPLKLEPLDGLIPFEQKMMDLSHQKHKDAAYDDSGSVSKLMFMGDIEATPSLQLQNGSKNRRRKQSNSPRTTPRATDSPAMGTRRRLGDATVKGEIKLEQTTPIAMDKQDPDYVPERRPAGRPKKAK

SEQ ID NO: 113867 - protein, 132 aa, Triticum aestivum
  Clone ID: PAT_TA_8285.pep
RQPWSPPIPDPAVHAAVSAHPKSPDFVVFATGGWASTLSSSSPIGAWHLGEPLGFVDLPDMSRGERGVVSFGREEGEQSTAPGRRARRRYVMPVVQEQHKHLVMELTSTAADNVSKMSLCRHLRVDWLPRAE

SEQ ID NO: 113868 - protein, 235 aa, Triticum aestivum
  Clone ID: PAT_TA_8286.pep
GTRLGSVTVPVASHAPGGPVWYTLDSSSGQVCLHIKAIKVHETSSRALNNTAEADARRRISLDKQGPTVVHQKPGHLQTIFGLPPDEVVEHSYSCALERSFLYHGRMYLSSWHICFHSNVFSKQIKVMLPLRDIDEIRRSQHAVINPAITIFLRTGAGGHGVPPLGCPDGRVRYKFASFWNRNHTFRALQRAVKNFHAMIEAEKQERAQSALRALSSSRENHKVPTKYITLIKDM

SEQ ID NO: 113869 - protein, 153 aa, Triticum aestivum
  unsure (1)..(153): unsure at all Xaa locations
  Clone ID: PAT_TA_8287.pep
HVLKLEVNCLVILLRHLDPTNGLCNGTMLVVCGXENFINVKIVLGQHPGKRGFLPRIPLCQSDDEILPIGFKRKQFPIRLCFVMTXINKAHGXTIPNVGVYLPDPFXSHGQLYVALSRATSKNSXKVLVVPLKDDSYSXGTFTKNIVYKDVLT

SEQ ID NO: 113870 - protein, 127 aa, Triticum aestivum
  unsure (1)..(127): unsure at all Xaa locations
  Clone ID: PAT_TA_8288.pep
FGTRPPPPFLPQSPPLLLLLPXSPPSPPPSPLLVGAPPPLHLVLPSSHSATSTPLNPAAPRTIDEARRAVPSDPPTRSPRPPDQAPYASSPVPGHAGRHRIIAQNASSADGLHTIWLSCFVLKIQSS

SEQ ID NO: 113871 - protein, 71 aa, Triticum aestivum
  Clone ID: PAT_TA_8289.pep
IQNAETLCFADKKSSSRIYMNPIPHYSKLASTNHTKCTHIITIQESISLDENCDIHDPSILHLPHLYSYQE

SEQ ID NO: 113872 - protein, 119 aa, Triticum aestivum
  Clone ID: PAT_TA_8290.pep
MDLKTSHNSPVFVDPLPSLALPMTYTTPTSFPSSGLYLNTPKKKPLPSKIEEVRAAGWLDLMLASSPPRKRQSKDFLPHDVQADDLDLRYRNWMVNYPSALGSFEAITELARGKKLALF

SEQ ID NO: 113873 - protein, 58 aa, Triticum aestivum
  Clone ID: PAT_TA_8291.pep
IYLEYVHPGSVNKCISQHCGAMTESVVHNFTCHILKGLDFLQSQKIMHRSGNKFKGKI

SEQ ID NO: 113874 - protein, 241 aa, Triticum aestivum
  Clone ID: PAT_TA_8292.pep
MKTPDSYSEWVRSKSSITQVIPGGWKATTWSMPIPVGSFTDWQLDCRVEANDVSMDTSNPHQCNLLSRLSGSNTVPILPKLLMAYPTISIDDDIVYFIYTTKPRHMGKLELVIAVDVRNKALRGVAELDAQKKFISVPAFCTCKICKYPRKNTGTAVELKRTEKEAVKRTDKDLGTGKPTRVHVKEPTRTRPPVNKRVLKTLELLQARSWSCPRRLGEQTPDAEIAIKYSLRSKIDDLTLY

SEQ ID NO: 113875 - protein, 193 aa, Triticum aestivum
  unsure (1)..(193): unsure at all Xaa locations
  Clone ID: PAT_TA_8293.pep
MAAMWSPIIALLLLLLPLVPSSSSAITLPLHGNVYPVGHYYVTLQIGKPLKHYFLDIHTGSNLTWLECQHPHLGCQHCTQGHKHSYYSPKLSNLKVGCQHMYCVALRKDLPGINPQCPIKEPHQCHYKIRYLDGTTEGVLSLDKISVGGKENNIALGCGYNQHPRKPSPVHGILALGMGTVGFVPQLKLQXXX

SEQ ID NO: 113876 - protein, 100 aa, Triticum aestivum
  Clone ID: PAT_TA_8294.pep
ERASLSMKNMIQGVFCIFHGGGTVHQAVHHITSIRTQSSGPAVQDASEHCITRKTVSPDMFSSLASPAWRYISPRLLCTASNFMGYFIIVSGMMSLMSLI

SEQ ID NO: 113877 - protein, 79 aa, Triticum aestivum
  unsure (1)..(79): unsure at all Xaa locations
  Clone ID: PAT_TA_8295.pep
RDKTWXGHVFSRTLSCKXGKKLEPGKPNVCKIVLDNPAAIAIDYWRHLTEDKRSSCLLATHNLDPTELCTCSRMNPRAE

SEQ ID NO: 113878 - protein, 157 aa, Triticum aestivum
  Clone ID: PAT_TA_8296.pep
RGTICVLCHCPNRCFMYVAMYDYIMDILRNMDPEAFHYVISGLRYPEDWHIQCQHNTYLAFYYRRGGYDPDATLIPETTDPRIVPLRFHRNGPSHALEDAADPIADHGMRLTRRDLGHVLYFQFTHLMISMETSLHFLGALSHLDVQDLFPFHVRKN

SEQ ID NO: 113879 - protein, 185 aa, Triticum aestivum
  Clone ID: PAT_TA_8297.pep
PAPPVGRSLPASRSCPSYEGVARRTPEPLWAPGPSPVQSPGGCPATPPGPPPPGGSLPGIPPRHRPHHGGWRQSEKNPYPTHLRTRSTKREDHPWADCRVVCGIRKTLCGKKKNHEVIRESGYSRSRQGLGPWRPVLVVVTGVGRAVRGKSFSLLAPFGLPRWGGLPFLLSPTGGEAFFFSSSPW

SEQ ID NO: 113880 - protein, 146 aa, Triticum aestivum
  Clone ID: PAT_TA_8298.pep
KKNLNNQCYIFENLVKTDPVYTLLLNYAYYILRVTWMCRRTWRPRLCPKTPWMAGGRDARRKKLSSLYRQSFLSESRAIACPHPTSKTYRTKQGKIKIGGARTERERVGPWLVTRSAPRRPDDKSPTAAPPGMPGAQAHTLLYGRG

SEQ ID NO: 113881 - protein, 109 aa, Triticum aestivum
  Clone ID: PAT_TA_8299.pep
MAFACACHVRRLLLLHPGAGAPARSFYAQPYQAKVGVVEFLNGVGKGVETHAAKLEEAVGGDLQRLLETRTLRLKKLGVPCKHRKLILSFAHKYRLGLWKPPAEARKVQ

SEQ ID NO: 113882 - protein, 109 aa, Triticum aestivum
  unsure (1)..(109): unsure at all Xaa locations
  Clone ID: PAT_TA_8300.pep
MAALACASNVRRLLLHPGAGAPARSFYSQPYQAKVGVVEFLNGVGKGVETHAAKLEEAVGGDLXRLLETRTLRLKKLGVPCKHRKLILSFAHKYRLGLWKPRAEARKVQ

SEQ ID NO: 113883 - protein, 207 aa, Triticum aestivum
  unsure (1)..(207): unsure at all Xaa locations
  Clone ID: PAT_TA_8301.pep
RRSYDTPPPVSRPRGRRRSLFHHGSPPPATTAPLLPRRHPPLRGGAKDGGSLRGVEPPRGRRRPACGAAPGPACRSPRAGAPGPLALARASHVRRLLLHPGAGSPARSFYGQEXRPKVGVVECLNGDRMGVGTLAANFVMSVRCGLRRLVATETLGIMKLGVAYKERNLYFDFCSQVQPWSLEAPNRSKGWAIKVGLFLKCLLRKTI

SEQ ID NO: 113884 - protein, 102 aa, Triticum aestivum
  Clone ID: PAT_TA_8302.pep
GSLLLSRSCDVRCYFLLRPCNSKSCVHKKDFVPQDWSNIDTISILPLPPAAANEIPLRNFICTCSTEAVPSYDDMLPILPGTCSIYFIWVCLLKKKKKKKKK

SEQ ID NO: 113885 - protein, 106 aa, Triticum aestivum
  Clone ID: PAT_TA_8303.pep
AETEPAEVPEDPSITLARKISSQTRQNRRVKAKAAKEDNLKKRLPAGGPGGGDGRGSRCACGGCCQMSTPTVQTASVWLRRSFLYIRCICFLIKIHNVRCVCSNFS

SEQ ID NO: 113886 - protein, 144 aa, Triticum aestivum
  Clone ID: PAT_TA_8304.pep
MRASMEASAAAARRSAAPDPPGAAKKQRLLAPPRDPAPAAAAVRGRAASRSGAAPAPAGQQAQVDELVAQYRTALGELTFNSKPIITNLTIIAGENLHAARSIAALVCANILEVPRLLLPPPLPPPVSMVRKLGSVAVPLVAAR

SEQ ID NO: 113887 - protein, 230 aa, Triticum aestivum
  unsure (1)..(230): unsure at all Xaa locations
  Clone ID: PAT_TA_8305.pep
MAAEPEICVLSNGRITANIASWGATITSLLVPDAQGDLADVVLGFDTLEPYLKGMAPYFGCIVGXVANRIKXGKFDLNGVEYSLPINNVPNXLHGGLKGVDKGVGEGVKRKXGEYPSITFQYESKDGEXEGYPGDVTRQNDVFSFRRRTTLRLDMEAIPANKATPISLAQHTYWNLAGHNSGXXLDHXSIQIWAXHITPVNENTIPTGEILPVQDTPFXDFTTEHKIGDR

SEQ ID NO: 113888 - protein, 335 aa, Triticum aestivum
  Clone ID: PAT_TA_8306.pep
MAAEPEICVLSNGRITANIASWGATITSLLVPDAQGDLADVVLGFDTLEPYLKGMAPYFGCIVGRVANRIKNGKFDLNGVEYSLPINNGPNSLHGGLKGFDKVVWDVVERKDGEYPSITFQYESKDGEEGYPGDVTVRATYSLPEATTLRLDMEAIPANKATPISLAQHTYWNLAGHNSGSILDHSIQIWAKHVTPVNENTIPTGEIMPVQDTPFDFTTEHKIGDRISDVPGGYDHNYVLDSGDEKNGLKHAAKLKDPSSSRTLDLWTDAPGMQFYTANYVNGITGKGGAVYGKHAGVCLETQGFPNAINQPNFPSVVVQPGAKYKHAMLFEFSA

SEQ ID NO: 113889 - protein, 234 aa, Triticum aestivum
  Clone ID: PAT_TA_8307.pep
MAAANGGGAALFSEEELRDVSGLRLREGFVEMMCGCTSRRYGDAVGRLLIYPSGELEISCDCTPGCREEKLTPSAFEKHSGRETAGKWRNTVWVMIDGEKVPLGKTEFLKYYNLSNKSVNGSNRSRNGRPLHRDEFIRCTRCDKERRFRLRTKEECRIYHDALAKPNRTCANLTADSVTCDDDEERGSRKVLKGCSRAASCAGCEKCVCFGCEMCRFTDCGCQTCVDFYRNSKE

SEQ ID NO: 113890 - protein, 217 aa, Triticum aestivum
  Clone ID: PAT_TA_8308.pep
YLFLFPAHHTRSRRRRPLTCRPICSRRRLSHQRWRLPQPPSSMWCSPHVPSRRCLLKIGQEKREADPPRPRAGQAAAMARPDPPAPSSSSTSAPSVGSTSGSIYTTTHSQAAAMEGSLCACFFPSQDAVAPTPWIMCRTEPPYGVRGDSFSTLMPSALRVRWTRFFFRSVMAYGKPPVLSLAPLLDGASALGPCWFLVAAPMLIILLRLGVVKRSRN

SEQ ID NO: 113891 - protein, 116 aa, Triticum aestivum
  Clone ID: PAT_TA_8309.pep
YCRLLPYPAGFSGWELRRRRRRPIQANPLPAMEFLLQLISTPRRSPLVEEVYGSHLSMDLLDNRRRRLSGKWKSRHRHPLGQTCGTIRNRRAWMDDGRARPSCLQNGCTLVVKEVR

SEQ ID NO: 113892 - protein, 180 aa, Triticum aestivum
  Clone ID: PAT_TA_8310.pep
YCRLLPYPAGFSGWELRRRRRRPIQANPLPAMEFLLQLISTPRRSPLVEEVYGSHLSMDLLDNRRRRLSGKWKSRHRHPLGQTCGTIRNRRAWMDDGRARPSCLQNGCTLVVKEKINTKRSPNAAKLFGDFFWTRKHLLGQRSIRGGAPRGAQPTRGAWAQARPGGLSHFDGLPHRLFAL

SEQ ID NO: 113893 - protein, 71 aa, Triticum aestivum
  Clone ID: PAT_TA_8311.pep
VCWGGSMDQDRFCFPLQYSILTCPTLFKAVPGCPPLMMPRTDKSQSEVLLAHMHHGADGSLSWHGLGQSMP

SEQ ID NO: 113894 - protein, 104 aa, Triticum aestivum
  Clone ID: PAT_TA_8312.pep
FFFIDERSERVVSYSWLAHGINVRTFEQNKRYTRRHASTAATVDLAAAARVRVGHRRRPDVGVGGVGAIPAHESTVADDAAGRLGPSPVGLLGRQHEACQHQGH

SEQ ID NO: 113895 - protein, 196 aa, Triticum aestivum
  Clone ID: PAT_TA_8313.pep
MLRQSSSRNHRSKGLKLKKALQISLLVLVSVWLLYQVKHSYEKKTAYNENDATSHEAGDEHKDGQSQVGVIKLGRKDLPAKEADSSTLDERVEDEENEEMEQVMKRDEHDDDPIDEPDLDKDEDLPEPGEHSANKDEGSDGRAVFEDEERKERSQEDQEKSFHDDDVSSAVTHDPPSSAARCADPSMPKRRSYSWD

SEQ ID NO: 113896 - protein, 223 aa, Triticum aestivum
  Clone ID: PAT_TA_8314.pep
MACSKTIACLFTMLLLAPAIMAADPDPLQDFCVADLDDNAVRVNGYPCIPQSEAGDDFLFSSKLAKAGNTSTPNGSTVTELDVAEWPGTNTLGVSMNRVDFALGGTNPPHIHPRATEIGIVMKGELLVGILGSLESGNKLYSRVVRAGETFLIPRGLMHFQFNVGKTEASMVVSFNSQNPGIVFVPLMLFGSNPPIPTPVLTKALRVEAGVVELLKSKFAAGF

SEQ ID NO: 113897 - protein, 134 aa, Triticum aestivum
  Clone ID: PAT_TA_8315.pep
GDLASVMRSLEEEICADDLTPPQPELGFLLEASDDELGLPPAARASSSSDDAGGWEPEEPAGVFGEQIWGFEDEIDGTYAFGGVAYSPEAAAATAAATAEWGDDGFDAGLFGFGDESLGPSDVDVLRQETMPAV

SEQ ID NO: 113898 - protein, 224 aa, Triticum aestivum
  Clone ID: PAT_TA_8316.pep
MGCSKTLVAGLFAMLFLALTVLATDPDPLQDFCVADLDGKAVSLNGHTCKPMSEAGDDFLFSSKLAKAGNTSTPNGSAVTELDVAEWPGTNTLGVSMNRVDFAPGGTNPPHIHPRATEIGIVMKGELLVGILGSLDSGNKLYSRVVRAGETFLIPRGLMHFQFNVGKTEASMVVSFNSQNPGIVFVPLTLFGSNPPIPTPVLTKALRIEAGVVELLKSKFAGGS

SEQ ID NO: 113899 - protein, 224 aa, Triticum aestivum
  Clone ID: PAT_TA_8317.pep
MGYSKNLAAGLFAMLFLAPAVLASDPDPLQDFCVADLDGRAVSVNGHPCKPMSEAGDDFLFSSKLAKAGNTSTPNGSAVTELDVAEWPGTNTLGVSMNRVDFAPGGTNPPHVHPRGTEIGMVMKGELLVGILGSLDSGNKLYSRVVRAGETFLIPRGLMHFQFNVGKTEAYMVVSFNSQNPGIVFVPLTLFGSNPPIPTPVLTKALRIEAGVVELLKSKFAGGS

SEQ ID NO: 113900 - protein, 268 aa, Triticum aestivum
  unsure (1)..(268): unsure at all Xaa locations
  Clone ID: PAT_TA_8318.pep
AATTSASNTLHQQTLSEPLLAKLAAFNSLPNKQRGAPKPFPMLLLAPAVLASXPDPPHPPPRLQFCVADLDGGAVXVRHTSTPKPGAGPPHLLPQLARRPRNTSPPDRPAVTGARRGTGRPGTNTRGVSMHRGRGLRAAEATNPPXHIHPRADHRDPGTVRGMVMKGEGRSSGSLDSGNPSSTPVVGALLRETFLIPRPGXMHFHVQRSVRAEASMVVSFNSQNPGIVFVPLTLFPLQPPPIPTPVAHPRHSRVDGRGFDGSFSQGPS

SEQ ID NO: 113901 - protein, 62 aa, Triticum aestivum
  Clone ID: PAT_TA_8319.pep
YQNVFNSLWILPVLTKVIIAEKLIWLLIAYPNFLLFRIHSELWDSTIPDSILLHIVNDMSMV

SEQ ID NO: 113902 - protein, 81 aa, Triticum aestivum
  unsure (1)..(81): unsure at all Xaa locations
  Clone ID: PAT_TA_8320.pep
TYLLQSHFHLERLSFLEHGKILAHASNTYLKITHKKRISLPIIALQYMAKLPCNIKKAEGIKPRVVRNVEXNVIMPTRENL

SEQ ID NO: 113903 - protein, 97 aa, Triticum aestivum
  Clone ID: PAT_TA_8321.pep
TISFLNMSYAMDLGSRSSLVCLQWSSGGEVELGVEVNILNARKNSSLCTSSRQIWPPEQTKRTARSPCWRRGMEGWTISSSWTAACTTPATTPATFV

SEQ ID NO: 113904 - protein, 129 aa, Triticum aestivum
  Clone ID: PAT_TA_8322.pep
MVAVKEEMEVPLEVDSGNLIRNNILGEEHDKGLKDAVNAALNPHTPGDSIFDIGGTKLGGNMKNEDEGSFRIFVKGKSRRKQTLRIPISLLNKTYSARSFKLDFNRVVRESDIFKPSGVSSAEVVSSGD

SEQ ID NO: 113905 - protein, 280 aa, Triticum aestivum
  unsure (1)..(280): unsure at all Xaa locations
  Clone ID: PAT_TA_8323.pep
MFRISPSRGRRTAAAAARGWCSCRSSDSPATRVTRWRSTGIVALRDAKLKAVPHEVLQVGNSLRTLDLTNNKIVEVPQEVGTIVNMQRLVLAGNLIENIPANIGYLRNLKILTLDRNXRITGLPEDLGSLSILLNLTNSXNLCIYQXSPLSDSVKKSINTKHTKKLNALPESIGGCKSLEELQANGNTIEDVPSSICNLACLKSVSLNGNKIRQLPPNLLKDCKALQNLSLHSNPISMDQFQQMDGFGEFEARRRKKFDKQIDSNVMMGSTALDEGIDLR

SEQ ID NO: 113906 - protein, 106 aa, Triticum aestivum
  Clone ID: PAT_TA_8324.pep
MSSSDNSITAALSRTTPVFSLRVWVLIAIGIGILMAILFIIVLWLSIRRKNKAVSGFDTTSQTEIPIVSKEINIDKGVDSQSVNDSSEVAFMPVHDKYTQMKTVPP

SEQ ID NO: 113907 - protein, 150 aa, Triticum aestivum
  unsure (1)..(150): unsure at all Xaa locations
  Clone ID: PAT_TA_8325.pep
IVVSPGDDPLLTPSLFSSSRXSSSAPLLRDSAMAATDALLSIATGQPSPPRHRLSTSIDLLDGSVDVTRSTEGGLHHRRSSPSPISHCCAPRIRPWPEPTLHSRPPPTTPARWPRWSIPDPWRSSPRPSPRFPPWLGLLIPGSALLRATL

SEQ ID NO: 113908 - protein, 129 aa, Triticum aestivum
  Clone ID: PAT_TA_8326.pep
VQTFHRLHCACGRQCARRNGSSVARRDKFYLNCVNYNVQGARFCEVYLWEDDLDRYTNQRYQSAVDLANYHKTRHERYEEKLNKVYEELKEAYAEIRKLKRTNKALQMALVATAPVAAIVAITSAWVAK

SEQ ID NO: 113909 - protein, 69 aa, Triticum aestivum
  Clone ID: PAT_TA_8327.pep
SCMDSMSKIHNFSKLIPGCCLQFCTEFACCIVSFSVHLLCFTVYDQTCSLVQQDITIPCIGKWSESKKK

SEQ ID NO: 113910 - protein, 124 aa, Triticum aestivum
  Clone ID: PAT_TA_8328.pep
EEFGRGEYLRETFQIKEGDFLTFDALRQAAQCVGRVIRSKADYGMMIFADKRYSRHDKRSKLPGWILSHLHDAHLNLSTDMALHTAREFLRRMAQPYDKAGSGGKKTLLTEEDLQDMARDAMEM

SEQ ID NO: 113911 - protein, 306 aa, Triticum aestivum
  Clone ID: PAT_TA_8329.pep
MGKSEATPTVTKGEGEELVLTMLEVDPATEDPDLLDAIRKKNSAALTSILDPHDELSAKDSSNAAAAVWYFVMNGHHITGNLNLLTDLTPVCDRWVRSLIGTGPPMQVCARGSVNCNGIKLDDVWYVPGVTVNMVAGAHFSNQEISLTLDRSAFSLKRPDGTVVGKGRVKGNLYEVDFLDISSTTAPWYIVSNAAEHMTGNLHLLSNFTPTQPGRQVRTHTGAMLQVRGKGSLSSTQLSIPSVSYVPGLTENIISVTQLTDSGFSVAFSPHGCTITRNRDGKTVGCAYHAGGQLYLLDYLRVADSK

SEQ ID NO: 113912 - protein, 242 aa, Triticum aestivum
  unsure (1)..(242): unsure at all Xaa locations
  Clone ID: PAT_TA_8330.pep
MCTRGHWRPSEDERLKELVARYGPHNWNAIAEKLQGRSGKSCRLRWFNQLDPRINRSPFSEEEEELLLASHRVHGNRWAVIARLFPGRTDNAVKNHWHVIMARRCRERMRLSSNRRATPAAASTTTGXAEKDDSPRNTAAGEKPRLPEANTMAALLHKYRREFAAPFAISRHSSKEGYCSSTNEDTNRSVEFYDFLQVNVSSSDTKCGSSIEEQEENRDEGDQQAEGQVSLIDFMEVGTSHQ

SEQ ID NO: 113913 - protein, 198 aa, Triticum aestivum
  Clone ID: PAT_TA_8331.pep
RNSDALGSLSDSQANGDRQPPPAEAEDAGAQVEEGDTGEKMEGVASIALLPSGAISGHFIRLPDSACYGLQGTPIPCERECSRGDDYRLIKLSIINFKRKTEKVVVVECRGHDAARLQNIDHLHGWEDDVVGLVQKKHGNKKVLVSFECETLKADKAAEEHISKYMPNLCGLDAVVNTGKMSISGINLDEDDEPSGDS

SEQ ID NO: 113914 - protein, 323 aa, Triticum aestivum
  Clone ID: PAT_TA_8332.pep
MAFIGPRWANDDAYPRTKPEDFTVPPKWIPFPSTTVFLHHEARRMLADNFGENASGRSDTDRLWDVFERCCLTIHRSCRELEPRMFTLLSDLLRKPAVPAGILLPEAVEDRDQDHRQSSSGGVLRWLDDQPPKSVLYVALGSEAPLTLENIHELALGLELAGVHFLWALRKPAGTNNEQELLPAGFEERMQDRRMVCTGWVPQVKVLGHGATAAFLTHCGWGSTIESFAFGLPLVMLPFLTDTPMIARAMAKRGIGVEVARDDSDGSFDRDGLAVAVRRVMVEDEGNLFSGAEPGFGHRGGQAKLKKKYRFLAIEYRHVVVTF

SEQ ID NO: 113915 - protein, 61 aa, Triticum aestivum
  Clone ID: PAT_TA_8333.pep
RIGCTLSGLFIFLTQVHLFYLLDPAVPVVNFTGDSEQTKETNRSRTMHSLWLLVQHDANYL

SEQ ID NO: 113916 - protein, 139 aa, Triticum aestivum
  Clone ID: PAT_TA_8334.pep
QLAKRNTSYTESPTSEGEIIQTPTETRQQTFLYKIYSFGSFLVPLCVNDSGNNIPQTFRMENFTSGELHLLPGYKASNSVRKHPTAPCHQSLATIIQDAFILASCRICTLHTWETQEAAYKYPWSIHSPVHQAHDSLSF

SEQ ID NO: 113917 - protein, 208 aa, Triticum aestivum
  Clone ID: PAT_TA_8335.pep
GISTAGELTRGGEAHEVAGEELDGAVREEQPTDRDSDRRSSCTIRGLLAANPGVAEWTGDTVRVLHHANLRQRFLEVCHYMSRRVLESILRSSPPPSAGRPAGGRSPEAPPPATVSVTLRPFSFSFLPLFPLSLMPCLSLSLDETDAAASKPPHQPRDPSLILRHFSFYAFLSFLSPSHPVSLFNWMSKTSPPPPEQAAAPAGRSAGP

SEQ ID NO: 113918 - protein, 104 aa, Triticum aestivum
  Clone ID: PAT_TA_8336.pep
RPCHRATSAACLPTWHRTHRWPGRVSKRGGAATDGTGLVPAPDKANGHLRSTFDALCPLMPCDKLTHCTPFHLLCATVAAPFSYKRRPEATRRRIPLFGTGQPP

SEQ ID NO: 113919 - protein, 66 aa, Triticum aestivum
  Clone ID: PAT_TA_8337.pep
LRLGAQSEVVKRVWDHIKSNNLEDPSNPTMILCDSKLKDLFGCESVTAPAVSELLSDHLFKQPNKI

SEQ ID NO: 113920 - protein, 75 aa, Triticum aestivum
  Clone ID: PAT_TA_8338.pep
CEAKGRIKKGDRVWQIAFGSGFKCNSAVWKALRAVDAVAVGDAGSPWAQDVDVLPVHVPKVVPIDDDQASYKTAA

SEQ ID NO: 113921 - protein, 82 aa, Triticum aestivum
  Clone ID: PAT_TA_8339.pep
SPDITEGHPTKKEITHRTMSNTATPAGNQTCQRRRRPLHLPNLGTKMIPYGREVVEPRTPESLHPSPSQQHRRSSTSATSIS

SEQ ID NO: 113922 - protein, 307 aa, Triticum aestivum
  unsure (1)..(307): unsure at all Xaa locations
  Clone ID: PAT_TA_8340.pep
MDLDLWISKVKEGQHLAEHELQTLCEYVKEILIEESNVQPVNSPVTVCGDIHGQFHDLMKLFRHRXGHVPDXPNYIFMGDFXSTGGFNSLEVFTILLLLKARYPAHITLLRGNHESRQLTQVYGIYDDCQRKYGNANACGYCTDVFDYLTLSAIINGTVLCVHGVLSPDVGTVDXIRTIDPSCEIPHEGXPFCDLMWSNLEEIETWAVIPRGAGWLFGSRVTTEFNHVNNLDLVCRAHQLVQEGLKYMFQDKGLVTVWSAPNYCYRCGNVASILSFDENMDRDVKFFTETEENNQMRGPRTAVPYFL

SEQ ID NO: 113923 - protein, 148 aa, Triticum aestivum
  Clone ID: PAT_TA_8341.pep
SLGCLSRPASRYAVNEITVVFTTSTEKSSLRAPDAIARGKAWGAWMHRSTILQGNQRDNLKHQQRHDAPASQPGPQTDPNQDGSISKPLAISEASPMCSLSGQLRRQLLRRACIVIKVKHNGVQDQHQFIRQDQARCVHTNTKDRHST

SEQ ID NO: 113924 - protein, 143 aa, Triticum aestivum
  Clone ID: PAT_TA_8342.pep
KNLSSQDLKLPGSSPCSPSPFTKRPVELGLCLLLGEAADRGEEEQYQQAYAGEQRRRRARGRGHRLLLLVPGGGEASGRRGRAEVGGRGEPATVKAKRKGRPSATGEILSITGSSRTSPRIEAGCLASSRSPPAPDHSQASPR

SEQ ID NO: 113925 - protein, 491 aa, Triticum aestivum
  unsure (1)..(491): unsure at all Xaa locations
  Clone ID: PAT_TA_8343.pep
MASGGGAVREVGSRAELDAAVGGARAAAVHFWAAWCEASKQMDEVFAHLAVDFPHALFLRVEAEEQPEISEAYGVTAVPYFVLCKEGKPVDTLEGANPASLANKVAKLAGPANVAQSAAPASLGVAAGPAVLEKVQEMARQNGSSAAESTLKKRLEQLVNSHPVILFMKGNPEEPRCGFSRRVVDILKQGMXVEFGSFDILTDNEVREGLKKFSNWPTFPQLYCKGELLGGCDIVIAMHESGELKDVLKEHNIPLTQQGSKIEEPVMSESANEQSPEAIGLTEAQKARLESLTNSNPVMIFIKGSPEEPKCGFSGKVVHILKQEKIPFSSFDILSDDEVRQGLKVLSNWPSYPQVYIKGELVGGSDIVMEMHKSGELKKVLTEKGIIRKESLHDRLISSSPVMLXFMYGKPETPRCPRCGLSANALSAVRVAGISFGSFDILSDEEVRQGLKTYSNWPTFPQLYYKSELMGGCDIVLELEKSGELKSTLSE

SEQ ID NO: 113926 - protein, 215 aa, Triticum aestivum
  Clone ID: PAT_TA_8344.pep
MAYRMVCAPQVIDLESERGHPHVHSESLIHNGNDLSDQGGQYTVRVVGNAMNAGLSDTQGYYNMSMNHPHQPVHSSLPNLGVDSGFGFPSNMYNPCMSTSMNRFVSHAQSFGLPLNQVVSGSMDGSTRNENVSETARGFIKRKNAAVAGSCHFVNGSASSSSSSHTSQNPTHRPWDPSFESNVFPNVTPFNPSEYHSHSTWPSVEGSSITGSNGF

SEQ ID NO: 113927 - protein, 199 aa, Triticum aestivum
  Clone ID: PAT_TA_8345.pep
MAMEKNQDSKVIMGRYKLGRLLGRGSFAKVYKAHNISTGEFVAIKVFDKEAVHRSGTVEQVKREVDVMRRVHHPNVVRLHEVMATRSRIYFVMEYASGGELFDRLAKSTRFPEPVARRYFQQLVTAVEFCHSRGVYHRDLKPENLLLDAHGNLKVSDFGLSALADGASRHRGDALLHTTCGTPAYVAPEVILKRGYDGA

SEQ ID NO: 113928 - protein, 222 aa, Triticum aestivum
  unsure (1)..(222): unsure at all Xaa locations
  Clone ID: PAT_TA_8346.pep
MLRTLRHRSITSIPVRTISSSVTRPEASYYESPFKGESKTTQIPNFSKYKSATGTNSNLVFQYFMVGTMGALTAAGAKATXQDFLVNMSASADVLAMAKVEVDLAAIPQGKNMLIKWRGKPVFIRHRTQAEIDEANSVDWEKLRDPQKDEDRTKNPEWLVMLGVCTHLGCVPIGEAGEYGGWFCPCHGSHYDISGRIRKGPAPYNLEIPSYDFPEENSLIIG

SEQ ID NO: 113929 - protein, 134 aa, Triticum aestivum
  unsure (1)..(134): unsure at all Xaa locations
  Clone ID: PAT_TA_8347.pep
APRPRLRPRRRPPRRRLPGLLPAPRPLWRTAFVAATTXVSMMLPFFNDVGAPVLLPFGVPAVALPGALGLCPRPRRGPLGMYIVQKKIPRWSSQWVCLQLLSLACLIITIAAAAGSIAGIMSDLKVYKPFSTTD

SEQ ID NO: 113930 - protein, 165 aa, Triticum aestivum
  Clone ID: PAT_TA_8348.pep
ILAELSALVDLELTFDRALEETIAIYGTAFAILKRFRVNCKNMAHLTFQVGAMPKLQCISLGLNALGWKQENYATPTGIENLFALERISVTIGCLDATESEQRSVESAIRSAINMHPGHAHITTNIAREPYRFCFGEFTSCPCSHYNPWYQGTTNTGTCHIRTFS

SEQ ID NO: 113931 - protein, 61 aa, Triticum aestivum
  Clone ID: PAT_TA_8349.pep
KCQYVSSHMMPPSNNEPGANFCLRLPCVVTVMELHLLDSPQFCFFPPAKMREIWRPRENAG

SEQ ID NO: 113932 - protein, 606 aa, Triticum aestivum
  unsure (1)..(606): unsure at all Xaa locations
  Clone ID: PAT_TA_8350.pep
GSRVLCENYGLVTYRESALLYDEQLSSASNKQQVAITVAHELAHQWFGNLVTIXWWTHVWLNEGFASWVSYLAVESIFPEWNNWTQFLDETTSGLRLDALAESHPIEVDVNHASEIDAIFDSISYDKGASVIRMLQSYLGAERFQKALASYIKKYAYSNAKTEDLWAVLEEETGEPVKDLMTTWTKQQGYPVIYAKLNGQDLELEQAQFLSDGSSGPGMWIVPMTACCGSYDLNKKFLLKGKTDTMHIKDFAATQSGQNFWIKLNIDQTGFYRVKYDDELAAGLENAIKAKKLSLMDMIGIVEDSYALSVACKQTLTSLLRLLNAYRHESDYTILSHVTSVCLSVNRISTDANPDLSSDIKQLLIKLLLLAAKRVGWDPKDSESHLDVMLRSLLLIALVKLGHEETINEGIRRFHIFLEDRKTPLLPPDNRKAAYLAVMRTVSTSNRAGYDVLLKIYKETSEAQEKSRILGSLSSCPDKDIVVEALNLMLTDEVRNQDAFYVLGGISLEGREAAWAWLKDNWDHVVKTWPSSSLISDFVNSTVSPFTSEEKAAEVSEFFATRVKPSFERALKQSLERVRISARWIDSIKSEANLAQTVQQLLLQEF

SEQ ID NO: 113933 - protein, 177 aa, Triticum aestivum
  unsure (1)..(177): unsure at all Xaa locations
  Clone ID: PAT_TA_8351.pep
SVVESLKEEHEAILKKREXPDTSAITWHEYKSMAFTAQVTNEIVRLSNVAPGIFRKTLTDVQAKGYTIPAGWLVMISPISVNLNPELYEDPLAFNPWRWQDESKKSTLLKNFMPFGGGLRLCVGAEFSRIQIALFLHTLVTKYRWKEIKGGEVQRISEIVFPKGYHIQIIPREESIN

SEQ ID NO: 113934 - protein, 126 aa, Triticum aestivum
  unsure (1)..(126): unsure at all Xaa locations
  Clone ID: PAT_TA_8352.pep
MGRPGYLTLPIFAVLAAIGYVYYTTVFVAVAGWLGLATAAXGVANAAAFTVLAAACLANYAAALSRXDPGRVPPAFLPDVEGAETPSTKSTPGVVCCAIAPHAPRYAPAHTVPCGQHGCGKGSSGF

SEQ ID NO: 113935 - protein, 215 aa, Triticum aestivum
  unsure (1)..(215): unsure at all Xaa locations
  Clone ID: PAT_TA_8353.pep
HASVEMIERSVLQRYRLKSFHVVAHSLGSVLALALAVKYPGAVKSLTLLAPPXFPVPAEEAGAATQYVMRRVAARRVWRNIDFGASMACCSSNGRPGLGLTICRHHRVWNRLFRIISKYMMRTFLLLAFMCHTHFLSFLPAYQDVVAGQLSCKVALFHGRDDELLPVECTLAVGARVPRARVTVYDNKDHITIVVGQEKLFAAELEAIWRSAAQD

SEQ ID NO: 113936 - protein, 116 aa, Triticum aestivum
  Clone ID: PAT_TA_8354.pep
TFGLFPSFMSVVTPLWPGCAGLPVEKKPRVLPYKEMHGAACRNITFLVGTFAPSRIGHLSTKFSSKVWLHLLLPHLLYLSQGVFMQAISLREHPHLNHQYVLFSISFCITTSIALL

SEQ ID NO: 113937 - protein, 145 aa, Triticum aestivum
  unsure (1)..(145): unsure at all Xaa locations
  Clone ID: PAT_TA_8355.pep
GVVFDSGSTYTYFAAQPYQATVSARKARLGVSLVGLPLGWLPLCGFGPVAVVSVAVVSLVFNSRFLSVGEIPPVDFPPVTYLGNVCLGILGGTVAERTAPHQSCHLIAGSAVQVRLXVWAAGMGPLGWIRGSCSRSSKSIMSNFP

SEQ ID NO: 113938 - protein, 222 aa, Triticum aestivum
  Clone ID: PAT_TA_8356.pep
MCTLPIPVHTFPRVLQGKVSCIHPLGSAKNGGRMCTLRRIVSNKFMHHFMPNTPRQYRNNRGRMTGNMMTFPHTVNYVSHAQTAKDFMSMSRQQFAHAKYIPPDVMSNGLAIHHGGPISSLNDSFASLLAAAPPEQQRDMLGNRIYPLVERYHPDLASKITGMLLELDTSYLLSMLNSQDTLSAKVNECVQALQGQQAAKNKPEDLEALHPGFLDSTGVNAN

SEQ ID NO: 113939 - protein, 136 aa, Triticum aestivum
  Clone ID: PAT_TA_8357.pep
RGEQPLIRRARRPGAAFQINPVATDRNELASAPSSPQLTASLILQLLPHRQPTTTRNYNRRVGATMVFWPSMLHFSEWQNPGRSKTIQLGIFQQFEIRNWNCSILKYLTNYRKKHQGLAPHETTPQYHCHMLFYLL

SEQ ID NO: 113940 - protein, 252 aa, Triticum aestivum
  Clone ID: PAT_TA_8358.pep
IRHEAGFCLSSLILDGRVFGGKSKSGPENVDTDEFLSWLYAGSPPVGEQLSEWNCMLVDRTSQGMQILDMIDKEASSLKNFCEMKHEQLNIEEGVLAVNNIIQEEQRLRDRGGRYSYQGYEELLRNRQEELLETRFRSSEYDAISNVLKEVRTSHFGYDEGFSGMTSRQCDFDGAAIDDWRLHDFMHPSDSVVPTIVLRMKEHVATELGKIDARIMRSVALMQQLDLKLEPAAFVDYRSILLPLLKSFLRNH

SEQ ID NO: 113941 - protein, 303 aa, Triticum aestivum
  Clone ID: PAT_TA_8359.pep
MEAGNLEFGEKECTNYLQEKRSLKLGAGDAHALYQYFLRMQSKDPAFFHVMDVAEDGRLRNVFWADARSRAAYESYWDVITFDTTYLTNKYRIPLATFVGVNHHGESVLLGCGLLSNEDTETFVWLFKSWLCCMSCKPPNAIVTDQCKPMQNAIEEVFPQARHRWCTCHIMKKIPENLSGYENIKSSLSNVVYDSLTKHGFDKAWVEMINKYDLQDNEWLAGLYDNKNLWVPAYVKDTFWAGMSSTKRSESVNAFFDGYVNARTTLKQFVEQYENALREKVEKENKADSKSFQEQIPCITHYD

SEQ ID NO: 113942 - protein, 311 aa, Triticum aestivum
  Clone ID: PAT_TA_8360.pep
SLFLPINRPTETITYMPLRSGCTRTKFFIPRVQCLASVRGILFILDLVFKHCNQDTDENESPAKIVIRPKRIFNSQSRESNSNEDELQATTELYGKWQLKPLQLPGAVNGIVPKNERGQVDVWSEKCLPPGTVHLSKPRIFQVAKRLGIDYAPAMIGFDYRSGRCAPVYDGIVVCAEFKNAILEAYKEEEERRQAAERKQEEAQALSRWYQLLCSIVTRQRLKESYNARSAALAPERPAKVDNPQKSTSDSRCSGATTPNNHPRADRLPDPRFSAHDHEHEFPEEDQSFDEETFVRTKRCPCGFSFQVEEL

SEQ ID NO: 113943 - protein, 157 aa, Triticum aestivum
  Clone ID: PAT_TA_8361.pep
LVHPTSRFALPSMLLSHHTTLLPHVTPQLHTAVGILPCSPHRTVVRHLAFLVRLRRSNTGLATLDHLHYMQNLKPICRYKTSRLVLTFTPLIFDVRSSTRITRSFLSTPSQRRRPPHSILLWTTPSQRRSQPRTILSWSTASSAHHHVLLPHPATTS

SEQ ID NO: 113944 - protein, 83 aa, Triticum aestivum
  unsure (1)..(83): unsure at all Xaa locations
  Clone ID: PAT_TA_8362.pep
FLMSNPLPPRLPCFSFHSFLPSLCFSFTWVCSGGCSALPPTSGEWASLPSLTCPTVTNANFSCHXNCSITPSSFISRSSHWGL

SEQ ID NO: 113945 - protein, 141 aa, Triticum aestivum
  unsure (1)..(141): unsure at all Xaa locations
  Clone ID: PAT_TA_8363.pep
MSDASEGRAIRRHENGSIGSSSNFSFAFPILAEXVDGDEGEHGRLPAAAEGARAVAADALEPQVAVRGDDDGGAAAAEGRVVLVRGVLRLLLVRLLMALLLLPMAVAVLLLLVAPVRPAASAAAGASERSYTRNGGKRTQS

SEQ ID NO: 113946 - protein, 154 aa, Triticum aestivum
  Clone ID: PAT_TA_8364.pep
EDDSDEEDVDEYDGDDEDDDDLDLEDFESDDEEGAGKSGGDIRYEDFFEESCKQQVKKRNGFTKKVHFKDELHEMEVDNIEKDDVNDGPALEDEQGLSTHEKGLLKMRNQIDIMEKASLEPSKWIMQGEVDASRRPKNSALGGELEVASSLGIA

SEQ ID NO: 113947 - protein, 128 aa, Triticum aestivum
  Clone ID: PAT_TA_8365.pep
AAPVDLYDSDINFSVMRADDGGLGFLFVSKFSVQLWKTKVICDCFNSWVLGRTIEMDKLFLLDSKVRESPMIVGFAEENNVALMWTEGSLFMFQLESLQLKKLVETRISFLSTIRKCLYCRNKHWWWT

SEQ ID NO: 113948 - protein, 123 aa, Triticum aestivum
  Clone ID: PAT_TA_8366.pep
GGGSGSRWCLQSGREALGRRRRASVAGIGQVRWEATMPEIVRCASTLSPALLRALSLVHGSPLSTELQIHDTSSEVSSGKGYHLATPLSSSFILSNPSGGFPTRRRCCCLASYWVAAVLVIVV

SEQ ID NO: 113949 - protein, 128 aa, Triticum aestivum
  unsure (1)..(128): unsure at all Xaa locations
  Clone ID: PAT_TA_8367.pep
IXSKQSSIHQLFIKWPTSAAVKKLRSMPQQIQPKNKPYSFIIRLFLLHTSSHGLSINNFLSISTFASCFHCCNNIIQHRPLISERLLLLPSLNVLYQGIQPPRQDLKHRTSVLETPMFPIIVQPSLSM

SEQ ID NO: 113950 - protein, 132 aa, Triticum aestivum
  Clone ID: PAT_TA_8368.pep
TGDFCPAPGVGAGQDAALRAALEGDLQRLRGTVKSLVDPRVVFSFEMGDLGVLHLAAGRGHLEVCKYLVEELGGDVNAPAPGVGDFAGVTPFMTSAQSGDVLTVKYLLDCGGDVTKADSKGRTVLHHAACKA

SEQ ID NO: 113951 - protein, 241 aa, Triticum aestivum
  unsure (1)..(241): unsure at all Xaa locations
  Clone ID: PAT_TA_8369.pep
KKEAADSIRVVXELAMHRWSGQFSRPFLFGLLNDGTFLCYHAYCYEGLESNVKDNSFSPAGSVDLASASDSRLKNLRFRRISVDITLREDISSLARPRITIINNVGGYEGLFLSGTRPVWVMVCRQRFRVHPQLCDGPIEAFTVLHNVNCCHGLIYVTSQGFLKICQLPEAYNYDNYWPVQKIPLHGTPHQVTYYAEQSLYPLIVSVPVVRPLNQVLSIMADQDLVHHMDYDATSADDLQK

SEQ ID NO: 113952 - protein, 179 aa, Triticum aestivum
  Clone ID: PAT_TA_8370.pep
ARTANAAGEASRTARTKRRTRAPAAGESAMGEQGPRSPGARRRAGDHQPRRPPRAQRRGSRRPGECRGSRRRRARIRTGAAREGPRRGGARGGRRRQRGRGRGRRGRRQATARRGRQRAPAPKPPRRAGAPTPPRPAGPPPKRRPQRRRRPWRPKRRRCAKPQKRRGREQARRRVARAE

SEQ ID NO: 113953 - protein, 138 aa, Triticum aestivum
  unsure (1)..(138): unsure at all Xaa locations
  Clone ID: PAT_TA_8371.pep
RPPASAPLAGDRPTPMPATSAIPFGSPSSSFHSAPLLLSPPSFQQRPPMFAPIHGPLLPPSLGPSPXHGASAVPPPQAHLFVPPRLHYPPAPPKTSRPPSAKLRGRWLTTATTGLNLLHAMGGGHGGCTSGHSLSASQ

SEQ ID NO: 113954 - protein, 129 aa, Triticum aestivum
  unsure (1)..(129): unsure at all Xaa locations
  Clone ID: PAT_TA_8372.pep
GWPVPTSVKEVRSFLGLAGYYRRFVRQFGTIARPLTDLLRKNTPFQWTAATREAFEALKTALVTAPTLALPDFTKXPFIIETDACEYGVGAVLQQEGHPXIAYLSKALGPRTKGLSTYEKEYLAMVLDY

SEQ ID NO: 113955 - protein, 138 aa, Triticum aestivum
  Clone ID: PAT_TA_8373.pep
PLAPDNTPWAYTAPPWLQQAVNIVEHDPVICTADKNPWHCHLTPCSQGHTATTDHRYPPVHKQPTNYHQPLVLAARPNFKMMPPTGTRPRAPPSSDLGRPRPRVSLEVFWEESRGLHVGTFNNVRTLAGAAVIGSDDS

SEQ ID NO: 113956 - protein, 264 aa, Triticum aestivum
  unsure (1)..(264): unsure at all Xaa locations
  Clone ID: PAT_TA_8374.pep
MERKSAILMNRYELGRMLGQGTFAKVYHARSLATNQSVAIKVIDKDKVLRVGMIDQIKREISIMRLVRHPNIVQLHEVMASKSKIYFAMEYVRGGELFARVAKGRLKEDAARKYFQQLIGAVDFCHSRDVYHRDLKPENLLVDEHGNLKGSDSGLSALKECQKQDGLLHTTCGTPAYVAPEIINKKGYDGEKADIWSCGVILFVLLAGYLPFQDSNLMEMYRKISKGDVRYPQXXSSDARXXLSRLLXXNPNXXXTMDKLIEXX

SEQ ID NO: 113957 - protein, 80 aa, Triticum aestivum
  Clone ID: PAT_TA_8375.pep
RNSARGRPASPAPASPVRQPEAAAVTWASRSTTCTARAGSLAVKHIDIAVSVLSLFMEPKKLAPASPSDAYVSHLALLCF

SEQ ID NO: 113958 - protein, 150 aa, Triticum aestivum
  Clone ID: PAT_TA_8376.pep
TLVFWSGWRRRLRRNHLQRRCLGGPAFGCRVGLFHFQGRCMSGLRLWDLLLSVEAAASGSTATTAPRGRAACRHGLGEDLEVRKQQGCQLRQCAPVGTVGRHVGAAAQDVVQRSWSMCGWPEQRELRVAVSSGVVPARLSLIQVADREEV

SEQ ID NO: 113959 - protein, 219 aa, Triticum aestivum
  Clone ID: PAT_TA_8377.pep
APKKLVYSFVGRGTTVLADHAEASGNFASVAAQCLQKLPPNNNRLSYNCDGHTFNYHIHDGFTYCVVATESAGRQLPIGFIERVKEDFAKKYSGGKAKTAGPNSLKREFGPKLKEHMKYCDLHPEEIDKLAKVKAQVSEVKGVMMQNIEKVLDRGEKIELLVDKTEDLRSQAQDFKKQGTKIRQKMWWENMKIKLIAFGIIVLLILCIILTVCRDFKCW

SEQ ID NO: 113960 - protein, 72 aa, Triticum aestivum
  Clone ID: PAT_TA_8378.pep
MNAQPLNVIVWNVRGLNAPARRNAVYQVVASVNPAIVCVQETKLQDVSLSVVQQCLGNKFGQFLFAGGWTEE

SEQ ID NO: 113961 - protein, 51 aa, Triticum aestivum
  unsure (1)..(51): unsure at all Xaa locations
  Clone ID: PAT_TA_8379.pep
GTWLFRLLFQYILMKAIXSGITAFRVTGXRRYRILLAVXQQYHFHKFRVHF

SEQ ID NO: 113962 - protein, 174 aa, Triticum aestivum
  Clone ID: PAT_TA_8380.pep
MASCRSSAAVAAAFVLVAVGCGVVESRRVACGARGIDLGGGEGAGLGLGLGLGVGAGTGGVSASGSGSGSGSVAGAGSTSESRSGSVSVGGASSSAGSSAGSNAGSAGSGAGSSAGSGAGYGGGQGYGGGGGGGSGSGSGYGEGGGYGRGGSGNGSGFGFGEGRGFGSGSAGNP

SEQ ID NO: 113963 - protein, 282 aa, Triticum aestivum
  Clone ID: PAT_TA_8381.pep
RRFFDLSDSRIFEDDDYDREGDRQLLYAGLICDDENPASFGIFCLAAHGEFRLRAAVFFSFLGMGGDWFLSPWLDVPHHPNPHPEGDEDDEDDDGDEGDLVLESGMRVGNFIYWPHQDRAYVVVLDPDPNNPRLFVEMIPPLLNLEGFRSSILGQINGDNMCIAYSNGFNIGFMLRQEDGLDAGAWANSRVFNLTDQVRRKLGYLPQNGLKIAAMRGSIVYFTTSQMFHPLDATCWFACLCLESRRLEWLFPRTYNGLFQPYHHSSWSTFLLPENERFYPFI

SEQ ID NO: 113964 - protein, 164 aa, Triticum aestivum
  Clone ID: PAT_TA_8382.pep
VVVQLTKFFTISSISIINLAFSPQPRTVEIKGRADGSATAALSLRRRSTTYNSRRRGCWDKPRTNPPRRHTPGSLLAPQTPDEGRRRRHHDFSGEAHQRLYLGFVSLYDSNTHMRYTRIHAAQPGRTLTSTGHTSRSRRRLHLLGPSHWLAHPVARQHTLVPNS

SEQ ID NO: 113965 - protein, 117 aa, Triticum aestivum
  unsure (1)..(117): unsure at all Xaa locations
  Clone ID: PAT_TA_8383.pep
VSRSRDVGARGLPEDPWARRFKPRDSAMNRRGDGVGASDGESGTDTVQGAVPKHGREVXXCVGGNLVDKTSEEVSGQNFPEDEVHSAAQPSKSCKKRRPASSTAAGSFISMLGDKRW

SEQ ID NO: 113966 - protein, 244 aa, Triticum aestivum
  Clone ID: PAT_TA_8384.pep
PRGRCVGTPLRTRGVTLRSVGRVDSSLRSIDAYVEVEDDKIIAPGLALVEVNQSGLIMETMIDITPKDPLPTPSVGPLDADCSKEGLILCDKERMKGHQGVSLDALVGIFTRLGRDMEEIGVQKSFKLAEKVASIMEEAQPLLSRIEALAEEVQPLLSEVRESDLVKDVETIAKGLAEASGDLRRLKSSMLTPENSDLIKQSIFTLIFTLKNIESISSDISGFTGDEATRQNIKLLIKSLSRLL

SEQ ID NO: 113967 - protein, 194 aa, Triticum aestivum
  Clone ID: PAT_TA_8385.pep
MAAANWNPPALPECDGYDAAVLLDTRCYIADLHNCTTAWGTTSRGSPIQVTFCAARPPLLSHFCVRCPDLDFLRSKPIVVATDADLVLLRVPIDLKAPLDARSWDYFGYKPQAHQLDLLPNPHPMSFHDSATALLSREDGAWYAVAAISSWCPVYESNGDSIIRWDFRLHLYRSSDSKGWTTTPVSVEELVRDK

SEQ ID NO: 113968 - protein, 48 aa, Triticum aestivum
  Clone ID: PAT_TA_8386.pep
LSTSSTLEPTIDRYHYSVFKSTVNESNHMLELVYIISLFFFIVLVFLY

SEQ ID NO: 113969 - protein, 82 aa, Triticum aestivum
  Clone ID: PAT_TA_8387.pep
MESPKKLRPLIIMAMLLLLVMAAEGHKHCPEDLCEGPSGKFKGACSQDDECQETCGEEGFHTGFCKVGPFNGACKCCKPCVF

SEQ ID NO: 113970 - protein, 78 aa, Triticum aestivum
  Clone ID: PAT_TA_8388.pep
DFFSHLEMHLRQEHPPLCGRDHMAYRSAYFPVKDVIDGDLCEQYPALPADMQRKIADELDRTPGEILKKLEDIRNKII

SEQ ID NO: 113971 - protein, 278 aa, Triticum aestivum
  unsure (1)..(278): unsure at all Xaa locations
  Clone ID: PAT_TA_8389.pep
VVLCLCCLPWLGYKHTGHFLLTPLSCDTLESAASFSSDQCSEGVVAVAGDALRIFTIERLGETFNETSIPLRYTPRKFVILPKKKYLAVIESDKGAFSAEQREAAKKECLEAAGAAENGNGNGDQMENGDGQEDGEESNALPDEQYGYPKAESEKWVSCIRILDPRSRDTTCLLELQDNEAAVSICTVNFHDKEHGTLLXVGTTNPPGASWPKWSLAHGFHLHIFPLSRCDXSAFELLRIPPFQLMPRAWCPLRGPVLPGVASGRWKTSETKSSRVIA

SEQ ID NO: 113972 - protein, 133 aa, Triticum aestivum
  Clone ID: PAT_TA_8390.pep
MDMALPIVNATTAALARVSAAFNAPLARAVVFGVHIDGHLVVEGLLIAVIVFQLSRKSYKPPKKPLSEKEVDELCDEWEPEPLCPPVKERSHIDPPILESAAGPHTTIEGKEVVNFASANYLGLIGNEKLIDS

SEQ ID NO: 113973 - protein, 263 aa, Triticum aestivum
  unsure (1)..(263): unsure at all Xaa locations
  Clone ID: PAT_TA_8391.pep
CLSXPVRRFASRTVEPGNRNRRRNTSILLRHVTPSRTSNILIDAGKFFYHSALQWFPAFGLREIDAVIITHSHADAIGGLDCLRDWTNNVQPSIPIYVAPRDYEVMKMTHHYLVDTSTVIPGAAVSTLQFNIMEEEPFTVQDLEVIPLPVWHGQGYRSLGFRFGDICYISDVSDIPDETYKLLEDCQLLILDALRPDRSSSTHFGLPRALEEVRKIKPKRTLFTGMMHLMDHEKVNDDLARLMETEGLDVQLSYDGLSTPVRL

SEQ ID NO: 113974 - protein, 106 aa, Triticum aestivum
  unsure (1)..(106): unsure at all Xaa locations
  Clone ID: PAT_TA_8392.pep
VTTKCSRSIVLTGDGSLTTACACGYVFLNEERAVTTPTLAGGKQSEGWFLDTGATNHMTGSIDAFAELDRLLALGPDIRRTTRRQVLXRRSRGRGSILGLKTYVES

SEQ ID NO: 113975 - protein, 140 aa, Triticum aestivum
  Clone ID: PAT_TA_8393.pep
PRSPLLSPPPPPSADLAQKQSPSSQKQTQPNRGSEGSLPSFFPLPSDGYMTSIGAPVCPRIHRSIGAASVAETTDLSTMRRQAGRNNGSSMPDGERVETGTLFLIPLLLFLYIIYYVCLEDLHRPKRSGADPFACLSSIG

SEQ ID NO: 113976 - protein, 145 aa, Triticum aestivum
  unsure (1)..(145): unsure at all Xaa locations
  Clone ID: PAT_TA_8394.pep
PTPGQARRTSPDQLLPGSLAIEEESSCSIQGLAWVSDAAHHLTFPGRRHGLRCGRPPDAPVVPPSTFPVPHGWQACDRKHANTRHYYHPVICSDLFQELSRQDNFRQSAEQPQLKTDLKGLQGGGAXSCYYIXXPPFTCNTNFHI

SEQ ID NO: 113977 - protein, 163 aa, Triticum aestivum
  unsure (1)..(163): unsure at all Xaa locations
  Clone ID: PAT_TA_8395.pep
PKDSLYIHPNGHPSFALLCALRLGSTPTNRRKTFRHPIYSVPMLSVEVELEVMKRLGSKCVETLQQLPTTAELDGRLVHFLRNLQNSTNWRVDVEQSSFGQEFAAFLRFHSVDLDCTHNQLLVRLLRSLERWELTXRWRCTYKIALTKCVLSCKRLINELSLQ

SEQ ID NO: 113978 - protein, 158 aa, Triticum aestivum
  unsure (1)..(158): unsure at all Xaa locations
  Clone ID: PAT_TA_8396.pep
STPQXFGYRFIRNCHLLESEDEVMFVGPVFATKEPGCPKSICGFEVYRLDVHGARWVKVERLAGEQALFVSDQSSFALHASEVPGCMSNCIYFVGDVDECSFSTWGIYSMVERKVLFQSPVGGLPGKYKAARWFFPGVVMPLARQCTNLGQRRKINGL

SEQ ID NO: 113979 - protein, 76 aa, Triticum aestivum
  Clone ID: PAT_TA_8397.pep
VMDGSQLSSGGHHVDKKAVAHPIFTTRKMQFYKKVNVGIFRVHLYNKYVCNNSLIWKLEAMKVVKPKQHWLGFLRA

SEQ ID NO: 113980 - protein, 274 aa, Triticum aestivum
  Clone ID: PAT_TA_8398.pep
ARGYCFVTGCDASVLIAPTRFAKSEKDAEINHSLPGDAFDAVVRSKLALELECPGVVSCADVLALASRVLVTMTGGPRYPVPLGRKDSLSSSPTAPDVELPHSNFTVGRILELFLAKGFTVQEMVALSGAHTLGFAHCQEFASRIYNYRDKTGKPAPFDPTMNPGYAKGLQAACKEYLKDPTIAAFNDVMTPGKFDNMYYVNIERGLGLLSTDEDMWSDLRTRPLVERYAANNTAFFDDFARAMEKLSMYGVKTGADGEIRRRCDAYNDGPNTL

SEQ ID NO: 113981 - protein, 116 aa, Triticum aestivum
  Clone ID: PAT_TA_8399.pep
GLHLGDFDQFGEPMYKAGAYRRATGVQPAPKEVICRRLQGNCRNARTVGWLDIVAMRVALRRAGRLSQTSSSYNLHRSDGLCSRLCNICGNYFYFMMHMFHLLPVLSNQVSLPRAC

SEQ ID NO: 113982 - protein, 134 aa, Triticum aestivum
  Clone ID: PAT_TA_8400.pep
MSKAALTLEEVSKHNTKDDCWLIIAGKVYNVTKFLEDHPGGDDVLLSSTAKDATDDFEDVGHSSTARAMLDEYYVGDMDTATIPARTKYAPPKQPHYNQDKTPEFIIKILQFLVPLAILGLAVAIRMYTKSESA

SEQ ID NO: 113983 - protein, 161 aa, Triticum aestivum
  unsure (1)..(161): unsure at all Xaa locations
  Clone ID: PAT_TA_8401.pep
GPXXPVXTLCSGPFTPEAPDAPDAAIPRNLGSLCSGVALLRPLLAQTTTNNLGQKKSAAAASNPIRPRYTSLIHPPSPILFSIRISWIFFSLPIFSICISTILAGCPNSLFRFDIFSSWKSKQVEASFIDAHLCPVAHVLDGINWRPGCHHRTYRTPAWES

SEQ ID NO: 113984 - protein, 182 aa, Triticum aestivum
  Clone ID: PAT_TA_8402.pep
MDGASAGDGGSASGGGRWYTGMSSDNIKGLVLAISSSLFIGASFIIKKKGLKKAAASSGGVRAGVGGYSYLYEPLWWVGMITMVVGEVANFVAYAFAPAILVTPLGALSIIISAVLAHVMLREKLHIFGILGCVLCVVGSTTIVLHAPQERQIESVTEVWGLATEPAFMCYVGVVLAIVALL

SEQ ID NO: 113985 - protein, 274 aa, Triticum aestivum
  unsure (1)..(274): unsure at all Xaa locations
  Clone ID: PAT_TA_8403.pep
WIPRAAGIRHQPDTSYLPRPVTATHVLLGVSESFDVVIDFSDDESNTPEVELVNTAPYPFPDGNAPGRLSGKVMKFVVEPAKTRDHSRVPARLLEYVKVAEEEATRKRYIVMYEYDDGATGGPTHLYINGKRLEDPATEDAAXGATEVWEVVNLTPDDHPLHLHLATFQAVRARGLVGLDELRRCMARLNDAGRCNVSGHAXGDAVGVPEHERTWKNVGKMAPGYLTTVVVKFLMVETGEAYPLDATAEPGYVYHCHILDHEDNAMIRPLKLIR

SEQ ID NO: 113986 - protein, 166 aa, Triticum aestivum
  Clone ID: PAT_TA_8404.pep
LDRRGRAHLRPVLAGVTDPKHEAKLKDLLVSVCNGAVETFVRTSRQVTKEASISRAEAAVVQEVCNSGPSCVMERVSTTLAMPSNRRFVLDVTGRVTAEMVRSFLEFSTQRVSVGARKSIVVARDEITERGLVAVKYLSAKSMAIFTLCLTMCMHISVGMRFPLPA

SEQ ID NO: 113987 - protein, 120 aa, Triticum aestivum
  unsure (1)..(120): unsure at all Xaa locations
  Clone ID: PAT_TA_8405.pep
ASLFDVGIXAAHSYDDQLPSPQSVGTKLAPAEKILHTDRGDVPLPSYPGDIRGSNNNMQMQADELTDHVKKRSKFPTGTSLAAMAASGLELAMSSSASSILELSIAPPRCYGAVDAIKVL

SEQ ID NO: 113988 - protein, 325 aa, Triticum aestivum
  unsure (1)..(325): unsure at all Xaa locations
  Clone ID: PAT_TA_8406.pep
MEEEGARKAVLFRLFGVEVRGAEEDDDAEPMELKKSTSMPNLACASTGPVLLPGEASNDKGYASDDGELASTPQLKRRRRKAQERKKGIPWTEEEHRKFLEGLKQLGKGDWRGISKNFVTTRTATQVASHAQKYFLRQTNPGKKKRRASLFDVGIPAGHSYDDQLPSTQSVGTKLAPAEKILHXTDRGDVXPLPSNPSSNNRRMSKQDPDEQVKKLTDHCGEEAQSAPAGTGAGRDMLSPGRSVGDVIISPPGSCGAAARILAVTARPMPWTCRGRCPDLHPLQAEVICRILHRPPGLALCRIPSLVAFLTSVSGERYKIVFSFV

SEQ ID NO: 113989 - protein, 134 aa, Triticum aestivum
  Clone ID: PAT_TA_8407.pep
LSLPRTRNRLRRHRRRFVWLPPPHGAVHAHPVGMSPPSPFSRRCPPSLVFRLKGQQRASISGGGHEIHHQIGGAPHPSSMYPIFIWSPWAGRCQICHARVHYSDAAVSNRSNREFRAPLAMSSSWNMLGLEVIY

SEQ ID NO: 113990 - protein, 315 aa, Triticum aestivum
  unsure (1)..(315): unsure at all Xaa locations
  Clone ID: PAT_TA_8408.pep
RARRDVSHDLAHCDGLVLVPSDAMVRVLNPATRRVLVLPLRPPHAVMFGSTPFGFQGHQAFGLGHDPRSKAYKVARFFYRSMEGPVDNPNHYTLGMEVLTVGAADQRWRETAAPPPYPVLPGRTATFFKDSLLHRRGVATPGSXGFIRFKLEDESFGVLPGPPCSPSLDYAAASLAELRGELCVCVPRHEADYGDGSHETWICRDLDDAPQWEPRHVIEIHTFPRLRCLRPIAAYTDVLVLHAEPCYLCRETQEPGRSKEEERAPLHMQLQLRYYHPDTGVFVEYPTETCAFQVISYVPSLVPVLECLSHFSVAR

SEQ ID NO: 113991 - protein, 469 aa, Triticum aestivum
  unsure (1)..(469): unsure at all Xaa locations
  Clone ID: PAT_TA_8409.pep
GEYKYGFGSDFESFSIPKGLSEATXVRRISELKAEPAWMLDFRLAAYRRFLTMAEPTWSDNVYSPVDLQSLCFYSAPKTKPKLNSLDEVDPELLKTFDRLGIPLGEQKRLSNVAVDAVIDSTSIATTHREALMAKGVIFCSISEAIREYPDLIKRYIGSIVPPGDNYYAALNSAVFSDGSFCYVPKDTVCPMEISTYFRINDKETGQFERTLIVADERSTVSYLEGCTAPAYDSNQLHAAVVELVCEEGAEIKYSTVQNWYAGDEEGKGGIYNFVTKRGRCKGRGSKISWTQVETGSAITWKYPSVELVGDDTVGEFYSVALTKDYQQADTGTKMIHKGKNSRSRIISKGISAGKSRNCYRGLVQMNSGAENAYNSSQCDSLLIGDNAAANTYPTIQVGCTSGRVEHEASTSKIGEDQLFYFQQRGIDHEKAVAAMIGGFCRAVFEHLPYEFAQEVDALMNLKLEGSVG

SEQ ID NO: 113992 - protein, 95 aa, Triticum aestivum
  Clone ID: PAT_TA_8410.pep
SDRIGCCCCNLAASRVGGHPNFGRDREFFWPTCPPPPPCWPWSYLSILYSPSCVNCDAGLGFWILPNGICDAGWMLQVRGVYVAYLVLICSVDWL

SEQ ID NO: 113993 - protein, 90 aa, Triticum aestivum
  unsure (1)..(90): unsure at all Xaa locations
  Clone ID: PAT_TA_8411.pep
QEADINRHNNRVSYFKEQISDASIVSWTRAFFWSEMHFYQCVTYKSNNPYYTTQSILVVIAILSAIAIPKFLFVLCRFLLALLAXWIFLX

SEQ ID NO: 113994 - protein, 122 aa, Triticum aestivum
  unsure (1)..(122): unsure at all Xaa locations
  Clone ID: PAT_TA_8412.pep
SARGAAGLSPPTQPXATHPPLPAWHSRTDSSIRRSSGSSTAPRPPARLSPKRNRAASPPSSPPQILLDPHSTRAWRDPESNPIPNGSMEINSLLGSQTRHLPRCTDQMLISILREHRLPQAS

SEQ ID NO: 113995 - protein, 177 aa, Triticum aestivum
  Clone ID: PAT_TA_8413.pep
GSTHASEKKQQPAAEFLPPTWTNPRRPAVPACRRRPPPPPAVAPIQPPPPPPPVRCPPLRSLLRPCGRQVVPLLLCPARRGARSLLLGVRRGAFLPGALPPRRPPLAGSMSTISDQKKRTLEAIQQRYAAAKAKKLQDEQPKCPKNKESTPKPKFDARRKGKTPESTPRTSGPAAYI

SEQ ID NO: 113996 - protein, 214 aa, Triticum aestivum
  unsure (1)..(214): unsure at all Xaa locations
  Clone ID: PAT_TA_8414.pep
MELLRAVVLLSLALLANGRDTDLSRDSFPKGFVFGTASSAYQVEGNSLKYGRGPCIWDTFLKFPGATPDNATANVTVDEYHRYMDDVDNMXRVGFDAYRFSISWSRIFPNGIGRFNKDGVDYYHRLIDYMLANNITPYIVLYHYDLPEVLNNQYNGWLSPRVVPDFTAFADFCFKTYGDRVKNWFTINEPRMMAWHGYGDGFFAPGRCTGCRFG

SEQ ID NO: 113997 - protein, 180 aa, Triticum aestivum
  Clone ID: PAT_TA_8415.pep
MDELSQEQIQEFREAFKLFDKDGDGTITTKELGTVMRSLGQHPTEGELKDMVEEVDADGSGTIDFNEFLGLVARQMRGDAEAEEELHEAFRVFDKDNNGFISLDELRTVMKNLGEKLSEDELNEMLQEADADGDGQINYKEFAKVMMAKRRANAEEHGAGDHGGSDHSHGGGGGCPCTIL

SEQ ID NO: 113998 - protein, 236 aa, Triticum aestivum
  unsure (1)..(236): unsure at all Xaa locations
  Clone ID: PAT_TA_8416.pep
EAMGYFPISFHVEDYDAFDSSRXYVFGYEPHSVLPIGVAALANHVGFMPLPKLKVLASSAVFHTPFLRQIWTWIGLIAATRKNFYSYLAAGYSCVVVPGGIQEILHMDHDSEVAFLNSRKGFVKIAMQAGCPLVPVFCFGQSKAYRWWRPGGKLFVNIARALKFTPIIFWGRYGTPIAFSAPMHVVVGRPIELKKNPLPTIDEINEVHGQFVGALQELFEKYKTKAGYPGLHLRVL

SEQ ID NO: 113999 - protein, 194 aa, Triticum aestivum
  Clone ID: PAT_TA_8417.pep
MAAAVRVDKATSDLLLGPDWTLNIDICDAANSDHGQAKEVIKTLKKRLQHKNSSVQSLALTLLETLVKNCGDHVHFLVVERGILPEMVKLAKKKANVQVRDKILTLLDSWQEAFGGPGGKHPQFYWAYSELKQSGLEFPRRSPEAATIFAPHLQPRDREVQANSSLRADGMISSSGSPLKFVRPATHFKCRGSY

SEQ ID NO: 114000 - protein, 153 aa, Triticum aestivum
  Clone ID: PAT_TA_8418.pep
FPLTSRGKMAYKGMANFIISIISTASLYTSRTLDKSHQRVYSRKEGLQQLVHELHTVGGSTKGVRALLLLLLLICFAVGGQCDHPGCYRSSTFPPCNPDKNRCYCCLYNWTCYKSFAECGPACHPPPLFLLCTIIELDSCSGLERWMNKAISC

SEQ ID NO: 114001 - protein, 164 aa, Triticum aestivum
  Clone ID: PAT_TA_8419.pep
QETRKKRHCAHMPDPEARRPPALLLVFPCLLATLATAPVTRARLPLARRSCTALASAASACHGRNSHTGGSSALSFMVAASPTTPSPARRPRLRLAAVVNLYRRVLVPAKGKGVGSKNWGCFQEKKGRISITCRRGCNAPTPAAAALHHLSPPSAALVGIGWQH

SEQ ID NO: 114002 - protein, 119 aa, Triticum aestivum
  Clone ID: PAT_TA_8420.pep
MMRPEKPESESKSGCSYLLDIASHVDRERVKTLGTTPYMIDATRYGNVSRFINHSCSPNLSARLVLVESKDCQLAHVGLFASQDIAVGEELSFDYRRKLQSGDGCPCHCGAQNCRGRVY

SEQ ID NO: 114003 - protein, 317 aa, Triticum aestivum
  unsure (1)..(317): unsure at all Xaa locations
  Clone ID: PAT_TA_8421.pep
GTRVKAKTASASHTXAKLVKKTDKKSVASSSNPSTCRTMKPVLRRTPGSSIEKIVSSRNVNNSTLDDIVAYEVHXEFIQTDCPSTEHSATPSDESCQSAXWDTEPSIDDAQEDFSGCSEASLISSQSSPPINRTPKKEVEIKDEMNLLLLSSKSFVNQAAQLIGTDAYDYDHLIEQYKDTGKAEMGDHELYVDIAMEQLERKHRQQNSLYYTGFRTQKCGATPYFSLEALLGDIGDGTRELKSYTDDKDDHGSGTKDSMSMKLERDLGCADPSINSAWDMGWQDWICMEETECWVRDAGEDVLSLLIEEVALEMLVN

SEQ ID NO: 114004 - protein, 85 aa, Triticum aestivum
  Clone ID: PAT_TA_8422.pep
MVLLCLSWADFTAQIHKCSRREFILFYTFFFLLGKRGVLHFDAIDPYATLPTAPCRSTQMQFSRACEDGKNVPRSEALMVILSEV

SEQ ID NO: 114005 - protein, 271 aa, Triticum aestivum
  Clone ID: PAT_TA_8423.pep
RRRHSFPFSLGIHPTHLFLCTQPTSAAHQSPRARDLIALTTMARPSPSPAPFFFFLPSPPSFALIPPPSLSFSCFHRNPKELCPDAMDRSRRSLVPTTCELSKPQAASDLEGITAVAPFSRPPRPSPAFDSPPSPLLCFRCVEQQQSRQRTPPLPRPRLELPSVGHWRLPRCSSSPRPLLLRPREGRTCAAPVDRDAQAQRPPGSIGLGGPAPLSLAGCSEDGPRPMGEATQRPTFFSFLLLGLSQIRPASTFFPVSANLSFIPVKQFCRN

SEQ ID NO: 114006 - protein, 236 aa, Triticum aestivum
  Clone ID: PAT_TA_8424.pep
RHAGAPHFRRPPPRPPALPPGPPPPPPPPLPPRSPPSPPSSAASPPPPPPGPAGPARRGLVTYPNLLGPVGIRGGCFLLVLILEGVNLPLFLVAVLRHRDAVIPVRRACDRTERLSHPWVCIAGRSPGPLVLSHCRAARLGPVPVRGNPLRSVTMQGPARLAASDLPSVGAGAPAGPGLEALPLERLVVTDACPNHLAHSCPNLRSLVLVSCEGFSTDGLATIATNCRFLKELDLQ

SEQ ID NO: 114007 - protein, 132 aa, Triticum aestivum
  Clone ID: PAT_TA_8425.pep
MGRSPCCEKEGLKKGPWTPEEDQKLLSYIEQQGHGCWRSLPAKAGLHRCGKSCRLRWTNYLRPDIKRGKFSLQEEQTIIQLHALFGNRWSPIALWTPRRTDNEIMNPWNTHLKKRMAKMGIDPVTHKPRSDV

SEQ ID NO: 114008 - protein, 67 aa, Triticum aestivum
  Clone ID: PAT_TA_8426.pep
HGCSKILLRRPWRAAQLRAAMATSVGSHPSIVATPASPPRHLHSPGDTLHQRLVLSACRFLAMRASG

SEQ ID NO: 114009 - protein, 430 aa, Triticum aestivum
  unsure (1)..(430): unsure at all Xaa locations
  Clone ID: PAT_TA_8427.pep
SKGYLPPLIHRRRGQGNSTWSHGVRRFLNLFMANRPGCMYSLRRFDLSRNQFFYSTPEEVALHGRVLPPIQRDSSSSLSKASGRVKKQQASEIRTIRLPSPLVNMRPAPYPKPKSDELRLDVFALSERNIVFADRQRHVFTYDTDSECLVTMPNLHAPKVDPLAISIPRPGGGEGSLYMIERLLCPGKSFQFEALVSGQHYNESHPCRTWQCDELPLPPLEEEIFIDSCAVVGNVICISASGFGSYCFDTLSHSWSRVGDWVLPFFGTAXYVPELNHWFGVSDQDYHLPCAADLSPVLTGQRPEPGLIWADNYLPEEWHHSGLSNPAKMVSLGSGRFCIIRFLETLLPSLDTEQIFVDKQYAVFTGLEVVLTGKGNGNGKVNANGNGNSNGNRLRMVRHKTRRCRNRESNLIECMLLKSYASPFNLLPLM

SEQ ID NO: 114010 - protein, 191 aa, Triticum aestivum
  unsure (1)..(191): unsure at all Xaa locations
  Clone ID: PAT_TA_8428.pep
MAIGSLLASRLARSGHALATRAIAQAPRTHQHHHATSPLLSRLGAVARAFSSRPAAADVIGIDLGTTNSCVSVMEGKTPRVIENAEGARTTPSIVATNSKGATFIGGAAWRRAAASPQDAARAANRLRGSARLVPRTLEDPNTLPDKKIGPTKGVAGTEGAAKSYSPSPIGAXFVLTKMKETAEAYLGKSV

SEQ ID NO: 114011 - protein, 110 aa, Triticum aestivum
  Clone ID: PAT_TA_8429.pep
SWSRSVSRWIYIYIDRKGKASTSCSNSGESMAQRYWTGVLRKATTCAAELSLRRQWSWSCCCIDYTRRTNKILLLPKGKNRELHGTSASIISQRHAVFVCLDWTGPESPR

SEQ ID NO: 114012 - protein, 193 aa, Triticum aestivum
  unsure (1)..(193): unsure at all Xaa locations
  Clone ID: PAT_TA_8430.pep
DPRRQAPTPEPSEADYETDELCNLLKSRVESPEFLEKLDNIQKSVYQHGAVDETISWDIVSAADIWDDKSMNVSDDSEDGYVLVKQEXDIVDGIACFMAAYLLSLKETKELTPNQLQEALSKTFSTKKRKGKLQKAWAGTQVIYNVASWSATAIGIYQNPAILKAATAAFLDVLPRGCPSSCGIVMKILLHIV

SEQ ID NO: 114013 - protein, 111 aa, Triticum aestivum
  Clone ID: PAT_TA_8431.pep
SFLLSYSIPEFACARTYVDLRIILVPLISECSTSALFSGIISMLPHLYPECPYSQFFIRIKCNMCSHPSLFGFLSRNLRIEYIADHCFQPKTSRVLELIPRPPCMHVYPAQ

SEQ ID NO: 114014 - protein, 350 aa, Triticum aestivum
  unsure (1)..(350): unsure at all Xaa locations
  Clone ID: PAT_TA_8432.pep
MGEADESPGGGDPQSLNRIAAGAYDYQNDARGAGCWSHVRVPPHPAARPGGVDHFKRKFYHRYIHPDWALEPMSSTSATQSTRSAASSSSTPSSEHSRARDTRSGARSAGASQPAPTERTGNSLRFDGRTIHFSITAWVLIVACLGILPIVPEDVASKAXRLSLLATICSSAYSLYCTYGKPRAWNMPAIQPWLQSIIVAKDFVHLMFSLMMFTSNVRFKIVLLPVLCWALDHVARFLRRNFARSSFYRRYMEEPCLWVETNNTTISLLCSNAEITLGFLMIVSLFSWKRNIIQTFMYFHLLKLMYHAPVTSGYHQSVWARIGRAVNPHILRYTPFLNTPISAVQRWWLR

SEQ ID NO: 114015 - protein, 286 aa, Triticum aestivum
  unsure (1)..(286): unsure at all Xaa locations
  Clone ID: PAT_TA_8433.pep
ILSLLVIVIVISCCPSGSAPCAPRVVLALLALAGDGAVGAKVHHKHGRFTAGPWKPAHATFYGGRDGSDTRAGACGYKDTVAEGYGLQTAAVSTAMFNDGETCGACYEVRCTDSPEWCKAGTAPLTVTATNLCPPNYQLPGDDGGWCNPPREHLDLTMPAFLQIAEEKAGIVPISYRRCVRXHTVPCAKLGGIRYTITGNKYFNMVAVTNVGGAGDVAALKVKGNKRVKWTLLQRNWGQVWQTSEDLTGESLTFRVMTGDHRKHTSWHVLPRDWQFGVTYQAPKNF

SEQ ID NO: 114016 - protein, 379 aa, Triticum aestivum
  Clone ID: PAT_TA_8434.pep
MRKLPSAVLLFLLVAGLGRPWALLPAAPPPALPARRSDSIFSFGDSYADTGNNPVVFAANSVFNVVTRPPYGSTFFGRPTGRNSDGRLIIDFFAQRLGLPLVPPSLAHNGSFRRGANFAVGGATAIDAAFFHDGSDPGNKFPLNTSLGVRPPRSPAPKPSLSPPARACNAFGASPPCLLAAFGVDACLSAVPPLGPHPVRAFVPDVVRAISMAIERLIKHGATSFVVPGTIPSGCTPQFSSYLAKDNPAEYNSTTGCREDYNKLGMHHNLLLQEALEKLRGRHPDAMIVYADLFGPIMDMVESPRKYGFEEDVLTSCCGGPGTLVCGDEGANLCEKPAARLFWDVVHLTEAAYRYIADGWLGSIDSPAAARESRYQLVR

SEQ ID NO: 114017 - protein, 154 aa, Triticum aestivum
  Clone ID: PAT_TA_8435.pep
SDTGSLPYLQAVVKETLRLHPPVPFATGLAEEAVEIEGYNVPKGTTALVNIWGICRNAKVWDEPNRFLPERFLHREIEFFGADFELIAFSAGKRICPGLQLSSKMVPLILGSMLYHFDWTLPGEEDAAPVDMTEQFGLVLSMAVPLRVVPKKIL

SEQ ID NO: 114018 - protein, 363 aa, Triticum aestivum
  unsure (1)..(363): unsure at all Xaa locations
  Clone ID: PAT_TA_8436.pep
MTSTQLDLTGEEETPRTKSSPGERVEVELINCSAKGFVVSLDSMIGFLPYRNLATKWKFLAFETWLRRKGXDPSLYKQSMSSXRKGSEVNDRSIEPESVSEVAHQDQGTLQSRLKFEELLRTYDEEKSKFLSSFIGQRLRVSVVLADRNSKRLFFSMRPKESDELIQKRKSLMAKLNVGDIVTCTIKRFVYFGIFVEVEGVPALIQQWEVSWDETLDPSVSYRIGQVVDAKVIQLDFNNSRIFLSLKDVKPSPPVGALEAVIGDDASIDGSLEPAQADFEWPEVDSLIEELKNIEQVKDVYKGRFFRSPGLAPTFQVYMASLVGQKYKVLARYGNNVQEVMVETSLDKEGLKEAILMCTNRVS

SEQ ID NO: 114019 - protein, 230 aa, Triticum aestivum
  Clone ID: PAT_TA_8437.pep
RISSMARACWFLLLWRPPSAAAAPHRPSPRKMISFLLQPNCSSSGRRVPPSFLRRPVGPCRPWIQRLCWNSDAETERRPSRSAPAPSVSPVRRGDQMVAARFPRRSPRFLQPYDGERVGSVQTCGQKEGGTGGCRLSSAPGRRSPSPGNRRKAPKVAAVSELLDLPLSGAPSPLTRGKLKQLAFHCDLNADAINAHAQAQASSSGIARLAQADANPTGSFAGRSLLNVQV

SEQ ID NO: 114020 - protein, 90 aa, Triticum aestivum
  unsure (1)..(90): unsure at all Xaa locations
  Clone ID: PAT_TA_8438.pep
MHRVGSAGNTAGSSRPRKEKRFTYVLNDADTXKHCAGINCLSYLNASASGTSEYLFTGSRDGTLKRWEYQNGDANFSATFESHVDWVNDA

SEQ ID NO: 114021 - protein, 132 aa, Triticum aestivum
  Clone ID: PAT_TA_8439.pep
PRRRRHRRWRASRARGHGDSTKSAPLSPTLDGVLSDLHSLLLSTLAASLPSPSPWRRCSKDSRSLTLIKASKMERPVNVVDTYFLFDHVCSCSHVLKLFYVVLHTIELRTHGHASAKVTWNFYMLRPYPPHV

SEQ ID NO: 114022 - protein, 117 aa, Triticum aestivum
  Clone ID: PAT_TA_8440.pep
LGLTPTELFPFNHQRESPVLGSSRHPRDRRAAVLVMKRRLHPRVGLDYVDRRVGEAAAKLLPPPLDMIIHVVAEAVSAVIACLHVIFLEGTPLPDGLLGRELGQRVGVWVPQRSGPS

SEQ ID NO: 114023 - protein, 142 aa, Triticum aestivum
  Clone ID: PAT_TA_8441.pep
ENNHNVDYALCVASLSADPSSRDASLHGLALISAKLVQAGVEGMDSGIAALRAKEATQSTRWSCLNACMDVFRNAMADLDDAIAAIEDGRFTEAKTKMTATTDAPVTCNDEFKEQGLQPPMEGDSRRLFQHAVISLAIISLL

SEQ ID NO: 114024 - protein, 438 aa, Triticum aestivum
  unsure (1)..(438): unsure at all Xaa locations
  Clone ID: PAT_TA_8442.pep
MGNMTRSDSPVSRRIVLSFLDFLNSVEGYSQDFYLNSLLLCKLMNKIGQDQIPXSNKCTTSNSEGQAEETFDLDHAGDELFAKFFAALDEINFFKTSPAGAEDPDQLSKASQFFDDALLEVRKSGRKVASLVDLAEFFKSKGNDFMRSKQHLKAVELYTGAIALSRKNAIYYCNRAAAYTLLNMCNEAVEDCLKSIEIDPNYSKAYSRLGSAYFAMGNFHDALHKGYLKAAELEPGNENVRLNIEATKRKLAEQQTAPGQNTHGPHSWFGGQASSGAPFTVFPPGSAPPPPEFFNMMNRGSGNGQQPPPHSVNINLNDFFGHASVNGNAQGPPSGNPGTHTPSAPFPASAGVPPAFPFMGSGTEANHAQQASGGHGGGHSEPGAQTDAGIHINIGESMVSPEQAAEALRAVMQMFGPQMGPNEGGGAPRGPPPPPGSI

SEQ ID NO: 114025 - protein, 169 aa, Triticum aestivum
  Clone ID: PAT_TA_8443.pep
MQGEVEQQAPMQMVLRVKHPSSLSSGSEEASEGEGSSRSALSVFKAKEEQIERKKMEVRDKVFAQLGRVEEESKRLAFIRQELEGMADPTRKEVESIQRRIDTVNRQLKPLSKSCVKKEKEYKEILEAYNEKSKEKAILVNRLIELVSESERMRMKKLEELNKTVDSLY

SEQ ID NO: 114026 - protein, 456 aa, Triticum aestivum
  Clone ID: PAT_TA_8444.pep
MGRKAPPFAPAGRKRKGPSLPFLSPGKRRFIPTPARAATGWASLPDDIARQVAALVLESGVVDYIAFRAVCSGWRTCAPTPRDPTLRIRSLRPVGWVALCDGDAVRPDDACQITFFHRRTARCLRVRLPELQRHRIIGFTDGLVILLHKRATAVRVLHPFTRAAVDFPSLVPVYQELIRNRNCVLRMNAAVCSSVSSTTSVAVVAWFPWSSVVLSADAGHPSWEVIQTNMYLSNTLPFQGQLYGFLQSSRQIVQVYPPKPPTGPVVAHVPQKFGNPLFCKYYLVESDGDMLLVVKSPKFVHPDVEEWRRYIIAIFNVNISIVGHRELIPVTSLGDRALFVSLDRCLSVSSKNLPSISSNSIYLTVSLPDPVVVHCLSSRSFERPTALCQVHDGKEMICTSVRPFTLADHLLTYCNHHEWSNGLMFHEYYSIPESFQGLWKKIRTQDSQLRISRMRD

SEQ ID NO: 114027 - protein, 338 aa, Triticum aestivum
  Clone ID: PAT_TA_8445.pep
GTLGFLVLHFRSPLQSVLKNRMPQDSFRSVVCRSLSKSHPSSSRSKDGSYLERTQCDAPYVVTLQPTVCRSCQSQDWRPSQSNREERSILSQRDYVMGSTLSRHFAEDLLRGAMDLQDSLVMLEKFQTVSQSMRQSTKQRRPGNDEESLDVTGIREALFEASIAKKLVPGSVSSRFDGQLRNSTDELKRVIKDSLYRAKLLSVASNGEQLASLSQSSRSTPNSTAVSKSTKEKKVVPRSSSCPPVQPDKSKSPSLVPTNKTPSLVARLMGLEGLPPHNGNTAKKDETLKTVSSPRAQFDIDMPRSKPTPAEKLPRQSLGKDSQRKGKAGQEMMKTIQV

SEQ ID NO: 114028 - protein, 129 aa, Triticum aestivum
  Clone ID: PAT_TA_8446.pep
LSFGSTPQQRPPPSPYGTIPPRAASPNIAAVPVSLLSCPFLDFDLFTRSKGLMFHEYYVIPSSWKEMLRKITLQDCEIQVSCVCEENEVGSLTSKKKNLGITGRTLALHWKSSHSGASPELILLEQISS

SEQ ID NO: 114029 - protein, 50 aa, Triticum aestivum
  Clone ID: PAT_TA_8447.pep
VRTVKLMCSLQLSIKWMWGNLIYPRSSYLTNHHPVCCMADSDALKVNNEE

SEQ ID NO: 114030 - protein, 177 aa, Triticum aestivum
  unsure (1)..(177): unsure at all Xaa locations
  Clone ID: PAT_TA_8448.pep
VLGDGSLRTAGTAQRLALPESSSTYLLQELKMIWDEVGQEENERERILEELEQECQEVYRRKVNSANMLRIQLHQALAESEAEFTNLLLSLGERSFPGRPEKMNGTLKEQLNSITPALQEMQMKKEARLKQFTEVQTEVQRIASEIAGRSENEVVTVNEDDLSLKKLEEHQXELQRL

SEQ ID NO: 114031 - protein, 358 aa, Triticum aestivum
  Clone ID: PAT_TA_8449.pep
RWWLCAGHGGDDEHEGKAAASTPWRFRKKHNKVCMKAMRGWAIQILTGLEYLHSQEPAIIHRDLKCDNIFINGHDGQVKIGDFGLATFLHQRKTRSIKGTLEFMAPELFTGNYNELVDIYSFGMCMLEMVTCEYPYSECEGKPWIYKKISEGIKPAVLSKVEDAEVRGFIEICLAPAAERLCASELLKNCFLQKDKPIPVPAPPISVSLVSSVTKDGRQSASFMLWKGEFSLKGDMHVTDHVNLSLRFPDPSGCFKNAEFPFDVDQDTSLSVALEMVDTFGRWRRRRQRLWLDSETSLLSLAPDGVPSVAVGRVVVVPESAHSHCSVSLPLLCCCLRCVAVLGWACLPRPCVSSLGLV

SEQ ID NO: 114032 - protein, 77 aa, Triticum aestivum
  unsure (1)..(77): unsure at all Xaa locations
  Clone ID: PAT_TA_8450.pep
SCESVKHELTKHTGVDASLXCSHCQQSTICLKYVPSQVAHFFNKAQTXEQCRVHVLKLNDLGRLEVHVYPCTPFTFL

SEQ ID NO: 114033 - protein, 323 aa, Triticum aestivum
  Clone ID: PAT_TA_8451.pep
MADHKVAQLGPGAACCGWNHCGRRLAAGAVDGSVSVYDSQPSPSSKWQAHEHAIVAVVWLPPDYGDAIACVCADGTLSLWEEIAEDDQLPIWRKCKVFEGGSSHILNVQFGVLLSSLKMVIAYSDGQVKVYELLDSLELDKWQLQAELQNITDPVSRIGKPACISASIAWSPRRGEGQQASFAIGFNSDSPNFNSCKIWEFEEAHQRWLPLIELGSPEDKGERVHALAWAPNIGRPYEMIAVATCKGIAVWHVGFNPESDGRLSTENVAVLPSHNGEVWQLEWDMGGMTLASTGVDGMVRLWQANLNGVWHEQAVLDCNGSHQ

SEQ ID NO: 114034 - protein, 102 aa, Triticum aestivum
  unsure (1)..(102): unsure at all Xaa locations
  Clone ID: PAT_TA_8452.pep
NSXRGTDRTRASAVSRRTSPWALRRKKFATVRMYCPPTSSGQLAPPLPALLQVGATPSTATHSAQLHHPPTPEKRTPSLQGRMESMKSMHCSKCQVNYSDMT

SEQ ID NO: 114035 - protein, 184 aa, Triticum aestivum
  unsure (1)..(184): unsure at all Xaa locations
  Clone ID: PAT_TA_8453.pep
SAXGQENSAATLFSLSMLDENKATIGTLGGIAPLVELLTNGTVRGKKDAATAIFNLILNQQNKVRATQAGIVPALMKVIDDRSLGMVDEALSIFLLLSSHPTCLGEIGTTPFVEKLVQLIKEGTPKNKECALSVLLELGSKKQTLLVHALRFGLHEHLSQIAKTGTSRAQRKANSLIQIAKKCY

SEQ ID NO: 114036 - protein, 107 aa, Triticum aestivum
  Clone ID: PAT_TA_8454.pep
HNGVKQSVNRRGSKARTTKQQNRSSTLIKYKTNRNATHFATSLLQIRTEDRHSQTPRSSPLLQNASLHCLKVAHSERGFRTTKKYIGVKISFLPPSTRPSAAFSKKL

SEQ ID NO: 114037 - protein, 385 aa, Triticum aestivum
  unsure (1)..(385): unsure at all Xaa locations
  Clone ID: PAT_TA_8455.pep
APLPPPPPRDLRPAASSRSSSCSSIPPEAPSSSSRDSEISAPDPFLPHQGPAQPPGRPSLLEPSPPPCYEKYHGYYGGKEESRKSNYTDMVNKYYDLATSFYEHGWGKSFHLANLRNGESIRYSIKGNKHFLALQLELKPVMNVLDVGCGIGGPLREIXARFSSTSVTGLNNNDYQITRGKALNRSVGLGATCDFVKADFMKMPFSDNTFDAVYAIEATCHAPDPVGCYKEIYRVLKPGQCFAVYEWCITDHYDPNNATHKRIKDEIELGNGLPDIRSTRQCLQAVKDAGFEVIWDKDLAEDSPLPWYLPLDPSRFSLSSFRLTTVGRIITRNMVKVLEYVGLAPEGSQRVSSFLEKAAEGLVEGGKKEIFTPVYFFVVRKPLSE

SEQ ID NO: 114038 - protein, 170 aa, Triticum aestivum
  Clone ID: PAT_TA_8456.pep
GWPPSPCPLPCRRRCRHWFALPATTTRPPFNCLARSAGRTHTMLPTDCVVFIALLVLLGDAATAVAGIRVDPAMMIRQPLDSIPTFREAPAFRNGAECAGGDKVNVAMTLDANYLRGTMAGVLSILQHTACPENVVFHFLAARMDGDLVAMLRATFPYLDLRVYRFDPSR

SEQ ID NO: 114039 - protein, 225 aa, Triticum aestivum
  unsure (1)..(225): unsure at all Xaa locations
  Clone ID: PAT_TA_8457.pep
METARRRHAGAAGPAFASAILVIFAFSCVESKPARARTPEHASGPASAPAHAPASAPAPALGPHQAVPSHALFNYKDKDPTGPDKWAKLNKGWAACGDGKKQSPIHIRNVEINKDMGPLEQTYKSSACTLENRGHDFILQWKGGNGKLTIEKXVYVLQQVHWHVPSEHTANGTRFDMELHMVHEDSSKARAVVSVLYSTKEGDPDKTLTDLAPYFKRLAGKYLGA

SEQ ID NO: 114040 - protein, 223 aa, Triticum aestivum
  unsure (1)..(223): unsure at all Xaa locations
  Clone ID: PAT_TA_8458.pep
TPLLTATSTTAASGHPSSSSSPTPASPTSSTAPPPAPQLCSTPSSRAVASRSPSAPSTRRTSLTCASTPXAWATPCSPTRLASSPPRRTVASSCYASPSPSPAILSHSVPTSTAPEKSTSSTTPASLCLSTFGTRNPAASPAWLTARLPSCXVQPTPTHQQPRPQTTTPSSRRPQLSPTSPWSRRPQLRPTIPRSRRPQVRPTTPWSRPPRLQQLQLRHCGAI

SEQ ID NO: 114041 - protein, 181 aa, Triticum aestivum
  Clone ID: PAT_TA_8459.pep
MAGLARFILLLLLVLAVPVAQPTPYSDNLQDACNKTLFPKLCIQALTGNPETRTADARLLAELSVNFANQAGTKLAATAHNELNGVKADDALFKCLDSCSDDIEEAVAHLSGLSREVTDTKFLEVKSWLSATLGGSSTCDDSCKDAPASDAKLFVVAESIEFEKLLRVTLDLITEASGPHV

SEQ ID NO: 114042 - protein, 142 aa, Triticum aestivum
  Clone ID: PAT_TA_8460.pep
HDETMQTLGLNQQLNVSTWQQKYSGMVAESVNLCIQHMDNQKHLTGAQIGQHGSTNPTSNQLVPHRGKEPLQWIVCTEKSSAGTRQPSGISCQAPLLRGPQGAGQLHFSRLWYPNKHVGNSSSVSLVILVISQQQNITCHFN

SEQ ID NO: 114043 - protein, 127 aa, Triticum aestivum
  unsure (1)..(127): unsure at all Xaa locations
  Clone ID: PAT_TA_8461.pep
MPTIQGAQHHIHLLPAKGLDREPYAYWKGNPEIATIRQELIKCDVSSKQEXNTRIYKQDWIKESKAGYKKSYLASLCTHRYKIYIEGSTWPGCVLLSMARVQPXYCDFFSRVLMPTQLYRPVPVAAG

SEQ ID NO: 114044 - protein, 210 aa, Triticum aestivum
  Clone ID: PAT_TA_8462.pep
PGTAMDLEGKICKLAARAAATSPALVRKAVGALERSSAARAAAEVLIYQFLSAVFIFSGFLNLVAVEACGGKNCTVASILFELSYHSGMIALLLLAPACVLFFLRAAGSTSDSEVEDEDRSEIFPWPLIWPVLGFITVAASAAPIAFVLQMCGFREASYQVCVAAVLCSALLSALFYIGAAVALWRMNPQERSIAGMLRMSLRPSNKVAE

SEQ ID NO: 114045 - protein, 139 aa, Triticum aestivum
  unsure (1)..(139): unsure at all Xaa locations
  Clone ID: PAT_TA_8463.pep
PRVLVSLPHAGHDSPATRTGTTSTTSSNGRRPPCIAGRGRSSPRTRGRPCSSFHTLAVDPIRTASLASSAASPRGRLTLGRPWTRWTQGRPCCPAPVRGCWRGPCLRKTELRHAGXFSMANXGKGPDEGXKGSPTPKHG

SEQ ID NO: 114046 - protein, 92 aa, Triticum aestivum
  Clone ID: PAT_TA_8464.pep
RHGARTGRGAARADAGDDDEDELAHRHGRGGCPAARRDGDGACPDGLDGRLPAAAEEGQRRRWQLVFRLHERPMGRIIWRAPPPQFARAWFH

SEQ ID NO: 114047 - protein, 87 aa, Triticum aestivum
  Clone ID: PAT_TA_8465.pep
GTRVDYSSVLDVSENLGYGESSSNSSNWNSAPEASNALEGEALHWASESKVEPFAGYAGDEDDKFALPCHGQQEHSMAHFDFNLEYF

SEQ ID NO: 114048 - protein, 213 aa, Triticum aestivum
  Clone ID: PAT_TA_8466.pep
RKKFPFSRSPRPVMAATAPGAGAVEVSMERQGQGVGGREDQGRGVQGADDRTVRGADGPRNRCAGEKGAGHRGGDGSRADARRVLRRPLGHAQGAPLLPRHLALGGGEALPPPNRRLRHRHHRRVRGQRRPRPRLRQPPQPVQPRNPTGVPRTLGSPSRFFGSGFGFGFGFGFSPRACCGQWRGCCMLRDDRLEHPAPFISSPHCHPSRLSWF

SEQ ID NO: 114049 - protein, 157 aa, Triticum aestivum
  Clone ID: PAT_TA_8467.pep
SNPSIRVQISYVRYSCPNCAPAPPAPLPARPPPVSTPAPAAPPPPPRAPPAPAPRSRPAGVPASPGPPSAPSAPAASQASERNDTLLGNGVIGILAETVNMWERRAPLTPSHCARLVLGGGKRESGVNRIIVQPSTKRIHHDAQYEDAGCEISEDLS

SEQ ID NO: 114050 - protein, 101 aa, Triticum aestivum
  Clone ID: PAT_TA_8468.pep
SSVTIESNSSLELEWPLFGVAITSSARPRSSPWSAAASRHTRAILLLDLGAAALLYVEPLRIAAQILRLPATVAAPPSYLGMDVEAEMKGSRGYGVGCWAA

SEQ ID NO: 114051 - protein, 253 aa, Triticum aestivum
  Clone ID: PAT_TA_8469.pep
MEVVALVSGGKDSCFSMMRCLDYGHKVVALANLIPLDDAVDELDSYMYQTVGLPTAAPFALCAGLPLPRRRSCGSTRDHALKYSVTAGDEVEDMFALLSEVKRRIPSIGAVSSGAIASDYQRLRVESVCSRLGLVSLAYMWRQDQTLLLEEMIRRGIVAITVKVAAMGLKPSAHLGKELAELKGHLLQMNESFGINVCGEGGEYETLTLDCPLFRNARIVLDDFEVILHSADSIASVGILHPLAFHVEPKPGS

SEQ ID NO: 114052 - protein, 166 aa, Triticum aestivum
  Clone ID: PAT_TA_8470.pep
MEQTGLCFLCFAFLLLLTCGESLEDKGYGASAYAVHWDPDHPHSEERGYGASAYAVHWDPDHPHSEEKGYGASAYAVHWDPDHPHSEENGYGASAYAVHWDPDHPQSEENGFGTSAYAVDWDPDHPHSASDVPEATAKHHQIKGQTGMLFLKKICVALYFRKDHFP

SEQ ID NO: 114053 - protein, 58 aa, Triticum aestivum
  Clone ID: PAT_TA_8471.pep
FIECSSRNLHYKQKCRLSYQIMYFPLFFCGNYKGPICFISHLLQIVEFSCTWALDNMG

SEQ ID NO: 114054 - protein, 101 aa, Triticum aestivum
  Clone ID: PAT_TA_8472.pep
DVFWIPRHLPFVQVASRGGPFVFFGFTTSARRNKPQFLTGPTSVLRMMLGPELAAGLGVPQKELREVVEAQTVAVIEPPLPEKEKGRKEREPFVMKQVARE

SEQ ID NO: 114055 - protein, 355 aa, Triticum aestivum
  unsure (1)..(355): unsure at all Xaa locations
  Clone ID: PAT_TA_8473.pep
PRVRPRVRNVIAFTLFELETITKSFRADYVLGEGGFGTVYKGYIDENVRVGLKSLPVAVKVLNKDGHQGHREWLTEVNFLGQLRHPNLVKLIGYCCEDDHRLLVYEFMFRGSLENHLFRKTASPLPWATRMSIALGAAKGLACLHNAERPVIYRDFKTSNILLDSDYTAKLSDFGLAKAGPEGDETHVSTRVMGTYGYAAPEYVMTGHLTARSDVYSXFGVVLLELLTGRKSIDKSRSSREHSLVDWACPKLNDKRRLLQIIDPRLEGQYSVRAAHKACSLAYYCLSQNPKARPLMSDVVETLEPLQLQGSDARFRSIHVPDYRIHRRLTGNNVHYRAIPNPKCAPAAVPACRVR

SEQ ID NO: 114056 - protein, 594 aa, Triticum aestivum
  unsure (1)..(594): unsure at all Xaa locations
  Clone ID: PAT_TA_8474.pep
MMRRGVAAMAPLLVLLLLLSGWSAMGTPRLRERWEEGEGEWRPEEEAKGGGGGGGTGKGLFLLDKVEKVVESEGGSVHVVRGLPASGVPEAPWQHGGWSAGCGACREGLMHIGFITMEPKTLFVPQYIDSNLILFVQRGDVKVGWIHKGGLVEKQLKMGDVLQIDAGSTFYMVNTGKGQRLHIICSIDASDSAGFAPYQSFYLGGGGKRTSVLAGFEPKILVTALNTTFDELERILPVKPLGPFVSYTTESGGKEHGQGGKRDVGENGRESEPWRPVGRGNDDERGSGQSTWTWSWRKLMSRFIGEELNKKSDKTVRAPEPYNLFDHEPSFRNTYGWSISVDKHDYQPLDHSDIGVYLVNLTAGSMMAPHVNPRATEYGVVLAGEGVIRAVCPNGSLAMSGEARAGDVFWIPRHFPFVPVASRGGRFLFXGFTPSARRNQPQFLTGRTSVFRVIPGPGARGRGWACPHNEKAAKKVVGAPDGRSHRASSARRSSTRCTRLSRVVQKQVRGARLSVRRGICLMLYGAAERSNPSSCWPNRPYLIHVFAPCVRSAPVASPCVPCYSSVFAPASCRRRQLIKRRLPSPLVRRGHHQT

SEQ ID NO: 114057 - protein, 335 aa, Triticum aestivum
  unsure (1)..(335): unsure at all Xaa locations
  Clone ID: PAT_TA_8475.pep
AANSARGTRVAFEAACAFLEDRESGLEGYDYEPVASHGGFVALRRRPSPSAVVLPGHSPPPSDLVVCNPVTGXHVSLPHPSIWDESFVLLAHGGTSFSLQILNLELADAGMLQIQTFSSAKGKWDGVVATYANLPLGAPSRFVRPSPLVLDGVAYWLCKSESKCLGYHVLALPLDGQRQPTPINFPIKVPETRGRGDNFNTEDILLASMTVNGTRRLTLAVVANVTISLWTLDDHQAEKPARWTRHKSFDLWNITLERKGRLPSREKGDRVALECFSELGESGSLLFHFYHRMLYRIDLQTEKVSLNLAGIYCKRSSSNMCEYHVDDAAVLKLKS

SEQ ID NO: 114058 - protein, 160 aa, Triticum aestivum
  Clone ID: PAT_TA_8476.pep
IAIVDCKATASATWYFLSSTQPLQQILPWSTHYPVPFPTWRQALVRRSGRKSSLCDCTDQPSLGAAARREWDAWVSSTSRPPWRCSGGEPTGAGFRPDAAAQQSSGGGGGSEFRRRSVSGATRPRRWAGAVQRCLGAVSRALCLSTERSARSGREASLLD

SEQ ID NO: 114059 - protein, 141 aa, Triticum aestivum
  Clone ID: PAT_TA_8477.pep
MPQPALPPSAAATADPEPSGTPAREMDDEDLVEELLATVNSARAYSEFRRTQRKECHNLLRWLQLILPLLEELRDSAPRLTDDAYRRLTLLGRALSAARRLLRSCNDGSKIFLALESEAVLGRFRAVYEKMNSALDGMPYA

SEQ ID NO: 114060 - protein, 458 aa, Triticum aestivum
  Clone ID: PAT_TA_8478.pep
MVAHQEAEATTTTTVDPMRLASRWRSPAEWVATAAALDSEPMPSELNTANSSGLFAVVSVDKMSVKYLGVNHHGHDVGVVQADCPAPMHRAVYYFEMTVRNAGLKGQTSIGFTTESFKMRRQPGWESQSCGYHGDDGYLYRGPGKSESFGPKFTSGDIIGAGINYIEQLLFFTKNGSLIGAFPKDIKGPLYPTIAVHSQDEELTVNFGKEQFCFDIEGYILEQKMTQQSISDKLYLQPDISHWIVRSYLLHYGYQDTLNSFDAASETDPPANHQTGYGEPPEMYGLSHRKILRQLIMNGDIDSAFKRLEEWYPQVLKDDVSVICFLLHSQRFIEYIRAEQLEGAVKYARANLANFLAHKAFEGLLKESVALLAYEKPSESCIGYLLESPQREFVADAVNAAILSTNPKMKDPESCLYSCLEKLLRQLTVCSSELRAFNSDQGDVFLLHKEIYERSRRP

SEQ ID NO: 114061 - protein, 366 aa, Triticum aestivum
  Clone ID: PAT_TA_8479.pep
TRPRRSQPHAPPRARAPGPRPPPPPPPPRLRPLASAPAPPPARAPGPRPPPPPPPLVPPPPPPRPPPAGSPLPAPPPPPRPPRPPRPPRRGRPPHPRAPLPAPPPRAPGGAAHVKVEVPAVEPLRWERGARVMPSRDAVVKVFCVHTEPNFSMPWQRKRQYSSSSSGFIIGGRRVLTNAHSVEHYTQVKLKKRGSGTKYLATVLAIGNECDWATWTRDVDEFWKGVLPLEFGLLPALQDAVTVVGYPIGGDTISVTSGVVSRIEILSYVHGSTELLGLQIDAAINSGNSGGPAFNDQGKCVGIAFQSLKHEDAENIGYVIPTPVIKHFIQDYEKSGEFTGFPILGIEWQKMENSDLRKALGMKSDQ

SEQ ID NO: 114062 - protein, 185 aa, Triticum aestivum
  unsure (1)..(185): unsure at all Xaa locations
  Clone ID: PAT_TA_8480.pep
MAADSSMGFHQGITAAASVYNHHHHHHHNNNMLSFQSSSSDVTMGGAGMGLVSMSGGPSSTAGLYHSSPNNHSSSNSNNNGGVFGNVPVVVQSRSSPGGASRGAGGTTASKYKFVTGSPSEWSDRELNILNEGLTRYAREPNIMRYIKIAAMLPNRTIRDVALRCWWAAXKDRRKKPEGFLQGKR

SEQ ID NO: 114063 - protein, 83 aa, Triticum aestivum
  Clone ID: PAT_TA_8481.pep
EGLTTMHSVVAAEVPALQFLQSALLAANLNTQVTLSCPHSMEMIPMAFPPSTATFNASWSSIMLPYLQFLKSTTTLALLVLGW

SEQ ID NO: 114064 - protein, 129 aa, Triticum aestivum
  Clone ID: PAT_TA_8482.pep
LNIKSMHGPQIMKKQNRRTNMFTSYGKMFFIKNLLHLVSFCVSFRSLVHKDFPRPHYPALPLIWRIPAKAARPREGGRVGGSRAMREGGGLVRWVVHLLQQLQVVRPDPGQPSIAVTEDPRSPARALEG

SEQ ID NO: 114065 - protein, 182 aa, Triticum aestivum
  unsure (1)..(182): unsure at all Xaa locations
  Clone ID: PAT_TA_8483.pep
RHEGRRQAVARXEENKVTLSGLLNFIDGLWSACGGERIIVFTTNHKEKLDPALIRRGRMDVHIEMSYCCFESFKVLAKNYLHVADHELFHEIQQLLGEVNMTPADVAENLMPKSKKKDVDTSLARLVKALKEAKEEALAKALAGAEEKEETEDDDEEDDTSSSEEEENGKNKKLYLPAKWEE

SEQ ID NO: 114066 - protein, 832 aa, Triticum aestivum
  unsure (1)..(832): unsure at all Xaa locations
  Clone ID: PAT_TA_8484.pep
GGFASGFKTPEEETFETRLYICKGKRAIRIKQVPFARSSLNHDDVFILDTENKIYQFNGANSNIQERAKSLEVIQHLKEKYHGCVCDVAIVDDGKLQAESDSGEFWVLFGGFAPIGKKTVSDDDVVLETTAPKLYSINGGELKFEDIPLTKAVLENTRCFLLDCGAEMFVWVGRVTQLEDRKAATKAVEEFIINQKRPKTTRVSTCLXALAALSNAFNPSSKPKTPPPSRSGQGSQRAAAVAALSSVLTAEQSGSSENLRASKTSTTSEKTEAEVVVWCIDGNTRSPLPKEDNGKFYSGDCYIVLYTYHSGDKKEEYYLNYWIGWESTADDLGMGAELANTMWNSLKGRPVLGRIYQGKEPPQFVARSRPPGSSPRRISSGYKKITEEKGAASGSYSPDGIALFRVSGTAIHNNKTLHVDALATSLSSTDCFVLQTGSAMFTWHGNSSTYEQQQWAAKVAEFLKPGVTVKHCKEGTESSAFWFALDGKQSYTSKPIMQDTIVRDPHLYAFSIRKGRLEVTEIFNFCQDDLLTEDLMILDTHGEVFIWIGQCVEPKEKQKAFEVGQKYIEHAMSIEDLSPYVPLYKVSEGNEPCFFKTYFSWDNTKSVIHGNSFQKKLSLLFGXAQRQKQATDSRPPSSGDGPTQRASALAALSNAFNPSSKPKTPPPSRSGQGSQRAAAVAALSSVLTAEQSGSSDNLRASKTSTTSEKTEAEVVVISPSEASPRSEAGESSEFQSEKDVAVDEVPSEVDVAEPEALEVPEEQETEHVGEATFSYDRLISKSTDPIRGIDYKRREAYLSESEFQTVFGITKDAFYQQPGWKQELQKRKADLF

SEQ ID NO: 114067 - protein, 165 aa, Triticum aestivum
  Clone ID: PAT_TA_8485.pep
MTIYLAREASKVWRKVCAETTTELPMLREKWPLLLAGIVFQYIHGLAARGVHYLHRPGPLLQDLGFMALPELGQDKNYLSECTFVFIFFSFFLWTFHPFIYHSKRFYTILIWRRVLAFLVASQVLRIVTFYSTQLPGPNYHCREGSSMATLPPPNNVLEVLLINF

SEQ ID NO: 114068 - protein, 122 aa, Triticum aestivum
  Clone ID: PAT_TA_8486.pep
PNPIRIPPTTGRQSMALRNLAKKLRIPTSAAARLPSAPNPADFRFPSDPGAWRASVSRLESARDWYEFQRARYDDVTTELKNFRREVVWTERAANLFDLVYKVGCPIVVGTLVIKVIVYRAM

SEQ ID NO: 114069 - protein, 196 aa, Triticum aestivum
  Clone ID: PAT_TA_8487.pep
HTPDKDTHATNHLFLHGYLLLQAVPSYHNQECSRQVHTHRALMNRAARGFSPPHLLLCEAPDKAIPFNDHTTNDNRTTHLVSQIKQVSHLFRPHNLKPEVSKLSCHIIITCPLELVPVSGALEPRNGRRRNARVRWEPESSRGGGRREPGSSRGGDPQLRGQVAQRHGLPAGGGRGSRSRTMLGFGLGVSCLVRMG

SEQ ID NO: 114070 - protein, 91 aa, Triticum aestivum
  Clone ID: PAT_TA_8488.pep
RKQRFLKIDACRHSLTLFYIIRRTRVYPSRTRVHATVCKISEGRLPKAALAATPRGYKRRRWAQQQGHTKRRESTEHSKHRGLSTRAPLPS

SEQ ID NO: 114071 - protein, 158 aa, Triticum aestivum
  Clone ID: PAT_TA_8489.pep
MAMAASRSLWASRAASYLKISAFPRAFSTVLKDLKYAETHEWVKVDGDSATVGITDHAQDHLGDVVYVELPEVGASVSQGTNFGAVESVKATSDINSPVSGEVIAVNDELLEKPALVNGDPYEGGWIIKVKVSDAGELNSLMDDKKYSKFCEEEDSKH

SEQ ID NO: 114072 - protein, 59 aa, Triticum aestivum
  Clone ID: PAT_TA_8490.pep
MANSLIPALARMTLLLGPPGAGKTTLLLALAGTLPSSLEVTNSLFFFFSLQISRFLVPN

SEQ ID NO: 114073 - protein, 313 aa, Triticum aestivum
  Clone ID: PAT_TA_8491.pep
MAEAAPPPLLGGLPDEIAIWEILVRLPPKDLLRCRAVCRAWRCTTSTRDFLLTHHARQPSLPLSYVKNYGGDLFTLDIISFDHQGGAATPQTVARLRRHILIPRVSCDGLIVFWIECKAGQQLFICNPATRQYGCLPMLFGGPLSAVGMPFGAPRPVAVGMYSHSPTGEYRLLLLQKAEAPDGSSLVYTYALGSSQPPWHLHIEGPNLNELDYEHEVWAFKYRVEIPYAELTLQFGLFYPRDCVVFTSWVGDVAVLVPFGRWLLQLDVGGKLVASFEDSGGLIGQPYQLKQTLVQHTFFLTLEGYVVNGSPFI

SEQ ID NO: 114074 - protein, 71 aa, Triticum aestivum
  unsure (1)..(71): unsure at all Xaa locations
  Clone ID: PAT_TA_8492.pep
LIFLLIFGFTIVNLFEGLHDGIILCRLMCRLFCHAFICPTLPRYLKVIAPSHTHXKKLHNCTMAIQYIKQD

SEQ ID NO: 114075 - protein, 386 aa, Triticum aestivum
  unsure (1)..(386): unsure at all Xaa locations
  Clone ID: PAT_TA_8493.pep
PVRNFRVDPRVRSDDSEGGEDGDESEDGSEGGKDGDAHAGDVEVWDKSYTAKIKRAQRAAKEAAGDDGSAAGDAAPGDDPKXLGXXKKTYYDDHEQDADDVEFDELRRLQAENKLSMKDFGLEDDESDEEGNKPSKASDHQVKLADEASPLESYTKLREDFAVLSRDEKMDVVYSSAPELVGLLADLNEAHEQLKAIGPVTPELAAGQGKNKGKMQPLEVKRACLLAHCQAITFYLLMRAEGLSVQDHPVIARLVETKNMVQKLANINLPSQDGDTEDHFMPDSSTLDEVNKAVALENEGKSSNLLDMDKDEHMGLQSIEMLKRRAILEEGLKQKGLSKLKPKLSKTLATNSRKKLQTLDDFDDEVQKNSQVVKPTKLLVNAAGSV

SEQ ID NO: 114076 - protein, 292 aa, Triticum aestivum
  unsure (1)..(292): unsure at all Xaa locations
  Clone ID: PAT_TA_8494.pep
FVPWXLLAVLGTLPCTLLIPGLFFIPESPRWLAKMNLMDDFETSLQVLRGFETDITAEMNDIKRAVASANKKATVRFQELNQKKYRTPLLIGTGLLVLQNLCGINGILFYASRIFRAAGFTNSDLATCALGAIQVLATGVTTSLLDKAGRRMLLIISTAGTTLSLLAVSVAFFLKDNLPHDSHSDYILSMVSLVALVAYIITFSFGMGAIPWLIMSEILPLGIKSFAGSFATLANMLTSFGVTMTANLLLSWSAGGTFASYMVVSAFALVFVILWVPETKGRTLEEIQWSFR

SEQ ID NO: 114077 - protein, 257 aa, Triticum aestivum
  unsure (1)..(257): unsure at all Xaa locations
  Clone ID: PAT_TA_8495.pep
LSFDAWADAWADAWADAWADAWADAWADAWADAWADAWAEAFRGNFSQLSSLIRVIADNNGISEEQAPAAGLVADLPLQDSVLTRRLVEDGAFTTIISKVIMIRQGESRGGRFVNPFLEGLVRIVSRITFILEDDPDIIAVAREYNLTALFSDLLQMNGLDTVQIVSATALGNLSGQPKHLTKILPPPQRGIVFFXYFHASVKSPLETGXCRVHPGVCSVQXNSXPLXRKLWXNLVACLXHNNEKFLNLNNTSTLRN

SEQ ID NO: 114078 - protein, 217 aa, Triticum aestivum
  unsure (1)..(217): unsure at all Xaa locations
  Clone ID: PAT_TA_8496.pep
FSSTRARQIENDDRRRRRRVRVRLPRSSRSADGDGLSGPTIGAAACDAARGATRCRGRRRALASRFTGTLRVSGRARGGGSSPPPDGAVVPAARAAAAASASPSLPVRHSRLVPARPAGSPPCSVLARSEVLRRAADDILRRFSACVRQRDEGKGRADHVHGREGSSSXXQPSPSSGAAAIGICSGPRRKXADATGESLQRSCAPFAXXIXXCCRXX

SEQ ID NO: 114079 - protein, 152 aa, Triticum aestivum
  Clone ID: PAT_TA_8497.pep
MLIFYLEMTDWDVMTSRQVVNFVHQCLQSEEKDPGTICEKLLDSCLREGSKENLTIILVQFKATAHGGAEANVAHGGAEANGAHGGAEANVAHGGADRETATDDIESKGSGSHSPKPLEIEAQESGSKKESAPRMLQLGLAKARGMLGVPTV

SEQ ID NO: 114080 - protein, 177 aa, Triticum aestivum
  Clone ID: PAT_TA_8498.pep
MATLQDLGVSAFINILGAFVFLLLFAVLRIQPINDRVYFPKLYIAGKRAADHRGARRAINLNLCTYFKFLSWVPGALRMTQTELIHHAGLDSAVYLRIYTLGLKIFLPVMVVALLVLIPVNVSGGTLLNLRKDVMFSDIDKLSISNVSPGSNRFFIHLLMAYVFTFWTCFMLYQEYS

SEQ ID NO: 114081 - protein, 98 aa, Triticum aestivum
  Clone ID: PAT_TA_8499.pep
CNAQGYDISVVLILVVQWRAFMDGRRTTHAIGRAASLKVVSIATDRSCSPCRRPYRQVCHDGRNLSTGSSSHSLSATRFMNHHDECDEGFLHQNNREQ

SEQ ID NO: 114082 - protein, 172 aa, Triticum aestivum
  Clone ID: PAT_TA_8500.pep
MPRMASLALARWVLLAAMAARLAGADDPYRYFTWIVTYGPINPLGAIQQGILINGQFPGPRIDCVTNDNLIVNVVNNLDEPFLITWNGIKQRKNSWQDGVAGTNCPIPPGANYTYKFQAKDQIGTFTYFPSVALHRAAGGFGALNVYQRPAIPVPYPPPAGDFTLLVGDWYL

SEQ ID NO: 114083 - protein, 50 aa, Triticum aestivum
  Clone ID: PAT_TA_8501.pep
DPYTYVRITCINRYCKPHGGWLETPSSSSGNLHWPMMIRFPSLTLKQGDQ

SEQ ID NO: 114084 - protein, 59 aa, Triticum aestivum
  Clone ID: PAT_TA_8502.pep
KSLTTRLDAKRVGSFTKYLLLVSEVKDVLYSEEIVLGSTTCQTLIDVQSGGPPELGPAI

SEQ ID NO: 114085 - protein, 124 aa, Triticum aestivum
  Clone ID: PAT_TA_8503.pep
MSSAAGAPSDGGGDRPWQSYHTAYTNAKAGMEGVDKEKVLKVIYEMSKGSKYFENEQKKEAITKLKIEHLRAQCAKLTDNDISHFQKVAEKKILELEASRDLSKIWLHTDMDAFYAAVETLENP

SEQ ID NO: 114086 - protein, 135 aa, Triticum aestivum
  unsure (1)..(135): unsure at all Xaa locations
  Clone ID: PAT_TA_8504.pep
IXSIAQQISYNLLLHARQQLRLAGTWIYPLHPPAPCEPAQYKLISCSIHLYRLVSPLDMVEDINKMVEVGMPLPAAAEDLTHQCSWMVVHQPPALWIQCPAWGLRHRPRGAGSGLACELELHHGRPAVVEPDVLL

SEQ ID NO: 114087 - protein, 153 aa, Triticum aestivum
  Clone ID: PAT_TA_8505.pep
PSPLHHARSFLQLSTWSPPPAVGSDGLTAFALRLAKKLPAGDGVVAFSPLSIYTTASPPWWSPEARGKTLEELLALLGTSSPDEVAGFVRGLASDPSSSGGPHITYACGGLHKEKMELTPSLPAQRRSPIRPRYVQSTLTRSALSSCSCCRQC

SEQ ID NO: 114088 - protein, 127 aa, Triticum aestivum
  Clone ID: PAT_TA_8506.pep
GPRGRPLPPFRRRPTADAGPSPPPGPSPCPPLRSAAPVPGTPAGHRPGLPRPPQPSAPSLAGVPGSLGRRRRRAPQAADRQSPLRAPTVGRPSDPQPQDTYEATGPTGFEAKGAILRTIFREDERGV

SEQ ID NO: 114089 - protein, 312 aa, Triticum aestivum
  Clone ID: PAT_TA_8507.pep
REGKIEELLREVGDADEKSTLLETTVQRLEERLTENDALSTTERQESEATKKLLNEVQGKNEELLKKLEDAGKNIVHYQDTTQRLEEEVAAAGVSLKDERQQNDVIMKQLADAQVEIVELQRNLEGADKRNSLLQDSLQRLDQGASAREAVLLAEQQEKEATSKALAEALARIEGLLEELASANSNVHLLLYTLHRLVEGATTTDALYLEEKHAHDQTKKVFSEAQEVNQELLRKVEEADKNIGHLLENVERLEKDAMTRESLLLKTKQSYDDTITELFEAQETNQQLTSKIEDSDNKIGLLEVSVKRLEES

SEQ ID NO: 114090 - protein, 138 aa, Triticum aestivum
  Clone ID: PAT_TA_8508.pep
MIGAAVEPAAGTHAVPILPSILSISPRLPPLYLLPRRPSRHSHGAPPPPASTTNRRDGSRPPPLPHRSPPPGTLPPSSCYRSDRGSGAPPRPASTTNHRDGSRPPPLPRRFPPPGSLPPFSCSRSGSGVGPHPHRKHF

SEQ ID NO: 114091 - protein, 153 aa, Triticum aestivum
  Clone ID: PAT_TA_8509.pep
GTRDAASCAVCLEDYACGERARELPCRHRFHSQCIVPWLEMHSSCPVCRFQLPADDDPKSSCGSGSGSSSTTTTYVTYVSAEVNDNVDGHGNESGDEAAGNAAVERQDGDVEGEGNASRLPASIQWLNSLFSPQAASPSSTSTSGGSSRHFED

SEQ ID NO: 114092 - protein, 267 aa, Triticum aestivum
  unsure (1)..(267): unsure at all Xaa locations
  Clone ID: PAT_TA_8510.pep
MASFMAAVLVLLLLASSARASEADPAPAETQQNVFIVDNYGARGDGKHDDAQPLAKAWNAACSSSRPAVLLVPEGKTYLLSSVTLSGPCKSSVVFMVKGTLVAPRSRSAWSQNDTSRWILIQGVTGLTVSGGGTINGNGDVWWTNSCKVNKALPCTKAPTALTFHXCNNLQVENLKLVNSQQIHLSVEDCSGVQLARLSITAPGTSPNTDXIHITRSKDXQAKDCVIKTGDTASHREWNHIFVICLCPGMNTSGAKNTIRRGYMIVT

SEQ ID NO: 114093 - protein, 210 aa, Triticum aestivum
  Clone ID: PAT_TA_8511.pep
MGIPNLLRFMKPFIEPVHIKKYAGQRVGIDAYSWLHKGAYSCSMELCMSPRSAGARRYISYFMHHVNLLRHHKVVPVVVFDGGSMPCKSATDEDRHKKRELSLVLGKEKLKQGNTAAAIDLFRKAVQITPSMAYQLIQILKTENVEFVVAPYEADAQLAYLATLDADQGGIAAVITEDSDLIAYGCTAIIFKMDRFGNGEEFIMEKTLET

SEQ ID NO: 114094 - protein, 65 aa, Triticum aestivum
  Clone ID: PAT_TA_8512.pep
FLTLRLIWRANDVARLCLAYPNSLPNHKKAQHDQVLATREDNAVEDLMVSFTYLRLGPDLFQPVY

SEQ ID NO: 114095 - protein, 190 aa, Triticum aestivum
  Clone ID: PAT_TA_8513.pep
GKVEFDDEGKVRGVTSEGETAKGKKVVCDPSYVPEKVKKVGKVFRAIAIMSHPIPNTAESHSVQIIIPQKQLGRRSDMYVFCCSYSHNVASKGKFIAFVSAQAESDNPEAELKPGIDLLGPFDELFFDTYDRYEPTNDPSSDNCFISTSYDATTHFESTVMDVLSLYTKITGKTVDLSVDLSAASAPEDD

SEQ ID NO: 114096 - protein, 211 aa, Triticum aestivum
  unsure (1)..(211): unsure at all Xaa locations
  Clone ID: PAT_TA_8514.pep
YECQFDGYQDTLYTHTSRQYYRDCTVSGTIDFIFGNAQVVFQNCILQVRKCMENQQNIITAQGRKERHSAGGIVIHNCTIXAAXAEFKDHMGRLRTFLGRPWKEHSRTLYIQSEIGDLIDPQGWLPWLGDFALTTCYYAEVDNRGPGAGXDMSNRVTWKGVKHVTYRQAQEKYTVERFIQGKLWISKYGVPFIPGLLPQEQAAHTDDTEPS

SEQ ID NO: 114097 - protein, 333 aa, Triticum aestivum
  Clone ID: PAT_TA_8515.pep
SARGFGSRQKQPAGYGFYFPAKDDHADEYTSNSMMKKISRLACILEEERSPCDEGVDQQSSPRDSASSKKDEVAVADNDIKITSLISTAELMKKERSTDWLREFKEWMDENTENTDGDSLYVDFTNRNGSQKQQNRREKLNIESSKSVTDLAKTSEGGSSSNLVESKLSSTDDACNGANGFTAGSLNEVNADQTHVRVHLNSAIQLPPLEFVGTSHPDSFSDVEGGANFLHTNGTPSNATSKLIEPSPSFAYPSPQSPPQYKEDILRRRLFMEEEFLQSSGDFQCVGSLGSGSSCSDDSSGDLCSCNSEDDCVAIQTKRELALNGQIASFPYA

SEQ ID NO: 114098 - protein, 280 aa, Triticum aestivum
  Clone ID: PAT_TA_8516.pep
MEYEISTGHNALERMLIDGSAEPMDLPLSLLEDITNCFSDDQQIGSGGFAVVYKGMVGNEIIAVKRLSRNMHESKFHKEVECLMKAKHKNIVRFLGYCSDTQGKIMDYEGKMVMADIRNWLLCFEYVPNGSLDKYITDASHGLEWRERFEIIKGTCDGLCHLHEKRILHLDLKPANILIDDHMVPKIADFGLTRCLEKEQTHVFTSNLCGSLGYLAPEFYSGQVTFASDIYSLGVIILEIMTGQKGYSEDKNGLARPTIRPTMCTESVPPEGNTSLRPQG

SEQ ID NO: 114099 - protein, 229 aa, Triticum aestivum
  Clone ID: PAT_TA_8517.pep
AVLALFVAGIFCIFLAAPRPARGRILRLPRSLADVRLLKDNLAVYASEHQANFVLGYCSIYIFMQTFMIPGTIFMSLLAGALFGVIKGGVLVVFTATAGASSCYFLSKLIGRPLVCWLWPERLRYFQSEIAKRKDKLLNYMLFLRITPTLPNTFINMASPIVDIPFHIFFAATLIGLIPASYITVKAGRALGDLRSVRELYDFKTLVVLFLIGSVAVVPTILKRKRTYE

SEQ ID NO: 114100 - protein, 103 aa, Triticum aestivum
  Clone ID: PAT_TA_8518.pep
PGRAQRQRDPRGTAAAQEGPVSPDAQRAPRQPSAECGEMRHFPHQAAEKRPVVMMQPASVGQLTEPLTQPVHHVAAHATVQSDIYRPYKFFFPFSFLKKKSGL

SEQ ID NO: 114101 - protein, 48 aa, Triticum aestivum
  Clone ID: PAT_TA_8519.pep
RNQFYSLALKHHAYHNLIIVHRFKMNYICNLTRILSSFIISNFHAKKK

SEQ ID NO: 114102 - protein, 152 aa, Triticum aestivum
  unsure (1)..(152): unsure at all Xaa locations
  Clone ID: PAT_TA_8520.pep
MWVEILCGLVACKLIRAVFFSDDGLDQLAGLDSSHSDLCFAVAARLERLYGGRCFVGLRIPDPDAGEXRQHVDVVLVTKREVMVGAIXNVSGFLLKVDKGWXLGSPKKKRKERRVIPNPRLAVRSSAANLPSSFEQRRATLPGGIVFPRREL

SEQ ID NO: 114103 - protein, 145 aa, Triticum aestivum
  Clone ID: PAT_TA_8521.pep
AGTTPWSTGLFDCAEDQGVCLMGWCCPCVAVGRIAEILDKGATSSGTGAALYFAVGLLTGWQCQWIYSCVYRTKMRAQYGLQETPCPDCCVHFCWLEYCAICQEYRELRNRGFVMDIGWHANVELQKQQGRSDGSIVPPATQHMI

SEQ ID NO: 114104 - protein, 260 aa, Triticum aestivum
  unsure (1)..(260): unsure at all Xaa locations
  Clone ID: PAT_TA_8522.pep
MAFLNMEQHTWAFTFGILGNIISLMVFLSPLPTFYRVYRKKSTEGFQSTPYLVTLFSCLLWMYYAFLKSGSELLLTINAVGCVIESLYIAMYLVYAPNSARLLTANLFSRLVVRLFRLTPLVTLLSVXHGPPRIPFAGWTWVALALGVLAARASSGLCAVPTAWVAFPPRSPSSCLALPAAXLARGPRAQDIFVAMPNVLGFLFGRARAARYMPYRTKKPATVVLVHAEVEQAAHVQQGGGRRRQAGGRRAHRGEDQLRR

SEQ ID NO: 114105 - protein, 291 aa, Triticum aestivum
  Clone ID: PAT_TA_8523.pep
LPPPPSQHPSLCLAVLISANIAIAVTATRRSGRRWRSSGSSLRHRTPLPRSWGTARRDHGHGGDGDAAEWKKVAELREVVEAQDPSAKEEDDFALRRFLRARDQNINKASAMLLRYLAWKRVTKPHGFISEDEVRGEIAKGRDRHQGFDRLGRPMSYLYGGRHFPVRRDHEDLKRYVVYVFDKICTRLPAGQEKFAAVIDLKGWGYANCDIRGYLAGLDIMQSYYPERLGRVFLIHVPYIFMAAWKIVYPLIDDKTKKKFVFVADRDLDATLRDAIDESQLPEEYGGKLKL

SEQ ID NO: 114106 - protein, 255 aa, Triticum aestivum
  Clone ID: PAT_TA_8524.pep
AFYYAKQEKLLIYDYLPNGNLHDRLHGHQMTGETPLDWTTRVTLLLGVARGLACIHREYRDSTIPHGNIKSTNVLLDKNGAACVTDFGLALLLSPAHAIARLGGYIAPERSGDHKRLSQEADVYSFGVLVLEALTGKVPAQHLQPLPDAAGNSAQRKDKQAAVSLPEWVRSVVREEWTAEVFDAELLRYKNIEEEMVALLHIALACVAQLPEQRPSMADVVRMIESVPVDQSPLPEEDVSMSPSIGITTDDGLSY

SEQ ID NO: 114107 - protein, 125 aa, Triticum aestivum
  Clone ID: PAT_TA_8525.pep
IEYVVVAETMQCLLVHNIPYQYIPCLQLIKLSSNDQTHATQHSIVLSLHASIQGRPWTRPILTSDRRAACASRSLLQIAAPASPDLVRDKVVDEVEDPRDAQHRGDGHHAVHKALEKTLVARTHG

SEQ ID NO: 114108 - protein, 259 aa, Triticum aestivum
  Clone ID: PAT_TA_8526.pep
MDISVTKEAAEATVNDREKVGCGFSSEDKSASPDNSRPSPPPTGHQRENVGCGLSSEDKSESPDNSEGSSEPNGRQTHGVRRSGRSSNASKRKVEESSEDEVNGSITLEKRKKEAPKRKKGAPKRKKEVPEGNQTGGGALWDIFRREDVSKLQEYLIKHSEEFRHYNYEPVKQVIHPIHDQCFYLTNEHKRKLKEEYGVEPWTFEQKLGDAVFIPAGCPHQVRNLKSCIKVALDFVSPENVKECIKLTEEFRLLPTGIG

SEQ ID NO: 114109 - protein, 284 aa, Triticum aestivum
  Clone ID: PAT_TA_8527.pep
GIRHQGLLLDTNEILYIKLTNLEGSTVAPPTVVRSSIILEVGNHQPSPPRMKQLAQTIANSSSGNLGLNHTVFGKVKQISLSSYLRHSLHSGSDSDAPSPAPMTHEDHRHHHHHHHHHHHHHHHHHHHSHHRSHEVIRHLPPSPAPVHPPVEQPKYRSPSPSGYSYGYTNKPKNKAPVAPAAEPVVRNHHYASPPTMPHAVSPSSVSPSPSARHSTNIPNRHHSSPAPSPANVKPPLHTVSLAHAHHPAQVPAVAPAPNTSIATRRHSCQWALAILLCLLAGLP

SEQ ID NO: 114110 - protein, 94 aa, Triticum aestivum
  unsure (1)..(94): unsure at all Xaa locations
  Clone ID: PAT_TA_8528.pep
YSGTDGVYKRTEYQWRIILHLPWRGRSSDKQEPNLKLATIRPNCSSNKTNIRKKGTTAIYTRCPLHLFCITAIFNLANQXPSQPTTMTRAPELH

SEQ ID NO: 114111 - protein, 253 aa, Triticum aestivum
  unsure (1)..(253): unsure at all Xaa locations
  Clone ID: PAT_TA_8529.pep
MAGAGIHPFHQQWPPQAAVPAPPAVPPPPPVPGAPDAAARPGSDEVRTIFITGLPVDVKERELHNLLRWLPGFEASQINFKGDQPMGFALFSYAHHAIAAKAALQDLVFDAETKSALHIEMAKKNLFIKRGVGTDANAMDQSKRLRTAPPPYNAYADDPVPAVPMASPSPVHYTHSAYAPPPFHPPPPAVSMWGTAGYMAAPPPYNPYAGYPVPTVPMTSPSPVPGPTAYAPVQNMKDNPPCNTLFIGNLXET

SEQ ID NO: 114112 - protein, 110 aa, Triticum aestivum
  Clone ID: PAT_TA_8530.pep
AYLTEFMSTRLGVRRESNVLSASSKVADDGKLYYEVEVNIKSYASNNELAVMPKDRVQSLEWDRRYLTVLGVENNQLYALRLQTPERLLSEEEGDLRRVMDSFRVNKIQA

SEQ ID NO: 114113 - protein, 243 aa, Triticum aestivum
  Clone ID: PAT_TA_8531.pep
MSSSFKPNPLSLSVPDPALDRWLRDSGYLDLLDSSTPAPAAAAPTRASPASTSSGPGAAADVLAFARTLASLLALNPFACLTAADLAAPTPSWSLAFIGPAGTASYSWPPTPTQARLRVQENVRRYTRNYAALSILVFACCLYRMPMSLLGLLASLAVWEAVRYCRNRWELATRAPGIGQALLHCAQIATAILLYVCNLQFALVYAIGLSYAVMMLHASLRKLTPSSLSVPANKNRRAQPRRS

SEQ ID NO: 114114 - protein, 111 aa, Triticum aestivum
  unsure (1)..(111): unsure at all Xaa locations
  Clone ID: PAT_TA_8532.pep
GDDTEYGSSRDETEKYRKEEKEHKHKEHLGRXGTLASGAFAMYEKHQVKKDPENAHRHKIEEEVAAVAAVGSGGYAFHEHHEKKEYKESAEDGEDEESGRGEGKKKHHFFG

SEQ ID NO: 114115 - protein, 237 aa, Triticum aestivum
  Clone ID: PAT_TA_8533.pep
MVVKEFTVDLNQPLVFQVGHLEEHYQEWVHQPIVSKEGPRFFANDTMEFLTRTKWWAVPVIWLPVVCWLFAKSIRMGHTIQEVILMALFGVFVWTFIEYALHRFLFHIETKSYWSNTAHYLIHGCHHKHPMDSLRLVFPPAGAAIICVPFWNVVAFFASPSTTPALFAGGLLGYVMYDCTHYYLHHGQPSKDPAKHLKRYHLSHHFRIQDKGFGITSSLWDAVFGTLPSSKIAAKLS

SEQ ID NO: 114116 - protein, 118 aa, Triticum aestivum
  unsure (1)..(118): unsure at all Xaa locations
  Clone ID: PAT_TA_8534.pep
KPSMFMHVXQARGYHGVSVSEKRNLRDHKRRILAAKYELRGKLYKAVCRDPELPSDMRDKFRYKLSKLPRNSNMTRLRNRCIFTGRSRGVYQKFRMSRIVFRTLANKGELMGVKKASW

SEQ ID NO: 114117 - protein, 142 aa, Triticum aestivum
  unsure (1)..(142): unsure at all Xaa locations
  Clone ID: PAT_TA_8535.pep
GELIVHIRPSSQSGSEHSATVDADQQLPFTCGHPEAGTPSFYDGGPYRALFWSLPELDDQGPKNVLPLPWSRLEMWGRLTAAALDGTWAVNPPIIHEHALPESVTLSTDVVMFYRPDXEAGGTNVMIAATEDVEHVYSMEEH

SEQ ID NO: 114118 - protein, 231 aa, Triticum aestivum
  unsure (1)..(231): unsure at all Xaa locations
  Clone ID: PAT_TA_8536.pep
MRAMLARSPALPVPYLTATETAAASSAFFQPCHLSTSPSVTFSKKKHGTRLTVQPNTQHGKAKGASGIQGKWRTLSSDPAQAXLSVDAGDSKTWEECKQILTSAEXSPAEDAEKMLKKAFGWAPFAVTGTEERKKEVPSAEVXVSGVLDYVRXLGLSDDDLYKLLXKKFPEVPGCDLESEVKLNVGKLDSDWGINGKTLRSVLLRNPKVLGYNVDCRGDCAAQCTRCWVRF

SEQ ID NO: 114119 - protein, 176 aa, Triticum aestivum
  Clone ID: PAT_TA_8537.pep
PAASLVKVNGFFLTGFTNLVENLHAANLTVHVGPLKNEFTNFGFDYFADPMVEIATYSAALVVDGIVTEFPATATTYFRSPCSDPTKNLTYTIMAAAPGALVSMVPPGALPPALPPAPLLEPADVLDPPLPPVSVSGPPEAAPKVADSSSSPHSSSAGSCFLVAAGIAAFLYSGFH

SEQ ID NO: 114120 - protein, 400 aa, Triticum aestivum
  unsure (1)..(400): unsure at all Xaa locations
  Clone ID: PAT_TA_8538.pep
MMALSERQPQSEKKAPRARPMSAKAVFVLCATSFFVGLLLSGRMTVLSPPASGSHGGSRIALFSDDDCEHRRKLEEESNPNDVMNEVSRTHQAIRSLDKSVSSLEMELAVERXRGTAAWARPGRPRAARGCGVVQGLNTHYSSRNAPRSLRATWPRAADKLRQLEKEKGVVRFVIGHSATPGGALDRAIDVEEAETRDFMRLDHVEGYHELSSKTRIYFAAAVATWDAAFYVKVDDDVHVNLGMLTNRLARYRTTPRVYVGCMKSGPVLSQKGVKYHEPESWKFGDEGNKYFRHATGQIYAISRDLASYISINQPILHRFANEDVSLGAWLIGLEVEHVDDRSLCCATPPDCEWKKQAGNVCAASFDWSCSGICKSVDRMRAIHSACGEGDGAVSNFAAA

SEQ ID NO: 114121 - protein, 183 aa, Triticum aestivum
  Clone ID: PAT_TA_8539.pep
GTRVFGKSSQGIVGLETSAGTLRVQLLPDCAPHSVDYFIELLRLHNCAGCRFYRAEGRGHLWDAKGDHVKNAAFGPPYALLQGTLEVDGVAFKEMPKEGCSTVRRGSVAWIGSGPEFLISLADHEEWRDAYTVFGSVVPEDMAIAEEMAMLPTSTDVWSGVTVRLLKDPVYIKVKRRSNVTAY

SEQ ID NO: 114122 - protein, 285 aa, Triticum aestivum
  Clone ID: PAT_TA_8540.pep
RPGHACEDAENDGRKDSLHQFFDMVAGGLAGQTPHAISAAVTGLARLTYEFSDLIGVAYKLLPSTFLLMQRNNRELVKANLGFIKALVARSKADVLHEHLKGVVEGLLSWQSDKKNSLKAKVSSLVEILVKKCGLDAVKAVMPEEHMKLLTNIRKINERKMRKGNLSEDGEAMSMASGATRQSGWNHTQMFSDFGSDDEDSNGPFSKQHTVASRNGSKASTRSNRKRQDKNLQEKFIDHSTGEPLDLLDQKTMRLALKSTGKKRAAPDDDDDDEIEMDPECRMII

SEQ ID NO: 114123 - protein, 318 aa, Triticum aestivum
  Clone ID: PAT_TA_8541.pep
AWSRPRYFAGVMVRLILVAAPAVCLISAIAVSATIKNLTTLIRSKSKSPQTTGKTTGSKAAAKGAVDQPLPFQHNVAVALLLGAFYLLSRYAIHCTWVTSEAYSSPSIVLSARGHNGGRVIFDDYREAYYWLRQNTPTDAKIMSWWDYGYQITAMGNRTVIVDNNTWNNTHIATVGRAMSSYEDEAYEIMQSLDVNYVLVVFGGVTGYSSDDINKFLWMVRIGGGVFPVIKEPDYLVNGEYRVDKGASPKMLNCLMYKLCYYRFGELTTEYGKPPGYDRVRGVEIGNKDIKLEYLEEAFTTSNWIVRIYKVKPPKNRS

SEQ ID NO: 114124 - protein, 177 aa, Triticum aestivum
  Clone ID: PAT_TA_8542.pep
QFNGGNFDDTVDNTPGYDKNVSFDVLNASDFMTSTMSGFEEEKAYILESLGRLEEKLRISTYKLASNDTTNIQETLLGDHIGDESSSFQQSIEQKDKDECSCSSFDNEKMSGLNNLQDEISLLDTRLRALEDDHEFLKRVLSSLKGDGLQCVRDIMSHLHEVAKSCSSMKRTCFVLS

SEQ ID NO: 114125 - protein, 101 aa, Triticum aestivum
  Clone ID: PAT_TA_8543.pep
TGPAAPESGEATVPRSLSRDHRLVQTVGDAEACVAPAPGGELLPVYILWKVQSQACHVCKVNTIRTSQSGARKIEDPSIYVCTTSFGLCLLWHRCPYTVLQ

SEQ ID NO: 114126 - protein, 253 aa, Triticum aestivum
  Clone ID: PAT_TA_8544.pep
LAETPPGQAKLVHQILKAAKSINEQVLLQITSPMALMDALPKSGRSSLGEDLYHAITTDYIPIEEIFVSLSLKTEHSVLETMNRLEGALFAWNQRISEERSRRSPARHSWKFMKDSSSELEKMSACIERVETLIQLLKSRFPNLPPTFIDVVKVQYNEDVGHAIVEAYSRVLVGVAFSILSRVAEIMLEDDLVKKPNTPMATLKFDLSSDVYLAGITETPPGHIRRSLMDQISMVDGRFDAVVKKRGAKQLMW

SEQ ID NO: 114127 - protein, 77 aa, Triticum aestivum
  Clone ID: PAT_TA_8545.pep
QKKPGMLVLMWFWTECFSLGEMLFARINIFFSPQRFYSSALNGLLSIFSSKQCIEFTMIHWSYLTEKYSLYTGYSYS

SEQ ID NO: 114128 - protein, 481 aa, Triticum aestivum
  unsure (1)..(481): unsure at all Xaa locations
  Clone ID: PAT_TA_8546.pep
METLRDMALPPGFGFHPKDTELVAHYLKKKILGQKIEYDIIPEVDIYKHEPWDLPAKCNVPTQDNKWHFFAARDRKYPNGARSNRATVAGYWKSTGKDRAIKVDKRTIGTKKTLVFHEGRPPTGKRTEWIMHEYYIDENECQACPDMKDAFVLCEVTKRIDWTSENGNEVGNNNPQPQQANVAAILAVSVEQPDTAASSIIGDELPSDAATVAIPAHTTPDGNDDLKEWLEELLDTSFDPSANTAVDSISAQLSPDEQNAESSNIGAMAPGAGRDSACPLRSGAVVPVFLVPAGCLSMWXPGCVVCPAWLLAFFTAADPFSLSNNFMDEFQMKELQLPLENNGPNLYEPADTGIVVRTRHGGTSAASAPPYKARLQQSLGRMVTSSSESINQTIKFVDNNGHLDLMTNVKHQKKHVRDITSARQSDAEKCGSHNNQGFLRGVQRAFRGCSATGLNILVALCMVGVAAAILHHGRHRGGISL

SEQ ID NO: 114129 - protein, 332 aa, Triticum aestivum
  unsure (1)..(332): unsure at all Xaa locations
  Clone ID: PAT_TA_8547.pep
WHYGGLSDLGKNIASVGKARAKDLMASEAIEGYAVLLENVIKFPSETLTPLTAGEIPLPLKQEWKWHLFEDVKHLYNVNESLADCKMLKKMDWHRNRKNDPHSITPKIDETFSAIAWKEERANRIMSAKMKLEEEYLKERSDQPRGTWEEVYRXNVKRVDRMKNEASERDEKELERTGQPLCIYEPFYGEGTWPFLHQSSLYRGIGLSSKGRRFGADDIDASSRLPLLNSGYYRDILGEFGAFFALANRIDRIHKNSWIGFQSWRVTARKANLSKNAESAMLEAIQTQKHGDAFYFWVRMDQDPRNHANQDFWSLWDAINAGNLRLAVLEAF

SEQ ID NO: 114130 - protein, 227 aa, Triticum aestivum
  unsure (1)..(227): unsure at all Xaa locations
  Clone ID: PAT_TA_8548.pep
MVDFPEGLRRLAALLLKCCDLDIPNRPKGLEDPERLARETVFSVNEIEALYELFKKISSAVVDDGVINKEEFQLALFKTNRKDSMFADRVFDLFDTKHKGXFCELEEFARAIHEFHPNAPFDDKIDFAFKLYDLKQQGFIEKQEVKQMVVATLAEMRIXSSDEIIEGIIXKTFEEADTKHDGKIDKEEWRNLVLRHPSLLKNMTLPYLRDITTTFPSFVFNSQVEDA

SEQ ID NO: 114131 - protein, 175 aa, Triticum aestivum
  unsure (1)..(175): unsure at all Xaa locations
  Clone ID: PAT_TA_8549.pep
CCCDXRDAVLSVSIPPVSLVMSATGGIGTVITYLFDFLLWPMAHYLDAISFTPSAILSTDQMEIDYTSRPIVDSGLTPLVSSFMTSAHGSYQSRPNTAPPVRRLVDPPQIGLPINLSWYHHSNSFPTMSASSPAEVRIAAAELSPLAAIVIPGKTIHCCXHARSCPLASLPPLAR

SEQ ID NO: 114132 - protein, 285 aa, Triticum aestivum
  unsure (1)..(285): unsure at all Xaa locations
  Clone ID: PAT_TA_8550.pep
MAAPFFSTPFQPYVYQSQQGSVTAFQISGGDVQVLQVMVKSQDKLTAKPGTMCYMSGNIQMDNNYLPENDGGVWQWIFGKSITSTVFFNPGPDDGYVGISAPFPGRILPIDLANFXGELLCQXDSFLCSVNDVSVTSSTVDQRPRNIEIGAEMILKQKLRGQGMAFLVGGGSVMQKILAPREVITVDCACIVAMTTTINFQLQNPTPHRRAVLVFGGVNQLKASLTGPGVVFIQSLPFNRLSQRIASRSVGAPRLIASPRFFIQIVMFFFLAYVMIVSSIILTDV

SEQ ID NO: 114133 - protein, 67 aa, Triticum aestivum
  Clone ID: PAT_TA_8551.pep
RTLIDHSVVESFGGGGRTCITARVYPVHAENNNSHVFLFNNGTGIVKVSRLEAWTLATAAVNVVHGG

SEQ ID NO: 114134 - protein, 104 aa, Triticum aestivum
  Clone ID: PAT_TA_8552.pep
LCSTYFPSYTCESSLALFSSSSFTSSSSSLFMAPVRALLPSHPCFMVVADAGAALSGGGGGAPPPLPHCSPGTPAPRSAPPGPPPPVGALPAAAGGAEPGARDP

SEQ ID NO: 114135 - protein, 138 aa, Triticum aestivum
  Clone ID: PAT_TA_8553.pep
MVLPAATKGPNMSSSMDAMKKIDKDKVKAALEKRRKSKGDAGRKVDVMDDDDLIERELEHGVEMAVKDEKKHDRRQSWPQPPHQNGTRTAENAEEGELSMDSQEYLSTVTELDDRKRKDVYDHRSYDHGERGLKRARS

SEQ ID NO: 114136 - protein, 123 aa, Triticum aestivum
  unsure (1)..(123): unsure at all Xaa locations
  Clone ID: PAT_TA_8554.pep
FGMVLLEIISGRRNSSLETPIHHLEAAAPRYQNVEYFPVQAISKLHXGDVKSLVDPQLHGDFNLEEAERVCKVACWCIQDNEFDRPTMGEVVRVLEGLQEIDMPPMPRLLAALTEQLGAATPV

SEQ ID NO: 114137 - protein, 131 aa, Triticum aestivum
  Clone ID: PAT_TA_8555.pep
ACIISQQEPPRGAGRYDQCATAKGSIEDLYSFISQGAYHCLSVVRTMEGSSGGSTTRGHWCRWEGISRTCSRSTRGTSKRRCARHGSARRAGSEQLKRSYGSSANMDRISEVSAPHSSAKLPFHVAAGPPV

SEQ ID NO: 114138 - protein, 92 aa, Triticum aestivum
  unsure (1)..(92): unsure at all Xaa locations
  Clone ID: PAT_TA_8556.pep
ESFGRGPGEFKPDXFRTAXAEREAPSAMLAFSAGPRSCIGQXFAMLEAKATLAVILRRFEFEVAPEYVHAPAEFLTLQPKCGLPVLLKLLGQ

SEQ ID NO: 114139 - protein, 155 aa, Triticum aestivum
  Clone ID: PAT_TA_8557.pep
TSLTPRSLLSQVEKRDGSPLPPAPPLRLVLPAPHRTRFFCASSLTPQSLVWQERREMARPYHLTLLSVFSFLLLTGLVTADLSGENKVGKIVTMTVQYPAAGSPPGEKTTISAHYVDEYGGGGTLTSTLDWDGGWCPVQFRHERTLITTLGGDTR

SEQ ID NO: 114140 - protein, 372 aa, Triticum aestivum
  unsure (1)..(372): unsure at all Xaa locations
  Clone ID: PAT_TA_8558.pep
TRPSTEGHRLSKELVSMVRGRKTTRDIILWVEEQIVPANGAKFAVDVVSQTLLDIGSKSFTHLITVLERYGQIISKLCPDEEMQLLLMDEVSAYWKNSTQMTAIAIDRMMGYRLISNLAIVKWVFSPANVXQFHVSDRPWEILRNTVSKTYNRISDLRKEIQTLRKSIQVAKEASAKAIKELEEAKSILEIVEGQPVSSERPGRLRRLQGFADKAKEEEVTIEESLEAKQALLARGLEEGKELLRLLFKSFVDVLTERLPPVSADGDVPNLRAGDPNVTFPASDPEAATMEIDDENGADNNSQVNGENMKAGYTIGELEQWCLCTLGYLKSFSRQYATEIWSHIGMLDEEVFVGSIHPLIRKAAXSPVCADR

SEQ ID NO: 114141 - protein, 69 aa, Triticum aestivum
  unsure (1)..(69): unsure at all Xaa locations
  Clone ID: PAT_TA_8559.pep
KVWQGLESAITSIVTTLPSXNAQAEVLSEWLQSEHAAFPDLSEAFDAWCYRSKVARRRLSFLNSANAAS

SEQ ID NO: 114142 - protein, 144 aa, Triticum aestivum
  unsure (1)..(144): unsure at all Xaa locations
  Clone ID: PAT_TA_8560.pep
PSTPSTXLSSAHGSCSTPPFINRSITKDKCTIQVLRADGGDPGGARGGRGARAGPGGGSNDSRLQRFDMSSFQQRAEALEGLLEFSAQLLQQERYDELGILLKPFGPEKASPRETAIWLSKSFNGDDVVSNVRLDGRSVAIFVT

SEQ ID NO: 114143 - protein, 141 aa, Triticum aestivum
  Clone ID: PAT_TA_8561.pep
LPSSSNSLRSSHRSTFAEILHNINRNCGFEDALRSVELVVKERNDEPFQWMSWLRQQPQQHGRSSRIGFCDVLGPLEELLDMFSSDREGASADFADFKSRFCRRAVYDDACREFEALLVLYRAGRTRYAKGMLALHGKHGG

SEQ ID NO: 114144 - protein, 287 aa, Triticum aestivum
  Clone ID: PAT_TA_8562.pep
ALSPVPVNNVKKEATVPSAGPVNNVKKTKATAPSAGPANNVKKTEATAPSAEIQCSLNFSVLSLEKASNAITEGSAHSPNPTYGHTKDHAGSNKKETVTSTLPNGGPVLFNGFPAEVSPNNGILKNVKSEASVPSAGPVSNLKENKATVALAGPVNNVKKTEAQVPSARPVNDVKKNEALALSPGPINNVKKDATVPSAGPVNNVKKDAAVPSAGPVNNVKKAKATAPSAGPANNVKKAEATPPSAVSANNVKKAEPTVPSARPVNNVKKAEATIPSPVPVNKCEEG

SEQ ID NO: 114145 - protein, 593 aa, Triticum aestivum
  unsure (1)..(593): unsure at all Xaa locations
  Clone ID: PAT_TA_8563.pep
MKLWLFHLPINNVKKEATVPSAGPVNNVKKTKATSPSAGPANNVKKTEATAPSAVSANNVKKAEPTVPSARPANNVKKAEATVLSPVPVNNVKKAEATVPSPGPVNNVKKAEATVPSPRPVNNVKKAEATVPSPGPVNNVKKAEATVPSPGPANTVKKTESVATSVAPIKSISSSTPIEGPGPHHDGLRCTESSSSAMLVTENGSTGADAPIIAAPADDSVTSLNKEDYQNKPLLPHGLKNTGNICFLXATLQAFLSCFPFVQLVQGLRNRSIPKAGYPTLSAFIELVSQFDVLDESTMKDERFALVAAKIINPTMFDQVLRNFTPDVPAGTSARPRQEDAQEFLSFAMDRMHDELLRLNGNGSNSKEGMVVSSDDDDAWETVGRKNKSAIMRTQSFVPSDLSAIFGRQXFKVYVNGCMPTKPSCYPASPCLAXISLDLFPGCRSNALTDAXLHLFSTPGIFGKDTRTTAGKGRIVTARNSFKIHDLSKIMILHLKRFSYGNRGCTKLYKPLHFPLELVLNRDLLSSPSSEGRRYELVATITHHGSGPSRGHYTADASVVAAEVLRFDDGHVMPINVNKVLHNPAYILFYEQV

SEQ ID NO: 114146 - protein, 267 aa, Triticum aestivum
  Clone ID: PAT_TA_8564.pep
ARPPVRARGIRTPKSPRSLSFPRAAMASVDAGEGQAAPAPRATVSHVIFDMDGLLLDTEGFYTEVQEKILARYGKVFDWSLKAKMMGKKAPESARIFVDECGLAGLLTPEQFLEEREGMLQELFPSCAVLPGVVRLIHHLHANEIPICVATGSHKRHFALKTQNHQEMFALMHHVVMGDDPEVKAGKPSPDIFLAAMRRFEGNVEPSKCLVFEDAPSGVGAAKNAGMYAVMVPDPRLDVSYQKDADQVLSSLLDFNPTEWGLPPFKE

SEQ ID NO: 114147 - protein, 93 aa, Triticum aestivum
  Clone ID: PAT_TA_8565.pep
LSLFTHINLDPTQAKNPSYVSISCVSYHPFLRRSSPYFLHEVLGHRAMPPCLPPRPYAVWQPSPIYHIYTHSTYIIVCMYMYIYTSIYTMHAI

SEQ ID NO: 114148 - protein, 375 aa, Triticum aestivum
  Clone ID: PAT_TA_8566.pep
PRVRYTYDDAQPLASLLASADAPEAFYISVKHGVEGVGDMLTKAISAALSQSAEYEQLNALLDKVIRKLDGTVSTFSRIDNEFAYMIQVTTSAHASGSIKDGSEDGDVASRARLCWATLHSLLHSQISSYRHHGYIWLVELLLSEISEETDGSVWSKIQNLQEEIKDAGSHDTSCPEVSLPVCLLCGLLKSKHNYIRWGFLYVLEKFLMRCKLLLDDSDMQEHSVAYHSKNRLDKAFAVIDVMSTALLLVVQNNETDHINILKMCDMLFSQLCLRLPSTNVMQLGGLQSLGQLFGCTTKNIECTLETLASHKTIGTKSLSRNETLQDTGMNQSTQSALLCETSMAALLLKGLAIAPMQLVALVPTSLFYGPLMQL

SEQ ID NO: 114149 - protein, 123 aa, Triticum aestivum
  Clone ID: PAT_TA_8567.pep
MCCQQLWQIPEQSRCQAIHNVVHAIILHQQQQQQQQQQQQQQQQQPLSQVCFQQSQQQYPSGQGSFQPSQQNPQAQGSVQPQQLPQFEEIRNLALETLPAMCNVYIPPYCTTTIAPSGIFGTN

SEQ ID NO: 114150 - protein, 142 aa, Triticum aestivum
  unsure (1)..(142): unsure at all Xaa locations
  Clone ID: PAT_TA_8568.pep
ERERERERERERERERERERERERERERERESSRERAADSRHVAFPPRALPSPSADQAISHAVSRTVELWVGLSCEGCVGAVERVLGKMXGVESFDVDIEEQRVSVXKGSVTPDAVLQTVSKTGKKTAFWEAEPSAASAVSS

SEQ ID NO: 114151 - protein, 128 aa, Triticum aestivum
  unsure (1)..(128): unsure at all Xaa locations
  Clone ID: PAT_TA_8569.pep
SVVDDSCEINGLRTDPXCSACEMAVVWXQNQLAQNKTQDLILDYXYQVSSVTFGEVCXCTSVVALCLXCXILQLCNRLPSPMGESAVDCASLGSMPDIEFTIGGKKFALKPEEVRLLLHDFPLLFVPL

SEQ ID NO: 114152 - protein, 153 aa, Triticum aestivum
  Clone ID: PAT_TA_8570.pep
MSPMLKRIAQDEPKKAAYVTFLAGSGDYWKGEAGLAKGLRADMSAYPLVEDVLPDVPEDHRQKLLAQGCLVREIVPVYPPESQTQFAMAYYVINYSKLRICEFVEYERMVYLDADIQVYDNVDHLFDLEKGSFYAVKDCFCEKTWSHTKQYEI

SEQ ID NO: 114153 - protein, 92 aa, Triticum aestivum
  unsure (1)..(92): unsure at all Xaa locations
  Clone ID: PAT_TA_8571.pep
AAGITAAAGTRLALQWILVKXLDCTHSNYQTLMRPXIVIYCHYLPVSGLGNLRACCLXLDVVAVSQAPSPESNPNSPSPVTTMVGPYPTIES

SEQ ID NO: 114154 - protein, 53 aa, Triticum aestivum
  Clone ID: PAT_TA_8572.pep
MKTLLIVTILAMATTIATANMQVDPGYQVHWPQQQPRPAPDLLMLTVNSVKLN

SEQ ID NO: 114155 - protein, 132 aa, Triticum aestivum
  unsure (1)..(132): unsure at all Xaa locations
  Clone ID: PAT_TA_8573.pep
NXXSPHRLFTKLRASFLLKPSPLSSWCFLNCFPIMIPIGLSCSFSLLDFQPEPLGRYPPPKRNQRGRCTAPCDRRRSGVGRRRWQGARPRWRGRCRIGGDRLRYRRISGGRRGRAGGGGGGRRRRRRGLPSR

SEQ ID NO: 114156 - protein, 191 aa, Triticum aestivum
  Clone ID: PAT_TA_8574.pep
MKTLLIVTILAMATTIATANMQVDPGYQVHWPQQQPFPQPQQTFPQQPQLPFPQQPQQPFPQPQQPQQQFPQSQQPQQPFPQPQQQFLQPQQPQQSFPQQQQPLIQLSLQQQMNPCKNFLLQQCNPVSLVSSLISMILPRSDCQVMQQQCCQQLAQIPQQLQCAAIHSVVHSIIMQQEQRQGVQIRRPLVS

SEQ ID NO: 114157 - protein, 196 aa, Triticum aestivum
  Clone ID: PAT_TA_8575.pep
ETAPRNESIKGSHVMEYGDKTFKDDMLFLYQGFDPAKSSIRNRPLPMPSLKGAIKQRDADILFMWKKYEKLNGGSEEKQRALREVKETVLHRKHLDTSIDFIGKLVFGFDKGPSVLEAARGSGQPLVDDWDCLKTMVRVFESQCGSLTQYGMKHTRAFANMCNNGASEAEMKEASISACDGYDMGKWSPLVRGYSA

SEQ ID NO: 114158 - protein, 247 aa, Triticum aestivum
  Clone ID: PAT_TA_8576.pep
MKTFLILAILAIVATTATTAVRVPVPQLQPQNPSQQQPQEQVPLVQQQQFPGQQQQFPPQQPYPQPQPFPSQQILQQILQQQLIPCRDVVLQQHNIAHASSQVLQQSTYQLLQQLCCQQLLQIPEQSRCQAIHNVAHAIIMHQQQQQQQEQQQQLQQQQQQQLQQQRQQPSSQVSFQQPQQQYPSSQVSFQPSQLNPQAQGSVQPQQLPQFAEIRNLALQTLPAMCNVYIPPHCSTTIAPFGIFGTN

SEQ ID NO: 114159 - protein, 276 aa, Triticum aestivum
  Clone ID: PAT_TA_8577.pep
MVRVPVPQLQPQNPSQQQPQEQVPLVQQQQFLGQQQPFPPQQPYPQPQPFPSQQPYLQLQPFPQPQLSYSQPQPFRPQQPYPQPQPQYSQPQQPISQQQQQQQQQQQQQQQQQQQQQQEQQILQQILQQQLIPCMDVVLQQHNIAHGRSQVLQQSTYQLLQELCCQHLWQIPEQSQCQAIHNVVHAIILHQQQKQQQQPSSQVSFQQPLQQYPLGQGSFRPSQQNPQAQGSVQPQQLPQFEEIRNLALQTLPAMCNVYIPPYCTMAPFGIFGTNYR

SEQ ID NO: 114160 - protein, 141 aa, Triticum aestivum
  unsure (1)..(141): unsure at all Xaa locations
  Clone ID: PAT_TA_8578.pep
MNVEKLKKMAGAVRTGGKRVNRAQGRRRQSTKTTTTDDKRLQKXTWKRIGVEQHXPGIERGNIFKDDVCYQFXNPKVQASMGANTWVVKLDSQQDKEXQXLFPFXLQQLGPDNLDXLRXXQTFQEQAPXVLGKRWAWGVKR

SEQ ID NO: 114161 - protein, 124 aa, Triticum aestivum
  unsure (1)..(124): unsure at all Xaa locations
  Clone ID: PAT_TA_8579.pep
TISQQQQQQQQQQQXLQQILQQQLIXPCMDVVLQQHNIAHGRSQVLQQSTYQLLQELCCQHLWQIPEQSQCQAIQNVVHAIILHQQQKQQQQPSSQVSFQQPLQQYPLGQGSFRPSQQNPQDQG

SEQ ID NO: 114162 - protein, 166 aa, Triticum aestivum
  unsure (1)..(166): unsure at all Xaa locations
  Clone ID: PAT_TA_8580.pep
MKTFLIISLLAIVATTATTAVRVPVPQLQPQQPISQQQAQQQQQQQQQILQQILQQILQQQQLIPCRDVIVLQLHNIAHESSQVLQQSSYQVLQQLCCQQLWQIPELSRCQAIHNVVQCYYPGIQQQQQQQQEQHQPFEQVSYNSSSNXPSGKVLPASQANPQAKV

SEQ ID NO: 114163 - protein, 319 aa, Triticum aestivum
  Clone ID: PAT_TA_8581.pep
MKTFLILALLAIVATTATTAVRVPVPQLQPQNPSQQQPQEQVPLVQQQQFPGQQQQFPPQQPYPQPQPFPSQQPYLQLQPFPQPQPFPPQLPYPQPQSFPPQQPYPQQQPQYLQPQQPISQQQAQQQQQQQQQQQQQQQILQQILQQQLIPCRDVVLQQHNIAHASSQVLQQSTYQLLQQLCCQQLLQIPEQSQCQAIHNVAHAIIMHQQQQQQQEQKQQLQQQQQQQQQLQQQQQQQQQQPSSQVSFQQPQQQYPSSQVSFQPSQLNPQAQGSVQPQQLPQFAEIRNLALQTLPAMCNVYIPPHCSTTIAPFGISGTN

SEQ ID NO: 114164 - protein, 184 aa, Triticum aestivum
  Clone ID: PAT_TA_8582.pep
MNVEKLKKMAGAVRTGGKGSMRRKKKAVHKTTTTDDKRLQSTLKRVGVNTIPGIEEVNIFKDDVVIQFLNPKVQASIGANTWVVSGTPQTKKLQDLLPSIINQLGPDNLDNLRRLAEQFQKQVPGGAAGIEAGASAGAAQADDDDDVPELVPGETFEETTSPFKNSDLPYLCQWTGFVMYASFV

SEQ ID NO: 114165 - protein, 148 aa, Triticum aestivum
  unsure (1)..(148): unsure at all Xaa locations
  Clone ID: PAT_TA_8583.pep
SFPPQQPYPQPQPFPSQQPYLQLQPFPQPQLPYLQPQPFRPQQPYPQPQPQYSQPQQPMXSQPQQQSQQQLGQQPQQQQLAQGTFLQPHQIAQLEVMTSIALRILPTMCSVNVPLYRTTTSVPFDVGPELVPTDKERSLVIYNWVTVV

SEQ ID NO: 114166 - protein, 137 aa, Triticum aestivum
  unsure (1)..(137): unsure at all Xaa locations
  Clone ID: PAT_TA_8584.pep
MRKAEAWFPWQIHGIRGSWAERRVEMRERRRKEGGEVWCARQELAGAERRRTCAADGGIQSRPVGRQYTNQARGGVRMRTSSPSAANAEESSWGAYCPGMXTPPPPEYMTCLGDAYSVSWMEDSETHNLQKEPIKQQ

SEQ ID NO: 114167 - protein, 165 aa, Triticum aestivum
  unsure (1)..(165): unsure at all Xaa locations
  Clone ID: PAT_TA_8585.pep
QQQQQQQQRQQILXQILQQQLIPCRDVVLQQLNIAHASSQVLQQSYQQLQQLCCQQLQQXPEQSRCQAIHNVVHAIILHHHQQQQQQQQPLTQVSFQQPQQQYPSGQGSFQPSQQNPQAQGSVQPQQLPQFEEIRNLALETLPAMCNVYIPPYCTIAQVGIFGTN

SEQ ID NO: 114168 - protein, 249 aa, Triticum aestivum
  Clone ID: PAT_TA_8586.pep
QLQPFPQPQLPYLQPQPFRPQQPYPQPQPQYSQPQQPISQQQQQQQQQQQQQQQQQLVQQQIPVVQPSILQQLNPCKLFLQQQCSPVAMPQRLARSQMLQQSSCHVMQQQCCQQLPQIPQQSRYEAIRAIIYSIILQEQQQVQGSIQSQQQQPQQLGQCVSQPQQQSQQQLGQQPQQQQLAQGTFLQPHQIAQLEVMTSIALRILPTMCSVNVPLYRTTTSVPFDVGTGVGCLLDKESSLSNIYWVTVV

SEQ ID NO: 114169 - protein, 145 aa, Triticum aestivum
  Clone ID: PAT_TA_8587.pep
MRQTFGKTISDELPQESSKLEQDGTPTTAISSGATLVDNGEANQGPVSPKGPASPKGPASPKGSASPKGPASPKEKPEQPEDTKDADQLKSANDEGVEPVDAKPKKPSGLDSDKDLKLKPCKSVATPHSNVDVDKEAHVVSGEFS

SEQ ID NO: 114170 - protein, 275 aa, Triticum aestivum
  unsure (1)..(275): unsure at all Xaa locations
  Clone ID: PAT_TA_8588.pep
QQQPIQQQPQPFPQQPPCSQQQQPPXSQQQQPPFSQQQPPFSQQELPILPQQPPFSQQQQPQFSQQQQPFPQQQQPLLLQQPPFSQQRPPFSQQQQQPVLPQQPPFSQHQQPVLPQQQIPYVQPSILQQLNPCKVFLQQQCSPVAMPQSLARSQMLWQSSCHVMQQQCCQQLPRIPEQSRYDAIRAIIYSIVLQEQQHGQGFNQPQQQQPQQSVQGVSQPQQQQKQLGQCSXQRPQQQQLGQWPXQQQVPQGTLLQPHQIAQLELMTSIALRTLQ

SEQ ID NO: 114171 - protein, 314 aa, Triticum aestivum
  unsure (1)..(314): unsure at all Xaa locations
  Clone ID: PAT_TA_8589.pep
MKTFLILSLIAIVATTATTAVRVPVPQLQLQNPSMQQPQEQVPLVQQQQFLGQQQTFPPQQPYPQPQPFPAQQPYPQPQPFPQPQPFPPQLPYPQPQPFPPQQPYPQPQTQHLQPQQPISQQQAQQAQQQQQQQQQQQQQQQQQQQQQLQQQILQQILQQQLIPCRDVIVLQQHNIVREISQVLQQSSYQVLQQLCCQQLWQIPEQSRCQAIHNVVHAIILHHHHQQQPTEEEQQXPSSQVSYQQPQQQYPSGXGSFQPSQQNPXAQGFVQPQHLPHLEEIRNLALQTLPAMCNVYIPPYCSTTIVPFGIFGTN

SEQ ID NO: 114172 - protein, 195 aa, Triticum aestivum
  Clone ID: PAT_TA_8590.pep
MLGKDGEHVNHASSAVEVPLSKNAEKKGGHIETAEKKGGHIETADNKEIHSIEPEDICRTDAKTKTKRGLKRKHHRAWTLSEVLKLVDGVAQFGPGKWSEIRRLSFASYSYRTSVDLKDKWRNLLRASQTQLSPENDGVCPRKSNPSIIPIPPAILLRVKELAELQPQAGNLAAAIKFSGQSSKAAQGRGSSGFP

SEQ ID NO: 114173 - protein, 106 aa, Triticum aestivum
  Clone ID: PAT_TA_8591.pep
SWLHFGSLLDSNEGVDVILNVSGERFHAQKFGSKYSRPCSQQQLGQEAQQQQLAQGTFLQPHQIAQLEVMTSIALRTLPTMCRVNVPLYRTTTSVPFGVGTGVGSY

SEQ ID NO: 114174 - protein, 295 aa, Triticum aestivum
  unsure (1)..(295): unsure at all Xaa locations
  Clone ID: PAT_TA_8592.pep
MKTFLVFALLTVAATSAIAQMETRCIPGLERPWQQQPLPPQQTFXPQQPLFSQQQQQQLFPXQQPSFSQQQPPFWQQQPPFSQQQPILPQQPPFSQQQQLVLPQQPPFSQQQQPGLPAQHSPCPQQQQHQQLVQQQIPGVQPSIVQQLNPSRYSSSSKCNPVAMPQRLARSQMVQQSSCHVMQQQCCQQLPQIPQQSRYEAIRAIIYSIILQEQQQVQGSIQTPQQQPQQLGQCVSQPQQQSQQQLGQQPQQQQLAQGTFLQPHQIAQLEVMTSIALRTLPTMCRVNVPLYRTXT

SEQ ID NO: 114175 - protein, 51 aa, Triticum aestivum
  Clone ID: PAT_TA_8593.pep
AGYNNIRHKLNVPLRLCSITSCIPQHKVTTKHYSYCRCFLPQPPNYNRHRQ

SEQ ID NO: 114176 - protein, 223 aa, Triticum aestivum
  Clone ID: PAT_TA_8594.pep
MKTFLVFALLAVAATSAIAQMETRCIPGLERPWQQQPLPPQQTFPQQPLFSQQQQQQLFPQQPSFSQQQPPFWQQQQPPFSQQQPILPQQPPFSQQQQLVLPQQPPISQQQQPPFSQQQQPPFSQQQQIPVIHPSVLQQLNPCKVFLQQQCIPVAMQRCLARSQMLQQSICHVMQQQCCQQLRQIPEQSRHESIRAIIYSIILQQQQQQQQQQQQGQSIIQYQ

SEQ ID NO: 114177 - protein, 90 aa, Triticum aestivum
  Clone ID: PAT_TA_8595.pep
KNNPDQWAQINQGGEDQSRIRGWKKRDKKLIELMEHLAAAERRSAAEIAIQLGAVTSVEPPQSHRSRLVPAWMEWPALLAYREGEPPWLR

SEQ ID NO: 114178 - protein, 151 aa, Triticum aestivum
  unsure (1)..(151): unsure at all Xaa locations
  Clone ID: PAT_TA_8596.pep
MKTFLVFALLALAAASAVAQISQQQQAPPFSQQQQPPFSQQQQPPFSQQQQSPFSQQQQQPPFAQQQQPPFSQQPPISQQQQPPFLQQQRPPFSRQQQIPXVIHPSVLQQLNPCKVFLQQQXCIPVAMQRCLARSQMLQQXSICHVMPQTI

SEQ ID NO: 114179 - protein, 161 aa, Triticum aestivum
  unsure (1)..(161): unsure at all Xaa locations
  Clone ID: PAT_TA_8597.pep
KTMYLEDRTVRLQLWDTAGQERFRSLIPSYIRDSSVAVIVFDVASRQSFLNTSKWIEEVRTERGSDVIIVLVGNKTDLVDKRQVXIXGEGEGKAKDLGVMFIETSAKAGFNIKALFRKIAAALPGMETLSSAKQEDMVDVNLRSGNANSSQSQAQAGGCSC

SEQ ID NO: 114180 - protein, 182 aa, Triticum aestivum
  Clone ID: PAT_TA_8598.pep
MFTVVKGYKLSGAIRDHLPFQDLLALPQSLARSQMLWQSSCHVMQQQCCQQLPRIPEQSRYDAIRAIIYSIVLQEQQHGQGFNQPQQQQPQQSVQGVSQPQQQQKQLGQCSFQRPQQQQLGQWPQQQQVPQGTLLQPHQIAQLELMTSIALRTLPMMCSVNVPVYGTTTSVPFGVGTQVGAY

SEQ ID NO: 114181 - protein, 122 aa, Triticum aestivum
  Clone ID: PAT_TA_8599.pep
TNSGGRSRKMNSDIYNVWSLANDTEKTVEALHSDVQKAQIIMDESRKMNSNAHQIWSLAKDTAKKVESLYTDVAKVQSVIDISKKMESNIHKAWSYAKQTEKRVEDIYSDVKKGFKKKAWMS

SEQ ID NO: 114182 - protein, 204 aa, Triticum aestivum
  unsure (1)..(204): unsure at all Xaa locations
  Clone ID: PAT_TA_8600.pep
QQQXPFSQQQXPFSQQQQQPLSQQPVIILQQPPFSQQQQPVLPQQPPFSQQQQQQQQQQPPFSQQQQPVLPQQPPFSQQQQPPFSQQQQPSSQQPPFPQQHQQFPQQQIPVVQPSVLQQLNPCKVFLQQQCSHVAMSQRLARSQMWQQSSCHVMQQQCCQQLPQIPEQSRSEAIRAIVYSIILQEQQQGFVQPQQQQPQQSGQG

SEQ ID NO: 114183 - protein, 199 aa, Triticum aestivum
  unsure (1)..(199): unsure at all Xaa locations
  Clone ID: PAT_TA_8601.pep
AFLQHQQLVLPQQQLPYVHPSILQQLNPCKVFLQQHCSPVAMPQSLARSQMLWQSSCHVMQQQCCQQLPRIPEQSRYDAIRAIIYSIVLQEQQPGQGFNQPXQQQPQQSVQGVSQPQQQQKQLGQCSFQQPQQQQLGQWPQQQQVPQGTLLQPHQIAQLEVMTSIAFHTLPTLCSTNVPXVYGTTTSVPFGVGTQIGAY

SEQ ID NO: 114184 - protein, 222 aa, Triticum aestivum
  unsure (1)..(222): unsure at all Xaa locations
  Clone ID: PAT_TA_8602.pep
MKTLLVFALLALAAASAVAQILQQQQQPPFLQQQQPPFSQQQQIPVIHPSXVQQLNPCKVLLHQQCIPVAMQRCLARSQMLQQSICHVMQQQCCQQXQQIPEQSRHESIRAIIYSIILQQQQQQQQQQQQGQSIIQYQQQQPQQLGQCVSQPQQQLQQQLGQQPQQQQLAHGTFLQPHQIAQLEVMTSIALRTPPKMCRVNVPLYETPPSGPLGVGIGVGVY

SEQ ID NO: 114185 - protein, 269 aa, Triticum aestivum
  Clone ID: PAT_TA_8603.pep
SLSHHQQQQPVQQQPQPFPQQQPCSQQQQPPLSQQQQPPFSQQQPPFSQQQQPSFSQQQQPPFSQHQQPVLPQQQIPSVQPSILQQLNPCKVFLQQQCSPVAMPQSLARSQTLWQSSCHVMQQQCCRQLPQIPEQSRYDAIRAIIYSIVLQEQQHGQGLNQPQQQQPQQSVQGVSQPQQQQKQLGQCSFQQPQQQQLGQWPQQQQVPQGTLLQPHQIAQLEVMTSIALRTLPTMCSVNVPVYGTTTIVPFGVGTRVGCLLDKKISLSNI

SEQ ID NO: 114186 - protein, 213 aa, Triticum aestivum
  Clone ID: PAT_TA_8604.pep
MAPELAGKMAAKAAVAAAKPATKAYVTFLAGAGDYWMGVVGLAKGLRKVGSAYPLVVAVLPDVPELHRKILVSQGCIVREIAPVYPPENHTQFAMAYYVINYSKLRIWEFVEYERMVYLDADIQVFENIDELFDLPKGHFYAVMDCFCEKTWSHTPQYQIGYCQQCPDKVTWPAAEMGPPPALYFNAGMFVHEPSMATAKALLDTLRVTPTTP

SEQ ID NO: 114187 - protein, 201 aa, Triticum aestivum
  Clone ID: PAT_TA_8605.pep
MSTTHNEPISSTLSSKTREIERAMAPMLKGIVEDAPKRAAYVTFLAGSGDYWKGVVGLAKGLRAVNSAYPLVVAVLPDVPEDHRRKLVEQGCLVREIVPVYPPESQTQFAMAYYVINYSKLRIWEFVEYERMVYLDADIQVFDNIDHLFDLDKGSFYAVMDCFCEKTWSHTPQYKIGYCQQCPDRVAWPERELGVPPPPLY

SEQ ID NO: 114188 - protein, 270 aa, Triticum aestivum
  unsure (1)..(270): unsure at all Xaa locations
  Clone ID: PAT_TA_8606.pep
MKTFLIFALLAIAATSAIAQMETSRVPGLEKPWQQQPLPPQQQPPCSQQQQPFPQQQQPIIILQQSPFSQQQQPVLPQQQPVIILQQPPFSQQQQPVLPQQPPFSQQQQPPFSQQQQPSSQQPPFPQQHQQFPQQQIPVVQPSVLQQLNPCKVFLQQQCSHVAMSQRLARXQMWQQSSCHVMQQQCCQQLPQIPEQSRSEAIRAIVYSIILQEQQQGFVQPQQQQPQQSGQGVSQHQQQSQQQQQLGQCSFQQPQQLQQLGQQPQQQQIP

SEQ ID NO: 114189 - protein, 138 aa, Triticum aestivum
  Clone ID: PAT_TA_8607.pep
IRHEGKIRSLIPSYIRDSSVAVIVFDVASRQSFLNTSKWIEEVRTERGSDVIIVLVGNKTDLVDKRQVSIEEGEGKAKDLGVMFIETSAKAGFNIKALFRKIAAALPGMETLSSAKQEDMVDVNLKSSNANSSRSQED

SEQ ID NO: 114190 - protein, 236 aa, Triticum aestivum
  Clone ID: PAT_TA_8608.pep
MKTFLVFALLALAAASAVAQISQQQQQPPFSQQQQPPFSQQQQSPFSQQQQQPPFSQQQQIPVIHPSVLQQLNPCKVFLQQQCIPVAMQRCLARSQMLQQRICHVMQQQCCQQLRQIPGQSRHESIRAIIYSIILQQQQQQQQQVQSIIQAQQQQPQQLGQCVSQPQQQSQQQLGQQPQQQQLAQGTFLQPHQIAQFEVMTSIALRTLPTMCNVNVPLYGTTTSAPFGVGTGVGAY

SEQ ID NO: 114191 - protein, 202 aa, Triticum aestivum
  Clone ID: PAT_TA_8609.pep
QSLRWQQQSPLPICRSTLAAEYNGHKNNHPPKSQQPFSQQPQQIFPQPQQTFPHQPQQAFPQPQQTFPRRPQQQFPQAPSNHNNHFPSPNNPNYHFPDNHNNHSPQQQQPQQSVQGVSQPQQQQKQLGQCSFQQPQQQQLGQWPQQQQVPQGTLLQPHQIAQLEVMTSIALRTLPTMCSVNVPVYGTTTIVPFGVGTRVGAY

SEQ ID NO: 114192 - protein, 272 aa, Triticum aestivum
  unsure (1)..(272): unsure at all Xaa locations
  Clone ID: PAT_TA_8610.pep
WKWLRLRIWLLWWKLLLLPWKLLLLYQWNLLLWLLLRWILWLPTRPQQSPFSQQQQIVLQQQPPFLQQQQPSLPQQPPFSQQQQQLVLPQQQIPFVHPSILQQLNPCKVFLQQQCSPVAMPQSLARSQMLQQSSCHVMQQQCCQQLPQIPQQSRYEAIRAIIYSIILQEQQQVQGSIQSQQQQPQQLGQCVSQPQQQSQQQLGQQPQQQQLAQGTFLQPHQIAQLEVMTSIALRTLPTMCRVNVXPLYRTTTSVPFSVLAPGGWCLLIRKGL

SEQ ID NO: 114193 - protein, 240 aa, Triticum aestivum
  unsure (1)..(240): unsure at all Xaa locations
  Clone ID: PAT_TA_8611.pep
QQPFPPQQPYPQPQPFPSQQPYLQLQPFLQPQLPYSQPQPFRPQQPYPQPQPQYSRPQQPISQQQQQQQQQQQQQQQQQQQIIQQILQQQLIPCMDVVLQQSSYQLLQQLCCQRLWQIPEQSRCQAIHNVVHAIILQQQQQQQQQQQQQQQQQQQQQQQQQQPSSQVSYQQPQQQYPSGQGSFQPSQQNPQAQGSVQSQQLPXFEEIRNLALQTLPAMCNVYIPPYCSTTIAPSGIFGTN

SEQ ID NO: 114194 - protein, 311 aa, Triticum aestivum
  unsure (1)..(311): unsure at all Xaa locations
  Clone ID: PAT_TA_8612.pep
RNLPFFFPGDFIKVLRXKHASKSYSEMIIYVEACESGSIFEGLMPQDLNIYVTTAANAEESSXGAYCPGMETPAPPECMTCLGDSYRVSWMEDSETHNLHKETIKQQYEVVKARTAPPNDSNIGSHVMEYGNKTFKDDKLFLYQGFYPVKSSITNRPLLSPSLKGAINQRDVDILFMWKKYEQLNVGSEEKQRALTXREVKETVLHRKHLDSSIDFIGKLVFGFEKGPSVIEATKGPGQPLVDDWDCLETMVRVFESQCGSLXSVWHEHTRAFANICNNGVSETEMKEATISGCDGYNMGKWNPLVLGHSA

SEQ ID NO: 114195 - protein, 208 aa, Triticum aestivum
  Clone ID: PAT_TA_8613.pep
MGDERVEAMEIDGQQRQEVAAAVPDGFNADYLRIYYGKLFPYGDFFKWLAYGNDAKHPGCDQSYIGRRELSFTLENDIYLRFQSFDTAAELETSIKEKCPFKIDIGPVYSVDPAKRHAYAQSGNNVFVPVERELIFDIDISDYDDVRYCCSGADTCLDCWPLMTIVIKILDTSLRGDFGFNHILWVYSGRRGVHCWVCDSRARKLSNE

SEQ ID NO: 114196 - protein, 160 aa, Triticum aestivum
  unsure (1)..(160): unsure at all Xaa locations
  Clone ID: PAT_TA_8614.pep
MNVEKLKKMAGAVRTGGKGSMRRKKKAVHKTTTTDDKRLQSTLKRVGVNTIPGIEEVNIFKDDVVIQFLNPKVQASIGANTWVVSGTPQTKKLQDLLPSIINQLGPDNLDNLRRLAEQFQKQVPGXAAGIEAGTSAXAAQADDDXDVPELVPGETFEEAA

SEQ ID NO: 114197 - protein, 297 aa, Triticum aestivum
  Clone ID: PAT_TA_8615.pep
MKTFLILALRAIVATTATIAVRVPVPQLQPQNPSQQQPQKQVPLVQQQQFPGQQQPFPPQQPYPQQQPFPSQQPYMQLQPFPQPQLPYPQPQLPYPQPQPFRPQQSYPQPQPQYSQPQQPISQQQQQQQQQQQQQQQILQQILQQQLIPCRDVVLQQHSIAHGSSQVLQQSTYQLVQQFCCQQLWQIPEQSRCQAIHNVVHAIILHQQQQQQQQQQQQQQQPLSQVCFQQSQQQYPSGQGSFQPSQQNPQAQGSVQPQQLPQFEEIRNLALETLPAMCNVYIPPYCTIAPVGIFGTN

SEQ ID NO: 114198 - protein, 244 aa, Triticum aestivum
  Clone ID: PAT_TA_8616.pep
PQQPFPLQPQQSFLWQSQQPFLQQPQQPSPQPQQVVQIISPATPTTIPSAGKPTSAPFPQQQQQHQQLAQQQIPVVQPSILQQLNPCKVFLQQQCSPVAMPQRLARSQMLQQSSCHVMQQQCCQQLPQIPQQSRYQAIRAIIYSIILQEQQQVQGSIQSQQQQPQQLGQCVSQPQQQSQQQLGQQPQQQQLAQGTFLQPHQIAQLEVMTSIALRILPTMCSVNVPLYRTTTSVPFGVGTGVGAY

SEQ ID NO: 114199 - protein, 116 aa, Triticum aestivum
  unsure (1)..(116): unsure at all Xaa locations
  Clone ID: PAT_TA_8617.pep
MSDLDVTLPSAFDPFAEANAEDAGAGPGAKDYVHVRIQQRNGRKSLTTVQGXLKKEFSYNKILKDLKKEFCCNGTVVQDPELGQVIQLQGDQRKNVATFLVQAGIAKKELIKIHGF

SEQ ID NO: 114200 - protein, 207 aa, Triticum aestivum
  Clone ID: PAT_TA_8618.pep
QQSPFSQQQQLILPAQQQQQLPQQQISIVQPSVLQQLNPCKVFLQQQCSPVAMPQRLARSQMWQQSSCHVMQQQCCQQLSQIPEQSRYDAIRAITYSIILQEQQQGFVQAQQQQPQQSGQGVSQSQQQSQQQLGQCSFQQPQQQLGQQPQQQQVQQGTFLQPHQIAHLEVMTSIALRTLPMMCSVNVPLYSSTTSVPFGVGTGVGAY

SEQ ID NO: 114201 - protein, 275 aa, Triticum aestivum
  unsure (1)..(275): unsure at all Xaa locations
  Clone ID: PAT_TA_8619.pep
MKTFLIFALLAIAATSAIAQMETSRVPGLEKPWQQQPLPPQQQPPCSQQQQPFPQQQQPIIILQQSPFSQQQQPVLPQQQPVIILQQPPFSQQQQQQQQPPFSQQQQPVLPQQPPFSQQQQPPFSQQQQPSSQQPPFPQQHQQFPQQQIPVVQPSVLQQLNPCKVFLQQQCSHVAMSQRLARSQMWQQSSCHVMQQQCCQQLPQIPEQSRSEAIRAIVYSIILQEQQQGFVQPXXQQPQQGGPKGVFQTPKQQVGRQPARQTFGTSGFFFSNQTL

SEQ ID NO: 114202 - protein, 235 aa, Triticum aestivum
  Clone ID: PAT_TA_8620.pep
MKTFLIFALLAIAATSAIAQMETSRVPGLEKPWQQQPLPPQQQPPFSQPQPPFAQQQQPSSQQPPFPQQHQQFPQQQIPVVQPSVLQQLNPCKVFLQQQCSHVAMSQRLARSQMWQQSSCHVMQQQCCQQLPQIPEQSRSEAIRAIVYSIILQEQQQGFVQPQQQQPQQSGQGVSQHQQQSQQQQQLGQCSFQQPQQLQQLGQQPQQQQIPQGIFLQPHQISQLEVMTSIALRTL

SEQ ID NO: 114203 - protein, 159 aa, Triticum aestivum
  unsure (1)..(159): unsure at all Xaa locations
  Clone ID: PAT_TA_8621.pep
HSEDLPIFALLAIVATSAIAQMENSHIPGLERPSQQQPLPPQQTLSHHQQQQPIQQQPQPFXQQQPCSQQQQQPLSQQQQPPFSQQQPPFSQSQQQLGQQPQQQQLAQGTFLQPHQIAQLEVMTSIALRTLPTMCRVNVPLYRTTTSVPFGVGTGVGSY

SEQ ID NO: 114204 - protein, 247 aa, Triticum aestivum
  Clone ID: PAT_TA_8622.pep
MKTLLIVTILAMATTIATANMQVDPGYQVHWPQQQPFPQPQQPFCQQPQQTIPQPHQTFHHQPQQTFPQPQQTYPHQPQQQFPQTQQPQQPFPQPQQTFPQQPQLPFPQQPQQPFPQPQQPQQQFPQSQQPQQPFPQPQQQFLQPQQPQQSFPQQQQPLIQLSLQQQMNPCKNFLLQQCNPVSLVSSLISMILPRSDCQVMQQQCCQQLAQIPQQLQCAAIHSVVHSIIMQQEQRQGVQIRRPLFQL

SEQ ID NO: 114205 - protein, 106 aa, Triticum aestivum
  unsure (1)..(106): unsure at all Xaa locations
  Clone ID: PAT_TA_8623.pep
RRIRVRFRRGSLRNGYHIQGRQQARKLPNPDIEFTIGGKKFALKPEEYILKVGEGAAAQCISGFTAMDIXPPPRGPLWILXGDVFMGPYHTVFDYGKLRVGFAKAA

SEQ ID NO: 114206 - protein, 220 aa, Triticum aestivum
  unsure (1)..(220): unsure at all Xaa locations
  Clone ID: PAT_TA_8624.pep
TSLDDVGGAFGMGAVGGSVFHFLKGTYNSPNGERLLGGAQQVRLNAPRVGGSFAVWGGLFSAFDCTMVFVRQKEDPWNSIIAGAATGGFLSMRQGPGAAGRSALXGGCLLALIEGAGLMLNRVLAAPQNLPPLPTDDPNLAAAMAGGGVGGFPGMPQPLVPPVEVGSSSGGGSWFGGLFGKKEEEKKPSGGGGKSEILESFDTPSTPIPIVRLQVRKKGS

SEQ ID NO: 114207 - protein, 80 aa, Triticum aestivum
  Clone ID: PAT_TA_8625.pep
QQLGQCVSQPQQQSQQQLGQQPQQQQLAQGTFLQPHQIAQLEVMTSIALRTLPTMCSVNVPVYGTTTIVPFGVGTRVGAY

SEQ ID NO: 114208 - protein, 359 aa, Triticum aestivum
  Clone ID: PAT_TA_8626.pep
MKTFLVFALLALAAASAVAQISQQQQQPPFSQQQQPQFSQQPPFSQQQQPPFSQQQQQPPFAQQQQPPFSQQPPISQQQQPPFSQQQQPQFSQQQQPPYSQQQQPPYSQQQQPPFSQQQQPPFSQQQQQPPFTQQQQQQQQQQPFTQQQQPPFSQQPPISQQQQPPFSQQQQPQFSQQQQIPVIHPSVLQQLNPCKVFLQQQCIPVAMQRCLARSQMLQQSICHVMQQQCCQQLRQIPEQSRHESIRAIIYSIILQQQQQQQQQQQQGQSIIQYQQQQPQQLGQCVSQPQQQLQQQLGQQPQQQQLAHGTFLQPHQIAQLEVMTSIALRTLPTMCSVNVPLYETTTSVPLGVGIGVGVY

SEQ ID NO: 114209 - protein, 204 aa, Triticum aestivum
  Clone ID: PAT_TA_8627.pep
MKTFLILALLAIVATTTTTAVRVPVPQLQPQNPSQQQPQEQVPLVQQQQFLGQQQQQFPGQQQPFPPQQPYPQPQPFLPQLPYPQPQPFPPQQSYPQPQPQYPQPQQPISQQQAQLQQQQQQQQQQPSSQVSYQQPQQQYPSGQGFFQPSQQNPQAQGFVQPQQLPQFEEIRNLALQTLPAMCNVYIPPYCSTTIAPFGIMSTN

SEQ ID NO: 114210 - protein, 79 aa, Triticum aestivum
  Clone ID: PAT_TA_8628.pep
AQQSAQIIPQQPQQPFPLQPQQSFLRQSQQPFLQQPQQPSPQPQQVVQIIPQQPQQPFPLLANQPQQPYPQQQPSGVMV

SEQ ID NO: 114211 - protein, 135 aa, Triticum aestivum
  Clone ID: PAT_TA_8629.pep
NSCNRGGYCNFMHVKQIGRELRRKLYGGRSRRSHGRSRSPSPQHRRDNRDRGGDFRRDGRDEYRDGGGYRGGGGGGYRGGGRGGGVGRHDRYDDGPRRRYGGSPPRRGRSPPARENSEERRAKIEQWNREREEKK

SEQ ID NO: 114212 - protein, 185 aa, Triticum aestivum
  Clone ID: PAT_TA_8630.pep
QISDVPSEMRCGRKGRGITLLPVKEEKIETPKSDGVELPKKRGRPKGWRPNNGGTPSTTPSKSKGKTAVKDAKGTPKSASEIKKEGKEKATGSANKTKDDLAKDSSNQKVKEVGSKSGDGSVKGRPVRKPKSAATTTPVAASGSGSVQEKRKEKEEKEEAEASEMEQEASGKGASSTGKKRRRKA

SEQ ID NO: 114213 - protein, 291 aa, Triticum aestivum
  Clone ID: PAT_TA_8631.pep
MKTFLILALLAIVATTATTAVRVTVPQLQPQNPSQQQPQEQVPLVQQQQFLGQQQPFPPQQPYPQPQPFPSQQPYLQLQPFPQPQLPYSQPQPFRPQQPYPQPQPQYSQPQQPISQQQQQQQQQQQQQQQQQQQQQQQILQQILQQQLIPCMDVVLQQHNIVHGRSQVLQQSTYQLLQELCCQHLWQIPEQSQCQAIHNVVHAIILHQQQKQQQQPSSQVSFQQPLQQYPLGQGSFRPSQQNPQAQGSVQPQQLPQFEEIRNLALQTLPAMCNVYIPPYCTIAPFGIFGTN

SEQ ID NO: 114214 - protein, 322 aa, Triticum aestivum
  unsure (1)..(322): unsure at all Xaa locations
  Clone ID: PAT_TA_8632.pep
MAPMLKRIAEDEPKKAAYVTFLAGSGDYWKGVVGLAKGLRAVKSAYPLVVAVLPDVPEDHRQKLLAQGCVVREIVPVYPPESQTQFAMAYYVINYSKLRIWEFVEYERMVYLDADIQLYDNIDHLFDLEMGSFYAVMDCFCEKTWSHTPQYEIGYCQQCPDRVVWPERDLGVPPPPLYFNAGMFVHEPSMATAKALLDKLVVTDPTPFAEQDFLNMFFRDVYKPIPPVYNLVLAMLWRHPENIQLHKVKVVHYCAAGSKPWRYTGXEANMDRDDIKMLVKKWWDIYNDEGLDYKAGEDTANLLRGALVEAGAVKYFPAPSAA

SEQ ID NO: 114215 - protein, 291 aa, Triticum aestivum
  Clone ID: PAT_TA_8633.pep
PSRSREFFPSMAMRVDSAILAVVVAFLLPLRLLSLCARLNSSGSAGDLRRSYSALAIAAALLATFFALPRHDGGRTGQCATSVGSPWEEGTGREVRLEIEQLKLQLYRLESLWQNKSKAPDDKGDASEEDAEFVKAMGLDIQALIKEQENIKESLWSSGDTIKSVENEVRILAAESRKMNSDIYNVWSLANDTEKTVEALHSDVQKAQIIMDESRKMNSNAHQIWSLAKDTAKKVESLYTDVAKVQSVIDISKKMESNIHKAWSYAKQTEKRVEDIYSDVKKGFKKKAWMS

SEQ ID NO: 114216 - protein, 273 aa, Triticum aestivum
  unsure (1)..(273): unsure at all Xaa locations
  Clone ID: PAT_TA_8634.pep
MKTFLILALLAIMATTTTTAVRVPVPQLQPQNPSQQQPQEQVPLVQQQQFLGQQQQQFPGQQQPFPPQQPYPQPQPFLPQLPYPQPQPFPPQQSYPQPQPQYPQPQQPISQQQAQLQQQQQQQQQQQILQQILQQQLIPCRDVVLQQPNIAHASSQVSQQSYQLLQQLCCQQLWQTPEQSRCQAIHNVIHAIILHHQQQQQQQQQQQQQQQQQQQQQQQQQPSSQVFYQQPXEQYPSGXGLRFQPSQQNPQGPGLWPNXQLPEFEEIRNLALQ

SEQ ID NO: 114217 - protein, 162 aa, Triticum aestivum
  Clone ID: PAT_TA_8635.pep
MAALIKLGSLLRQSAVASSASTGSAPALFNAARFMCAGQPADGSKLFVGGLAWATDDHSLKEAFQCFGEVVEARVITDRETGRSRGFGFVSFASGEDAKSAAENMDGKELAGRNVRVNFANERPSGGGGGGGYGGGGFGGGGGYGGGRGGGGGGYGGDRESY

SEQ ID NO: 114218 - protein, 209 aa, Triticum aestivum
  Clone ID: PAT_TA_8636.pep
MRPRGTRSPLIRLPTENGHAPAPAPGPAASAAGEEVTKWAVLVAGSSGYENYRHQADVCHAYQILKKGGLKDENIVVFMYDDIANSPDNPRRGTVINHPKGKDVYHGVPKDYTGDQVTAKNFYAVLLGNKTAVTGGSRKVINSKPEDHIFIFYSDHGSPGSLGMPNGPDVYADDFIKVLRQKHASKSYSKMVIYVEACESGSIFEGLMP

SEQ ID NO: 114219 - protein, 216 aa, Triticum aestivum
  unsure (1)..(216): unsure at all Xaa locations
  Clone ID: PAT_TA_8637.pep
MHQQQQQQQEQKQQLQQQQQQQQQLQQQQQQQQQQPSSQVSFQQPQQQYPSILQQLNPCKVFLQQQCSPVAMPQSLARSQMLQQRSCHVMQQQCCQQLPQIPQQSRYEAIRAIIYSIVLQEQQQVQGSIQTQQQQPQXLGQCVSQPQQQSQQQLGQQPQQQQLAQGTFLHPHQIAQLEVMTSIALRTLPTMCRVNVPLYRTTTSVPFSVGTGVGAY

SEQ ID NO: 114220 - protein, 240 aa, Triticum aestivum
  Clone ID: PAT_TA_8638.pep
QQQQQQQQQRQQILQQILQQQLIPCRDVVLQQLNIAHASSQVLQQSYQQLQQLCCQQLQQTPHQSRCQAIHNVVHAIILHQQQQQQILQQILQQQLIPCRDVVLQQHNIAHARSQVLQQSTYQPLQQLCCQQLWQIPEQSRCQAIHNVVHAIILHQQQRQQQPSSQVSLQQPQQQYPSGQGFFQPSQQNPQAQGSVQPQQLPQFEEIRNLALQTLPRMCNVYIPPYCSTTIAPFGIFGTN

SEQ ID NO: 114221 - protein, 60 aa, Triticum aestivum
  Clone ID: PAT_TA_8639.pep
MPQPPVPPVEVGSSGGGGSWFGGLFGKKEEEKKPSGSGGKSEILESFDTPSPPIPSFDYK

SEQ ID NO: 114222 - protein, 496 aa, Triticum aestivum
  unsure (1)..(496): unsure at all Xaa locations
  Clone ID: PAT_TA_8640.pep
MNWGVAMAAWWVCGFLPLLLLAVAADGDSEQLIRLPTENGHAPAPAPGPAASPVEEEVTKWAVLVAGSSGYENYRHQADVCHAYHILKKGGLKDENIVVLMYDDIANSPENPRRGVVINHPKRKDVYHGVPKDYTGEQVTANNLYAVLLGNKTAVTGGSRKVINSKPNDHIFIYYTDHGGAGALGMPNVPFVYAGDFIKVLRQKHASKXSYSKMIIYVEACESGSIFEGLMPQDHNIYVTTAANAEESSWAAYCPGMEVPPPSEYKTCLGDAYSVSWMEDSETHNLKKETIKQQYEVVKARTAPRNESSIGSHVMEYGDRTFKDEMLFLYQGFDPAKSSITNRPLLRPSLKGAINQRDADILFMWEKYEQLNGGSEEKQRALREIKETVLHRKHLDSSIDFIGKLVFGFEKGPSVLDASRGSGQPLVDDWDCLKTMVRVFESQCGSLTQYGMKHMRAFANICNNGISEAEMKEASISACDDYDMGKWSPLVRGHSA

SEQ ID NO: 114223 - protein, 352 aa, Triticum aestivum
  Clone ID: PAT_TA_8641.pep
TTTIPPTTIPPATTTTIPPTTISNTIPTPAITRTFPIPTISSNNNHHFRSNSNHHFHSNNNQFYRNNNSPGHNNPLNNNNSPNNNSPSNHHNNSPNNNFQYHTHPSNHKNLPHTNNIQQQQPPFSQQQQPPFSQQQQPVLPQQSPFSQQQQLVLPPQQQQQQLVQQQIPIVQPSVLQQLNPCKVFLQQQCSPVAMPQRLARSQMWQQSSCHVMQQQCCQQLQQIPEQSRYEAIRAIIYSIILQEQQQGFVQPQQQQPQQSGQGVSQSQQQSQQQLGQCSFQQPQQQLGQQPQQQQQQQVLQGTFLQPHQIAHLEAVTSIALRTLPTMCSVNVPLYSATTSVPFGVGTGVGAY

SEQ ID NO: 114224 - protein, 465 aa, Triticum aestivum
  unsure (1)..(465): unsure at all Xaa locations
  Clone ID: PAT_TA_8642.pep
PRVRPRVRPTEKGDAPAPAPAAPAAEEGVTKWAVLVAGSSGYGNYRHQADVCHAYQILRRGGLKEENIVVFMYDDIAKNSLNPRPGVIINHPKGQDVYAGVPKDYTGKQVTAKNFFAVLLGNKTAVTEGSRKVINSKPKDHIFIYYADHGGPGVLGMPNRPYIYAGDFIKVLREKHASKSYSKMIIYVEACESGSIFEGLLPEDLNIYVTTASNAVENSWGAYCPGMKSSPPTEYDTCLGDIYSVSWMEDSETHNLKKETLKQQYEVVKTRTSKSKEFDKGSHVMEYGDKTFKDEKLFLYQGFDPANSNVANRLLLPDLGGAINQRDADILFMWKRYEKLNGGSXRKQRVLREIKETVVHRKHLDSSIDFIGKLVFGFENGPSMIEAARSSGQPLVDDWDCLKRTVRVFESQCGSLTQYGMKHMRAFANICNNGISGPEMREASISACGGYDSAKWSPLAVGHSA

SEQ ID NO: 114225 - protein, 224 aa, Triticum aestivum
  Clone ID: PAT_TA_8643.pep
MVFVHKGGVWWFLFLVAVLLAAAAVGAEQEDGATATVAAEVEEEVGGLVHDHGNDMCDIKCHHGQHLPWRRRWVNECHRQKLHHSCRAFCEMKCQDHYHDPSRMELCVHQCMSYGIKLHADSNNGVDHHTHAWEVEAGWGADDRSNDMCDIKCQHWRDPAGRRRCVNECHGREHHHPSTAFCEMKCQHHYHDPSRMELCVHQCMSYGLNLHVGGNNGADEHPIV

SEQ ID NO: 114226 - protein, 180 aa, Triticum aestivum
  unsure (1)..(180): unsure at all Xaa locations
  Clone ID: PAT_TA_8644.pep
MKTFLVFALLAVVATSAIAQMETSCIPGLERPWQQQPLQQKETFPQQPPSSQQQQPFPQQPPFLQQQPSFSQQPLFSQKQQPVLPQQPSIFASNNKQVLPQQPSIFASNNTNSFWQQQIPIVHPIHFASKLNPCKVFLQAAVVSPVXAMAQHLAKSQXWQQDNCXVMQQQVANNGTIPTS

SEQ ID NO: 114227 - protein, 319 aa, Triticum aestivum
  unsure (1)..(319): unsure at all Xaa locations
  Clone ID: PAT_TA_8645.pep
MAPMLKRIAEDEPKKAAYVTFLAGSGDYWKGVVGLAKGLRAVKSAYPLVVAVLPDVPEDHRQKLLAQGCLVREIVPVYPPESQTQFAMAYYVINYSKLRIWEFVEYERMVYLDADIQVYDNVDHLFDLEKGSFYAVKDCFXEKTWSHTKQYEIGYCQQCPDRVVWPERDLGVPPPPLYFNAGMFVHEPSMATAKALLDKLVVTDPTPFAEQDFLNMFFRDVYTPIPPVYNLVLAMLWRHPENIQLHKVKVVHYCAAGSKPWRYTGEEANMDREDIKMLVKKWWAIYDDESLNYKPAADPLRAALAEVVAVKSFPAPSAA

SEQ ID NO: 114228 - protein, 205 aa, Triticum aestivum
  Clone ID: PAT_TA_8646.pep
QQSFPQQPEQIIPQQPQQPFPLQPQQPFPQQPEQIISQQSQQPFSLQPQQPFSQPQQPLSQQPGQIIPQQSQQPCPLQPQQPFPQQPEQIIRQQPQQPFLLQSQQPFHQQPEQIISQQPQKPFSLQPQQPFSQPQQPFPQQPGQIIPQQPQQPFSLQPQQPFPQQLQQPFALQPQQSFPQQPQQPFPQPQQAFPEQAEQIIPQQP

SEQ ID NO: 114229 - protein, 173 aa, Triticum aestivum
  unsure (1)..(173): unsure at all Xaa locations
  Clone ID: PAT_TA_8647.pep
QTFKQQQPPFSQQQQPSSQQPPFPQQHQQFPQQQIPVVQPSVLQQLNPCKVFLQQQCSHVAMSQRLARSQMWQQSSCHVMQQQCCQQLPQIPEQSRSEAIRAIVYSIILQEQQQGFVQPQQQQPQQSGQGVSQHQQQSQQQQQLGQCSFXQPQQLQQLGQQPQQQQIPQGIFL

SEQ ID NO: 114230 - protein, 227 aa, Triticum aestivum
  Clone ID: PAT_TA_8648.pep
MGTPETSREPCPDRILDDVGGAFGMGAVGGSVFHFLKGTYNSPNGERLLGGAQQVRLNAPRVGGSFAVWGGLFSAFDCTMVFVRQKEDPWNSIIAGAATGGFLSMRQGPGAAGRSALMGGCLLALIEGAGLMLNRVLAAPQNLPPLPTDDPNLAAAMAGGGVGGFPGMPQPPVPPVEVVSSSGGGSWFGGLFGKKEEEKKPSGSGGKSEILESFDTPSPPIPSFDLK

SEQ ID NO: 114231 - protein, 429 aa, Triticum aestivum
  Clone ID: PAT_TA_8649.pep
AGSSGYGNYRHQADVCHAYQILRKGGLKEENIVVFMYDDIAKNDLNPRPGVIINHPKGEDVYAGVPKDYTGKQVTAENFFAVLLGNKTAVTGGSRKVINSKSKDHIFIYYADHGGPGVLGMPNRPYIYAGDFIKVLREKHASKSYSKMIIYVEACESGSIFEGLLPEDLNIYVTTASNAVENSWGAYCPGMKSSPPAEYDTCLGDIYSVSWMEDSETHNLKKETLKQQYEVVKTRTSKSMEFDKGSHVMEYGDKTFKDEKLFLYQGFDPANSNVANRLLLPDLEGAINQRDADVLFMWKRYEKLNGGSEEKQRVLREIKETVVHRKHLDSSIDFIGKLVFGFENGPSMIEAARSSGQPLVDDWDCLKRTVRVFESQCGSLTQYGMKHMRAFANMCNNGISEAEMREASISACGGYGSAKWSPLAVGHSA

SEQ ID NO: 114232 - protein, 167 aa, Triticum aestivum
  Clone ID: PAT_TA_8650.pep
MNVEKLKKMAGAVRTGGKGSMRRKKKAVHKTTTTDDKRLQSTLKRVGVNTIPGIEEVNIFKDDVVIQFLNPKVQASIGANTWVVSGTPQTKKLQDLLPSIINQLGPDNLDNLRRLAEQFQKQVPGGAAGIEAGASAGAAQADDDDDVPELVPGETFEEAAEEKKAES

SEQ ID NO: 114233 - protein, 178 aa, Triticum aestivum
  Clone ID: PAT_TA_8651.pep
KGKTAVKDAKGTPKTAVEIKKEGKEKATGSANKTKDDLAKDSSNQKLKEVGSKSGNKLFVGGLAWATDDHSLKEAFQSFGEVVEARVITDRETGRSRGFGFVSFANEADADSAAKGMDGQELAGRNVRVNFANERPSGGGGFSRGGGGYGGGGGFGGGGGYGGGGRGGGGYGGDREAF

SEQ ID NO: 114234 - protein, 185 aa, Triticum aestivum
  unsure (1)..(185): unsure at all Xaa locations
  Clone ID: PAT_TA_8652.pep
QQQQQQQQQILQQILQQQLIPCRXVILQQHNIAHASSQVLQQSTYQLLQQLCCQQLLQIPEQSRCQAIHNVVHAIIMHQQEQQQQLQQQQQQQLQQQQQQQQQQQQQPSSQVSFQQPQQQYPSSQVSFQPSQLNPQAQGSVQPQQLPQFAEIRNLALQTLPAMCNVYIPPHCSTTIAPFGIFGTN

SEQ ID NO: 114235 - protein, 169 aa, Triticum aestivum
  Clone ID: PAT_TA_8653.pep
MCDIKCQHGQHLAWRRRCVNECRRQELRHPSRAFCEMKCQDHYHNPSRMELCVHECMSYGLKLHADSNNGVDHHPHAWEVVVGWRADGRSNDMCDNKCQHWQDPAGRRRCVNECHSREHHYPSRAFCEMKCQHHYHDPSRMELCVHQCMSYGLNLHVGGNNSADEHPIV

SEQ ID NO: 114236 - protein, 226 aa, Triticum aestivum
  unsure (1)..(226): unsure at all Xaa locations
  Clone ID: PAT_TA_8654.pep
PYLQLQPFPQPQLPYPQPQLPYPQPQPFRPQQPYPQPQPQYSQPQQPISQQQQQQQQQQQQKQQQQQQQQILQQILQQQLIPCRDVVLQQHSIAYGSSQVLQQSTYQLVQQLCCQQLWQIPEQSRCQAIHNVVHAIILHQQQQQQQQQQQPLSQVSFQQPQQQXPSGQGSFQPSQQNPQAQGSVQPQQLPQFEEIRNLALETLPAMCNVYIPPYCTIAPVGIFGTN

SEQ ID NO: 114237 - protein, 186 aa, Triticum aestivum
  unsure (1)..(186): unsure at all Xaa locations
  Clone ID: PAT_TA_8655.pep
PTRPPTRARGGPKNLVLGSCEILETAGQGALGTLYKVLESAIADRENGSSAQGQIIWVHFGVNSGASRFALENQAVNEATFRCPDELGWKPQRVPIVPSDGSISRTRETTLPVKELTKSLRKTGYDVMPSDDAGRFVCNYVYYHSLXRFAEQHGIKSLFVHVXPLFSTVDEEVQIHFVASLVEALG

SEQ ID NO: 114238 - protein, 169 aa, Triticum aestivum
  Clone ID: PAT_TA_8656.pep
VILQQHNIAHASSQVLQQSTYQLLQQLCCQQLWQIPEQSRCQAIQNVVHAIILHQQQQRQQQQQQQQQQQQQQQQQQQQQQQQQQQQQQQQPSSQVSFQQPQQQYPSGQGSFQPSQQNPQAQSSVQHQQLPQFEEIRNLALQTLPAVCNVYIPPYCSTTIAPFGIFGTN

SEQ ID NO: 114239 - protein, 248 aa, Triticum aestivum
  Clone ID: PAT_TA_8657.pep
FPGQQQPFPPQQPYPQLQPFPSQQPYMQLQPFPQPQLPYPQPQLPYPQPQPFRPQQSYPQPQPQYSQPQQPISQQQQQQQQQQQQQILQQILQQQLIPCRDVVLQQHSIAHGSSQVLQQSTYQLVQQLCCQQLWQIPEQSRCQAIHNVVHAIILHQQQQQQQQQQQQQQQQQPLSQVCFQQSQQQYPSGQGSFQPSQQNPQAQGSVQPQQLPQFEEIRNLALETLPAMCNVYIPPYCTIAPVGIFGTN

SEQ ID NO: 114240 - protein, 437 aa, Triticum aestivum
  Clone ID: PAT_TA_8658.pep
MDDDDAGGGGDASPQHEGGGGAVVIERGAGATAPARDAAAASPTSSRSVTETVNGSHRFVIQGYSLAKGMGVGKHIASETFAVGGYQWAIYFYPDGKNPEDNSAYVSVFIALASEGTDVRALFELTLQDQSGRGKHKVHSHFDRALDAGPYTLKYRGSMWGYKRFFRRTALETSDFLKDDCLKINCTVGVVTSTMEYSRPHSLEVPDSDIGHHFGTLLESQEGADVIFSVAGEKFHAHKLVLAARSSFFRSEFLDPESDEENSEVDTSNEIKEIVIDDMEPKVFQAVLHFMYRDNLVGDDELSASSSDCPIFDTLAGKLLAAADKYELPRLRVLCESYLCKQISVKSVATTLALADRHHATELKSVCLKFAAENLSAVIRTDGFDYLKDNCPALQSEILRTVAGCEEECSSGGKSQSVWGQISDGGDTSGRRVRPRV

SEQ ID NO: 114241 - protein, 530 aa, Triticum aestivum
  Clone ID: PAT_TA_8659.pep
MMNSRVAMAAWWVCGLLPLLLLAVAADGDSEPLIRLPTENGHAPAPAPGPAASAPEEGVTKWAVLVAGSSGYENYRHQADVCHAYQILKKGGLKDENIVVFMYDDIANSPENPRRGVVINHPKGKDVYHGVPKDYTGEHVTAKNLYAVLLGNKTAVTGGSRKVINSKPNDHIFIYYTDHGGAGSLGMPNVPFVYAGDFIKVLRQKHASKSYSKMIIYVEACESGSIFEGLMPQDHNIYVTTAANAEESSWAAYCPGMEVPPPSEYKTCLGDAYSVSWMEDSETHNLKKESIKQQYEVVKARTAPPNESSIGSHVMEYGDKTFKGDMLFLYQGFDPAKSYSSYFRQRLPSLKGAINQRDADILFMWKKYEQLNGGSEEKQRALTEIKETVLHRKHLDSSIDFIGKLVFGFEKGPSVLDAARGSGQPLVDDWDCLKTMVRIFESQCGSLTQYGMKHMRAFANICNNGVSEAEMKEASISACDDYDMGKWSPLASRAAAPDPPALQYMGAVRLYQMLQRFLARPHIWCTYKHT

SEQ ID NO: 114242 - protein, 327 aa, Triticum aestivum
  Clone ID: PAT_TA_8660.pep
MAEHLASIFGTEKDRVNCPFYFKSGACRHGDRGSRLHNRPTTSPTIVLANMYQGPDMITPGVDAQGVAIAPEKMQEHFEDFYEDIYEELSKFGEVETLNVCDNLADHMIGNVYVQFREEEQAVAAHNALQGRFYSGRPIIVEYSPVTDFREATCRQFEENSCNRGGYCNFMHVKQIGRELRRKLYGGRSRRSHGRSRSPSPQHRRDNRDRGGDFRRDGRDEYRGGGGGGGGGYRGGDGGDGGGYRGGGGGGGYRGGDGGGYRGGGGGGYRGGGRGGGGGRHDRYDDGPRRRYGGSPPRRGRSPPARENSEERRAKIEQWNREREEKK

SEQ ID NO: 114243 - protein, 337 aa, Triticum aestivum
  unsure (1)..(337): unsure at all Xaa locations
  Clone ID: PAT_TA_8661.pep
MAPELAGKMTAKAAVAAAKPATKAYVTFLAGAGDYWMGVVGLAKGLRKVGSAYPLVVAVLPDVPELHRKILVSQGCIVREIAPVYPPENHTQFAMAYYVINYSKLRIWEFVEYERMVYLDADIQVFDNIDELFDLPKGHFYAVMDCFCEKTWSHTPQYQIGYCQQCPEKXVTWPAAEMGPPPALYFNAGMFVHEPSMATAKALLDTLRVTPTTPFAEQDFLNMFFREQYKPIPLVYNLVLAMLWRHPENVQLEKVKVVHYCAAGSKPWRFTGKEENMDREDIRILVRNWWDIYNDESLDFKGLAADADELEAAAKKPLRAALAEAGTVKYVTAPSAA

SEQ ID NO: 114244 - protein, 113 aa, Triticum aestivum
  Clone ID: PAT_TA_8662.pep
LTRGSSSNPSDLTPNFAFPHPSAPSPSADQPISHAMSQTVELRVGMSCEGCVGAVKRVLGKMEGVESFDVDIKEQKVTVKGNVTPDAVLQTVSKTGKKTSFWEAEPSASAVSS

SEQ ID NO: 114245 - protein, 322 aa, Triticum aestivum
  Clone ID: PAT_TA_8663.pep
MAEHLASIFGTEKDRVNCPFYFKIGACRHGDRCSRLHNRPTTSPTIVLANMYQRPDMITPGVDAQGVAIAPEKMQEHFEDFYEDIYEELSKFGEVETLNVCDNLADHMIGNVYVQFREEEQAVAAHNALQGRFYSGRPIIVEYSPVTDFREATCRQFEENSCNRGGYCNFMHVKQIGRELRRKLYGGRSRRSHGRSRSPSPQHRRDNRDRGGDFRRDGRDEYRGGGGGGGYRGGDGGDGGGYCGGGGGGYRGGDGGGYRGGGGGGYRGGGRGGGGRHDRYDDGPRRRYGGSPPRRGRSPPARENSEERRAKIEQWNREREEK

SEQ ID NO: 114246 - protein, 340 aa, Triticum aestivum
  Clone ID: PAT_TA_8664.pep
QQQSPFSQQQQQPGFSQQQQPPFSQQPLISQQQQLPFSQQQQPQFSQQQQPPYSQQQQPPYSQQQQPPFSQQQQPPFSQQQQPSFSQQQQQPPFTQQQQPPFSQQSPISQQQQQQQQQQQQPFTQQQQPPFSQQPPISQQQQPPFSQQQQPPFSQQQQIPVIHPSVLQQLNPCKVFLQQQCIPVAMQRCLARSQMLQQSICHVMQRQCCQQLRQIPEQSRHESIRAIIYSIILQQQQQQQQQQQQQQQGQSIIQYQQQPPQQLGQCVSQPQQQLQQQLGQQPQQQQLAHGTFLQPHQIAQLEVMTSIALRTLPRMCSVNVPLYETTTSVPLGVGIGVGVY

SEQ ID NO: 114247 - protein, 183 aa, Triticum aestivum
  Clone ID: PAT_TA_8665.pep
ATQYSQPQQPISQQQQQQQQQQQQQQQEQQILQQILQQQLIPCMDVVLQQHNIAHGRSQVLQQSTYQLLQELCCQHLWQIPEQSQCQAIHNVVHAIILHQQQKQQQQPSSQFSFQQPLQQYPLGQGSFRPSQQNPQAQGSVQPQQLPQFEEIRNLALQTLPAMCNVYIPPYCTIAPFGIFGTN

SEQ ID NO: 114248 - protein, 134 aa, Triticum aestivum
  Clone ID: PAT_TA_8666.pep
FPPQQPYPQLQPFPSQQPYMQLQPFPQPQLPYPQPQLPYPQPQPFRPQQSYPQPQPQYSQPQQPISQQQQQQQQQPQQQQLAQGTFLQPHQIAQLEVMTSIALRTLPTMCRVNVPLYRTTTSVPFGVGTGVGSY

SEQ ID NO: 114249 - protein, 174 aa, Triticum aestivum
  Clone ID: PAT_TA_8667.pep
QILQQILQQQQLIPCRDVVLQQHNIAHASSQVLQQSSYQLLQQLCCQRLWQIPEQSRCQAIHNVVHAIILQQQQQQQQQQQQQQQQQQQQQQQQQQPSSQVSYQQPQQQYPSGQGSFQPSQQNPQAQGSVQPQQLPQFEEIRNLALQTLPAMCNVYIPPYCSTTIAPSGIFGTN

SEQ ID NO: 114250 - protein, 322 aa, Triticum aestivum
  Clone ID: PAT_TA_8668.pep
TEHLMRFISKDPQGYVPISVIAGFKKIKALVHNNPMLAAALRTSSKLVVSGDGKRVKRRHPFTESDMQEFQSRIVVAENLPGDPSYQNLMKIFSAVGSVRTIRTCYPQTPNGPGPATNRSAKLDMLFANKLHAFVEYETHEDAEKAILELNDERNWRNGLRSRLLNTCMTKGPVKGKTGGHEGDGNGEEDVSTSNQSNERQLEGSFQLSDVLPEHLFDENNSDKQGPKRGKGRGRCGKGRGRGYHQLNNNHHYIHNGSNHHQVINSRGSHPVGTPPNTQLIMVEQLLPVANKQPPGPRMPDGTRGFAMGRGKPSSASCAVEL

SEQ ID NO: 114251 - protein, 502 aa, Triticum aestivum
  Clone ID: PAT_TA_8669.pep
MHMMNSRVAMAAWWVCGLLPLLAMAAAAADGVKGNSEPLIRLPTENGHAPAPAPGPAASAPGEEVTKWAVLVAGSSGYENYRHQADVCHAYQILKKGGLKDENIVVFMYDDIANSPENPRRGVVINHPKGKDVYHGVPKDYTGEQVTAKNLYAVLLGNKTAVTGGSRKVINSKPNDHIFIYYTDHGGAGSLGMPNVPFVYAGDFIKVLRQKHASKSYSKMIIYVEACESGSIFEGLMPQDHNIYVTTAANAQESSWAAYCPGMETPPPSEYKTCLGDAYSVSWMEDSETHNLKKESIKQQYEVVKARTAPRNESSIGSHVMEYGDRTFKDEMLFLYQGFDPAKSSITKRQLLMPSLKGAINQRDADILFMWNKYEQLDGGSEEKRRALRKIRETVFHRKHLDSSIDFIGKLVFGFEKGPSVLDAARGSGQPLVDDWDCLKTMVRVFESQCGSLTQYGMKHMRAFANICNNGVSEAEMKEASISACDDYDMGKWSPLVRGHSA

SEQ ID NO: 114252 - protein, 217 aa, Triticum aestivum
  unsure (1)..(217): unsure at all Xaa locations
  Clone ID: PAT_TA_8670.pep
MKTLLIVTILAMATTIATANMQVDPGYQVQWPQQQPFPQXPQQPFCQQPQQTIPQPHQTFHHQXPQQTYPHQPQQQFPQTQXQPQQPFPQPQQTFPQQPQLPFPQQPQQPFPQXPQQPQQQFPQSQQPQQPFPQPQQQFLQPQQPQQSFPQQQQPLIQAXLQQQMNPCKXNFLLQQCNPVSLVXSLXXMILPRSXCQXCNNNCCQQTGTKILQRFPR

SEQ ID NO: 114253 - protein, 116 aa, Triticum aestivum
  Clone ID: PAT_TA_8671.pep
AGPGSRRRRPTPPTSPPTFPFPPPSRPRRHADQPISHAMSQTVELRVGMSCEGCVGAVKRVLGKMEGVESFDVDIKEQKVTVKGNVTPDAVLQTVSKTGKKTSFWEAEPSASAVSS

SEQ ID NO: 114254 - protein, 300 aa, Triticum aestivum
  unsure (1)..(300): unsure at all Xaa locations
  Clone ID: PAT_TA_8672.pep
MKTFLIISLLAIVATTATTAVRVPVPQLQPQNPSLQQPQEQVPLVQQQQFPGQQQTFPPQQPYPQPQPFPAQQPYPQPQLFPQPQPFPPQLPYPKPQPFPPQQPYPQPQTQHLQPQQPISQQQAQQQQQQQQQILQQILQQILQQQQLIPCRDVIVLQLHNIAHESSQVLQQSSYQVLQQLCCQQLWQIPELSRCQAIHNVVHAIILHQQQQQQQQEQHQPSSQVSYQQPQXQYPSGPRAPSSPSQXNPQAQGFVQPQRLPQLKEIRNLALQTXLPAMCNVYIPPYCSTTIAPFGIFGTN

SEQ ID NO: 114255 - protein, 428 aa, Triticum aestivum
  Clone ID: PAT_TA_8673.pep
QFLGQQQPFPPQQPYPQPQPFPSQQPYLQLQPFPQPQLPYSQPQPFRPQQPYPQPQPQYSQPQQPISQQQQQQQQQQQQQQQFPQQQQPLLPQQPPFSQQQPPFSQQQQQPPFSQQQQQPILLQQPPFSQHQQPVLPQQQIPSVQPSILQQLNPCKVFLQQQCSPVAMPQSLARSQTLWQSSCHVMQQQCCRQLPQIPEQSRYDAIRAIIYSIVLQEQQHGQGLNQPQQQQPQQSVQGVSQPQQQQKQLGQCSFQQPQQQQQQQQQQQQQQQQQQILQQILQQQLIPCMDVVLQQHNIAHGRSQVLQQSTYQLLQELCCQHLWQIPEQSQCQAIHKVVHAIILHQQQKQQQQPSSQVSFQQPLQQYPLGQGSFRPSQQNPQAQGSVQPQQLPQFEEIRNLALQTLPAMCNVYIPPYCTITPFGIFDTN

SEQ ID NO: 114256 - protein, 214 aa, Triticum aestivum
  Clone ID: PAT_TA_8674.pep
QPYLQLQPFPQPQLPYPQPQLPYPQPQPFRPQQPYPQPQPQYSQPQQPISQQQQQQQQQILQQILQQQLIPCRDVVLQQHNIAHGRSQVLQQSTYQLVQQLCCQQLWQIPEQSRCQAIHNVVHAIILHHHQQQQQQQQPLTQVSFQQPQQQYPSGQGSFQPSQQNPQAQGSVQPQQLPQFEEIRNLALETLPAMCNVYIPPYCTIAQVGIFGTN

SEQ ID NO: 114257 - protein, 493 aa, Triticum aestivum
  unsure (1)..(493): unsure at all Xaa locations
  Clone ID: PAT_TA_8675.pep
MMNSRVAMAAWWVCGLLPLLAVGYSEPLIRLPTENGHAPAPAPGPAASAAEEGVTKWAVLVAGSAGYENYRHQADVCHAYQILKKGGLKDENIVVFMYDDIANSPDNPRRGTVINHPKGKDVYHGXVPKDYTGDQVTAKNLYAVLLGNKTAVTGGSRKVINSKPEDHIFIFYSDHGSPGSLGMPNGPDVYADDFIKVLRQKHASKSYSKMVIYVEACESGSIFEGLMPQDYNIYVTAASNAVESSWXAAYCPDDGTPPPPEYFTCLGDLYSVSWMEDSETQNLKNETIKQQYEVVKARTAPRNESIRGSHVMEYGDKTFKEDMLFLYQGFDPAKSSIRNRPLPMPSLKGAIKQRDADILFMWKKYGKLNGGSEEKQRALREVKETVLHRKHLDSSIDFIGKLVFGFDKGPLVLEAARGSGQPLVDDWDCLKTMVRVFESQCGSLTQYGMKHTRAFANMCNNGVSEAEMKEASISACDGYDMGRWSPLVRGYSA

SEQ ID NO: 114258 - protein, 166 aa, Triticum aestivum
  unsure (1)..(166): unsure at all Xaa locations
  Clone ID: PAT_TA_8676.pep
MNVEKLKKMAGAVRTGGKGSMRRKKKAVHKTTTTDDKRLQSTLKRVGVNTIPGIEEVNIFKDDVVIQFLNPKVQASIGANTWVVSGTPQTKKLQDLLPSIINQLGPDNLDNLRRLAEQFQKQVPGGAAGIEAGASAGAAQADDDDDVPELVPGXFEEAAEEKKAES

SEQ ID NO: 114259 - protein, 169 aa, Triticum aestivum
  Clone ID: PAT_TA_8677.pep
TRERESRERERERERERERERERERERERERERERERERHATALTSVRIYSPLSRQFLLPSSSNPSDSRHVAFPPRALPSPSADQPISHAMSQTVELRVGMSCEGCVGAVKRVLGKMEGVESFDVDIKEQKVTVKGNVTPDAVLQTVSKTGKKTAFWEAEPSAASAVSS

SEQ ID NO: 114260 - protein, 140 aa, Triticum aestivum
  unsure (1)..(140): unsure at all Xaa locations
  Clone ID: PAT_TA_8678.pep
MSDLDVTLPSAFDPFAEANAEDAGCKAPGAKRLCCMCASKQAQRAGKSLDQLSKGLKKGVQATTKILKGFSKKXEFCCKWHSIQGFRELRPRSFKLQGDXQRKNVATSLSKLGLXRRTXQIHGPNPSDKSRTQPVYLYED

SEQ ID NO: 114261 - protein, 208 aa, Triticum aestivum
  Clone ID: PAT_TA_8679.pep
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIEEVRTERGSDVIIVLVGNKTDLVDKRQVSIEEGEGKAKDLGVMFIETSAKAGFNIKALFRKIAAALPGMETLSSAKQEDMVDVNLKSSNANSSQSQAQAGGCSC

SEQ ID NO: 114262 - protein, 235 aa, Triticum aestivum
  unsure (1)..(235): unsure at all Xaa locations
  Clone ID: PAT_TA_8680.pep
SNSRGFSQQQQQPILLQQPPFSQHQQPVLPQQPPFSQQQQQPILPQQPPFSQQQQPVLLQQQIPFVHPSILQQLNPCKVFLQQQCSPVAMXQSLARSQMLQQSSCHVMQQQCCQQLPQIPQQSRYEAIRAIVYSIILQEQQQVQGSIQTQQQQPQQLGQCVSQPQQQSQQQLGQQPQQQQLAQGTFLQPHQIAQLEVMTSIALRTLPTMCNVNVSLYRTTTRVPFRRWAPEFVGY

SEQ ID NO: 114263 - protein, 320 aa, Triticum aestivum
  Clone ID: PAT_TA_8681.pep
MKTFLIISLLAIVATTATTAVRVPVPQLQPQNPSLQQPQEQVPLVQQQQFPGQQQTFPPQQPYPQPQPFPGQQPYPQPQLFPQPQPFPPQLPYPQPQPFPPQQPYPQPQTHHLQPQQPISQQQVQQQQQQQQQQQQQQQQQQQQQQQLLLQQQILQQILQQQQLIPCRDVIVLQQHNIAHESSQVLQQSSYQVLQQLCCQQLRLIPEQSRCQAIHNVVHAIILHQQQQQQQQQQQQQQGQHQPSSQVSYQQPQQQYPSGQGSFQPSQQNPQAQGFVQPQHLPQLEEISNLALQTLPAMCNVYIPPYCSTTIAPFGIFGTN

SEQ ID NO: 114264 - protein, 115 aa, Triticum aestivum
  Clone ID: PAT_TA_8682.pep
MSDLDVTLPSAFDPFAEANAEDAGAGPGAKDYVHVRIQQRNGRKSLTTVQGLKKEFSYNKILKDLKKEFCCNGTVVQDPELGQVIQLQGDQRKNVATFLVQAGIAKKELIKIHGF

SEQ ID NO: 114265 - protein, 301 aa, Triticum aestivum
  Clone ID: PAT_TA_8683.pep
MKTFLILALLAIVATTTTTAVRVPVPQLQPQNPSQQQPQEQVPLVQQQQFLGQQQQQFPGQQQPFPPQQPYPQPQPFLPQLPYPQPQPFPPQQSYPQPQPQYPQPQQPISQQQAQLQQQQQQQQQQQQQQQQQQQILQQILQQQLIPCRDVVLQQPNIAHASSKVSQQSYQLLQQLCCLQLWQTPEQSRCQAIHNVIHAIILHHQQQQQQQQQQQQQQQQQQQPSSQVSYQQPQQQYPSGQGFFQPSQQNPQAQGFVQPQQLPQFEEIRNLALQTLPAMCNVYIPPYCSTTIAPFGIMSTN

SEQ ID NO: 114266 - protein, 426 aa, Triticum aestivum
  unsure (1)..(426): unsure at all Xaa locations
  Clone ID: PAT_TA_8684.pep
MDDDAGDASPPPGPAPPAATGAPSLRDMAASPTSSRSVTETVNGSHRFVIQGYSLAKGMGVGKHIASETFTVGGYQWAIYFYPDGKNPEDNSAYVSVFIALAFEGTDVRALFELTLQDQSGKGKHKVHSHFDRSLESGPYTLKYRGSMWGYKRFFRRTALETSDFLKDDCLRINCTVGVVVSTIDYSRPHSIQVPDSDLGYHFGSLLDSNEGVDVILNVSGERFHAHKLVLAARSTVFRSKLFDDESEGDKNEVNESEDLKEIVLDDLEPKVFKAMLHFIYRDTLVDDYELDASGSMGSIFDTLAAKLLAAADKYDLGRLRLLCESYLCKGISVASVASTLALADSHHAMELKAVCLKFAAENLSAVIRTDGFDYLKDNCPSLQSEILRTVAGCEEPCSSGGKSQSVWGQLSXGGDTSGRRVRPRI

SEQ ID NO: 114267 - protein, 653 aa, Triticum aestivum
  Clone ID: PAT_TA_8685.pep
MEVDTLQDAEETKNGGNDFEENGSLDPVVYQLVRVEGDGTLVPPTEDEVLQIEQFLDDKVDLPSIDDVGNVEDFFTNDCMLLKEPDFEEGYSELETNGEIHTQQFDADLEVDRLKPSDDSLDIPSKCTVVHDHKPDKLNTEQGDNNIVHQDNASTETPKSTVLNDSCSAEKEKADACSRSVNNSSTGPSVSGVTSSVPDFSILRGEVCLDNLTIRELQEAFRATFGRETTVKDKLWLKRRITMGLTNSCDVQSSGCVVKDYKIVCKDAKHELPTIEGIPKAEVEATSLVRFQVLGSGNERDTSSCSYYRSEDQQRSSNRLKGVSTDNDESEGTLQDEQGAAKRLRKPTKRYIEELADTETLDSTGKLSSPGKRAAHGEVLLRQRVTPLQEVDSLSITYPTRKDTFGGFSVHVPYASRMRRGRPRRNFISFLDDDPPVECPEVQMAVETMLGKDGEHVNHVSSAVEVPLMKNAEKKGGHIETAEKKGGHIETAEKKGGHIETADNKEIRSIEADDICRTDAKTKTKRGLKRKHHRAWTLSEVLKLVDGVAQFGPGKWSEIRRLSFASYSYRTSVDLKDKWRNLLRASQTQLSPEKDGVCPRKSNPSIIPKPPAILLRVKELAELQPQAGNLAAAIKFSGQSSKVAQGKGSSGFL

SEQ ID NO: 114268 - protein, 277 aa, Triticum aestivum
  Clone ID: PAT_TA_8686.pep
IVATTATTAVRVPVPQLQPQNPSQQQPQEQVPLVQQQQFLGQQQPFPPQQPYPQPQPFPSQQPYLQLQPFLQPQLPYSQPQPFRPQQPYPQPQPQYSQAQQPISQQQQQQQQQQQQQQQQQQQQILQQILQQQLIPCMDVVLQQHNIAHGRSQVLQQSTYQLLQELCCQHLWQIPEQSQCQAIHNVVHAIILHQQQKQQQQPSSQVSFQQPLQQYPLGQGSFRPSQQNPQAQGSVQPQQLPQYEEIRNLALQTLPAMCNVYIPPYCTIAPFGIFGTN

SEQ ID NO: 114269 - protein, 172 aa, Triticum aestivum
  Clone ID: PAT_TA_8687.pep
WIPRAAGIRHQQQQQQEQQILQQILQQQLIPCMDVVLQQHNIAHGRSQVLQQSTYQLLQELCCQHLWQIPEQSQCQAIHNVVHAIILHQQQKQQQQPSSQVSFQQPLQQYPLGQGSFRPSQQNPLAQGSVQPQQLPQFEEIRNLALQTLPAMCNVYIPPYCTIVPFGIFSTN

SEQ ID NO: 114270 - protein, 293 aa, Triticum aestivum
  unsure (1)..(293): unsure at all Xaa locations
  Clone ID: PAT_TA_8688.pep
MKTFLVFALLALAAASAVAQISQHQXAPPFSQQQQPPFSQQQQPPFSQQQQAPPFSQQQQQPPFTQQQQQQQQQQPFTQQQQPPFSQQPPISQQQQPPFLQQQRPPFSRQQQIPVIHPSVLQQAKPMQGYSSNSKCIPVAMQRCLARSQMLQQSICHVMQQQCCQQLRANXPEQSRHESIRAIIYSIILQQQXKQQQQQQQQQQGQSIIQYQQQQPXNKLGQCVSQPLQQLQXKQLGQQPQQQQLAHQIAQLEVMTSIALRTLPTMCNVNVPLYXETTTXSVPLGVGIGVGVY

SEQ ID NO: 114271 - protein, 279 aa, Triticum aestivum
  Clone ID: PAT_TA_8689.pep
MVRVPVPQLQPQNPSQQQPQEQVPLVQQQQFLGQQQPFPPQQPYPQLQPFPSQQPYMQLQPFPQPQLPYPQPQPFRPQQLYPQPQPQYSQPQQPISQQQQQQQQQQQPISQQQQQQQQQQQQQQILQQILQQQLIPCMDVVLQQHNIARGSSQVLQQSTYQLLQELCCQHLWQIPEKLQCQAIHNVVHAIILHQQQQQQQQQQPLSQVSFQQPQQQYPLGQGSFRPSQQNPQAQGSVQPQQLPQFEEIRNLALQTLPAMCNVYIPPYCTIAPFGIFGTN

SEQ ID NO: 114272 - protein, 167 aa, Triticum aestivum
  Clone ID: PAT_TA_8690.pep
MNVEKLKKMAGAVRTGGKGSMRRKKKAVHKTTTTDDKRLQSTLKRVGVNTIPGIEEVNIFKDDVVIQFLNPKVQASIGANTWVVSGTPQTKKLQDLLPSIINQLGPDNLDNLRRLAEQFQKQVPGGAAGIEAGTSAGAAQADDDDDVPELVPGETFEEAAEDKKAES

SEQ ID NO: 114273 - protein, 303 aa, Triticum aestivum
  Clone ID: PAT_TA_8691.pep
MKTFLVFALIAVVATSAIAQMETSCISGLERPWQQQPLPPQQSFSQQPPFSQQQQQPLPQQPSFSQQQPPFSQQQPILSQQPPFSQQQQPVLPQQSPFSQQQQLVLPPQQQQQQLVQQQIPIVQPSVLQQLNPCKVFLQQQCSPVAMPQRLARSQMWQQSSCHVMQQQCCQQLQQIPEQSRYEAIRAIIYSIILQEQQQGFVQPQQQQPQQSGQGVSQSQQQSQQQLGQCSFQQPQQQLGQQPQQQQQQVLQGTFLQPHQIAHLEAVTSIALRTLPTMCSVNVPLYSATTSVPFGVGTGVGAY

SEQ ID NO: 114274 - protein, 372 aa, Triticum aestivum
  unsure (1)..(372): unsure at all Xaa locations
  Clone ID: PAT_TA_8692.pep
GKPAAIQYGTGSIAGYFSEDSVTVGDLVEKDQEFIEATKEPGVTFLVAKFDGILGLGFKEISVGKAVPVWYNMVEQGLISDPVFSFWLNRHADDEGEGGEIIFGXGMDPKHYVGEHTYVPVTQKGYWQFDMGDVLVGGKSTGFCAGGCAAIADSGTSLLAGPTAIITEINEKIGAAGVVSQECKTIVSQYGQQILDLLLAETQPKKICSQVGLCTFDGTRGVSAGIRSVVDDEPVKSNGLRTDPMCSACEMAVVWMQNQLAQNKTQDLILDYVNQLCNRLPSPMGESAVDCASLGSMPDIEFTIGGKKFALKPEEYILKVGEGAAAQCISGFTAMDIPPPRGPLWILGDVFMGPYHTVFDYGKLRVGFAKAA

SEQ ID NO: 114275 - protein, 182 aa, Triticum aestivum
  unsure (1)..(182): unsure at all Xaa locations
  Clone ID: PAT_TA_8693.pep
MAALIKLGSLLRQSALASSASTGSAPALFNAARFMCAGQPAGGNKLFVGGLAWATDDHSLKEAFQSFGEVVEARVITDRETGRSRGFGFVSFANEADADSAAKGMDGQELAGRNVRVNFANERPSGGGGFXAGGGGYGGGGGFGGGGGYGGGRRRLWRWWPEVAVAMVVTVKLSKESADYQI

SEQ ID NO: 114276 - protein, 176 aa, Triticum aestivum
  Clone ID: PAT_TA_8694.pep
MAALIKLGSLLRQSAVASSASTGSAPALFNAARFMCAGQPADGSKLFVGGLAWATDDHSLKEAFQCFGEVVEARVITDRETGRSRGFGFVSFASGEDAKSAAENMDGKELAGRSVRVNFANERPSGGGGGGGFSRGGGGYGGGGGGYGGGGFGGGGGYGGGRGGGGGGYGGDRESY

SEQ ID NO: 114277 - protein, 175 aa, Triticum aestivum
  Clone ID: PAT_TA_8695.pep
MAALIKLGSLLRQSAVASSASTGSAPALFNAARFMCAGQPADGSKLFVGGLAWATDDHSLKEAFQSFGEVVEARVITDRETGRSRGFGFVSFASGEDAKSAAENMDGKELAGRNVRVNFANERPSGGGGGGFSRGGGGYGGGGGGYGGGGYGGGGGYGGGRGGGGGGYGGDHESY

SEQ ID NO: 114278 - protein, 287 aa, Triticum aestivum
  Clone ID: PAT_TA_8696.pep
MKTFLILVLLAIVATTATTAVRFPVPQLQPQNPSQQQPQEQVPLVQQQQFLGQQQPFPPQQPYPQPQPFPSQLPYLQLQPFPQPQLPYSQPQPFRPQQPYPQPQPQYSQPQQPISQQQQQQQQQQQQQQQQQQQILQQILQQQLIPCMDVVLQQHNIAHGRSQVLQQSTYQLLQELCCQHLWQIPEQSQCQAIHNVVHAIILHQQQKQQQQPSSQVSFQQPLQQYPLGQGSFRPSQQNPQAQGSVQPQQLPQFEEIRNLALQTLPAMCNVYIPPYCTIAPFGIFGTN

SEQ ID NO: 114279 - protein, 115 aa, Triticum aestivum
  Clone ID: PAT_TA_8697.pep
MSDLDVTLPSAFDPFAEANAEDAGAGSGAKDYVHVRIQQRNGRKSLTTVQGLKKEFSYNKILKDLKKEFCCNGTVVQDPELGQVIQLQGDQRKNVATFLVQAGIAKKELIKIHGF

SEQ ID NO: 114280 - protein, 265 aa, Triticum aestivum
  Clone ID: PAT_TA_8698.pep
FGTRSPVPQLQPQNPSQQQPQEQVPLVQQQQFPGQQQQFPPQQPYPQPQPFPSQQSYPQPQPQYPQPQQPISQQQAQLQQQQQQQQQQQILQQILQQQLIPCRDVVLQQPNIAHASSQVSQQSYQLLQQLCCQQLWQTPEQSRCQAIHNVIHAIILHHQQQQQQQQQQQQQQQQQQQQQQQQQQQQQPSSQVSYLQPQQQYPSGQGSFQPSQQNPQAQGFVQPQQLPQFEEIRNLALQTLPAMCNVYIPPYCSTTIAPFGIMSTN

SEQ ID NO: 114281 - protein, 265 aa, Triticum aestivum
  Clone ID: PAT_TA_8699.pep
TRKHYVGEHTYVPVTQKGYWQFDMGDVLVGGKSTGFCAGGCAAIADSGTSLLAGPTAIITEINEKIGAAGVVSQECKTIVSQYGQQILDLLLAETQPKKVCSQVGLCTFDGTRGVSAGIRSVVDDEPVKSNGLRTDPMCSACEMAVVWMQNQLAQNKTQDLILDYVNQLCNRLPSPMGESAVDCASLGSMPDIEFTIGGKKFALKPEEYILKVGEGAAAQCISGFTAMDIPPPRGPLWILGDVFMGPYHTVFDYGKLRVGFAKAA

SEQ ID NO: 114282 - protein, 291 aa, Triticum aestivum
  Clone ID: PAT_TA_8700.pep
MKTFPILALLAIVATTATTAVRVPVPQLQLQNPSQQQPQEQVPLVQEQQFPGQQQPFPPQQPYPQPQPFPSQQPYLQLQPFPQPQLPYPQPQPFRPQQPYPQPQPQYSQPQQPISQQQQQQQQQQQQQQQILQQILQQQLIPCRDVVLQQHNIAHGSSQVLQESTYQLVQQLCCQQLWQIPEQSRCQAIHNVVHAIILHQQHHHHQQQQQQQQQQPLSQVSFQQPQQQYPSGQGFFQPSQQNPQAQGSFQPQQLPQFEAIRNLALQTLPAMCNVYIPPYCTIAPFGIFGTN

SEQ ID NO: 114283 - protein, 219 aa, Triticum aestivum
  Clone ID: PAT_TA_8701.pep
MGSEGPSIVTVHVTGFKKFHGVAENPTEKLVTNIKSFIEKRGLPKNLVLGSCEILETAGQGALGTLYKVLESAIADRENGSSAQGQIIWVHFGVNSGASRFALENQAVNEATFRCPDELGWKPQRVPIVPSDGSISRTRETTLPVKELTKSLRKTGYDVMPSDDAGRFVCNYVYYHSLRFAEQHGIKSLFVHVPLFSTVDEEVQIHFVASLVEALASLN

SEQ ID NO: 114284 - protein, 279 aa, Triticum aestivum
  Clone ID: PAT_TA_8702.pep
QQPPFSQQQPPFLQQQQPVLPQQPPFSQQQQQFPQQQQPLLPQQPPFSQQQPPFSQQQQQPPFSQQQQQPILPQQPPFSQHQQPVLPQQQIPSVQPSILQQLNPCKVFLQQQCSPVAMPQSLARSQMLWQSSCHVMQQQCCRQLPQIPEQSRYDAIRAIIYSILLQELCCQHLWQIPEQSQCQAIHNVVHAIILHQQQKQQQQLSSQVSFQQPQQQYPLGQGSFRPSQQNPQAQGSVQPQQLPQFEEIRNLALQTLPAMCNVYIPPYCTIAPFGIFGTK

SEQ ID NO: 114285 - protein, 241 aa, Triticum aestivum
  Clone ID: PAT_TA_8703.pep
MVVVLPQQPSFSQQQLPPFSQQQPPFSQQQQPVLPQQPPFSQQQQQQPILPQQPSFSQQQQQLVLPQQQIPFVHPSILQQLNPCKVFLQQQCSPVAMPQSLARSQMLQQSSCHVMQQQCCQQLPQIPQQSRYEAIRAIIYSIVLQEQQQVRGSIQTQQQQPQQLGQCVSQPQQQSQQQLGQQPQQQQLAQGTFLQPHQIAQLEVMTSIALRTLPMMCRVNVPLYRTTTSVPFGVGTGVGAY

SEQ ID NO: 114286 - protein, 301 aa, Triticum aestivum
  Clone ID: PAT_TA_8704.pep
QPIQQQPQPFPQQPPCSQQQQPPLSQQQQPPFSQQQPPFSQQQQPVLPQQPPFSQQQQQFPQQQQPLLPQQPPFSQQQPPFSQQQQQPPFSQQQQQPILLQQPPFSQHQQPVLPQQQIPSVQPSILQQLNPCKVFLQQQCSPVAMPQSLARSQTLWQSSCHVMQQQCCRQLPQIPEQSRYDAIRAIIYSIVLQEQQHGQGLNQPQQQQPQQSVQGVSQPQQQQKQLGQCSFQQPQQQQLGQWPQQQQVPQGTLLQPHQIAQLEVMTSIALRTLPTMCSVNVPVYGTTTIVPFGVGTRVGAY

SEQ ID NO: 114287 - protein, 239 aa, Triticum aestivum
  unsure (1)..(239): unsure at all Xaa locations
  Clone ID: PAT_TA_8705.pep
RHEAQPQPXPPQLPYPQPQSFPPQQPYPQQQPQYLQPQQPISQQQQQQQAQQQQQQQQQQQQQQQILQQILQQQLIPCRDVVLQQHNIAHAXSQVLQQSTYQLLQQLCCQQLLQIPEQSRCQAIHNVAHAIIMHQQQQQQQEQQQQLQQQQQQQLQQQRQQPSSQVSFQQPQQQYPSSQVSFQPSQLNPQAQGSVQPQQLPQFAEIRNLALQTLPAMCNVYIPPHCSTTIAPFGIFGTN

SEQ ID NO: 114288 - protein, 307 aa, Triticum aestivum
  Clone ID: PAT_TA_8706.pep
MKTFLVFALLTVAATSAIAQMETRCIPGLERPWQQQPLPPQQTFPQQPLFSQQQQQQLFPQQPSFSQQQPPFWQQQPPFSQQQPILPQQPPFSQQQQLVLPQQPPFSQQQQPVLPPQQSPFPQQQQQHQQLVQQQIPVVQPSILQQLNPCKVFLQQQCSPVAMPQRLARSQMLQQSSCHVMQQQCCQQLPQIPQQSRYEAIRAIIYSIILQEQQQVQGSIQSQQQQPQQLGQCVSQPQQQSQQQLGQQPQQQQLAQGTFLQPHQIAQLEVMTSIALRILPTMCSVNVPLYRTTTSVPFGVGTGVGAY

SEQ ID NO: 114289 - protein, 115 aa, Triticum aestivum; identical to SEQ ID NO: 114264
  Clone ID: PAT_TA_8707.pep

SEQ ID NO: 114290 - protein, 508 aa, Triticum aestivum
  Clone ID: PAT_TA_8708.pep
MGTRGLAVLLLAAVLLQGLLPASEAEGLVRIALKKRAIDRNSRVAKSLSDREEVHLLGGASNTLPSEEEGDIVSLKNYMNAQYFGEIGVGTPPQKFTVIFDTGSSNLWVPSAKCYFSIACYLHARYKAGASSTYKKNGKPAAIQYGTGSIAGYFSEDSVTVGDLVVKDQEFIEATKEPGVTFLVAKFDGILGLGFKEISVGKAVPVWYNMVEQGLISDPVFSFWLNRHADDEGEGGEIIFGGMDPKHYVGEHTYVPVTQKGYWQFDMGDVLVGGKSTGFCAGGCAAIADSGTSLLAGPTAIITEINEKIGAAGVVSQECKTIVSQYGQQILDLLLAETQPKKICSQVGLCTFDGTRGVSAGIRRVVDDEPVKSNGLRTDPMCSACEMAVVWMQNQLAQNKTQDLILDYVNQLCNRLPSPMGESAVDCASLGSMPDIEFTIGGKKFALKPEEYILKVGEGAAAQCISGFTAMDIPPPRGPLWILGDVFMGPYHTVFDYGKLRVGFAKAA

SEQ ID NO: 114291 - protein, 300 aa, Triticum aestivum
  unsure (1)..(300): unsure at all Xaa locations
  Clone ID: PAT_TA_8709.pep
MKTFLVFALLAVVATSAIAQMETSCIPGLERPWQQQPLQQKETFPQQPPSSQQQQPFPQQPPFLQQQPSFSQQPLFSQKQQPVLPQQPAFSQQQQTVLPQQPAFSQQQHQQLLQQQIPIVHPSILQQLNPCKVFLQQQCSPVAMPQHLARSQMWQQSSCNVMQQQCCQQLPRIPEQSRYEAIRAIIFSIILQEQQQGFVQPQQQQPQQSVQGVYQPQQQSQQQLGQCSFQQPQQQLGQQPQXQQQQVQKGTFLQPHQIARLEVMTSIALRTLPTMCSVNVPLYSSITSAPLGVGSRVGAY

SEQ ID NO: 114292 - protein, 258 aa, Triticum aestivum
  Clone ID: PAT_TA_8710.pep
MNKCELCFLLVQQQQFLGQQQPFPPQQPYPQPQPFPSQQPYLQLQPFPQPQLSYSQPQPFRPQQPYPQPQPQYSQPQQPISQQQQQQQQQQQQQQQQQQQQQEQQILQQILQQQLIPCMDVVLQQHNIAHGRSQVLQQSTYQLLQELCCQHLWQIPEQSQCQAIHNVVHAIILHQQQKQQQQPSSQVSFQQPLQQYPLGRGSFRPSQQNPQAQGSVQPQQLPQFEEIRNLALQTLPAMCNVYIPPYCTMAPFGIFGTN

SEQ ID NO: 114293 - protein, 255 aa, Triticum aestivum
  Clone ID: PAT_TA_8711.pep
QEQVPLVQQQQFPGQQQPFPPQQPYPQPQPFPSQQPYLQLQPFPQPQLPYPQPHLPYPQPQPFRPQQPYPQPQPQYSQPQQPISQQQQQQQQQQQQQILQQILQQQLIPCRDVVLQQHSIAYGSSQVLQQSTYQLVQQLCCQQLWQIPEQSRCQAIHNVVHAIILHQQQQQQQQQQQQQPLSQVSFQQPQQQYPSGQGSFQPSQQNPQAQGSVQPQQLPQFEEIRNLALETLPAMCNVYIPPYCTIAPVGFFGTN

SEQ ID NO: 114294 - protein, 188 aa, Triticum aestivum
  unsure (1)..(188): unsure at all Xaa locations
  Clone ID: PAT_TA_8712.pep
MLQQQPPFSQQQQPPFSQQQQQPPFTQQQQPSFSQQPPISQQQQQQQQQQQPFTQQQQPPFSQQPPISQQQQPPFSQQQQPPFSQQQQIPVIHPSVLQQLNPCKVFLQQQCIPVAMQRCLARSQMLQQSICHVMQQXCCQQLRQIPEQSRHESIRAIIYSIILQQQQQQQXNNTQGQSIIQYQQQHPH

SEQ ID NO: 114295 - protein, 250 aa, Triticum aestivum
  Clone ID: PAT_TA_8713.pep
FSQQQPPFSQQQQPVIPQQPSFSQQQLPPFSQQQPPFSQQQQPVLPQQPPFSQQQQPILPQQPPFSQQQQQPVLPQQQIPFVHPSILQQLNPCKVFLQQQCSPVAMPQSLARSQMLQQSSCHVMQQQCCQQLPQIPQQSRYEAIRAIIYSIILQEQQQVQGSIQSQQQQPQQLGQCVSQPQQQSQQQLGQQPQQQQLAQGTFLQPHQIAQLEVMTSIALRTLPTMCRVNVPLYRTTTSVPFGVGAGVGAY

SEQ ID NO: 114296 - protein, 359 aa, Triticum aestivum
  Clone ID: PAT_TA_8714.pep
IAGYFSEDSVTVGDLVVKDQEFIEATKEPGVTFLVAKFDGILGLGFKEISVGKAVPVWYNMVEQGLISDPVFSFWLNRHADDEGEGGEIIFGGMDPKHYVGEHTYVPVTQKGYWQFDMGDVLVGGKSTGFCAGGCAAIADSGTSLLAGPTAIITEINEKIGAAGVVSQECKTIVSQYGQQILDLLLAETQPKKVCSQVGLCTFDGTRGVSAGIRSVVDDEPVKSNGLHTDPMCSACEMAVVWMQNQLAQNKTQDLILDYVNQLCNRLPSPMGESAVDCASLGSMPDIEFTISGKKFALKPEEYILKVGEGAAAQCISGFTAMDIPPPRGPLWILGDVFMGPYHTVFDYGKLRVGFAKAA

SEQ ID NO: 114297 - protein, 309 aa, Triticum aestivum
  unsure (1)..(309): unsure at all Xaa locations
  Clone ID: PAT_TA_8715.pep
MKTFLVFALLAVAATSAIAQMETRCIPGLERPWQQQPLPPQQTFPQQPLFXQQQLFPQQPSFSQQQPPFWQQQPPFSQQQPILPQQPPFSQQQQLVLPQQPPFSQQQQPVLPPQQSPFPQQQQHQQLVQQQIPVVQPSILQQLNPCKLFLQQQCSPVAMPQRLARSQMLQQSSCHVMQQQCCQQLPQIPQQSRYEAIRAIIYSIILQEQQQVQGSIQSQQQQPQQLGQCVSQPQQQSQQQLGQQPQQQQLAQGTFLQPHQIAQLEVMTSIALRILPTMCSVNVPLYRTTTSVPFDVGRIRSAMEVITSS

SEQ ID NO: 114298 - protein, 350 aa, Triticum aestivum
  Clone ID: PAT_TA_8716.pep
MKTFLIFALLAIAATSAIAQMETSRVPGLEKPWQQQPLPPQQQPPCSQQQQPFPQQQQPIIILQQSPFSQQQQPVLPQQQPVIILQQPPFSQQQQPVLPQQPPFSQQQQQQQQQQPPFSQQQQPVLPQQPPFSQQQQPPFSQQQQPSSQQPPFPQQHQQFPQQQIPVVQPSVLQQLNPCKVFLQQQCSHVAMSQRLARSQMWQQSSCHVMQQQCCQQLPQIPEQSRSEAIRAIVYSIILQEQQQGFVQPQQQQPQQSGQGVSQHQQQSQQQQQLGQCSFQQPQQLQQLGQQPQQQQIPQGIFLQPHQISQLEVMTSIALRTLPTMCGVNVPLYSSTTIMPFSIGTGVGGY

SEQ ID NO: 114299 - protein, 292 aa, Triticum aestivum
  unsure (1)..(292): unsure at all Xaa locations
  Clone ID: PAT_TA_8717.pep
MNKWYLLLQQQQPSLPQQSPFSQQQQIVLQQQPPFSQQQQPSLPQQPPFSQQQQPVLPQQPSFSQQQLPPFSQQQSPFSQQQQIVLQQQPPFLQQQQPSLPQQPPFSQQQQQLVLPQQQIPFVHPSILQQLNPCKVFLQQQCSPVAMPQSLARSQMLQQSSCHVMQQQCCQQLPQIPQQSRYEAIRAIIYSIILQEQQQVQGSIQTPQQQPQQLGQCVXSQPQQQSQQQLGQQPQQQQLAQGTFLQPHQIAQLEVMTSIALRTLPTMCRVNVPLYRTTTSVPFGVGTGVGSY

SEQ ID NO: 114300 - protein, 323 aa, Triticum aestivum
  unsure (1)..(323): unsure at all Xaa locations
  Clone ID: PAT_TA_8718.pep
MRYVVLLQDNIAHHLSQASSGQYKSTMKTFLILAILAIVATTATTAVRVPVPQLQPQNPSQQQPQEQVPLVQQQQFPGQQQQFPPQQPYPQPQPFPSQQPYPQPQSFPQPQPFPPQLPYPQPQPFPPQQPYPQPQPQYPQPQQPISQQQAQQQQQQQQQQQQQQRQQILQQILQQQLIPCRDVVLQQLNIAHASSQVLQQSYQQLQQLCCQQLQQTPHQSRCQAIHNVVHAIILHQQQQQRQQQQPSSQFPYQQPQQQYPLGQGSFQPSQQNPEAQGSVQPQQLPQFEEIRNLALQTLPAMCNVYIPPYCXTTIAPFGIIGSN

SEQ ID NO: 114301 - protein, 569 aa, Triticum aestivum
  unsure (1)..(569): unsure at all Xaa locations
  Clone ID: PAT_TA_8719.pep
SSGKDTVDDGKLSERTISDELPQESSKLEQDGTPTTAISSGATLVDNGEANQGLASPKGPASPKGSASPKRPVSPKGPVSPKGPASPKGPASPKEKPEQPEDTKDADQLKSANEGVEPVDAKPKKPSIXDSDKDLKLKPCKSVATPHSNVDVDKEAHVVSGELSADKKVVNGVADNVPKCADTTPDVVKPKRGRPPGPKSSEKKAARNNRSSDLDLKKTEEAMDSTGKLTKRSAKDDTKASTKKTGEGESSKKQQKPSLKQHKEEILSEEDTTKDMTLKEMVSPKSLTKGSGRTKGQSGQNNVMKRKREQDTEETPRSRKDKGLDGSLVGARIKVWWPDDEMFYKGVVDSFDTHSKRHKVAYDDGDVEVLLLRDEKWDFISEEEGKTCDFPSERRGRKGRGITLLPVKEEKIETPKSDGVELPKKRGRPKGWRPNNGGTPSTTPSKSKGKTAVKDAKGTPKTAVEIKKEGKEKATGSANKTKDDLAKDSSNQKLKEVGSKSGDGSVKGRPGRKPKSAATSTPVAGSGSGSVQEKRKEKEEKEEAEASEMEQEASGKGASSTGKKRRRKA

SEQ ID NO: 114302 - protein, 105 aa, Triticum aestivum
  Clone ID: PAT_TA_8720.pep
SGLPPRPRPLGRAIRGGRRRDAAPSAAGRRAGSPSPSSSSTRRAAGRGDSRCCSARRRSGLPVSKQRKVAAMRISSFGRTSVLARQRGGSTQHRSGRVPEDRLHE

SEQ ID NO: 114303 - protein, 100 aa, Triticum aestivum
  Clone ID: PAT_TA_8721.pep
SVNHKPTARVKPIIIQEVDSPATVLTFDKSFALKGIMRPSYACLRFNFSVAYSEGNPFTQGAQAIPQLEEVRQHRLLLVRCGPPWRRAQVPDRQVGGPRV

SEQ ID NO: 114304 - protein, 86 aa, Triticum aestivum
  Clone ID: PAT_TA_8722.pep
RWNQHGLGGDNILGSCRPLHKGPVSLMHWSGKGKPWDRLDAGRPCPLDHTWKSYDLYIGDGDASQASAPSWASLSSSALPAAVFSW

SEQ ID NO: 114305 - protein, 358 aa, Triticum aestivum
  unsure (1)..(358): unsure at all Xaa locations
  Clone ID: PAT_TA_8723.pep
MECLAEMPHAPLDRRPRKRQRLGWDVGPEIPQLKKLCGEEVANVISAMTMGLSSGGIVFSQETQGLFRFATPPLREDDKDGHYVFAVGDNLTSRYRINAKMGEGTFGQVLECWDRERKEMVAIKIIRGIKKYRDAAMIEIGMLEQLCKYEKSRSXCVQIRNWFDYRNHICIVCEKLGPSLYDFLRKNSYRSFPVAIVRGRLPNNCLECLAFMHDLRLIHTDLKPETFXLVSLETSILADYSTSSRSPQTHEYXERLAMMERVLGPLPYHMLKKADRXGEKYVRKGRLNWPEGCASRESMKAVMKLPRLQNLVMQNVEHSAGDFINLLQGLLSYDPASRLTAQEALEHPFLTELSERRR

SEQ ID NO: 114306 - protein, 206 aa, Triticum aestivum
  Clone ID: PAT_TA_8724.pep
MECLAEMPHAPLDRRPRKRQRLGWDVGPEIPQLKKLCGEEVANVISAMTMGLSSGGIVSSQETQGLFRFVTPPLREDDKDGHYVFAVGDNLTSRYRINAKMGEGTFGQVLECWDRERKEMVAIKIIRGIKKYRDAAMIEIGMLEQLCKYEKSRSRFQSSFHNSYYKRVPKSSSIKVIDFGSTTYDQQDQTYVVSTRHYRAPEVILG

SEQ ID NO: 114307 - protein, 204 aa, Triticum aestivum
  unsure (1)..(204): unsure at all Xaa locations
  Clone ID: PAT_TA_8725.pep
MDENPFSISQKWRKISTSSPKVGPYHGRLRISSSIYLYSFGSTCYESRGHTIVVPSMHSGALEEILRVGCGXSCYIWXVRCVIVELCTXENLEHLAMIERVLGPLTYHMLKKADTCSRRXDRHGEKYVRKGRLNWPEGCASRESMKAVMKLPRLQNLVMQNVEHSAGDFINLLQGLLSYDPASRLTAQEALEHPFLTERSERRR

SEQ ID NO: 114308 - protein, 432 aa, Triticum aestivum
  Clone ID: PAT_TA_8726.pep
RPETEIGGAVLRLKTASAQSWTCMDLYVFATPYRITWDYYFAAREHTLEITSWEEEAELEYVKQHGVSVFLMPSGMLGTLLSLIDVLPLFSNTGWGQNSNLAFLEKHMGATFEKRSQPWVANIMKEDIQSGDFLALSKIRGRWGGFETLEKWVTGAFAGHTAVCLKDEKGDLWVAESGFENEKGEEIIAIVPWDEWWEMALKDGSNPQIALLPLHPDIRSRFNESAAWDFARSMVGKPYGYHNMIFSWIDTIGDNYPPPLDANLVMAVMSMWTRLQPLYAANMWNEALNKRLGTEGLDLQGVILETEKRGMSFDQLLTIPEQDEWVYSDGKSTTCVSFILAMYKEAGVFAPFTESIQVTEFTIRDAYMLKIFEDDRTRLPNWCHTEADKPPFCQILGEYRMELPEYNTIEPYAKMNENCPSLPPTYKRPSRC

SEQ ID NO: 114309 - protein, 273 aa, Triticum aestivum
  Clone ID: PAT_TA_8727.pep
CFRVLNAYARFLDDTPELVKIVRVSCGEYHAAAISENGEVYTWGLGSLGQLGHRSLQSGDKELIPRRVVALEGIVIRDVSCGGVHSCAVTEGGALYCWGGGHVGQLGLGPQNGFFSCALNGSDMLLRNIPVLVIPSGVRLVTCGHSHTLISMKDGRIYGWGYNSYGQAAYEKSTYAWYPSPVDWCVGEVRRLAAGGGHSAVLTDASSLKELCEFKLAETVNRSNARLIEDVASRTGADALARLCEKLREHLVEQGDSELMEMHMVEEIEAKAG

SEQ ID NO: 114310 - protein, 90 aa, Triticum aestivum
  Clone ID: PAT_TA_8728.pep
LALVVHSDLLRICGGLPVVVAGRWSALGSRESSPSLPYSNHGSAQTRAHHGVAGHPISTTTTKGYKIDQAGVLTSESHRCAGALISHEDV

SEQ ID NO: 114311 - protein, 338 aa, Triticum aestivum
  unsure (1)..(338): unsure at all Xaa locations
  Clone ID: PAT_TA_8729.pep
MSVSNIGMMDGAYFVGRNEILAWINTTLQLGLAKVEEAASGAVACQLMDAAHPGAVPMHKAAEPDAAAANAXARSWRRLRPQASPPRIXRGELEAGSSGSTQEEEHLGPGGVRDGVELQDEALRRLGCAAVRLTVDERHPPARRDRIAGAKLLSLPVVSFVVWFRRTQAKRANGHASNAPQRCAKPPPAXPPLMTELKLLVDSAEKERDFYFSKLRDVEILCQSPEVEHLPIVKAIQKILYASEDDPSTVAEAQAEMVAQQNQMQQQPMLSPILEASEAPSITPKDSSEESLRQEAAAAHKRKSISDLEEFEMGSSSRMRLSDVSDVQLCGSPLMSFT

SEQ ID NO: 114312 - protein, 97 aa, Triticum aestivum
  Clone ID: PAT_TA_8730.pep
MDWQGQKSAEMLMQVLLVASAVAAFLVGYAMADFQLMLLVYAGGVVLTALVTVPNWPFFNRHPLKWLDAAEADRHPRPQISSAPATTGGKKKTGKNK

SEQ ID NO: 114313 - protein, 183 aa, Triticum aestivum
  unsure (1)..(183): unsure at all Xaa locations
  Clone ID: PAT_TA_8731.pep
MAAGDEPSVTRWSFQDFERYYDAGLGICRQPQGDGDDAPPGSGSADTAHANGGADLSVFEQFERLDRNVELRNGSMDAGPPQKSLLPSFESAETRNLAETLLRDIIRGSPDVKWESIKGLETAKRLLKEAVVMPIKYPKYFTGSVITLXXYIAXWSTRNRKXTMLAKAVATECKTTXXNISXX

SEQ ID NO: 114314 - protein, 156 aa, Triticum aestivum
  Clone ID: PAT_TA_8732.pep
SQRSQRNSPPKAIIVSCWIICCTKTCPTTRVILVLFSTASLPTEVIFRSAGRHHQQLWPLDMQAPARYGAATPMSSSGLLYQQRPPWLAAPVTVRTSIPVCSARPNAAVVNSSPGAAARARPAVQILSREDPEAHRNTRHVGDASTASSELNKLHM

SEQ ID NO: 114315 - protein, 183 aa, Triticum aestivum
  Clone ID: PAT_TA_8733.pep
SYCLPPTPGSSGFLTLGAATSGFVVKTPLLRSRQVPAYYIVSLQAIRVGGRQLNIPTTVFSAGSLMDSGTIITRLPRTAYSALSSAFKAGMKQYPPAQPMGILDTCFDFSGQSSIRIPSVALVFSGGAIVNLAPEGIILESCLAFAANRDDSSLGIIGNVQQRTFEVLYDVGGGALGFNAGAC

SEQ ID NO: 114316 - protein, 459 aa, Triticum aestivum
  Clone ID: PAT_TA_8734.pep
MLGARRSFSRLAAAVRTPVDVPRMPAFDHVPLPYDGPSAVEIARKRAEFLSPSLFHFYSKPLNIVEGKKQYLYDEHGRRYLDAFAGIATVCCGHTHPDIIDAITAQANRLQHSTVLYLNHAIADFAEALAAKMPGDLKVVFFTNSGTEANELAIMMARLYTGSHDIISLRNSYHGNASGTMGATAQKNWKFNVVQSGVHHAVNPDPYRGAFGSDGEKYARDVKEIIEFGTTGHVAGFISEAIQGVGGIVEVAPGYLPLAYDAVRKAGGLCIADEVQAGFARVGSHFWGFETHGVIPDIVTMAKGIGNGIPLGAVVTTPEIAQVLTRRSYFNTFGGNPLCTAGGLAVLKVLDRERLQENAFIVGAYLKDRLRGLQEKHQIIGDVRGTGFMLGVELVTDRQLKTPAKDEICQAMEHMKDMGVLVGKGGFYGNVFRITPPLCFTKEDADFFVDVMDIALSKL

SEQ ID NO: 114317 - protein, 142 aa, Triticum aestivum
  unsure (1)..(142): unsure at all Xaa locations
  Clone ID: PAT_TA_8735.pep
QAMQRAERYRTDLLKRGVLLIPVIFGAAPKVQGNPQGNGPRRCGAPAPSIGGDFEKRTESIAAKSRLRAEVRFKADIVSPGXQWESWIRDRQXLEGVTPGEDVYIILRLDGRVRRSGRGMPNWNDILKELPRLEDLLSKLER

SEQ ID NO: 114318 - protein, 194 aa, Triticum aestivum
  Clone ID: PAT_TA_8736.pep
ITIHPHPRVSLPPACLLPDTHCLLLLLARQQIQASKMEPKDATMRTKLNKNISSPCWSPSSSSVAPPTPFSKAAMTPHEGRAGGGRGCVLCRVVLFFPSSPAALTGEPSSITDADRIHHCTTPASTCSRRALHVLLPPPRPGRCLGLSHDGGAKGKRPRARGREHAVDLCGGGWRAREKGADAWADAWADAWAD

SEQ ID NO: 114319 - protein, 168 aa, Triticum aestivum
  Clone ID: PAT_TA_8737.pep
SLIMGSKSLLPASPPPSPSSVSSQKILANKELDQLSWAAISFSQLVHLHDFFTSRAGIVFLEFFEESLRNHIIRYIPHNGNTSIIRVPNFPKTLLFILLFVQEVNKCRHKFSEIIMGQHVSLRHHQQHLGLRVGTCGGAAGGCLLRFSLRHNCRKESVLSCGLRREAG

SEQ ID NO: 114320 - protein, 743 aa, Triticum aestivum
  Clone ID: PAT_TA_8738.pep
PRVRDFSNGDGNGGESIYGEQFEDENFVLRHDDRGLLSMANAGRNTNGSQFFITFKPNSHLDRKNTVFGKLILGNDVLKRIEHVDVDGSTNKPIVPVRIVDCGELVDGKGRGSFSTENDKKKDKSTLSIDSSEDEGNEEKHKGRRKKSLKRRKKKRRYSSSESETSSESESSDSESESDYSSESSDISSSSDDKRRRRKRHSKKDKRKHGKRRRDRRREKRRRKRDRKSKQKSKRMVESDSETGNASDSSSEDARRKRQRHGRKSKATSQISAEDHTAVAALKDATSTQEKIGTPRSLAQEDKSQLENGEMRTNGVTDSKSERKSGIMPVLTGNRSKSRSQSTSANHSMSKSMSVSPRSPIKRSNVSLERLVSPSPVHQRSRSPVHASKQKESRSPPRQRNMSMSPHRRSPSKSPPGRASRSPVVRRNRSPVEVRTRSISRSPARSLQRRSPSRSPERTHVRKSVSPSPTPMEKGKSISRTSARSPLHKGFSRSPDMPPRKTTSRSPQRNAHRNFSRSPVGSSRRSLTPVRGGRSRRNASRSPSPPRRAVSPPNHGRSPSRSVSPDGSKRIRRGRGFTQRYSFARQYRSPSVDRSHRYGGRGDRDRYISHRGSRYRSPPRRYRSPPRRASPRYRRRSRSVSRSPPAYRDRTRGGGYSRSPVRSRSPPGGKPSSRGDRARSLSRSRSLSGSRSRSPPPVQDRSPIASPSPKRASNDRSRSMSVSPEGKKGLVSYGDGSPDSAGK

SEQ ID NO: 114321 - protein, 231 aa, Triticum aestivum
  unsure (1)..(231): unsure at all Xaa locations
  Clone ID: PAT_TA_8739.pep
MPTSKAFLILVLAVLTPMAATSQDTATNLTLHNLCAYPVWPLITPNIGLPAIPDLDDAASRLDGGGEGLVTLSFPSGAWSGRVVARTGCSSSDDYDSSSPSSSSPAAVTRCDTGMPPAPVTVAQVSVHGSGGLAEYSVSLVDGFNXPVMVTPHGFEQGRQCPSLGCAVDLDVDCPRDARAPAGGCRAQGQGHFFKERCPDTRTTPTDVEATPQRCIQPGELKIVFCPDSSY

SEQ ID NO: 114322 - protein, 263 aa, Triticum aestivum
  unsure (1)..(263): unsure at all Xaa locations
  Clone ID: PAT_TA_8740.pep
SVLSTIIDPKDGSMASTQALKQMALEHDVPIVSIADLIRREGKREKLVELIAVSRLPTKWGLFRAYCYQSKLDGTEHIAVAKGDIGDGEDVLVRVHSXECLTGDILGSARCDCGXQLDLAMQLIQKAGCGVLVYLRGHEGRGIRLRQKLRAYNLQDQGSDTVEANVELGLAIDSREYGIGAQILRDIGVRTMRLMTNNPAKFVGLKGYGLAVVGRVPVISPITKENQKYLETKRTKMGHLYGSDLPGGLLKEFLNPTEDNATN

SEQ ID NO: 114323 - protein, 222 aa, Triticum aestivum
  Clone ID: PAT_TA_8741.pep
MAAAATAAAATGTLLPHALLNHRSPPPPQLLALSSSFRRLSLSTSHRRNTHLVAHADAGAAEPEPATESAPEGEPVAASADSEEGEAEGAVALAEEEEEPAPRPKPIKFGEIIGILNKQFIEEAEKVKVLPDLKPGDIIELRMQRPNKRRLSLFKGIIIAKHKSGVHTTIRVRRIIAGVGVEITFPIYSPRIKEIKVIRHKKVRRAKLYYLKYKLPRFSTFK

SEQ ID NO: 114324 - protein, 234 aa, Triticum aestivum
  unsure (1)..(234): unsure at all Xaa locations
  Clone ID: PAT_TA_8742.pep
QLCPPDPAVAAAAAAAARDLPTASLRTLESSLAPPAAAPAAPLAVPPPPLPLLPSPGPPLKHAHSRRRRRRSRGPLSEPAPDGRAGQLPLLTAKEGEAEGGCGSGRGEEEEPAPRPKPIKIGEFIGILKKXFIEEAEKAEMLTVLKRGDITGHNFQRFNKRRLSLFKVVILAKHIFSVHNTIRFRRNIAGLGVEITFPMYSPKSKEIKVRRQKKERRAKLYYLKYKLPRFSTFK

SEQ ID NO: 114325 - protein, 182 aa, Triticum aestivum
  Clone ID: PAT_TA_8743.pep
RHEAAMYKNEEIQNLILGLGLGVKGEDFKKEALRYHKIVILTDADVDGAHIRTLLLTFFFRYQRALFDEGCIYVGVPPLYKVERGKQVHYCYDEADLKELVNTFPTNASYNTQRFKGLGEMMPLQLWETTMDPERRLLKQLTVEDAAEANVVFSSLMGARVEYRKELIQKAASMVNLDHLDI

SEQ ID NO: 114326 - protein, 178 aa, Triticum aestivum
  Clone ID: PAT_TA_8744.pep
GSVVKLMHERTKFRLHSHDVPYGSGSGQQSVTSFPNVDDANSYWIVRPQPDTSAKQGHAITPGTIVRLQHMRTRKWLHSHLHASPITGNLEVSCFGGEGESDTGDYWMLEIEGGGKTWRQNQRIRLRHVDTGGYLHSHDRKYTRIAGGQQEVCGVGDKRPDNVWLAAEGVYFPVSQAK

SEQ ID NO: 114327 - protein, 167 aa, Triticum aestivum
  unsure (1)..(167): unsure at all Xaa locations
  Clone ID: PAT_TA_8745.pep
MAAASFALALVLYLGLDLPEASPSQSYAADSDSAVEISYGSVVKLMHERTKFRLHSHDVPYGSGSGQQSVTSFPNVDDANSYWIVRPQPDTSAKQGHAITPGTIVRLQHMRTRKWLHSHLHASPITGNLEVSCFGGEXESDTGGLLDASDKVWVAAEGVYFPVSQAK

SEQ ID NO: 114328 - protein, 82 aa, Triticum aestivum
  unsure (1)..(82): unsure at all Xaa locations
  Clone ID: PAT_TA_8746.pep
FFFFSFFFFFHFPDVGAKVIDADKRGPXGAVLFNHSKADFAVKPGGHVAQMIVQVISTPEVADVEDLDATVRXKGGFVSSGV

SEQ ID NO: 114329 - protein, 167 aa, Triticum aestivum
  Clone ID: PAT_TA_8747.pep
IQSQVESEARRALQADLDEATVSLNEVNESTLFLSNKLDSTVSRISAIKEEKEVLSAALLEQKKSTAEAQKNMVDAQHLIKRLGMERENSEIRSTKLEEELATAKGEMLYLRRQITASGSQNADVLEASPTPIFNQSPEDRVPNTSSTDAVPPRSAKKIYRRRKDRP

SEQ ID NO: 114330 - protein, 195 aa, Triticum aestivum
  Clone ID: PAT_TA_8748.pep
PDSTSTNHLGNTGCSGSHVAAFVATFSGLDPTSRESSVGHLCHRVCRNSGTRGPGRPGRRVSLLEMDNKLASCIDNDASIEIWVMQDYEAEVWALKYRINLLAMNTSPQFKYISKMALLNQRELLICCHTPSVGPDYLLHCDTDGKFLGYYEMKEGTYSTYFTNQYFQESMIPLPFCEMQEEGGVDKEPPFFIGL

SEQ ID NO: 114331 - protein, 229 aa, Triticum aestivum
  Clone ID: PAT_TA_8749.pep
MVVIELEPEHEGEETTRPSSPPEFVEAPDPRRAEVDEEAFEDALTDEQLREKARSQANDAKAEGNKHFAAGQYEDALSQYEIALQIAAELESSEDISSACHSNRAVCFLKLGKYDETIKECTKALELNPSYLKALLRRGEAHEKLENYDDAIADMKKIIELDPSNQQAKKSLFRLEPLAAEKKEKMKEEMIAKLKDLGNSVLGRFGMSVDNFKAVKDPNTGSYSVSFQK

SEQ ID NO: 114332 - protein, 261 aa, Triticum aestivum
  unsure (1)..(261): unsure at all Xaa locations
  Clone ID: PAT_TA_8750.pep
MPGDVATSSATASGPPAAASSSHHHHHPATSARSALSNAVAGASAGVIAATFVCPLDVIKTRFQVHGWPKLAPGTAGGSVIIGSLXQIARREGFRGLYRGLSPTMLALLPNWAVYSTVYEQLKSMLASGEGSHQLSLGANVMAASCAGAATTIATNPLWVVKTRFQTQGVRAGAMVPYKGTVAALTRIAHEEGIRGLYSGLVPALAGITHVAIQFPVYEKIKAYLAERDNTTVEALSFGDVAVASSLAKLAASTLTYPHEV

SEQ ID NO: 114333 - protein, 164 aa, Triticum aestivum
  unsure (1)..(164): unsure at all Xaa locations
  Clone ID: PAT_TA_8751.pep
RKKXNFQDVRFGNLTGATVQQAPKRPRTVTAKRNQECSRQKKRKTSKWDGSYSIIVEQLNYYCFDDSDEDEVPLINKRTEMRKRQRLLKNSQATELNDGRKDVCFDSCSQGSGDKNISESAPASQVEERSLPDHLVHNRVGAPGQTDRETVESAIGEIVDISDG

SEQ ID NO: 114334 - protein, 153 aa, Triticum aestivum
  unsure (1)..(153): unsure at all Xaa locations
  Clone ID: PAT_TA_8752.pep
TRACRLFDSTLLLDLFPGYSIFFCTVRPSNSFIKYADRRSLFVYLIGRLWSVDRRSGVEIVFXNPRAGIARRLVRAAISEAARKREMRYADMQHIERGIKRHFHDDITVVVLYLDSHKQDAQTKFGGLDSFRFTNAPVDIFSPSGRTVEPTVL

SEQ ID NO: 114335 - protein, 170 aa, Triticum aestivum
  Clone ID: PAT_TA_8753.pep
MSVLEDLIRAIELWLRIAKEQVPLVDPSLDPVLLVPGIGGSILEAVDEAGNKERVWVRILAADHECREKLWAQFDASTGKTVSVDEKIRITVPEDRYGLYAIDTLDPDLIIGDDSVYYYHDMIVQMIKWGYQEGKTLFGFGYDFRQSNRLSETLDKFSKKLESVYTASGE

SEQ ID NO: 114336 - protein, 99 aa, Triticum aestivum
  Clone ID: PAT_TA_8754.pep
LYNERSRHFWKRQGRWVVPVPVHRLTLHLDGAGLGAAGNTCIEDHGVRGMCLMLDVMVGHQTVIGNYKQQNMRVVYNLDRAMLSFVSAHYNCSEQRKNL

SEQ ID NO: 114337 - protein, 248 aa, Triticum aestivum
  unsure (1)..(248): unsure at all Xaa locations
  Clone ID: PAT_TA_8755.pep
TTGESTVENDEPLEEEANASFDLFRVAGGLPDGFRXAYVVFVYRSPSAAEASVQLQRGGHGHLVCLEAPIWATPAFPALDTDGVHVRALPGSLCLVREYLECAQXFESGVRLAEECVSQAGYLLFSLPQCEPEXPAGLDLSTEGGNFRAHAYSSPTVVDLDGDGNSDILVGTSYGLLCAPVHQLDDQNRCFTCSCYLLVIQQDRFKNETNQYQQESKIRIIQSQASYPAQSTAVSYLCTPLDPFCRMP

SEQ ID NO: 114338 - protein, 162 aa, Triticum aestivum
  Clone ID: PAT_TA_8756.pep
HQVTNTAQHNTLSPPTLPIFPQHTYTSPCPPLTNYSPVPPHLNSLHIPPPPPPPPAPKTNLHLLIPNHLYHPQPNPITPTPQQKPRIQLTPLLLLPQNLNSAKDPYFGAGRRRRRETFFFTYLGCGRAGNDLACLICGVCFGVDERVSVWERSTMSTIDVVW

SEQ ID NO: 114339 - protein, 205 aa, Triticum aestivum
  Clone ID: PAT_TA_8757.pep
DTPDLQRLEYCGEMLPTSTFQSIPCLEHASLQFTDDIFPEYDADRLDDISTCFPHIKSLCLWYEIPKLVKPRTPATFLNLKVLTLNIATKPSDDLLWMFMFLIAAPYLATLRTTVRYLSYLESHNGVVWNDVDFQHVSLKNVEMYNFMGRDNEIGLVRLLLCRAPNLRCLSFNQARLEEGGDHQLVPPTWPMAETFSPRDSQFVL

SEQ ID NO: 114340 - protein, 149 aa, Triticum aestivum
  Clone ID: PAT_TA_8758.pep
GEHDLALQLDSTLEAALEPAPIFNLETAAQIEDGWLDTASGAATSTEIEPNTDLVPHEACDFEVPDSESPTPPPIESDWVPVMEFTAADIFQHSPFGDILSSLKYLSLSGEPWPDCGQDSWNADDKEIQSPPTTPLIATTFRRTTATPP

SEQ ID NO: 114341 - protein, 377 aa, Triticum aestivum
  Clone ID: PAT_TA_8759.pep
MNSLQSFLAVAPVMADEAKYIVGTYKRAQVVFVAGRGCKLYDIDGREYLDMAAGIAVNALGHGDPDVDAAAADQRGRLVHASNVGYTVPQVELAKRLVEASFADRAFFANSGTEANEAAIKFARKYQRVAHPNGDAPTEFMSFTNCFHGRTIGSLALTSKVQYREPFEPVMPGSTFVEYGNLEEAKKVIQSGKIAAVFVEPVQGEGGIHSATKEFLQGLRDACDEAGALLVFDEVQCGLGRTGYLWAHEVYGVVPDIMTLAKPLANGLPIGVALVTEKVAAAINYGDHGTTFGGGPFVCHAALATLDKIQKPGFLAEVTRKGEYFKQLLKAKLSGNPHVKEIRGAGLIVGIELDVPAGEAVACAHRVGRRSWSKLQR

SEQ ID NO: 114342 - protein, 84 aa, Triticum aestivum
  unsure (1)..(84): unsure at all Xaa locations
  Clone ID: PAT_TA_8760.pep
CKQNTNYFRPSTREHVEKDIERAFGVLEPQLAIDRGPARFRDTQXIMTTCIILHNMINEDERDLNVFSVIILAVVSSLPETQMR

SEQ ID NO: 114343 - protein, 99 aa, Triticum aestivum
  Clone ID: PAT_TA_8761.pep
MASLAARSGLRSLAARARAPAPATGGRRMSSSAHDDAYETAKWEKITIIGAVTCTLLAAWNLSKGHPHFDEPPAYPYLHIRNKEFPWGPNGLFEVKHDH

SEQ ID NO: 114344 - protein, 494 aa, Triticum aestivum
  Clone ID: PAT_TA_8762.pep
MAMVLRRLAGASGSPSAAALLLRPALTRPISTGFREERDTFGPIRVPNDKLWGAQTQRSLQNFDIGGERERMPVPIIRAFGVLKKCAAKVNMEYGLDPTIGKAIMQAAEEVAEGKLDDHFPLVIWQTGSGTQSNMNANEVIANRAAEILGHKRGDKFVHPNDHVNRSQSSNDTFPTVMHIAAAVEINSRFIPSLEQLHKSLHSKSDEFKDIIKIGRTHTQDATPLTLGQEFSGYATQVKYGIDRIACTLPRMYQLAQGGTAVGTGLNTKKGFDGKIAAAVAEETELPFVTAENKFEALAAHDAFVESSGAVNTISASLMKIANDIRLLGSGPRCGLGELILPENEPGSSIMPGKVNPTQCEALTMVCAQVMGNHVGVTIGGSNGHFELNVYKPMIAAGLLRSLRLLGDASVSFEKNCVRGIEANHKRISQLLHESLMLVTSLNPKIGYDNAAAVAKKAHKEGTTLKEAALSLGVLTEKEFHELVVPEKMIGPSD

SEQ ID NO: 114345 - protein, 91 aa, Triticum aestivum
  Clone ID: PAT_TA_8763.pep
IIKDTTSSFSSSQKGTILPTRVYLAEAPAHHRALTVGTHYACTSQHILRNLVVVLSFRFVHSSQNYVYSFQCSSSTPLLFAVHHCPVESAG

SEQ ID NO: 114346 - protein, 89 aa, Triticum aestivum
  unsure (1)..(89): unsure at all Xaa locations
  Clone ID: PAT_TA_8764.pep
PKXSXGLKEPXGXQRGALAWRSPAEGRWPGGARRRGLLQRCLADGGGRRSVFKLGVFMYFCTFSPGRRELPTTIISEMEGVVVYVAGKV

SEQ ID NO: 114347 - protein, 135 aa, Triticum aestivum
  Clone ID: PAT_TA_8765.pep
RGVEPTQTIFTTIMDAHGRNSDFGNAVIWFNEMETRGYPPDKKAKNILLSLAKTPEEQEEANELTGNGGLTDSTAHHHSLNGASTSDLNGRNKAGSSGCEDEEDDDDDDDDYEEMDDEELDFVSFKDKRELNFAT

SEQ ID NO: 114348 - protein, 241 aa, Triticum aestivum
  unsure (1)..(241): unsure at all Xaa locations
  Clone ID: PAT_TA_8766.pep
MIDTSHSSLFGPPVGISGNQVSTGMPVQGSAVHQSAVAASMGGLPSQLPSNSQGTSGIQEATSSHDSKSSGRTALPVDFFTSLYPSATPAMPGWQRAPQSGMGFGMQYPXNPVYQQNAYPQPAKASNPFDLGNEAAPIQAHMSRPLGASAGATNPTLVGNSSFGVPPQQPQQMYQPSVHQNHYMMQHVSNNMPEQLPNGMLPRQQGGAGSLGVGYDQQAAPRYSQPNTPPSYGAVGGNPFG

SEQ ID NO: 114349 - protein, 125 aa, Triticum aestivum
  unsure (1)..(125): unsure at all Xaa locations
  Clone ID: PAT_TA_8767.pep
QSSVCQNKGYRVIRRCISKLSDLDPETRXTVEKMMMISFVHNLMGLPTSDEMQKQDMLEKFMFWVCGNMLTVLLCMHWLTSQPGVSDRAFHCNTQKWCLSFNCQAKSMYLSLQIYGTHFISKEEH

SEQ ID NO: 114350 - protein, 270 aa, Triticum aestivum
  unsure (1)..(270): unsure at all Xaa locations
  Clone ID: PAT_TA_8768.pep
LPSQIVLCAICCNEMXRPALYVDYVRVLHSMRRKGRAEKAALKAVNQVCQLEPNRISDSVHSVQSGLRQLKQLLDDEESLAEFPHASFLHTVETADDSAPLFSLLAPLGSGVHKSYWKARPGNTSVEFPIVLGGISDVSGVAIIVSSCGYSTSDCPIVEIWASNKIQRDDRTFIGKWDVQSMIVSSPQLYGPENSGSLDEAPRHFKLHFPNPIRCRIISIKMTLPQIGSSSTKFNEDFSDLLSLDESSFIDSKANNSHNSFIHAKRIVVF

SEQ ID NO: 114351 - protein, 84 aa, Triticum aestivum
  Clone ID: PAT_TA_8769.pep
LRETILLKLINIGLLCVQDNPADRPTMSTVNVMLSSNTVSLQAPSRPTFCIDEMEGFSGMYSTEGSKPEGVSVNEVSLTELEPR

SEQ ID NO: 114352 - protein, 152 aa, Triticum aestivum
  unsure (1)..(152): unsure at all Xaa locations
  Clone ID: PAT_TA_8770.pep
MEHRKQQRSPSPRSGGSSGKGGGXGASKAGGSGGKKPIKVVYISNPMRVKTSEAGFRALVQELTGRHADPSKYNTDDGRAAQELSPEGSAAGSTPDAGAPGSAAAGGQPELAAAAFGDRDEEDIFESXLVDNDYAVFSPSAFLYDYPHSNKV

SEQ ID NO: 114353 - protein, 121 aa, Triticum aestivum
  Clone ID: PAT_TA_8771.pep
MECADFRVALGFERAIRRDRPYGGYPRLPSEGSPQMAFFDAAFQGDLPRLRELASGRDAKGMAWLADVCLVGAGPFQTAARLGKLDAVRCMVEELGFDVNAGSQAGVTALAGAAADGRMHV

SEQ ID NO: 114354 - protein, 182 aa, Triticum aestivum
  unsure (1)..(182): unsure at all Xaa locations
  Clone ID: PAT_TA_8772.pep
TRFCRVPFCVFFLVFLFYLISFGGDMXSKSFGRTFYGLISHFRMRYVFPGIRFIVFLLIILVFLNLFGLVPIGISYTSLPSITIGLAFIMWGGSYIYCFSKNTLRCIAHFVPVRAPVVLCVALIQIEILSWLCRPLALGVRLIANITARHLLLVLIGSRLFSLSGVFQVFGLVLILLVFFRD

SEQ ID NO: 114355 - protein, 78 aa, Triticum aestivum
  Clone ID: PAT_TA_8773.pep
AELWLKSICRFSFELLQDDSVGHLAVLMGRGHQCQLILLTEKTASGRFFSGLYIVACLLEKVQAGFKEVTAWTITCCV

SEQ ID NO: 114356 - protein, 230 aa, Triticum aestivum
  Clone ID: PAT_TA_8774.pep
SSGGLHYDLPPWFISILPDWQKTVFNTARVGSHISQMKMEWAGGLTWQSYNEEINSYSEEEAFTAVGLLEQINMTRDNTDYLWYTTYVDVAKNEQFLTSGKSPKLAVMSAGHALHVFVNGQLTGTVYGSVEDPKLTYTGSVKLWAGSNTISCLSIAVGLPNVGEHFETWNAGILGPVILYGLNEGRRDLTWQKWTYQVGLKGEAMSLHSLSGSSSVEWGEPVQKQPLTWY

SEQ ID NO: 114357 - protein, 151 aa, Triticum aestivum
  Clone ID: PAT_TA_8775.pep
VRPRVRVEANEYLGISLHADDPEDFWKLDDTIVKSIETAPNDELKKAKEIIQRIRRRELYKFCNQYSVPKDKLDHFKNITAQDIVCSQIASKVLLKEEDVAVSNVKIDLTRGKDNPLESIKFFKDFGCEEKFPITDERVSHLLPVCNQDRI

SEQ ID NO: 114358 - protein, 341 aa, Triticum aestivum
  Clone ID: PAT_TA_8776.pep
PPARPPPHARLEPSPAAEVRCGAPLGQPSAPAPPAQPDGARPGAVAGLPLPPAAAPGRALHGLHARCSSKRVSGPLHGYISPGPWARAVVVTGAAQRLRRRGQLGLACLVSPGALPARFEHSLGVYRLAGEAMNNLQKYQGNELGIDRIDVQTVKLAGLLHDIGHGPFSHLFEHEFLPRVHPGSTWAHEHMSALLLDSIVDKHAIDIEPDYLKVIKEMIVASSDVSTAEGVKEKRFLYDIVANGRNGIDVDKFDYIDREGSPRGSGSFFQHCGRVEGFPVTGDRVCHPPPVCLRVRIVCASPAEPHRAVAAPAAVENLQLRMYGEKTQVHDTPTKKKRRFN

SEQ ID NO: 114359 - protein, 67 aa, Triticum aestivum
  unsure (1)..(67): unsure at all Xaa locations
  Clone ID: PAT_TA_8777.pep
TSDSLALDGGLTSFGRYLRLDKRVDGDSQXEAKLSLLDEEEDPVTSVRKLFMTPPSKKPRIHQAEKS

SEQ ID NO: 114360 - protein, 155 aa, Triticum aestivum
  unsure (1)..(155): unsure at all Xaa locations
  Clone ID: PAT_TA_8778.pep
MTVYRFGNQSAASVWYELAYIDAKGVAKKGDRGRTIGPGAGNECDASERVCIQAGGRADGPWVHRGHNQPEEHAEPXKKTRHRFGNQSTSSVWYELSYIEAKGWMKKGNRVWMIGFGAGYECNTVGWVCIQPSSGMDGPWVSCIHHYPVDVSKNG

SEQ ID NO: 114361 - protein, 175 aa, Triticum aestivum
  unsure (1)..(175): unsure at all Xaa locations
  Clone ID: PAT_TA_8779.pep
CERSFNELKTRLTSAAVLTLPDIYRSFDVYCDASRKGLGCVLMQDGKVVAYASRQLRQHEGNYPTHDLELAAVVHALKIWRHYLIGKKCQIFTDHKSLKYIFTQPDLNLXQRRWLELVKDYDLGINYHLGKANVVADALSRKPANLNALMDSLPPELYEEIMQLNLVITDARLNN

SEQ ID NO: 114362 - protein, 183 aa, Triticum aestivum
  Clone ID: PAT_TA_8780.pep
NLWSIVSSLATTRQSHAILDLVEAKWSDLVAEMPLKICYPALEDQEWKYITGSDPKNTPWSYHNAGSWPTLLWQLTVACIKMNRPEIAARAVEVAERRISVDKWPEYYDTKRGRFIGKQARLFQTWSIAGFLVAKLLLENPEKSRILCNNEDEEFANAFNLMADSCNPNRKRGRKALKKTYIV

SEQ ID NO: 114363 - protein, 164 aa, Triticum aestivum
  Clone ID: PAT_TA_8781.pep
VNISNRDFPPGLQPLYFNQSGPKMPVLCNPLKPDMSPRECASGEVDFKTAPGEWKKFQCQAKGPAGKEVCTTVGRVTPAAYNQMTAAASISMGLYEYGPFLMNLQDCTFVRETFTSISVNNCPGLRYFSRTVYHGLILVSASVMVSIVCWMVHTRQRSLRGKQE

SEQ ID NO: 114364 - protein, 162 aa, Triticum aestivum
  Clone ID: PAT_TA_8782.pep
PELWAVFDQFFDPAIHDNIFARSRTHIHPALRNYDVIAYPAGMVPRVASFVDPKGNRLAHDSHPQSDSRLHLPDGRFVHVCDPYIWVIFDEHLSPNLRPIIQGFQHVQYRGPPISLNSARAHAPVAYPKHENTNTWIDVRPRRRGRAANVVGNGLGQAGGAA

SEQ ID NO: 114365 - protein, 370 aa, Triticum aestivum
  unsure (1)..(370): unsure at all Xaa locations
  Clone ID: PAT_TA_8783.pep
AEEERCHQTSDRHAVVXGVRLLDQTSKDSRLGRANGVHHLGQRRVPEVFVERFXAAVFGGRLXVVLDGPASGXRRFDVPDQMLAFVRSHRVMVRGHNIFWENQDATPRWVKGLSPDDLRSAVNTRIQSLMTRYRGEFAHWDVNNEMLHFNFYEQRLGPNATMEFFSVAQDADPLATLFMNEYNVVETCDDVSSTVDAYVARLKDLRAGGAVLEGIGLEGHFSRPNIPYMRAVLDKLATLNLPIWFTEIDINNKFDAQTQAVYLEQVLREAYAHPAVSGVMLWTALHEGGCYQMCLTDWNLKNLPVGDVVDRLLQEWQTGQVAGPTDAHGAYSFSGYLGEYVVTVNAGNTSKQATFSLSPGDETRHITVQI

SEQ ID NO: 114366 - protein, 528 aa, Triticum aestivum
  unsure (1)..(528): unsure at all Xaa locations
  Clone ID: PAT_TA_8784.pep
MSADEAALKTCHERINLSVAASHQAENGPVTTVSSKKSEEATYAYLPPIESTDAHLHEFAEAMRTVGKALQQVAEGKAAAQAEAAEWKRKYESEKAAKAHTHHSVIKGCSNCVKDKLEHLASKLTLETASADETGCCGNHGICSRQILQDQCPGPNRKSDGRIVGRKVPFRLSWGSNGDKNGQHKHDFVSFEKIDITTAERSNRLFFLGIPLHKQTLLXLNLPNTPCVHAVPKEMDSLLNIITNINILVHELASKDRLNEDSYFNFIQTWDNDQEMKTLHTKVALIVTLGGDGTVRLHHSLIKGPVPPVVAFSLGSLGFMIPLASEQYRACAINWLKRPLTITLRSRLQCHVIRDAAKDEVETGEPMRVLKVLTTDRGLPSFPTYFACVCVVFFVACEQGGGXIYLHWKGSTSSSRXTGGGTAPPQVPGILFTXCPHSLSFRPLILPEYVTLRVQVPFNSTGEGWPSXSFQGQNTVQLGPGDALIXVSPWPLPTACMVDSXSTTDFLRSIHEGLHWNLRKSQALDGPA

SEQ ID NO: 114367 - protein, 216 aa, Triticum aestivum
  Clone ID: PAT_TA_8785.pep
APHGHGGEVSNSCDIPRSREQQSTLEFVSSGSKVLLEVVSVEDGEEVEQVRSSPACVQSRSPIRAPLGIPLGTPKAHTPQPSTSYTYETCSNNAELPDTRSLWNVLQHRLQAQGLNVSMEFAHVLNSGLNSHLTRLLKSSLDVAKARGNGTRIPQANGRARPSWNGGQNHGFPSESGQFYQASLQDVKVAVESNRQLLGCDHSKQHEKLSFRLMDQ

SEQ ID NO: 114368 - protein, 82 aa, Triticum aestivum
  Clone ID: PAT_TA_8786.pep
MKKGGAGTAKEAAAAVGQVKAELEDAGKAAGRAVAVAAAPALSPLSETLWREKAAVEFLGDVSARLAWRDLTVTVALGSGDT

SEQ ID NO: 114369 - protein, 74 aa, Triticum aestivum
  Clone ID: PAT_TA_8787.pep
CGILLISNESLQQTERLIQEQHDVKGEGACMTDGSDAKHGAVKGPKAKESRMGLPFQGMFKKGIHGLEALKLGP

SEQ ID NO: 114370 - protein, 215 aa, Triticum aestivum
  Clone ID: PAT_TA_8788.pep
MSLFGLGRNQKTFRPKKSAPSGSKGAQLRKHIDATLGSGNLREAVRLPPGEDINEWLAVNTVDFFNQVNLLYGTLTEFCTSESCPTMTAGPKYEYRWADGVQIKKPIEVSAPKYVEYLMDWIEGQLDNESLFPQKLGTPFPPNFKDVVNTIFKRLFRVYAHIYHSHFQKIVSLKEEAHLNTCFKHFILFTNEFGLIDKKELAPLQELIESIIVPY

SEQ ID NO: 114371 - protein, 167 aa, Triticum aestivum
  unsure (1)..(167): unsure at all Xaa locations
  Clone ID: PAT_TA_8789.pep
YELFYSPGQAKLHLDGQPEPIYKHGVNAVFDSGSTYTYIPARIYNPFVHTVRHMIGSSHREVHDHDLPHCWKFKSIXKVQRLFKPLSLQFDNKIAMHIPAMNYLIHTRSNNWCLAILNGTQIAGGDRRILIGDATMRDMLVIYDNQDGRLGWVHQPECTRPHPASRL

SEQ ID NO: 114372 - protein, 78 aa, Triticum aestivum
  Clone ID: PAT_TA_8790.pep
MASTEASGFSKIALALFHGSQKIEMNTCIKYHSYLKEGYGANMDDEDWNTDLPLCSSTKMNQLFHSDIPVKQHKSHFF

SEQ ID NO: 114373 - protein, 119 aa, Triticum aestivum
  Clone ID: PAT_TA_8791.pep
LVKLLRHTKLDAPDSFQLGLSRRTDKNVCNAEISVTQTSKLTLPHSFENCSTNFLPSFCSSPVGLTVNNFTWNLHFTLRLGTVRRHSNSKPYLYVTLHVNCIILENIAFSALILFVNQR

SEQ ID NO: 114374 - protein, 167 aa, Triticum aestivum
  Clone ID: PAT_TA_8792.pep
RPPTRPRTRGAEPLSTVIRGEAGSERVRESPPHPWRVPTACSSWPASSPRCSRRWPPCSGRSWGLHASPPCWRRRSRSPACSTCPPRTAVSRSSPPSTSGAASPASAASPRSRSLSWPASTPATSSRSTSSAVVSVPESPILQQPAKDPLPRPPSSAAPHPDAPLLH

SEQ ID NO: 114375 - protein, 491 aa, Triticum aestivum
  unsure (1)..(491): unsure at all Xaa locations
  Clone ID: PAT_TA_8793.pep
VHHASGKATGALKKSKGNQICENSELDSGKWMEVPKESRIALLDIFAGWGRFIRKGCKQAXLSFXLKWGQLKSEGTEPGXKQFRAINHPGKLACRLLDNLAMVDFKGQCMDKVMGNXDDSCLNLLKAARTSRLNLLEENIKNLPVPGEVEFINGGPPCQGFSGMNRFNQSPWSKVQCEMILAFLSFAEYFRPRFFLLENVRNFVSFNKGQTFRLAVASLLEMGYQVRFGILEAGTFGVAQSRKRAFIWAAAPGEILPDWPEPMHVFASPELKITLPDGKYYAAAKSTAGGAPFRAITVRDTIGDLPKVENGASKLILEYGGEPTSWFQKKIRGSTIALNDHISKEMNELNLIRCKHIPKRPGCDWHDLPDEKVKLSSGQMVDLIPWCLPNTAKRHNQWKGLYGRLDWEGNFPTSVTDPQPMGKVGMCFHPDQDRIITVRECARSQGFPDSYQFSGTIQSKHRQIGNAVPPPLAFALGRKLKEAVDAKRQQA

SEQ ID NO: 114376 - protein, 268 aa, Triticum aestivum
  Clone ID: PAT_TA_8794.pep
SQTQDLQRKRKVNVLGSQCQAKVIVKLHNEQWEFTGVKHEHNHPLCPSPSLTSTRPDHKYLSSEEKLFLRVLQQSRVNPRKAMNIFQRMRSNFGNVSSSNEKDMSNSQCVDQWRKENSDVETALKRFKELELRNQGFSYTMQKDEDNIVRSLFWTDARSRVDYEIFGDFISFSTTYSTNRHNMPFTPIIGVNNHGRILVFGCALLQDQKAETFKWMFQTFLHVMRGKLPKTIIIDQDEGMVKAIAEVMPQVRHRLCKFSVMRKAQEML

SEQ ID NO: 114377 - protein, 196 aa, Triticum aestivum
  unsure (1)..(196): unsure at all Xaa locations
  Clone ID: PAT_TA_8795.pep
MASAAEEKHKNQEAETGSVIGGRGLDVRKDGVAREVVRMEREAVIPIIKPKLVMKLADLIEHEVDRNEFLKLCKKVEYTIRAWYLLQFDDLMXQLYSLFDPVNGEKRLEQQNLTPEEIDTLEFNFMTYLFQIMEKSNFKLLSDEEYDVAQSGKYLLNLPIKVDESKLDKKLLTTYFKEHPHDNLPTFADKVILMSF

SEQ ID NO: 114378 - protein, 139 aa, Triticum aestivum
  unsure (1)..(139): unsure at all Xaa locations
  Clone ID: PAT_TA_8796.pep
RAPKNRRASSNISSPYSGAGAPCRIIFTCAPRFFPCPPSPASSAPGSRPLISPGIRRAASASLLRRRREPCGTTWRRRWRKRWGRKRRASNAGRLGGKTLRVSPLAFQLRSKNSNDIKCDTADFAXDSKHXNNGXRISR

SEQ ID NO: 114379 - protein, 176 aa, Triticum aestivum
  Clone ID: PAT_TA_8797.pep
VDPRVRFNQPRPMETLNDYNEDFQLEFGRDVTFATTAEAVSSAPEVMNQEKLALVDTTQRELIGPFDDSINAYDGSEIIIDPPQELTSNPTMFWDDIIKGVGQEFDNVKDFRAQLCKYSIAKGFAYRFIKNETTRVTVKCVGDGCTWRLHASESSRSKKFVIKKMTDVHTCGGRWG

SEQ ID NO: 114380 - protein, 143 aa, Triticum aestivum
  Clone ID: PAT_TA_8798.pep
AIFFSYADNPPQVLSRPFLRPKRPDFYGPPEMWIMIHFVENNPGETATLALCADDAYAHGFKSTNSWNHLSEFQPIVPGSYMLPVSHVYPDLLPLLPNLRRSSHRDLYKVRVGIASPSMHSAFWPTTIHKPQACPNLDRHLSV

SEQ ID NO: 114381 - protein, 129 aa, Triticum aestivum
  Clone ID: PAT_TA_8799.pep
AAKQPSSKLNLFGVLSLPISFAPFESLIFTSIMVPQASFIGHLSGIIVGYSIAWGLIHGMNNYWAITMLGWIVLVFVLSLKRTGSLEMRFIEIEPVTDPSLPSVGVVASRNGRALQMDMLPGRGVADFV

SEQ ID NO: 114382 - protein, 129 aa, Triticum aestivum
  Clone ID: PAT_TA_8800.pep
VRGRVGSSQIRACVPVHVLIRRGRLPPDSTTPSDSNLGDFPSDNGGGGAPGGAQRARPQQRPARASSPPPSSGSPSRPYGHTVVVVFGNESLPRGRYPCGAGGGHPVRSPRASRRPAGHPAARRGLPGI

SEQ ID NO: 114383 - protein, 282 aa, Triticum aestivum
  Clone ID: PAT_TA_8801.pep
MAEEGHKVVLNVYDLSNGLARQLSTSFLGKPIEAIWHTGVVVYGNEYFFGGGIQAAPAGATQYGRPVRVVDLGVTHLPREVFEDYLRDIAPRYTAATYSLLTHNCNNFSNEVAQFLVGAGIPDYILNLPNEVMSSPMGAMIMPMIQNLEATLRNNAAPQTTQFVPTPASVSVPQPAASAGKTPTANASSTAAAAAASAAPAGSSSEKEEEKKVEKQTPEKAAAPAPLTVADPLGSARGKVQEEVMREFAALMASGTLRASEAAALAMRRVMERHGDGASMQA

SEQ ID NO: 114384 - protein, 134 aa, Triticum aestivum
  Clone ID: PAT_TA_8802.pep
ALSGEVDELGVLAPNSEALSCEQLETLESIVSVVPVTDDVEVVGMLAPDPSVRNQPLIFVEHGGSDVVVTHSHVTVGQVSVRDKVNDILFDLELHSLLKRLERVSPGSGKAIVEEALRSKGKKSEATGKASAAA

SEQ ID NO: 114385 - protein, 299 aa, Triticum aestivum
  Clone ID: PAT_TA_8803.pep
MGGGGGTNPAAVAFALLAAVVVGAVAAAAEGDSLAGLAAGIDGAAPEVKELGPWAKGLLNGMPVGPPGPAAMGPVAKYPLVLAEDRTRRPDVLRHLRMYGGGWNITSKHYWASVSFTGVAGFLLAALWFISFGIAAASFCFCKSRVGKAKVSHADVARPVLLVVAVLVRGRVGGRVGYGQNEFREEATDTLDYVVNQSDFTIQTLRNVTDYLSFAMTINVAALYLPSDVQAQINNLKVDLNKAADTISLKTTESYKRIRKVLHNVYVSKLSLLTCRFSSRISLRNSVDVTMLASGLKSN

SEQ ID NO: 114386 - protein, 151 aa, Triticum aestivum
  Clone ID: PAT_TA_8804.pep
CVLAHPAAVRPGTIFSGPAISFPRVGDPLKSPSGTGFDSDLLIWDAMIFGPLPPAVEGFGAAGGLRSAAWHVVTICPTKSRSVRLPYPPPKYPSAIPAPLSAPPDTLSASGRPLAASFTHVSIVHSNCSPVLWPLMTHSYFQQLLLLFLSF

SEQ ID NO: 114387 - protein, 111 aa, Triticum aestivum
  unsure (1)..(111): unsure at all Xaa locations
  Clone ID: PAT_TA_8805.pep
MASGKHFKYIVLGGGVSGGYAAREFAKQGVQPGELAIISKEAVAPYERPALSKAYLFPQNPARLPGFHVCVGSGGERLLPEWCSKKGIELILSAGIVKADLASXTLTSASG

SEQ ID NO: 114388 - protein, 289 aa, Triticum aestivum
  unsure (1)..(289): unsure at all Xaa locations
  Clone ID: PAT_TA_8806.pep
WENDDAANLYAAIQAKXGGKAVVVGGGYIGLELSAVLKMNDLDVTMVFPEPWCMPRLFTAEIAAFYESYYTNKGVKILKGTVAIGFDADANGDVTAVKLKDGSVLEADIVVVGVGGRPLTNLFKGQVAEEKGGIKTDAFFETSVPGVYAVGDVATFPMKIYNDERRVEHVDHSRKSAEQAVKAIKGKEAGSAVEEYDYLPYFYSRSFDLSWQFYGDNVGDAILFGDADPSSAKPKFGSYWVKDGKCVGAFLEGGSPDENAAIAKLARAQPPAASPDELKAAGLQFASKI

SEQ ID NO: 114389 - protein, 293 aa, Triticum aestivum
  unsure (1)..(293): unsure at all Xaa locations
  Clone ID: PAT_TA_8807.pep
MAACPRVRSAAPSILSLSVSGQLASFLPLRPTVRRRRSRAGPAMASGKHFKYIVLGGGVSGGYAAREFAKQGVXPGELAIISKEAVAPYERPALSKAYLFPQSPARLPXGFHVCVGKXGARRLLPEWYSXEKGIELILSTEIVKADLXSKTLTSAXGATFTYEILLIASWSPRVIKLXSHFGAQGADSNNILYLREIDDADNLYAAIQAKKGVKAVVVXGGDYIGLELSVVLKMNDLDVTMVFPEPWXCMPRLFTAEIAAFYERYYTNNGVKILEGIRAVGSVAGGQREVTPS

SEQ ID NO: 114390 - protein, 259 aa, Triticum aestivum
  Clone ID: PAT_TA_8808.pep
MSSPMEEAHHGMPSTTTAFFPLAGLHKFMAIFLVFLSWILVHWWSLRKQKGPRSWPVIGATLEQLRNYYRMHDWLVEYLSKHRTVTVDMPFTSYTYIADPVNVEHVLKTNFNNYPKGEVYRSYMDVLLGDGIFNADGELWRKQRKTASFEFASKNLRDFSTIVFREYSLKLCSILSQACKAGKVVDMQELYMRMTLDSICKVGFGVEIGTLSPELPENSFAQAFDAANIIVTLRFIDPLGRVKKFLHVGSEALLDRASS

SEQ ID NO: 114391 - protein, 203 aa, Triticum aestivum
  Clone ID: PAT_TA_8809.pep
YDQLLEQVELLLQAKLHDKPSLSTIMRSQQPNLPQNDTSNSEPRRASSKKNKNVENRRQQQSPLESSKKKKGRQGLVEPEEAELPLRVLAPRTWPANPSHRRPATTPVLAPSHLMQAPYVTQQFGLNSLQGFSGMSPFGQMQEQSPVHLQQPHLQQPPFHSGPQMHQAPPPDIQSLQFLSSNPQLGHQTTDQGQYTIPVWDFL

SEQ ID NO: 114392 - protein, 374 aa, Triticum aestivum
  Clone ID: PAT_TA_8810.pep
MEAYKVWVRKNRDLVRSLESLANGVTWILPERFANSEIAPEAVYALLGIVSSVNQHIIETPNDGHSLASKEQSIPWALVVSILKDVEAVVEVAAQHFVGDDRKWGFLAVTEAVKACVRLAAFRESGYRMLLQGGEVENEEEDVLEDNQGVKTNGVPVIYPVNGHSQNGHWITSDGPDGKPGIISKTLEGRAVAALNRFGQNAKMLSDPTWMSRLQPSPVPPAVMEIEKPTLATIWSSKGVSGRLFMLGEAVHIFRPLVYVLLIRKFGIKSWTPWLVSLAVELASLGIHSHATDLNHRAGKVHQLSSAERDELKRRKMMWALYVMRDPFFASYTRRHLEKAEKALNPVPLIGFITGKLVELLEGAQSRYTYTSGS

SEQ ID NO: 114393 - protein, 291 aa, Triticum aestivum
  unsure (1)..(291): unsure at all Xaa locations
  Clone ID: PAT_TA_8811.pep
VRPIGTLAAIDKSQAELNYDQVFMRDFVPSALAFLMKGEPTIVKNFLVETARLQSREKMVDLFKLAQGVMPASFKVHHSHPTKKTETLLADFGEIAIGRVAPVDSGLWWIFLLRAYTKYTRDSSLAESPHCQRAMRLILKLWLCEGFDTSPALLCADGCSMIDRRMGIYGYPLEIQALFFMALRCALSLLKDSDDDFVYQITKRIKALSYHLHSYYWLDFQRLNDIYRYKTEEYSQTALNKFNVIPESIPDXLFDFMPSRGGYFIGNVSPARMDFRWFCLCNFIAILSCLA

SEQ ID NO: 114394 - protein, 815 aa, Triticum aestivum
  unsure (1)..(815): unsure at all Xaa locations
  Clone ID: PAT_TA_8812.pep
MADDHYSSSAASAPSPAAAAAAEAAAVVGSSVIPIVNKLQDIFSQLGSSSTIDLPQVAVVGSQSSGKSSVLEALVGRDFLPRGSDICTRRPLVLQLVHQPRRPADAERDERGEFLHHPGRRFYEFPDIRREIQAESGWEPAGVLGASHRPARGLSVPPHVLICSFAGLPGFTXGPAPDQPTGVVPSLRTMICSYIHHKTCIILAVSPANADLANSDALQMARPADPDGSRTIGVITKLDIMDRGTDARNFLLGNVIPLRLGYVGVVNRSQQDINSDVSVKQALAREESFFRSHPAYNGLAKHCGIPQLAKKLNQILVQHIRTILPGLKARISSQLTAIAKEHAFYGDPVESKAGQGAKLLNILAKYCDAFSSMVEGKNEDISTIELSGGARIHYIFQSIFVKSLEGVDPCEDVTDEDIRMAIQNATGPRSALFVPEVPFEVLVRRQISRLLDPSLQCADFIYEELVKMSHRCLCNELQQFPILRRSMDEVIGKFLRDGLKPAQDMIAHIIEMEADYINTSHPSFIGGSKAVEQAQQQVRAARLPATVVRRDGVDADRPQASEKTQKARALLGRTTGVNGVITDQIQQGVRSAAEAERPGSSGSGSTSFWGSIFTSSEDRAHSSARGGSTNKSYASATPNLEHSFSSIQLKEPPLVLKPSESHSEQEDLEIAITKLLLQSYYNIVRKNVEDFVPKAIMHFLVNHTKRELHNFLITTLYREELFGDILREPDEITTKRRQIRDTLKVLQQAYKTLDEIPLEAETVERGYSLDSDATGLPRVHGVYDGSSPYSTPKQTRPRKSSHSGEQQQPFSGNGF

SEQ ID NO: 114395 - protein, 400 aa, Triticum aestivum
  unsure (1)..(400): unsure at all Xaa locations
  Clone ID: PAT_TA_8813.pep
MMNGSTGSLGDHVNGKQVQSVDPPGLSSFNNGPRHCPLNALRRCRGVLCLVIMPVTACMMMVYLAPATTFVVRFFSVHYSRKWTCFLFGMWLAMFPFLFEKINRTRFVFSGEKVPPKECVLLFANHRTEVDWMYLWDLALRKGRLQSIKYILKKSLMKLPIFXWAFHXIEFIPVYRNWEVDEPLIRRRLSELKYPKDPLWLAVFPEGTDYTEKKCIKSQEYAAEHGLPILKNVLLPKIKGFNCCLQELRSNLDAVYDITIAYKHRLPTFMDNVYGVDPSEVHIHTKIIQVSDIPTAEDEVSSWLTERFRLKDELLSDFLTQGHFPNEGTEEDLSTLKCVANFVAVIGMTAFFIYLTLFSSVWFRVFAACSASFLTYATLYSVHAPQIVCLPEAGAHAKKA

SEQ ID NO: 114396 - protein, 95 aa, Triticum aestivum
  Clone ID: PAT_TA_8814.pep
LFAFRVSSLIRTLSSMDVEFLISHRPMGSILERCLFPFYTHTVLLPTRLAASSLQEEALLQISTRSSEETIVQTLRANVLPIGWGQCESCEWVRA

SEQ ID NO: 114397 - protein, 342 aa, Triticum aestivum
  Clone ID: PAT_TA_8815.pep
MDGPAEAPAVTEHEMSEIPNPTCGEQADASIEEQANPESDVAEQIKEEAENTSDEEPKGTNNEESGNPSDEAQVTVKDDDMGDQNSEDQAIRSLEEPAEAEQLANVETEDTKWPGWPGESVFRVLVSAQKVGALIGRKGEFIKRMCDESKARIKILDGPPGVPERAVMISAKDEPDALVPPAIDGLLRVHNRITDGLDSETDQAQRGAGPAGPTRLLVPASQAGSLIGKQGATIKSIQDASMCPLPILENVPPVALNDDRVVEIQGEPHDVHKAVELIASHLRKFLVDRSVLPLFEMQMKVHSAPREQPMPAPQQWGPPPPWSHPPNIPPSGPGYGGNPHFM

SEQ ID NO: 114398 - protein, 157 aa, Triticum aestivum
  unsure (1)..(157): unsure at all Xaa locations
  Clone ID: PAT_TA_8816.pep
EGRLAWLFHLLGHTAPAQAASLLIFGPFVDLWLTDKRVDTFGYTMVVTFFIVLSCIIAVGTNLSQFICIGRFTAVSFQVLGHMKTILVLTLGFXLFGKEGLNFHVALGMTIAVIGMIWYGNASSKPGGKERQVYIPISEKTQKHGILSSQSELDLKV

SEQ ID NO: 114399 - protein, 164 aa, Triticum aestivum
  Clone ID: PAT_TA_8817.pep
TTPASPSARATGTSPTTTASSSSRRARAAPPRTSAAWPSSATKIIRAAAVEHRQAHRPPSRHPQRGRQEDPGPARRTATSCTPAPWTSSTRRRGASRPGSSRTPLTNLSAACGRAADLRGRVPPAGREFAAGRRGLQVQEGVLHRSRCNEHVVSDKGLLSFGSI

SEQ ID NO: 114400 - protein, 200 aa, Triticum aestivum
  Clone ID: PAT_TA_8818.pep
LRNPLVPVIPVEDDDASDQSEGPLLDQPNDYHQFDNYGPAEINGLQVSNTPITPAQQQPGGSTGVEADVLAAASAAYTAIMQSNQKGSMRPPTRPVKILSDPVQVERLMKEYNQIRNEQSTSSSVVAPMPPCPPPQMTMTAPASYSNHMTTFQNTNSTLPPSMAPRAMMNRPPQGYSPVSMNHPPGSSPALNLPPGSNPV

SEQ ID NO: 114401 - protein, 147 aa, Triticum aestivum
  unsure (1)..(147): unsure at all Xaa locations
  Clone ID: PAT_TA_8819.pep
TGVGSFLGRFAQPRPAGAXXEQGGRRXAASSKPQGGGRXGRRASXAGQRGQEARPARLSRSKSKRLVQGHHLPHQEVDDRQAAAAATSVNCNPVECVVVLYRHIHQKCVRSRGDHGTSTTSAMGRHVSPAMIGYGLFSTPLVPNSAR

SEQ ID NO: 114402 - protein, 386 aa, Triticum aestivum
  Clone ID: PAT_TA_8820.pep
MHGRRHLAASLARTLSQAPSRSISSTPSLLQTLDPTPQSPPLAAPAAGRLAEMRRRLQAETPSLGDFAYSVEVGTRKKPLPKPKWMKETIPGGAKYAAIKAKLRELKLHTVCEEARCPNLGECWSGGETGTATATIMILGDTCTRGCRFCNVKTSRTPPPPDPNEPANVAQAIASWGLEYIVITSVDRDDLPDQGSGHFAETVQRLKTLKPDMLIEALVPDFQGDRSCVEKVATSGLHVFAHNIETVEELQRSVRDHRANFKQSMDVLKMAKEYAPPGTLTKTSVMLGCGETPDQVISTMEKVRAAGVDVITFGQYMRPSKRHMPVSEYITPEAFENYRALGVEMGFRYVASGPMVRSSYKAGEFYIKAMIEDDRAKSGAVAESSS

SEQ ID NO: 114403 - protein, 137 aa, Triticum aestivum
  Clone ID: PAT_TA_8821.pep
PGPRPVWPPQSGRLCGPPPSLAPPPLGLGGPPSFAAPPSRGHSPSSPLAWTTPSRCWAPAGSSRRARVSHSPPAAVFCLSPHHFPPVLRDLLRAAWPRFRRLRLVSSPRLARPPKASLSRQTPYCPMAGDNKRGVAH

SEQ ID NO: 114404 - protein, 181 aa, Triticum aestivum
  Clone ID: PAT_TA_8822.pep
YVFRGSKEISKEQILDQLGLSGGGRPGFPKMTQQPGVQQVNGMHPLVTTGVNRFLLPVSECECTLSTLLDELQPDQWPVEAGNRAIRCTGVALNVAAGLLGACVPGTGARIIALLGGPCTEGPGVIVSKDLSEPVRSHKDLDKDAAPHFQKAVKFYDGLAKQLVSQGHVLDVFASALDQVG

SEQ ID NO: 114405 - protein, 516 aa, Triticum aestivum
  unsure (1)..(516): unsure at all Xaa locations
  Clone ID: PAT_TA_8823.pep
LFDVCLPIWLAHSFDCLFGHVSFHHEFYFLLEINVKKIISALLGGPCTEGPGVIVSKDLSEPVRSHKDLDKDAAPHFQKAVKFYDGLAKQLVSQGHVLDVFASALDQVGLAEMKLAIERTGGLVVLSESFGHSVFKDSFKRIFEGGEHSLGLSFNGTFEINCSKDIKVQGVIGPCTSLEKKGALCADTIVGQGNTTAWKMCGLDRNTSLTVFFDVSPSERSGQPGHQNPDLYIQFVTSYQHPEGQMRIRATTVSRKWVDGSTNTEELVEGFDQETAAVVLARYISLKMEIEEEFDATRWLDRSLIRLCSRFGDYRKDDPSSFSLHSNFSLFPQFMFNLRRSQFVQVSITXPDETAYSXMLLNRESITNSVAMIQPPFISFPSTPSLSPASRDAATSGADRILLLDAYFSVVIFHGMTIAQWRNMGYQNQPEHEQFAQLLQAPHEEAQMIIKGRFPVPRLVVCDQHGSQARFLLAKLNPSATYNSAHDVAPGSDIIFTDDVSFQVFCEHLQRLAVQS

SEQ ID NO: 114406 - protein, 120 aa, Triticum aestivum
  Clone ID: PAT_TA_8824.pep
MSHPSSSPLLKDSIMSPLSSPSPPPIISSKPPPTSKSPSSSSSSFSSPLSISSSSSSSPPSSPLLLLGSSSESVSPSPKSVPRRTSTSESSSSSSSSSVSPPSSGSESSSVGRFLPTRTR

SEQ ID NO: 114407 - protein, 144 aa, Triticum aestivum
  Clone ID: PAT_TA_8825.pep
SALVAQGFTQDVLPSEQRFSLGIIYDQTQALVFLQLCVCQLNHLDVSSDATRQQVVRIRGNRAATLGTGGAHYISTKSSTAPRGRKCFEDRTVEIHDEDNRGERAAPAHHTSLVLNLLAPGWVPGRSSARDAQGCTPEEKPTEQ

SEQ ID NO: 114408 - protein, 96 aa, Triticum aestivum
  unsure (1)..(96): unsure at all Xaa locations
  Clone ID: PAT_TA_8826.pep
TYDLLHAWLLFSEMENQGCGLEDLLIEMDRIMRPHGYAIIRDKAAVIDYIKKLLPALRWDDWSSXVKPKRDALSSDDERVLIVRKKLWDQAAQAAS

SEQ ID NO: 114409 - protein, 390 aa, Triticum aestivum
  unsure (1)..(390): unsure at all Xaa locations
  Clone ID: PAT_TA_8827.pep
MSGLGGLGSIGGGGNGRSHGSGGKAKLLALGKGLPEQVLPQEKLVETYLQDTSCDDPATRAKLERLCKTTTVRTRYTVMSKELLDEHPELKTEGTPTLTPRLDICNAAVLELGAAAARAALGEWGXPAADITHLVYISSSELRLPGGDLFLATRLGLSPNTVRTSLLFLGCSGGAAALRTAKDIAENNPGSRVLVIAAETTVLGFRPPSPDRPYDLVGAALFGDGASAAIIGASPIKAEEDPFLELEFSTQEFLPGTDKVIDGKISEEGINFKLGRDLPEKIESRIEGFCRILMDKVGIKEFNDVFWAVHPGGPAILNRLEVCLELEPDKLKISRKALMNYGNVSSNTVFYVLEYLRDELKKGAIREEWGLILAFGPGITFEGLLVRGIN

SEQ ID NO: 114410 - protein, 93 aa, Triticum aestivum
  Clone ID: PAT_TA_8828.pep
LAGRNGGASRCKAAASCSYYGKGRAPNNFYAPCRRQLIKSRGNRKARRRSRSLCTPSAIFCLPYRMRVDQDEPTKSCTMYVEHVRSISESMNN

SEQ ID NO: 114411 - protein, 92 aa, Triticum aestivum
  Clone ID: PAT_TA_8829.pep
SYSAIFIEEYFKGSFSFRHCLPAGWGVLLISGATTAFSERVFLNRNRFKQTLPIHMAIGIMCLGFSLLEIYRGEKQFLMSIVKSLKGHDKHT

SEQ ID NO: 114412 - protein, 129 aa, Triticum aestivum
  unsure (1)..(129): unsure at all Xaa locations
  Clone ID: PAT_TA_8830.pep
WYRTXYMMAMGAGLTEVQDKIVLEKVGAIASDLPIYVAVMTKTNVRVSLTFGTEYTAKYLRQGGHNLELQLEGKSQRWHGKMRDKKGALRISGGWTSFASENGLREGDICLFELMKNKGGLKMMVYIIC

SEQ ID NO: 114413 - protein, 156 aa, Triticum aestivum
  Clone ID: PAT_TA_8831.pep
LVLTGPFETISGFGFSRMTIEIPEISRRGVIDTATLVFGDYPCVDVKHEDALITTKYGRRLVVSYVLMEEGLGVHVQVSLRLFGDDTFQTINVHGQITAHNRVFEDDCVLLFFCEGGEKVQLTPSAGNGSVILKPMQRFIVTVPINPQPFLTIKGP

SEQ ID NO: 114414 - protein, 104 aa, Triticum aestivum
  Clone ID: PAT_TA_8832.pep
ARGGGGGGGEGGGAAQSTVGFKGADSALPPSGAGRRMCPGTALGMANMELALASLLFHFDWELPCGVGAEDMDMTETFGITVRRKSKLWVHAKPHVPCPRSDGR

SEQ ID NO: 114415 - protein, 190 aa, Triticum aestivum
  unsure (1)..(190): unsure at all Xaa locations
  Clone ID: PAT_TA_8833.pep
FGTRIIXAGSMDNGDGIAVGWLGHPVFRDKEGRELFVRRMPTFFETFPXVVLVDEEGIVRADVPFRRAESKYSVEQVGVTVEFYGGELNGVSYSDPATVKKYARRSQLGEIFELDRATLKSDGVFRSSPRGWFTFGHATFALLFFFGHIWHGARTLFRDVFAGIDPDLDAQVEFGTFQKVGDPTTRKQAA

SEQ ID NO: 114416 - protein, 162 aa, Triticum aestivum
  unsure (1)..(162): unsure at all Xaa locations
  Clone ID: PAT_TA_8834.pep
VPASRKNFSXYLGAGYSCAVVPGGLREMRYMDHESDSEVAFIRSRKGFVRIAIQTGCPLVPVFCFGQDRVYNWWRPGSNLLVKIAGLLKAPAIVFWGKFGTFIPFRLPMHVFVGRPIEVTKNNQPTMDEINEVHEKFVMALQELFNKHKYKVGCPNLQLQVI

SEQ ID NO: 114417 - protein, 362 aa, Triticum aestivum
  unsure (1)..(362): unsure at all Xaa locations
  Clone ID: PAT_TA_8835.pep
MPAKGERVVQPGGRLIPSAPAGGSLSLAAWPLCVQAAGSSSANSARPLPSPRAPSRLLGRLGHGRFGRMLANIRREPGVHADGIVFEPRSRPLSAPARHRAXCRRSLLCQPRRQRGRVLRRRPSPISTSSKGAAVFHYGSISLIAEPCRTAHLHAMKVAKEAGALLSXDPNLREALWPSLEEARTKILSIWDQADIVKVSEVELEFLTGINSVEDDVAMKLWRPTXKLMLVTLGDQGCKYYFQRISVGTVPSYKVQQVDTDRCXGDAFIGSSAAXSVHDPSALQEKTEIAGAIKFANACGAITATKERGNPVNAGKTRGVEGRWRRREDADYDYEVAYYSTNRIVRGFGSGARCPSCMMHLP

SEQ ID NO: 114418 - protein, 88 aa, Triticum aestivum
  Clone ID: PAT_TA_8836.pep
ESANPQRCDSMLGCSEAEDADTVRAAPSARPPARARRGYPVQLVASAKSAVISHVCSRQRLDEFVLAIQTKSARLVSLLAALQQQGPF

SEQ ID NO: 114419 - protein, 124 aa, Triticum aestivum
  unsure (1)..(124): unsure at all Xaa locations
  Clone ID: PAT_TA_8837.pep
SAVALKPPNYFALLHHERAGLQEPKDATRALFGLISHVVVYILNPKRLSLSISVVLLILIRCRLIMFPSPRHIGSCPRAILLSRQLPRWGLGARPGGVPRQPGAKVRYNKYQVVAFLXCPYRKY

SEQ ID NO: 114420 - protein, 123 aa, Triticum aestivum
  Clone ID: PAT_TA_8838.pep
QESEFESEKHNPLDPTRNIKTKWEIIEWTSDGHAYDKEAGWGEGVGRGGRLACRSSRNKEAGSAVEYLAGCAISSAATSSFDSPRNGLLCYEPQYGISPFPTIHMLSMDLFNDNLISTAFSSG

SEQ ID NO: 114421 - protein, 99 aa, Triticum aestivum
  Clone ID: PAT_TA_8839.pep
MRRKQNMHENGTIMIQFGQQVPNCESSASDSPQEVSGMSEGSFNEQNDQSGNRDGYTKSDEGKMMLTSNWGTRLMPCLMRIFWDARAYASTTIYNEYNI

SEQ ID NO: 114422 - protein, 109 aa, Triticum aestivum
  Clone ID: PAT_TA_8840.pep
SAVALKPPNYFALLHQERAALQEPKDATRALFGLISPVVVYILNPKRLSLSISVVLLILIRCRLIMFPSPRHIGSCPRAILLSRQLPRWGARGSTRRGSPPTRSEDEVQ

SEQ ID NO: 114423 - protein, 169 aa, Triticum aestivum
  Clone ID: PAT_TA_8841.pep
MRRKQNMQENGTIMIQFGQQVPNCESSASDSPQEVSGMSEGSFNEQNDQSGNRDGYTKSSDEGKMMSALSLGNSEMAYTPPKPDRTHPFAISYPYADPYYGGAVAAYGAHAIMHPQMVGMVPSSRVPLPIEPAAAEEPIYVNAKQYHAILRRRQLRAKLEAENKLVKSR

SEQ ID NO: 114424 - protein, 134 aa, Triticum aestivum
  Clone ID: PAT_TA_8842.pep
NLNSTATSRDVQRGLLVGLELHQTWRQENKNAVGLVPVLNLLIVKVLHFPAGVGPQSLRGFYAARFWEWGQVLGSAFKPYRPVTSRSGPAGGRLSGLFPLAICPCVSGALHARQFSHILMCNLLDIQQCYFGVL

SEQ ID NO: 114425 - protein, 71 aa, Triticum aestivum
  unsure (1)..(71): unsure at all Xaa locations
  Clone ID: PAT_TA_8843.pep
RYSKIRTHSRTSELNXILVVLDHTETKHTKIIPVHLWYLLRVWHRSHGRIDKTRKPDSLSCSDLHASERAT

SEQ ID NO: 114426 - protein, 230 aa, Triticum aestivum
  unsure (1)..(230): unsure at all Xaa locations
  Clone ID: PAT_TA_8844.pep
MRRGLSSETSLRRHRARARWVAVAALVTGTIWLWSSSSVVLFGTHRVQDFVVDELWRTADSNGWRASSAPRTYWPPPPTESESNGYLRVRCNGGLSQQRSAICNAVVAARIMNATLVLPELDANSFWHDESGFVDMYDVPHFIKTLKYDVRIVMSVPKITAHGKSKKLRSYKIEPPKDAPVTCYRTTALEKLRMNXSLYLTPEGRPTRGTRPPTRDAWVPLFTAPRKIRG

SEQ ID NO: 114427 - protein, 277 aa, Triticum aestivum
  unsure (1)..(277): unsure at all Xaa locations
  Clone ID: PAT_TA_8845.pep
MAVVVCVTGAGGFIGSWIVKLLLARGYAVRGTSRRADDPKNAHLWALDGAAERLTMVQVDLLDRASLRAAFHGCDGVIHTASPMHDTPEEIIEPVITGTLNVVEMAADAGVRRVVLSSTIGTMYMNPHRDPDAPLDESCWSDLDYCKQTKNWYCYAKTIAERGAWEAARALGLDLAVVIPVVTLGXLLQADHEHQAPRHILKYLTGEAKAYVNESHAYVHGQGRRPRRKSRVPRGARPRPTAPSFCAVFPPCNRRRSSARILRPASFPGVTRFPQRC

SEQ ID NO: 114428 - protein, 109 aa, Triticum aestivum
  Clone ID: PAT_TA_8846.pep
IEETISSSYIHCTHQRNNSVEDWFLGEAPRGGGAADGRSSWMSRCCLRKRASRRWRGSWSWCCPERKFREAALRRGGGCLGAATWVGEGSRRLMWQRLRRKRRRVLAGG

SEQ ID NO: 114429 - protein, 204 aa, Triticum aestivum
  unsure (1)..(204): unsure at all Xaa locations
  Clone ID: PAT_TA_8847.pep
RPPTRPTPGVSPSSSPSHLPAEERRGISPSASPSPSMAAPSWIRLPRATXSCSCSPSTSPSPSPPSSRGSTPTNCPPPPPPTSRPPTMTTRASTSTSRPLRPSPSPSPLLPLPXPPPLPQTLTSPPTPRSRPRIPLPRSTSGTRTSSRASPFQKRQPPATPPRRPSPPRQIPPPRKRPRRRRPRQGAPRSSSARSPARSRASAS

SEQ ID NO: 114430 - protein, 209 aa, Triticum aestivum
  Clone ID: PAT_TA_8848.pep
MSESELSVIKPESLKTYIWLQCFDGSIQQVEEEVAMFCPMICREIVKNGTGSSKNHAIALPERVNPSSLSLILDYCRFHQVPGRSNKERKSFDEKFVRIDTEKLCELTSAADSLQLKPLVDLTSRALARIIEGKTPEEIRDIFHLPDDLTEEEKLEPLKNINDDPRIRLLNRLYAKKRKELQERQKLKDIQVQQEQKDERSLDELLCFI

SEQ ID NO: 114431 - protein, 220 aa, Triticum aestivum
  Clone ID: PAT_TA_8849.pep
MAPSFVWSRRALVVMVVVAAQSSEAAARSGGADEDELRFPGFPGGRPRNPGFPGVPGGRVASPPASRFKPSSPPPSPPPPQPSPAVSAPACVSSGAPSQPALQPLPGFPGLQQPGNGGGSASSPADCVTPLAGLMTCASFLTGSEPDTPTPQSECCSGLGMFLNSTAAVDDRSLRCLCPVILGDVNRMLPKPIDPVRMMYLPISCGVVLPPQVLFICFTG

SEQ ID NO: 114432 - protein, 251 aa, Triticum aestivum
  Clone ID: PAT_TA_8850.pep
MASSLVWSRRALVVMVVAAAMVVATQSSEAAARSGGADEDELRFPGFPGGRPRNPGFPGVPGGRVASPPASRFKPSTPPPSPPSPPLQPSPAASASPPCSSGAPSQPALQPLPGFPGLQQPGNGGGSPSSPADCVTPLAGLMTCASFLTGSEPDTPTPQSECCSGLGMFLNSTAAVDDRSLRCLCPVILGDVNRMLPKPIDPVRMMYLPISCGVVLPPQVLFICFTGQPTPPVVSRIPDSWMTPASSALTP

SEQ ID NO: 114433 - protein, 248 aa, Triticum aestivum
  Clone ID: PAT_TA_8851.pep
MAASRCSTAFVLLVVVTVAVGAAAALLQPAEAAAAARRADTRVLWYPGTRQRSPSGFRGFPRSRLSPPSAGRLTPPSPSGRPMTPPPSQAQAPPAPISPPCTAANPQPGFPGLPVGFGGSSPSPPLAPTDCVTPLAGLMTCASFLTGSEAETPTPQSECCGGLGMFLNSSAAADDRSLRCLCPVILGDVNRMLPKPIDPVRMMYLPIACGVVLPPQVLFICFTGQPTPPVVNRIPDSWKTSSSSALSP

SEQ ID NO: 114434 - protein, 120 aa, Triticum aestivum
  unsure (1)..(120): unsure at all Xaa locations
  Clone ID: PAT_TA_8852.pep
AAAAAEXXASANRAGGXSGXGXDGHRNHEXLRRRQQXEEGGGAGAGRXAEREXSPGXSGRXWPVGRPESSRKTETHGPQHQRSSVCNFLGFTCSRMEESSSSWLIVAPGPGCGWASKIFT

SEQ ID NO: 114435 - protein, 183 aa, Triticum aestivum
  Clone ID: PAT_TA_8853.pep
GVIRALHSGGVLEKAFCTETRPFNQGSRLTAFELVHDKIPATLIADSAAAALMNNGQVQAVIVGADRIAANGDTANKIGTYNLSISAKHHGVQFYVAAPVTSIDLSLPSGKQIVIEERSSKELLNSEGGLGKQVAASGISVWNPAFDVTPANLITAIITEKGVITKSDPNGSFDIKGFIECAK

SEQ ID NO: 114436 - protein, 366 aa, Triticum aestivum
  unsure (1)..(366): unsure at all Xaa locations
  Clone ID: PAT_TA_8854.pep
MGESSALQSILYDRGALRLLDQRKLPLEEVYIDVKDSADGWNAIRDMVVRGAPAIAIAAALSLAVEVNDHDFTGTPVEAASFVSKKLEYLVSSRPTAVNLSDAATKLQNLVSRTAETAKDAKSIFQVFIEAAEAMLVDDVADNKAIGLHGAEFLQRQLGSSRNISVLTHCNTGSLATAGYGTALGVIRALXSGGGLXKAFCTATSPPSYQAYSIAVELLHDNRDAARILGSAAAAELRNKLDLEVFVVADHLAADXETTKKSLTHISSIFQKINGVQFYVAAPVTSLDLSLPSVKQIIISXKNQNQLKNSXGGLGKQGNASGLVIXIRAFAVTPANPSTAINTNKDRKGNDHKVVILEVVSSTEVS

SEQ ID NO: 114437 - protein, 236 aa, Triticum aestivum
  Clone ID: PAT_TA_8855.pep
MASDQPFARALAAICVGFFVILCCSPQARAVDYTFARDATRAPAVSYYDYIIVGGGTAGCPLAATLSQRFRVLLLERGGSPYGDQRVENMTHFTATLADTSPGSPAQRFVSEDGVINSRPRVLGGGSCINAGFYTRASDEYVMDVGWDLEAAIAAFRPVDGAAAPPPPPGPWQAALQRGLMEVGVAPDNGFTFDHIDGTKVGGSIFDDEGRRHTAADLLRYARPEGIDLLLRARVA

SEQ ID NO: 114438 - protein, 74 aa, Triticum aestivum
  Clone ID: PAT_TA_8856.pep
IKELTKKGIIPVDHDIESLGDNIDDETMDYSRPFLMGKAAAVIHEKKSAKALVDELVSDAVACIRNGEKIIAKL

SEQ ID NO: 114439 - protein, 117 aa, Triticum aestivum
  Clone ID: PAT_TA_8857.pep
SLTLMVQHIPPLLPSNGHLPLPAPSASNLPRTARAANNSLQRRLAEPNTYNRSRPSHLYFALSISSLQQTFFQAASDMGLDWCPPEYSAPEAFFSFSESELIKIMLISGKGCILTSH

SEQ ID NO: 114440 - protein, 191 aa, Triticum aestivum
  Clone ID: PAT_TA_8858.pep
HLEKAAFKVSSQKLKLDRGILLDNYVQRGPILVDAQSRSLLIHSKRSKRHMSLKQHKKCGSFDLHDTFRRFDLYKPMHEMWKEYMRELTKSTPKKQLSENLLSADLHGALIIVAQCKAASYEGVSGIMIRDTAETFGIISEDNRFRVVPKAGSVFVLQADCWKVTLIGDKLSPKEKLKESQRLQRAQSLIR

SEQ ID NO: 114441 - protein, 139 aa, Triticum aestivum
  unsure (1)..(139): unsure at all Xaa locations
  Clone ID: PAT_TA_8859.pep
HITDQGLLDISSAACVGNLTSVSLWGLAGITDXGVVHLVSRARSLQXHLNIGGTFITDESLYAVADSCTNLKSIILWSCRHVXTEAGLVALVNKCPELECINVGGMRVSPEXWAGLQSISPALRIRSIPQILNADVQVA

SEQ ID NO: 114442 - protein, 139 aa, Triticum aestivum
  Clone ID: PAT_TA_8860.pep
PNQLSSTASLCRPRTHSCSAQQLRRSLGSASTSNCTHQAAAAGAGTTHLNHNFLTTHLLTRRHHGPLKDNTESNPFVASSSQQLSTSSSPLKVPLNMRPLQQSQSFGRTASKCRVRFTDKQEPEATHVCRVSPAVLCSF

SEQ ID NO: 114443 - protein, 160 aa, Triticum aestivum
  Clone ID: PAT_TA_8861.pep
MAPRNRTSSRRPLWVIVLIAFVCAIVTGAYLYKPQHYTGCYLSNSCGSQPALEPVRVYTDDEIAARAVMRDLVLSQPVQSKNPKIAFMFLTPSSLPFEKLWEKFFMGHEDRYTIYVHASREKTVHASPIFAGRDIRSEKVVWGSVLVSTCPGYLASYVPV

SEQ ID NO: 114444 - protein, 142 aa, Triticum aestivum
  Clone ID: PAT_TA_8862.pep
LSSKLCPPGIEGTFFALLMSIDNIGVLSASWIGGLLLHLLRITRTEFKNLWAAILIRNVMRLLPLALLFLVPRSDPNSNILPADLLAEYDGAEARRIENVELTSLTVDKNTSTDASLQECKTQEHLDVGQDDDEASLLANRG

SEQ ID NO: 114445 - protein, 231 aa, Triticum aestivum
  unsure (1)..(231): unsure at all Xaa locations
  Clone ID: PAT_TA_8863.pep
QLECQNGPLFDDNLFTTIKDYVVAVSCTPPRVYRQVASLVGLQLVTSFISVAKTLSGQRETTQRQLNAEKKKHSDGPAVESLNKRLSITHENITYLEESMRTIFSGLFMHRYRDVDPEIRIFCIKSLGIWVVSYPSLFLQDMYLQYLGWTLNDXNAGVRRTSILALQSLYDVDDNIPSLGLFTERFYSRMIQLADDIDISVAVPAIGLIKQLLRHQLLSDDDLGPLYDLLI

SEQ ID NO: 114446 - protein, 177 aa, Triticum aestivum
  unsure (1)..(177): unsure at all Xaa locations
  Clone ID: PAT_TA_8864.pep
GPPRAQVIPRGVGPARSRPRGKPGGGCPPPSLGTGGANQPCPKSEPLPWPGPPYWSGRRLEDSESEVTGNILGDVGPEGTETASSVLITALRSFKEALIKDGEANVAEIDAFLLSVDAEDEKNSLVSKITALDELLITVRDRVLRVGADSEFYGQKTETEXLVGNVQGEVTESFLLR

SEQ ID NO: 114447 - protein, 227 aa, Triticum aestivum
  unsure (1)..(227): unsure at all Xaa locations
  Clone ID: PAT_TA_8865.pep
TRLXXSREADHESDSGPARSWIFAAGDAGREGDGRGARRSVVNSWPSLGVSFVEFGLVPVFGVMPMERNPPPLARSAWWSPVTSSALLPWWWRRGDDVSGASSLNKRVVFVPRIWRKASRFSRFLQAVAVMERELGRSGHLKMSDRVRAQQQQLLRWGSWRLLWRSMAGCRRHSAASSGRRAAISHSSRPCSHLGGSSSFRRSPWLVAMAPSSPQVVSSPAMARCIR

SEQ ID NO: 114448 - protein, 248 aa, Triticum aestivum
  Clone ID: PAT_TA_8866.pep
RPPTRPLGGVAPYAVPQVSSGSLRKDIGFKTNVSHSDALMTLNLWMTSQVPFSASVDQMCKFYTFVSEGAADAKIDIIRELMSCSSIFTPLIRARSSEVVHGKFLSPKDLYWHDPTGCSETTEEFVLVKNRMFPRRMLCSTYPNLCEFFTEACGVPKVPTTADYVEMLLRLSKVALPSQVAHQVFRVFVRWATDIHSVNDKNDLVYVKDSLQKLETTILPTLVDKWVSLHPSFGLVCWSDDDELKQHF

SEQ ID NO: 114449 - protein, 100 aa, Triticum aestivum
  Clone ID: PAT_TA_8867.pep
SSGSSKSEASYRDEEDDRLALVLVDNPHYSAEPAETKEKEKEEKDGLAMVLADPQPRATSVGGNDVQSVLLALRQVKEQLRYTIQRRSEGLVAHRELCGH

SEQ ID NO: 114450 - protein, 322 aa, Triticum aestivum
  Clone ID: PAT_TA_8868.pep
MADAKAEAARQAPQSSQEEEEDWKEAEGDVEVADRSTSNGGGAGEGITDRPIRVYADGIYDLFHFGHARSLEQAKKSFPNAYLLVGCCNDELTHQYKGRTVMTEDERYESLRHCKWVDEVIPDAPWVVTEEFLNKHNIDFVAHDSLPYHDASGASNDVYEFVKKLGKFKETKRTEGISTSDIIMRIVKDYNEYVMRNLARGYSRNDLGVSYVKEKRLRVNMGLKTLRDKVKQHQEKVGEKWSTVAKLQEEWVENADRWVVGFLEKFEEGCHSMGTAIKERIQERLKEAQSRDFSLLQYDSDDFDDFEEEDDEVAKDAKYVKE

SEQ ID NO: 114451 - protein, 209 aa, Triticum aestivum
  unsure (1)..(209): unsure at all Xaa locations
  Clone ID: PAT_TA_8869.pep
VRECRKLCGGHGYLNSSGLPELFAVYVPACTYEGDNVVLLSHVARFLMNTVSQVAAVKQPVVTIAYMGNIQRPRTRGRTRGVNTDWLNPAAIKEVFEARALRMAVNCAQNISKAPSQEEGFSELSPDLLEAAVAHVQLIIVTKFIEKLQEDIPGPRVKEQLQKLCSIYALHLLHKHLGDFLSTXCVTARQGALANELARKLYAQVRSNA

SEQ ID NO: 114452 - protein, 406 aa, Triticum aestivum
  unsure (1)..(406): unsure at all Xaa locations
  Clone ID: PAT_TA_8870.pep
CTRQRLRVHSAVPWLLRFGTWAAVRPPIVARASFPPAPAVATVXPVRYCAIRKQFGSQDGGPETQVLNYKTQQSTWAPLLASAYAYRFVGQWLKWLYTDVTQKLEAKDYSTLPEAHACTAGLKSVTTSATADAIEECRKLCGGHGYLNSSGLPELFAVYVPACTYEGDNVVLLVQVARVLMKTVAHWATGKQPVASIAYMGNIQNSCIGKLYAQVRPNAVALVEAFDYTDHXARALAVAVAQNISKAPSQEEGFSELSPELLEAAVAHVQLIIVTKFIEKLHEDIPGPGVKEQLQKLCSIYALHLLHKHLGDFLSTGCVTARQGALANELLGKLYAQVRPNAVALVDAFDYTDHYLGSVLGRYDGDVYPALYEEAWKDPLNETVVPDGYQEHLRPLLKQQLKLSRL

SEQ ID NO: 114453 - protein, 524 aa, Triticum aestivum
  Clone ID: PAT_TA_8871.pep
NSSAPHMGNKDNRKLHETFHNEVNGTDDDQMNGGNSNPHDEHDNENFNSAIAPSYLDGMEQEDPGTENGISTPGNQWDSPPERSAGLEKGTPSPARRVSLSVERSPHAHSSEKLDSPHHAKEGDNLADSRSPPARHRSRSPGSPENHDTNRRRAPSHELSPHARDNSPERKAQSRRGDGSPRRRSTSPGRRDGSPQRRSASPKRRDGSPRRRSASPRRRHGSPRRRSASPKRRDGSPRRRSPSPKRRHGSPRRRSPSPKRRHGSPRRRSPSPKRRHGSPRRRSPSPKRRASPKRRGSPRRRDSPTRRDSSPRRRDSPRKRDSSPRRRDSPTRRDSSPRRRDSPRKRDSSPRRRESPTRKRDSPTRKRDRSKSRSPSRKTDSSRLAWARPRSRSGSPHSRNHHRRSPRRRHSPRHRSPPARHHSPKRCWSPPANRKTGLGKPGRNLFVAGFSYATTERELEKKFAKFGRVTRVRVVRDKRTGDSRGFGFLSLEKDEDADAAIRACDETEWNGRIILVEKSKAPAW

SEQ ID NO: 114454 - protein, 972 aa, Triticum aestivum
  Clone ID: PAT_TA_8872.pep
MGTFGGQFEDFHADDRRAEVIDWLGGLLPEFDLPLDSSDEELREYLIDGTALCYTADKLMPGVLEGVWGGYASDHRSNVKKFLSVIAEMGLPGFSVKDLEEGSMSSIVECLLALRDNVSAGLGENMSNYPAKTPPRPVAPVSSPAGRSPGEDRRRGLWDAKSPQRSPLLSGQKANEVFQFKRGQYTDLPAAKISEMIQSNSLDNAPTQSLLRVVNGILDESIERKRGEIPHRVVYLLRNVVQEIEHRISIQAEHIRNQNNIIKTREDKYRSKIKALETLVNGTNEENEMAINRLELVKVEKSKIDERRKIGEQDMVRLMREKENAENTVTNLQQEIQVMSRMFEEYREQMEEKTSQMEEHLTLRAKEAEFLLMQSKKRVEELETASELQLQLWSKKANTFRSFMDNQKLCIKDIRISSQSIKQEMFALQMKWRDEISNMGLDLKGLVDAAENYHGVLAENQKLFNEVQELKGNIRVYCRVRPFLPGQDGKSTAVDYIGENGEILISNPSKQGKDGYRMFKFNKIFNTHVSQAEVFSDIQPLIRSVLDGFNVCIFAYGQTGSGKTYTMSGPGKSKHASGVNYRALNDLFDISLKRRNTFSYEVEVQMVEIYNEQVRDLLSNDIAQKRLGIWSTSQPNGLVVPDASLIPVKSTSDVLDLMEIGQANRAVGSTALNERSSRSHSILTVHVRGLDVKNGSTSRGCLHLIDLAGSERVERSEATGDRLKEAQHINKSLSALGDVIFALAQKNAHVPYRNSKLTQVLQSSLGGQAKTLMFVQINPDVESCSETISTLKFAERVSGVELGAARSNKEGKDIKDLLEQVASLKDTISRKDMEIEQLQVNKVKSPSSLTDKSGSSLLKQPSTASQQNQLISGSIGSGETEYEDNASDDGCSVGETEYSVGSASESAADRMQKGPSRLTRFFLTKNGQPAASRPKPKEPAPKSTTIGRRNSIASQVPTAASSIKPPKKRVVQ

SEQ ID NO: 114455 - protein, 288 aa, Triticum aestivum
  Clone ID: PAT_TA_8873.pep
MVSSSASPSPREEEGGGPCLPSLRGKKRRMRVRTASPEPASTAAPPQTHGKWHPDESNRPEIDDAPVFTPTEEEFKDAIGYITSIRPQVEKYGICRIVPPSSWRPPCPLKEKSFWKCTEFNTRVQQVDKLQNREPKKKETQPRVQKKRPPTRQPTRGMSQKRRSAESADQDEKFGFQSGSDFTLEEFQKYADMFKEQYFGMKGSDEISLFEIKQHKEMWRPSVEEIEGEYWRIVVCPDDEVEVDYGADLDTAIFSSGFPKSYLSDANKQDPYGLFCWNLNNLRRPPRS

SEQ ID NO: 114456 - protein, 232 aa, Triticum aestivum
  unsure (1)..(232): unsure at all Xaa locations
  Clone ID: PAT_TA_8874.pep
HAIQCSTKRSPLLPLPSPPPLRPSLSPSPQTPAPPPPPPPPRPPFAPRPCPXPPPAPPPPEIVDLPAHDVEEELEWVSRIMDWTPSAPPPPPAPPPPRRASRPPXPPPPPPPPAPPPPPPAPAGWSVPRSAVYVRPYAXRPYARCPRRRWSRSRRSAASALGRRGGRSRAPRRTPPRPRRPPPPPPAPRRPPSRPTSCWTRRTSAPRSSWRSTTSCRRRPRSPSTARGRRGR

SEQ ID NO: 114457 - protein, 125 aa, Triticum aestivum
  Clone ID: PAT_TA_8875.pep
SPHQPSSPLLLFQPRNPSVAQSIRRAADDDHENFLLKLKERMDRVGIDYPTIEVRFEKLEIEAEVRVGNRGLPTLINSVTNTLEVKPPAQKVQFRCKTDATVHGGLASACLCFSPHRWNKHVDHS

SEQ ID NO: 114458 - protein, 113 aa, Triticum aestivum
  unsure (1)..(113): unsure at all Xaa locations
  Clone ID: PAT_TA_8876.pep
LCCWCLRRQVAAILFTLQCNPADARRQTAAYCVFINESSCSRKNHYLVVHGRVHFGRDPLALYGTRWPSNHFGLVHEECLDVPASGNRTAPVTXMFCMSEQKFPHEDTLPATS

SEQ ID NO: 114459 - protein, 152 aa, Triticum aestivum
  unsure (1)..(152): unsure at all Xaa locations
  Clone ID: PAT_TA_8877.pep
AAFLGDMIERGSECVEIKDMXAVVFKALLHFIYTDTVLEFEQQEGAEAMITDTVPESGQRDEAHEQAASVMALAQHLLAAADRYGLDRLKLICASKLYDGIKVDTAATTLALAEQYNCWELQKRCADFITKTYARNSSLDAVAATEGTSGRD

SEQ ID NO: 114460 - protein, 116 aa, Triticum aestivum
  unsure (1)..(116): unsure at all Xaa locations
  Clone ID: PAT_TA_8878.pep
KDTGCGISPQDVSHVFTKFAHTQSGGNQGYNGSGLGLAICKRFVSLMGGHIWLESDGAGKGWPAXPFVVKLGACDAYQQPAVPLVWPXHAGSDPSGPARREERGLSNLKPRYQRSI

SEQ ID NO: 114461 - protein, 106 aa, Triticum aestivum
  Clone ID: PAT_TA_8879.pep
AVQQQQQSPFSWWRSCSCRCGADSTRRWLCLIKCLGAPMIYTWNPDDSVSSSPKYFNGGSFPVGSIAAGFRWVGAKAAGSRGGSGDGRTALAVCPNGGAMDTEKQV

SEQ ID NO: 114462 - protein, 260 aa, Triticum aestivum
  unsure (1)..(260): unsure at all Xaa locations
  Clone ID: PAT_TA_8880.pep
ADKLLFEXLXYSHVCKYXACSEEVPELQDMGGPVEGGFSVAFDPLDGSSIVDTNFTVGTIFGVWPGDKLTGVTGGDQVAAAMGIYGPRTTFVVALKDCPGTHEFLLLDEGKWQHVKDTTTIGEGKMFSPGNLRATFDNPDYDKLVNYYVKEKYTLRYTGGMVPDVNQIIVKEKGIFTNVTSPTAKAKLRLLFEVAPLGFLIKKAGGHSSDGKQSVLDKVISVLDERTQVAYGSKNEIIRFEETLYGSSRLAASATVGATA

SEQ ID NO: 114463 - protein, 265 aa, Triticum aestivum
  unsure (1)..(265): unsure at all Xaa locations
  Clone ID: PAT_TA_8881.pep
METVAAAGYARGAATRSPACCAAMSFSQSYRPKAARPATSFYGESLRANTARTSFPAGRQSKAASRAALTTRCAIGARAGRSSSXATPDKNLIRLLICMGEGMRTRSPLXVRTASCRRHGSCVNYFGHEELAVAMLPDKLLLEAFEXYSHTCTYACSERVPELEGMGGPVEGAMHVCRSTPLRVVATNFTVGTIGAIWPGDKLTGGTGGDQVAAXMGIYGPRTLCPVALLAWPATHDCPLLARIPSPRGREMTTCQGEKKLPASK

SEQ ID NO: 114464 - protein, 413 aa, Triticum aestivum
  Clone ID: PAT_TA_8882.pep
MEEKKPRRQGAAGRDGIVQYPHLFIAALALALVLMDPFHLGPLAGIDYRPVKHELAPYREVMQRWPRDNGSRLRLGRLEFVNEVFGPESIEFDRQGRGPYAGLADGRVVRWMGDKTGWETFAVMNPDWSEKVCANGVESTTKKQHGKEQWCGRPLGLRFHRETGELFIADAYYGLMAVGESGGVATSLAREVGGDPVHFANDLDIHMNGSIFFTDTSTRYSRKDHLNILLEGEGTGRLLRYDRETGAVHVVLNGLVFPNGVQISQDQQFLLFSETTNCRIMRYWLEGPRAGQVAVFANLPGFPDNVRLNSKGQFWVAIDCCRTPTQEVFARWPWLRTAYFKIPVSMKTLGKMVSMKMYTLLALLDGEGNVVEVLEDRGGEVMKLVSEVREVDRRLWIGTVAHNHIATIPYPLD

SEQ ID NO: 114465 - protein, 74 aa, Triticum aestivum
  Clone ID: PAT_TA_8883.pep
AYNTRMSQLVIRVGNSWNEQLVRRFLRPHGAGIIVNMSAPDDSKGDFTAWHYERNGLFTMMCAYTVCLQPQEKR

SEQ ID NO: 114466 - protein, 228 aa, Triticum aestivum
  unsure (1)..(228): unsure at all Xaa locations
  Clone ID: PAT_TA_8884.pep
HHADISVMACPGTRQGIVRVEHFGSKETKFITAHDSNISCMTVPGDGLPQAAASVGGARSGIGPRMDGAWRREVRRGAGGAARGSPGPGGDEEGLGGRKRQGGRGCAQAXARPRGKDAGNGESAIAGRQMDRSYSSGSVGPNVSSSLSFMKGILPKYFSSEWSFAQFRLPEVTRYITAFGDQTTVMMIGLDGSFYRCNFDPVNGGKMVLDEFIRFMKPSMSRSRTPNT

SEQ ID NO: 114467 - protein, 676 aa, Triticum aestivum
  unsure (1)..(676): unsure at all Xaa locations
  Clone ID: PAT_TA_8885.pep
MATYEPKNILLTGADGFIXSHDANRLIKSYLPLHXIVVLYKIDYCSRLKMIKPSRPSRIYNSGKTGMPRADLVNYLLITXRIDTKMHFAAATLHYNSFGXCFEFKKNNIYCTHVVLEACRVTVNYRRFIHIITDGEYGETDDDAVVGNHNLRYFVTRYVSSCSIIRGEMFGRAYVRAHGHPLVPTRDNNVYGPNQFPEKLIPKFILLAMKGLPLPIHGDGSNVRSYLYCEDVAEAFEVVLHKGEVGHVYNIGTVKERRVIDVASDICKLFGLDTEKVIRFVENRPFNDQRYFLDDQKLKKLGWAERTTWEEGLKKTIEWYTSNPDYWGDVAGALLPHPRMLMTPGVERHNWTEEIKSLASSPAEAKECSTVPAAATSKSTSSVPQKATYKFLIYGKTGWIGGLLGKICEKQGIPYEYGKGRLQERSQLLQDIRNVKPTHVFNAAGVTGRPNVDWCETHKQDTIRTNVVGTLNLADVCREQGLLMINYATGCIFEYNAEHPEGSGIGFKEEDTPNFVGSFYSKTKAMVEELLKDYDNVCTLRVRMPISSDLSNPRNFITKIARYDKVVNIPNSMTILDELLPISVEMAKRDCRGIWNFTNPGVVSHNEILEMYKEYINPDFKWTNFTLEEQAKVIVAPRSNNEMDASKLKSEFPELLSIKESLIKNVFEPNRKVSTN

SEQ ID NO: 114468 - protein, 109 aa, Triticum aestivum
  unsure (1)..(109): unsure at all Xaa locations
  Clone ID: PAT_TA_8886.pep
LRAVCIRDRTAXSVAIGFQEASAXSLFATSTIFASVVMYDASGVRLHAGKQAAVLNQIVCELPAEHPLAETRPLRELLGHTPTQVVAGAVLGCMIGIAGQIIIAVTSVV

SEQ ID NO: 114469 - protein, 157 aa, Triticum aestivum
  unsure (1)..(157): unsure at all Xaa locations
  Clone ID: PAT_TA_8887.pep
AAAPGPSYGSSSAPSSQAPSTDASAPSSSSDASAPSKRFQXPXAPSAGAPGXXYGSSSAPSSQAPSTDAPTPSSAPTSDAPSSGSPGPSYGSASGPATDAPSPSPSGADAPSSGSAGAPSSGSAGAPSSGSAGAPSYGSAGAPSPSDAGAPDADSPA

SEQ ID NO: 114470 - protein, 398 aa, Triticum aestivum
  unsure (1)..(398): unsure at all Xaa locations
  Clone ID: PAT_TA_8888.pep
AILGIALCGLVILLMILIAVCRPHSPPVFKDVSVSKPVSNVPPKLVILNMNMALHVYEDIMRMTENLSEKYIIGYGASSTVYKCVLKNCRPVAIKKLYAQYPQSLKEFQTELETVGSIKHRNLVSLQGYSLSPVGNLLFYEYMENGSLWDVLHEGQSKKKKLDWETRLRIALGAAQGLAYLHHDCSPRIIHRDVKSKNILLDKDYEPHLTDFGIAKSLCVSKTHTSTYVMGTIGYIDPEYARTSRLNEKSDVYXLWHRSARAADGQKARGQXCNLHHSILSKTASNAVMETVDPDIADTCQDLGEVKKVFQLALLCTKKQPSDRPTMHEVVRVLDCLVHPDPPPKAAQPQPPTGPSYANEYVSLRGAGTLSSSCANSSSTSDAELFLKFGQAISHNTE

SEQ ID NO: 114471 - protein, 153 aa, Triticum aestivum
  Clone ID: PAT_TA_8889.pep
SSGNVFLDSHYNALLGEVEISKLLDPSKGTASISAVAGTFGYIPPEYAYSMQVTVPGNVYSFGVLLLEILTSKMPVDEEFGEGVDLVKWVHSAPERGETPEQIMDPRLSTVSFAWRRQMLAVLKVAMLCTERAPAKRPKMKKAVEVLQEAKNS

SEQ ID NO: 114472 - protein, 153 aa, Triticum aestivum
  Clone ID: PAT_TA_8890.pep
WMLNTIGWVTFYWHWKHITLWQGNVSQFNESSTYLMGWLRDYLWLNSSQLINGYNPFGMNSLSVWAWMFLFGHLVWATGFMFLISWRGYWQELIETLAWAHERTPLANLIRWRDKPVALSIVQARLVGLAHFSVGYIFTYAAFLIASTSGKFG

SEQ ID NO: 114473 - protein, 116 aa, Triticum aestivum
  Clone ID: PAT_TA_8891.pep
IYTDRASSSSCYTSEQTQNALIMLGLTKPRTNFVEPRRESAGRARAGERRREGKWGRLFTLVAGATSQPWRARLRGRPAGRSAAAAHLVAIDGFELRGIWWEHGRRGGGNAPRGKC

SEQ ID NO: 114474 - protein, 152 aa, Triticum aestivum
  Clone ID: PAT_TA_8892.pep
MEARREIAKRARTAGTSNDDDAGSQGSAGGAAAVSSGVAVRTGAAEMDGEELAVVAAAEAEVAGSAETEEHVQRILLAIDNFTRKVSEMLDSGRAMFKDLAADFEDRLCTIHKERVEKWEEEIRELRARDAANERTRAMLHNAQLQLFHIRE

SEQ ID NO: 114475 - protein, 110 aa, Triticum aestivum
  Clone ID: PAT_TA_8893.pep
MAKKRKRSSDAPASAVVEKPDDSAPERPERTLFGFKDQPDSPAEPASKDAGPFFRNKEKVLITCSRRIIYRYRHLMQNVVSLLPHAKKDSKVESKQSKGSALNELVELRS

SEQ ID NO: 114476 - protein, 227 aa, Triticum aestivum
  Clone ID: PAT_TA_8894.pep
PPACIGLTIKFIGTVACSSCLFFECRKQKDLYLWMVKSPAGPSVKFLVNAVHTMEELKLTGNHLKGSRPLLTFSSNFEQQPHWKLLKEMITQIFATPKDHRKAKPFHDHVFVFSIVDDHIWFRNYQISVPHNEIDKVDKGGLDKMTLVEVGPRFCLNPIKIFGGSFGGPTLFENPFYVSPNQIRALEKRKKAGKYAKKVKAKVRRKMHEMENTLEPDEFADLWKGED

SEQ ID NO: 114477 - protein, 322 aa, Triticum aestivum
  unsure (1)..(322): unsure at all Xaa locations
  Clone ID: PAT_TA_8895.pep
MAKKRKRSSDAPASAAVEKPDDSAPERPERTLFGFKDQPDSAAEPASKDAGPFFRNKEKVLITCSRRIIYRYRHLMQNVVSLLPHAKKDSKVESKQSKGSALNELVELRSCSSCLFFECRKQKDLYLWMVKSPAGPSVKFLVNAVHTMEELKLTGXNHLQGSRPLLSFTSXFTMETXCSPSKELIAQIFAAPIDFRLAKPFHDHVFVFSIVDDHIWFRNYQISVPHNEIDKVDKGGLDKITLVEVGPRFSLNPIKIFGGSFGGPTLYENPFYVSPNQIRALEKRKKAGKYAKKVKAKVRRKMHEMENTLEPDEFADLWKGED

SEQ ID NO: 114478 - protein, 65 aa, Triticum aestivum
  Clone ID: PAT_TA_8896.pep
SGPNSGGARAPTRPSSGAFEVYCNGDLVFSKLAEQRFPSEFELRDLIGSRLPPSPFGKNMGNVLS

SEQ ID NO: 114479 - protein, 175 aa, Triticum aestivum
  Clone ID: PAT_TA_8897.pep
PPPLPYSSPNRREERRSAPPSACSSPPPAPPRDTPSPAAAQEKRREHSMRAEAGDGPPARPAPPRRTTRNPLPIRTHRKLETSVPATTPPPRHPPPPLPKRVLPPILPAAPAAPTPPPTAPPPPPGPRRSPHTASHSGRRSCIRQNIGDAFPRRLLVQGKCYDDEAPFGNYCSGH

SEQ ID NO: 114480 - protein, 77 aa, Triticum aestivum
  unsure (1)..(77): unsure at all Xaa locations
  Clone ID: PAT_TA_8898.pep
FSIXIKALGXSLVTLISWLGSFAVSYSFNFLMDWSAAGTFFMFSASSLVTILFVARLVPETKGKTLEEIQASLNYGR

SEQ ID NO: 114481 - protein, 132 aa, Triticum aestivum
  unsure (1)..(132): unsure at all Xaa locations
  Clone ID: PAT_TA_8899.pep
XXXLSTRSVKALSEVEGFALHADELKFVAGQFRRLHSKQLQQTFRFYSQQWRTWASCFIQAAWRRYEKRKAAEQRRREEEEMYAAEMASASSSSQITTAFLVSRFAKNAMRGVQRQRSLEEERLILLPKPKD

SEQ ID NO: 114482 - protein, 154 aa, Triticum aestivum
  unsure (1)..(154): unsure at all Xaa locations
  Clone ID: PAT_TA_8900.pep
VGCLDEVRPYLMGEGGXMSVLHEXDGNVVRLKLQRACGSCPDAXTTMTMGIERHXEEKIPAIVAVKTIDNEESWXFELNEENIDKVXDQIKPYLSGTGGGELEFGGMEEFILIDRPTVTAAVVMPAPVVLTHQVGQTIPKSADIQLLSYTLQHT

SEQ ID NO: 114483 - protein, 602 aa, Triticum aestivum
  unsure (1)..(602): unsure at all Xaa locations
  Clone ID: PAT_TA_8901.pep
GITQDQVILMAARASRTENQDAIDTAIVGMLADPKEARAGIQEVHFLPFNPTDKRTALTYIDADGKMHRVSKGAPEQILHLAHNTSEIERRVHAVIDKFAERGLRSLAVAYQEVPDGRKESPGGPWHFAGLMPLFDPPRHDSAETIRRALNLGVNVKMITGDQLAIGKETGRRLGMGTNMYPSSALLGQKNSDESISALPVDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEXFTTGVILGGYLAIMTVIFFWAAYKTNFFPRLFHVESLEKTAQDDIQKLAAAIYLQVSTISQALIFVTRSRSWSFAERPGFLLVFAFLVAQLIATLIAVYADWPFTQIKGIGWGWAGVVWLYNIITYLPLDIIKFLIRYTLSGKAWDLVIDQRIAFTRKKDFGKEERELKWAHAQRTLHGLQPPDXKMFSEKAGYNELNTWLIXAKRRAEIXRVRELXTLKGHVESVVKLKGLDIETIQQSYTV

SEQ ID NO: 114484 - protein, 340 aa, Triticum aestivum
  Clone ID: PAT_TA_8902.pep
MAVDLMGCYTPRRADDQLAIQEAATAGLRSLELLVSSLSGAAPSKAPQQHPQQPFGEIADQAVSKFRKVISILDRTGHARFRRGPVQSPTPPPPPAPVAPPPPPPRPLAPQSLTLDFTKPNLTMSGATSVTSTSFFSSVTAGEGSVSKGRSLVSAGKPPLSGHKRKPCAGAHSEANTTGSRCHCSKRRKNRVKTTVRVPAVSAKIADIPPDEYSWRKYGQKPIKGSPYPRGYYKCSTVRGCPARKHVERALDDPAMLVVTYEGEHRHAPGPVPLQTAPSPMPVPLAAPVAQVLCPPATGTSDLVLLLCPSPSDVGLRAKCTGLVTVHRRRLIVSHTAQRK

SEQ ID NO: 114485 - protein, 139 aa, Triticum aestivum
  Clone ID: PAT_TA_8903.pep
TRKLRAAKVLGAVTDGYEHQLATAAGGDANLLFHYARRKMAHRWCALRAAVAASGIFSLPNEVAGFCTFTKDTVTSNPAFAWLRCEKQEVEDLESFLRENKIITRSGTKFGADQKVVRISMVDTDEAFGIFVNRLAAIK

SEQ ID NO: 114486 - protein, 404 aa, Triticum aestivum
  Clone ID: PAT_TA_8904.pep
MDRIVGSKYKLGRKIGSGSFGEIYLATHVDTYEIVAVKIENSKTNHPQLLYEAKLYNALQGGTGIANIKWCGIDGEENVLVIDLLGPSLEDLFVYCGRRFSLKTVLMLADQMITRIEFLHSKGYLHRDIKPDNFLMGLGRKANQVYIIDFGLAKRYRDSTTNRHIPYRENKNLTGTARYASPNPHLEFEQSRWDDLQSIGYVLLDFLRGSLPWQGLKAATKKQKYDKISEKKLSTPIEVLCKTHPVEFASYFHYCHSLTFDQRPDYGFLRRLFRDLSDREGHQFDHVFDWTLLKCKQTQKVKAQQQDPGVSSRPVAKNMDKHQAEASCQLEAEQRPVIRMQIRSTAENSRSNNRHSDKLRVSASTDKELLQSTSFGHAGAPRKNVSISKTPWLVDPNSGPSNHL

SEQ ID NO: 114487 - protein, 199 aa, Triticum aestivum
  Clone ID: PAT_TA_8905.pep
MQPSDIWKAHASQQQQSEGPGLDMERSNGCNGHNCCPSPLQPVASAGQHSESSAAYFSWPTSTLMHGSAEGRANYFGNLQKGVLPGHLGRLPKGQQATTLLDLMIIRAFHSKILRRFSLGTAIGFRIRKGTLTDTPAILVFVARKVNKKWLRPTQCLPAALEGPGGVWCDVDVVEFSYYGAPAPTPKEQLYDELVDGLR

SEQ ID NO: 114488 - protein, 304 aa, Triticum aestivum
  unsure (1)..(304): unsure at all Xaa locations
  Clone ID: PAT_TA_8906.pep
HRMLSLLLRKAMKKCFGEDAKPEECSVVQSNEFFSQVLGGFEPYGFASIVMEHPLRVRVFCAQVRAGMWRKNGDAAILSAEWYRSVQWFEQGLESDLFLLQCCGALSSPEFFVRTIQERFGLSDYTSLDLTQQNEYEPVLIQEMLTLIVQLVKERRFCGCSTADNLKRELIYKLAVGDATHSQIVRSLPRDLSSSEQLQDVLDSVAVYPDPSGKKKGKYVLREAFWKELDLYHPRWSPRELQVANERYCRFCKVSTLGAQLPQWTNVLSPLRSISKIATSKAVLQIXXAXLFYAXYTDASSVSR

SEQ ID NO: 114489 - protein, 552 aa, Triticum aestivum
  unsure (1)..(552): unsure at all Xaa locations
  Clone ID: PAT_TA_8907.pep
ALRESAGGITAAVPNGLAVRSIRTRAIETSIRNVPGSRLFIDAAPYDDKAGYKTEGEIKQKLVPWHADIFEFLDLRKNHGQXENRERDLFFALWVPDLFMQRVQNNEDWSLFCPNEAPGLADCWGEKFEELYKKYEKAGKAKKVIPAQTLWFNILKARKETGTPKILYKDSCNRRCMHQNQVTIKSSNLCTEKTGATSHLESDVLNILSTALQRLLRGKVIDNPGVISYLNKLIDKKIIAVSYYPVETARRSNMRHRPFGLGVQGLADSLMLRGTAVDSPEAQHLNRDIFETIYYHARTAAAELAARDGPXGSPVSEGIIQPDMWNVVPSTRWNWPTLRETISKVGVRNSLLVAPMPTASTSQILGNNECFEPYTSNIYSRRVLSGEFVVVNKHLLHDLTEMGIWTPALKNKIIYEDGSIQKMEEIPDDLKAIYKTVWEIKQKTLVDMAVDRGCYIDQSQSLNVHMDQPNFAKLTSLHFHAWSKGLKTGMYYLRTRAAADAIKFTVDTGFLKVNGDANGTNGTNXAEEDDEAKMAQVVCSLNNREECLACGS

SEQ ID NO: 114490 - protein, 135 aa, Triticum aestivum
  Clone ID: PAT_TA_8908.pep
SQKKLHHYTRMNSPGPRALLATNESFCTRIRTSEVGRHSRFSLTHQAKARPRWPNYFLSYPSSSNNVLVQNLTYPCCSRARTAAPGPPFLPPGGKGPCVPCACVNAPLAVPAHLPHPAFALAAFGPGASPLDGVA

SEQ ID NO: 114491 - protein, 140 aa, Triticum aestivum
  Clone ID: PAT_TA_8909.pep
IKLSIENSVLSEYTSMVVLQTNLDAAQKVKQKQKGHKGANEPLRFQLHGLKLGFGDKAATRENLLTCFGDEKPLETLKIFKKAGGCCGRVADCLCCMCCIKACNKMNDQCAILMAQVCAALSCLGCYECCAEVCCGGSES

SEQ ID NO: 114492 - protein, 195 aa, Triticum aestivum
  Clone ID: PAT_TA_8910.pep
VRKEACPMTFECLMEVDIRIKGDIEDVTLVDGCSDLIESHCLYDTEIECTMDDTNGAAMFDFIIFRRALEATVELNFTKVPTGGMEVKMCGYTAISESLYDFMGEQRECDRFVASAGRHPQYFIAAVPFEDTLFVDFMEGKLSIPFKAAVHGSQEREYHLSNGCGGVGDGFLGRRPITEPSKIYKYAECQLTATC

SEQ ID NO: 114493 - protein, 143 aa, Triticum aestivum
  unsure (1)..(143): unsure at all Xaa locations
  Clone ID: PAT_TA_8911.pep
KASKFXLWKERXSFVKXWCLIGGYVVPTPSLFIKTSRRDIISRVNSNTCIRHPNAGVFPQSSLDKSNSTGSPVRQVLRAAMPASWPIEEILCIPHRRNIVSSRIENFCTRLNISLVRILSSVHEKSQNSWCVCRKIXXQVSKF

SEQ ID NO: 114494 - protein, 187 aa, Triticum aestivum
  Clone ID: PAT_TA_8912.pep
ASSAAVVAGQRRYAVNGVSFVVPDTPLKLLDNYNIANVIEWDSVPERPDGGAPRPGTPVVRLNLHEFVEVVFQNTENEMQSWHLDGYDFWVVGYGDNGQWTENERLNYNLVDAQARHTVQVYPNGWSAILVSLDNQGMWNLRSANWDRQYLGQQLYLRVWTAEQSFSNEYSIPTNAILCGRAAGLPH

SEQ ID NO: 114495 - protein, 177 aa, Triticum aestivum
  Clone ID: PAT_TA_8913.pep
RRRPPPYANFSKGSSQIIAQYYQLIRLGFEGYKDIMQNCRDNATVLREGVEKMGYFHLVSKDSGVPLVAFSLKDSSKYTVFEVVESLRRFGWIVPAYTMPADAEHIAVMRVVIREDFSRGLAERLITDLKKVMVEMDAHAKKHGHHEHVKKTAHQIEKEVTTYWRTFVARKKHSLVC

SEQ ID NO: 114496 - protein, 83 aa, Triticum aestivum
  Clone ID: PAT_TA_8914.pep
LTPTRPNQLSSYDSTHASEVFSAQFGGSWLPVFSSTKARKSEDESHWVVGLDANNIFCILCKSPVCFPHVIPYPVLTILGLLF

SEQ ID NO: 114497 - protein, 126 aa, Triticum aestivum
  unsure (1)..(126): unsure at all Xaa locations
  Clone ID: PAT_TA_8915.pep
LALALALCNKFIIKRRVLSNKFLIRLQAQSNKFLIKPSTIYSSKKSLQKMPEIIIKKRPPINIILVIMSYDYFGKVQGSKNCLSKPHPPGNFNLMVQNRCKRRVSNIALPPXVRRYVSPTNLFGHR

SEQ ID NO: 114498 - protein, 76 aa, Triticum aestivum
  Clone ID: PAT_TA_8916.pep
ETMQMDLVQWVQFCIQDKKPSADVLDPFLAGDSEQEGEMIAVLKVALACIHANPERRPVMRNVTETLERLSASVSS

SEQ ID NO: 114499 - protein, 196 aa, Triticum aestivum
  Clone ID: PAT_TA_8917.pep
GVRAPCHHGRSLMFPACGLCCLLCSCLSFGFPCCLIWLCLVFAHIGLVLLLSRALDDVLNYERRICRHRPPDVAPRRPTPATPTAVPTTAPSSTLPGSAAASGSVPSGRRKSARGSATGATTIEVCATCSLCWTKIGASALSSRRPSMFIRYTTTTIVFFVIKHDFNYFNVYFSSFPIRLAYPMLCKTLCLGEDGF

SEQ ID NO: 114500 - protein, 79 aa, Triticum aestivum
  unsure (1)..(79): unsure at all Xaa locations
  Clone ID: PAT_TA_8918.pep
PVMLPIRVTFLGSYGTSSSMAGMPIRVIKNXNISNLEELEYIASYRFPTFISTLIEDLVMVLDMQGMLQYAWENYTCSA

SEQ ID NO: 114501 - protein, 213 aa, Triticum aestivum
  Clone ID: PAT_TA_8919.pep
STHASGTEKLWILKEVGPMLYEIVQCNSDGEEISSYALQEDAISEQMFQSSESALDDLVWTADSVFSSMKEHSFSFISSMFLRRLLQPGVNHCSALRETLLEYKRSSADSEFQSLTTSGLRKEILSIIEQEGSSQVASSTVYHWKKFSARYLHNWCWNNRPYGLLLDTNSEVFGLIRKGSFSLFRCLEGVEQLIYGSSDDLGNFIGLWDELNR

SEQ ID NO: 114502 - protein, 258 aa, Triticum aestivum
  Clone ID: PAT_TA_8920.pep
MDELRREQHRIAGHPYAFEVGSYFLAGYYSVLASTPELARQFYTNGSTVVRVDCQTMESQFGETAEEINDILMSMNVQKVEIKTANFLESWAGAITLLVTGLVQLKGYPLRKRFSQSIILAPQVKPDGFFVDSDIFQLICDEYDDHYQVADYGYANQFPQMAAHNTMTETASDYVAEELELKGFAAPADTDERANGIIYENHEMQQQDPLEFESAVNGETHFEDPAPSLPSSTDVKQDASLAPPHPPSPPTPEEEPVG

SEQ ID NO: 114503 - protein, 101 aa, Triticum aestivum
  Clone ID: PAT_TA_8921.pep
TRGPQKDNQPLCHAPQPQPQLWSAFDIDIVIRARLRGQGARQSPSKRYSRSYGWKEHGPSQKTTPQVRFSGDGRKVKQREDTLMAPGLAWPQLIASGAAPV

SEQ ID NO: 114504 - protein, 234 aa, Triticum aestivum
  Clone ID: PAT_TA_8922.pep
RHEDSFEEVPGVFQLATAITSNDLEEIQKFLDLSVNSSCEGLIIKTLDTDATYEPAKRSNNWLKLKKDYMDSVGDSLDLVPIAAFHGRGKRTGVYGSFLLACYDEHNEEYQTICNIGTGFSEQQLEERSTSLRSKVIKNPKAYYRFADTTDPDVWFEPSEVWEVKAADLSISPVHRAANGIVDPNKGISLRFPRLLRVRDDKNPEHATTAEQVADMYRAQKINHSHNQEDEDDD

SEQ ID NO: 114505 - protein, 289 aa, Triticum aestivum
  Clone ID: PAT_TA_8923.pep
RREGLTYKLGEAESVSKALSDELVSAKEMIQKGQEELEATSNELASAVEARDNLKKELLDVYKKFESTTQELVDERRIVTTLNRELEALAKRQEADSQARKVLEADLDEATRSLNEMNTSAVSLSEALESTHSKNATLEAEKEMLSKALDEQTKLTTEAQENCEDAQNLITRLQTERETFEMRSRHLEEELALAKGEMLRLRRQISASKSQKTRYVPRASASTETSTAPRASSPTETSNVPRTSVPTETSQTPNEQSVNDGTQKTGEIAAETPYTVRVKARRGKGGGPR

SEQ ID NO: 114506 - protein, 195 aa, Triticum aestivum
  unsure (1)..(195): unsure at all Xaa locations
  Clone ID: PAT_TA_8924.pep
SCHPNSPIVDVDHPHHLWHGXTMSQCQSPLTILPSPTPSQXPATTANLPHVAILLLTWTAPSRRRSPHHHHLTASHRSVPPAALHCRRPSPCAGVLHLTWSPLRHRRRSHCLRPPPRRPQPPALSSPPRINKALMPIVGAASSRSATLLLALSHTTLSLVCVIQHKEHNQEKDRLLLCTRGPFPWWNKRLHCVFP

SEQ ID NO: 114507 - protein, 86 aa, Triticum aestivum
  unsure (1)..(86): unsure at all Xaa locations
  Clone ID: PAT_TA_8925.pep
MKIPKIRRSRWIXGSKPGQRKKPFKGNKDGSSSLDRILDRPCQIHGTPDKPANHTSKNCWVFKQVGKLNTEHKGKGPPSKDDDEPR

SEQ ID NO: 114508 - protein, 123 aa, Triticum aestivum
  Clone ID: PAT_TA_8926.pep
LIGLEPTLTISILPRCITVALALSIVSFFEGANTSLTAAVVVLTGLIGANFVQAAMDKLGLNDPIARGIGTASSAHGLGTAALSAKEPEALPFCAIAYALTGIFGSLICSSPAVRQSLVFIAG

SEQ ID NO: 114509 - protein, 192 aa, Triticum aestivum
  Clone ID: PAT_TA_8927.pep
RLASRAPARGAASALALSAGPPCPLPAAALALPVALAQGATRHYQFDVPTANVTRLCGTKSIVTVNGQFPGPALSAREGDRVLVRVANHAPHNMSIHWHGVRQLRTGWADGPAYVTQCPVQPGQTYVYKFTITAQRGTLWWHAHISWLRTTVYGPIVILPKLGVPYPFAAPYKEVPIMFGEWWKADTEAVIS

SEQ ID NO: 114510 - protein, 125 aa, Triticum aestivum
  Clone ID: PAT_TA_8928.pep
LLFLSRSPLPRTPPPLALAPPPPFAPPRRAHRHRSPSRRRRLRCPTCWIPTIHFSGVVASSSRARGRRSEGDVEPPLGTPPSSSRAHGRRSGGGVEPLLGTPDAIICRSVSPASLMYLARDERGI

SEQ ID NO: 114511 - protein, 193 aa, Triticum aestivum
  Clone ID: PAT_TA_8929.pep
MGKSSKKSAVAVAPAAGLVPDGKSGKKGKRNAEDDIEKAASAKKQKTAPEKAVPVKYDLKVKKLPPKKVECSSSDEDSSESEDEVMVQPKKAAPSAKQESSSDSSDESSSDDEPAKKPAAAPKKPAALASNGSKKVKSDSSSSDSSSDEDVMVPPKKAAQSAKQESSSDGSDESSSDDEPAKKPAAASKKTCC

SEQ ID NO: 114512 - protein, 228 aa, Triticum aestivum
  unsure (1)..(228): unsure at all Xaa locations
  Clone ID: PAT_TA_8930.pep
HNHSNGKQTELAFIQIADNWQETSTLLAALERIESWIFSRIVETVWWQALTPHMQTPAEGSSTPKARKVLGPSLGDQQQGTFSVNLWKAAFHDAYSRLCPLRAGGHECGCLPVLAKLVMEQCVARIXDLQVFNAILRESASEIPTDPISDPIVDPKVLPIPAGELSFGSGAQLKNSIGNWSRWLTDNLGIDADDPEDEGFVIGHGNDERIGAAEAKSFKLLTELSDLL

SEQ ID NO: 114513 - protein, 185 aa, Triticum aestivum
  Clone ID: PAT_TA_8931.pep
APDGAEEFTLCSTQDETSSSNKLSLFHLGRQKEAECDKDLPTLQLRQHEESEYGGPSLEAPDLEMNNGVSFKAASVSTVPAFYPSLLPVPLTLWPANVSNVEAANASHEVLKPTPVNLKEAIKADEVVSMSKLSIGGGTSGSMEPSALSLQLTGPTNTRQSAFHVSPPMTRTDLSQGNNSPIHAV

SEQ ID NO: 114514 - protein, 364 aa, Triticum aestivum
  Clone ID: PAT_TA_8932.pep
PCSKQSHSLQKQMVHMNQGQGETSYARNSRIQNAQQNRMKPLIEGSIFELCSNNTLFPGKILIADLGCSSGPNALALVSIAVEAIHSYCLQFEQTLPEVCVLLNDLPDNDFNTVVKSLVTLRQSKKPNVLTGVTPGSFYERLFTSGSMHLICSSNSLHWLSKAPEHLTRNQIPAYDMDEHARCESLPIVLEAYAQQFMEDFTLFLKLRAKELVPGGRMVVSLVGRHSDVTASKFSHLWETVAQILSVMASEGVIDKAKYDSFYVPMYGASSEELMEIIQEEGSFSITDMRVYDPATDMNNALFTSSWFINHLRAIFEPIIVEHFGDVMNEFVRTAEQRWTLEGSVQDERAKYPRAMQVVSLAKA

SEQ ID NO: 114515 - protein, 149 aa, Triticum aestivum
  unsure (1)..(149): unsure at all Xaa locations
  Clone ID: PAT_TA_8933.pep
QGFWRYLLKKNLDARWLQGFPCAVFAIGDSGYQGXATKKLRTRLSQLGAKSIXIGLGDDQDSSGYEKALGPWLLSFWKSLNRTNPSLLPRIQARPRALRQASKHSYECPCTSAPLPQTFRKKRIPLVWKMDSSRIYSSQWLYAAFNFSV

SEQ ID NO: 114516 - protein, 52 aa, Triticum aestivum
  Clone ID: PAT_TA_8934.pep
RVNLRGTLAGIKHATRVMAPAGSGSILCMGSISGIMGCLGSYPYSLSKLAIA

SEQ ID NO: 114517 - protein, 165 aa, Triticum aestivum
  Clone ID: PAT_TA_8935.pep
RQLDLLQLRWNNFNDNFFCQVIWLLLFTAPPLHAVWTLTRQGSSHLWTSSAAFIGLLRQALNIQYHISCPVHACDLSTGFRVPLVASSRDGCGWTPEFSPAGSTTGFVVPCVPNFPGSGSSWILLGLLGRELLAGIRMTALLLFRWIGGRRRSLGEEKKLQEWRG

SEQ ID NO: 114518 - protein, 102 aa, Triticum aestivum
  Clone ID: PAT_TA_8936.pep
VRSSFGLSAAVSFSRSRTNLAVTAVSAPLTSVLDVYCGRGDRKTKRGKRFSHSYGNARPRNKNKGTGPARLYAPPAPPKKDQFEDGEIIAIEIDDDIMERMD

SEQ ID NO: 114519 - protein, 124 aa, Triticum aestivum
  Clone ID: PAT_TA_8937.pep
PIEHTLPTPHPTSAPLPAPSNGVPRPPGHAHVHGRLPLPTTALSYPLSLSRSHPPLRSPAPAPPTPPLLSRLLSHQFLMSTGGRGDRKTKRGKRPSHSYRKCTTPVIRRREHRPARLYAPSRAS

SEQ ID NO: 114520 - protein, 155 aa, Triticum aestivum
  unsure (1)..(155): unsure at all Xaa locations
  Clone ID: PAT_TA_8938.pep
MASPMSGDARTPPRGAAPYALYQFGTSGAAVAVATAVTHPLDVIKIRLQMQLAGQRGNLVGMGAIFTQMVEREGPRSLYLGFAPALTRSLIYGGLRLGLYEPCKHVCSYAFGSTNFAFKFASGVVAGALATALTNPMEVLKVXXQMSTSRTSTIG

SEQ ID NO: 114521 - protein, 156 aa, Triticum aestivum
  Clone ID: PAT_TA_8939.pep
LHPAGEPACLAGKMLRWLQARRRPQMTFPTPSSASSTTRPSAQLFQVAQRLGGYTQWVRLRAPTQSADSVSAPGTLDVIISFFNNNKTLRPTFPSCSEARRLHPVSALACPHRKQAAPAVVRGRLSSTTSSTSTSAQTLRRTFQVGRRLRGYCRGG

SEQ ID NO: 114522 - protein, 85 aa, Triticum aestivum
  Clone ID: PAT_TA_8940.pep
SSSTTPAAKTRRRSGASPPDLWSSGGSSASAGRACCLMLGLARNQSTETRLTSAYIFYGAALVFSQVLLLFLEELSQILLYAKKK

SEQ ID NO: 114523 - protein, 78 aa, Triticum aestivum
  Clone ID: PAT_TA_8941.pep
AGGTTGCLHTTTTGVLTTCVETTRLYTRRLKKPEQLATSLPLHVNCLSWRPDAICTEVISSKSQPIFCTGETVEPNYF

SEQ ID NO: 114524 - protein, 130 aa, Triticum aestivum
  Clone ID: PAT_TA_8942.pep
LGFRPPPLTSPGSARSGDGEARARRICYGRGAGHLGAVWTAATAGGRRPSYSRRRRTRGAPSWRPCPARGGGGCRAQARPRRPTSAEMQGGRDVHGLDWKDWMQTNAHEEERCKPGHDLKMSLEKMAIGV

SEQ ID NO: 114525 - protein, 311 aa, Triticum aestivum
  unsure (1)..(311): unsure at all Xaa locations
  Clone ID: PAT_TA_8943.pep
MICGVKSGDNCSSVSLDPLSYPPDDLKIQPQQSMSRSHRIAIICGATVGSVAFVAIMVGMLLWWRHRRNQQIFFDVNDQYDPEVCLGHLKKYTFKELRASTNNFNSKNILGEGGYGIVYKGFLRDGSIVAVKRLKDYNAVGGEVQFQTEVEVISLAVHRNLLRLIGFCTTECERLLVYPYMPNGSVASQLRGPFQRHPPPGCPRGALLPPAPAPALRSVHDQCEPSXLPRPVRASDPLLVHLGHALVGASRLAVLVVLQASQVSSAARGPPAPCAPEFWPSRPSPVLSVVLGSFILLPCHQTKPDYVDCFY

SEQ ID NO: 114526 - protein, 155 aa, Triticum aestivum
  Clone ID: PAT_TA_8944.pep
MDASATVAAGKAKKGAAGRKAGGPRKKSVSRSVKAGLQFPVSRIGRYLKKGRYAQRVGTGAPVYLAAVLEYLAAELLELAGNAAKDNKKSRITPRYLLLAVRNDEELGKLLAGVTIAHGGVVPKINPVLLPKKTAEKSTKEPKSPKKTAKSPKKA

SEQ ID NO: 114527 - protein, 128 aa, Triticum aestivum
  Clone ID: PAT_TA_8945.pep
MYFAGIYDPVDQSWRGKENEIALCWSGPTVVVDGTLYMLDQSLGTKLMMWLNETKEWVMVGRLSDKLTRPPCELVAIGRKIYVIGKGLSTVTIDMDMAARVDGFLVSSSTGPLMEHDFSPEKCSVITI

SEQ ID NO: 114528 - protein, 363 aa, Triticum aestivum
  Clone ID: PAT_TA_8946.pep
MNHHLESGDYQKLFCRKMESAELHTPLLHGLPDEIALLCLARVPRQYHNALRCVSRGWKALLCSEEWHSYRKRNNLDESWIYVICRGTGFKCYVLVPDPTTRCLKVIQVMEPPCSGREGVSIETLDRRLFLMGGCSWLKDATDEVYCYDAASNHWSKAAPMPTARCFFVTAALNNKIYVTGGLGLTDKSPNSWDIYDKATDSWFSHKNPMLTPDIVKFVALDDELVTIHKASWNRMYFAGIYDPVDQSWRGKENEIALCWSGPTVVVDGTLYMLDQSLGTKLMMWINETKEWVMVGRLSDKLTRPPCELVAIGRKIYVIGKGLSTVTIDMDMAARVDGFLVSSSTGPLMEHDFSPEKCSVITI

SEQ ID NO: 114529 - protein, 263 aa, Triticum aestivum
  Clone ID: PAT_TA_8947.pep
RAAGIGTRRDFKSSNILLEHDFTPKVSDFGLARTARGEGNQHISTRVMGTFGYVAPEYAMTGHLLVKSDVYSYGVVLLELLTGRKPVDMSQPAGQESLVAWARPYLTNVVGLRQAVDPLLGPNVPLDNVAKAAAIASMCVQPEVAHRPSMSEVVQALKLVCSEGDEGLGSGSFSQELAARTTAAYDVTGMEAERVLLSEMFGSTPVFTPADDSGSFRMQSSSGPLMTGKNKKFWQRMRNLSRGSMSEHGASPDFETHSQCSNR

SEQ ID NO: 114530 - protein, 265 aa, Triticum aestivum
  unsure (1)..(265): unsure at all Xaa locations
  Clone ID: PAT_TA_8948.pep
RRCTRETHCEFLTEQVTCMRNGRRDDSYQKWRWQPTDCDLPRFDARLLLEPPRGVRRRLGGAARVRCPGESXVCLVQSAIPKGHKTLTKFVNNGSSNVFYAHDYNATVEFYWAPFLVESNSDNPKVHSVPDRVIQWHSIAKHAKNWVGVDYLVFNTYIWWLSALDMKVLKKGSFDEGATEYEEVDRPVAYSEVLKTWAKWVDRNIDPNSTTVFFMGMSPNHITPEAWGNQGGIKCAMETQPIANRSATLDVGTDWRLYAGAQDVL

SEQ ID NO: 114531 - protein, 217 aa, Triticum aestivum
  Clone ID: PAT_TA_8949.pep
ERLISFGCNGPRTIRVIAAPKLTVLGYPSCRFYELVMGLGTIIVKEMIPISLAVSVRTVKVLVLESIGPNLDVVVGFLRCFPCVEKLYIQSCLRKDMKNVGQYGTLDPIECLELNLKAIVLNTYEGKTPDVDFAKFFVLNAKVLEVMKFGVYRNSCNQKWVANQHMRLQLDNRASRDARFDFERDYGNSRFYYKKHMHDMWIADPFDRSLCKFCRKV

SEQ ID NO: 114532 - protein, 341 aa, Triticum aestivum
  unsure (1)..(341): unsure at all Xaa locations
  Clone ID: PAT_TA_8950.pep
MAAKTKAPAGTPVGPVPFADVETDPGLVSPVPEQLPEEHAALPSASAFNGRMNIRCYQGFWLPDYFAAAAVALQRRFEPCRNDVIVASFPKSGTTWLNALAFATMARRAYPAADAGHPLLRLNPHQCIPFLENLFRSRAEAAKLEALPSPRLMNTHMPLGMIMPGAGGCKVVYVCREPKDMVVSLWHFLQHVHPDLALADVLDSVCSGAVPYGPVWXHILGYWRASIARPDAVLFLRYEELLRXPAGNVRDLARFVGLPFSEXEEDAGVVQDIVKLCSFGHLKPLEANSTGQLDPLVPVPREALFRKGVAGDWANHMTPEMARRLDEIVADKFHATGLTFQ

SEQ ID NO: 114533 - protein, 157 aa, Triticum aestivum
  unsure (1)..(157): unsure at all Xaa locations
  Clone ID: PAT_TA_8951.pep
MFGTPNSPSLFGTPSSAPSFGTPSTTPAFGTPSSTPAFGAPSSTPAFGVPSSTPAFGAPSSTPSFWTPTSSPTFGTPSSTPAFGALPSSSPSPFGFQQQVTPSPSPXVSAAGLAGQITTQMAPVAPLPLSPSDRDIQAMVDAYXXXPGNPRYAFXHL

SEQ ID NO: 114534 - protein, 223 aa, Triticum aestivum
  Clone ID: PAT_TA_8952.pep
MQPSKKLARVDTAEIKSQLVRKLGHQRSELYFHSLKKFLSFQLGKSEFDKICVATLGKENIKLHNFLVQSILGNAYMSLGPPPSRQTPTGNSQTSAVTNGTLASGVPLARRVRPVANRDKRFADKPSPLGKSPLGHPGAAEFVSVEDGEEVDQARGSPVCVQSQSPIRAPLGIPPKAQNSQPSISYPLEICYNNGELPGSEDLSKLLENKLKAEGLSISVEMC

SEQ ID NO: 114535 - protein, 59 aa, Triticum aestivum
  Clone ID: PAT_TA_8953.pep
VMVYGGLAALVFCGYIIYDTDNLIKRYSYDEYVWAAVALYLDVINLFLSLLTLFRASDS

SEQ ID NO: 114536 - protein, 333 aa, Triticum aestivum
  Clone ID: PAT_TA_8954.pep
PGRTRRAAVARTFALDELAAFALDELAAATRNFRDDSSVVGREANLYKAYLKSINKIVNIKLQHAVRTSGPSEQLNREFLAHVLTLSALRHPNVVNLIGFCADGEYKILVHEHVPLGSLEDHLHPRDRSPAGKAPLDWNTRMNIAARVAKGLEYLHHKGVVYRKSMGSSDILLGDGYHPKLSQYGLADLGRLLAEDNKDWSTEFWGSTTIAPETFVTGKVTMESNVYSFGGLLLEMITGRRPIDPAQPAAEDRNLIAWATRLMKDRSQFRRMADPALQGRYPSMDLEEALTVASMCVHQQPAMRSPIGTVVTALSRLAYDVDPPESSHPAAPS

SEQ ID NO: 114537 - protein, 181 aa, Triticum aestivum
  unsure (1)..(181): unsure at all Xaa locations
  Clone ID: PAT_TA_8955.pep
TWPRXLMLPAYLFFTTSACGLLAYLNFDQLVKRGYVPSKVGDSFTGGYLDTPVGWITGMISNGRXRDLPTFTRTTDTNDVMVTINIKQCELDAPAADGILLNTFDDLEHTSLAAIRERLPNTITIGPLISLPSYLPSLTSSLWKEDNVCTSWLDKQPDGSVVYVNFGSITVMSTEQMVEFA

SEQ ID NO: 114538 - protein, 130 aa, Triticum aestivum
  Clone ID: PAT_TA_8956.pep
MATKLVVFGLPWDVDSEGLRKHMAKFGPLEDCVVMKDRFSGRSRGFGYVTFSSADDVKNVLECEHFLGNRALEVKIATPREELKPLSQGTKTATRIFVGRIPQSADESMFRRHFEAFGEIIDLYMPKEHG

SEQ ID NO: 114539 - protein, 116 aa, Triticum aestivum
  Clone ID: PAT_TA_8957.pep
ARQACDDPLALIFSFQEDEATRCGSCGSIFHKQCLRKISVCPCGKSASTGMKIVALEQAIEYGSNRLSTEFIPPPSFSSSSRFFAGILSKARPDKIWKPRDSNPVILMGSLPDTSM

SEQ ID NO: 114540 - protein, 227 aa, Triticum aestivum
  Clone ID: PAT_TA_8958.pep
HLQTLFLGIWGRPPSVTYRRQLYTVRDGGTIALDWLLASDWEAADGSSCDGTISSDDSTPIVVVVPGLTSDSTAAYVKHLVFSMASNGWNVVVGNHRGLGGISITSDCFYNGGWTEDIREVVNYLHQKYPEAPLFTVGTSLGANILVKYLGEEGESIPIAGAASICSPWDLLVTSRFISRKLVQRCYDKALAIGLKGYAKLHQPVLARLANWEAITSVCNVLTCWSN

SEQ ID NO: 114541 - protein, 147 aa, Triticum aestivum
  Clone ID: PAT_TA_8959.pep
RPRRPRQNPNRPPFPSCSRTLAADRAAAGRDGGARRRRRLPPLPAEPYGSGGRHLLPATPPLRRDAARRRQAHPPRRNFRLRAQGSGRPIRARAAGREQRRSVLLFRARARTGASFKACAAPAPAPGASRRPRRFATRDARSARSRT

SEQ ID NO: 114542 - protein, 244 aa, Triticum aestivum
  unsure (1)..(244): unsure at all Xaa locations
  Clone ID: PAT_TA_8960.pep
MATLLRRASLRRAIASAASAATASASCPESYRQVICGSTFHCRDFASKAKKKSKSSGTDSGEENMSKKDLALHQAIDQITTSFGKGAIMWLGRSEGHREVPVVSTGSFSLDLALGIGGLPKGRVVEVYGPEASGKTTLALHVIAEAQKLTGGGCGAFADALRPSGPPRADATGVDXDRLXLSLPLSADLALCLGHPPIRCGSVDVVVVDSVAALVPKTELDGEMGDAHVALQARLMSQALRKLS

SEQ ID NO: 114543 - protein, 179 aa, Triticum aestivum
  Clone ID: PAT_TA_8961.pep
EWSANEAEQEVCAGDISCVTDLEQKAAKHHEDQPEEHQAEQQIVRDECAAVKTVKDVGIDAVPSSAESPSRWPIDFANRQRQIIELWHDCNVSLGTQDLLFLLLQREMPQDSVLHGKLEHRRLSFIPGPSTTPARRRLSRNRIPLKNYETRTCSYKQLEELNQGQGSYPNGVFWVPNNV

SEQ ID NO: 114544 - protein, 143 aa, Triticum aestivum
  unsure (1)..(143): unsure at all Xaa locations
  Clone ID: PAT_TA_8962.pep
VAVSTPSKLSTLELTCGLVVSSVEATIAAQIVKGSWPEGSRGQLTACIGSVGDMNVMLFDCREEKSPVIAADGTIQLSRRVVSVERFGQLIVRGVVNRGGGDHDKVLAEGKASFAPXMQVEAVVRLILTACVSWKSLSPGLLS

SEQ ID NO: 114545 - protein, 219 aa, Triticum aestivum
  unsure (1)..(219): unsure at all Xaa locations
  Clone ID: PAT_TA_8963.pep
GSSPLISSALQKLIFISLSRDDEHNPSRTTVRASSGAILARLLVMNTNFSAQLLSEPTLLANIQQSGISLKDNLLLSLVDMWIDKXDNASAIQQKEYAMALSVVLTLQIPQVIDKLDDILSVCTTVIIGGREVKTEDDSRGDITSPPWLGNDNSGYSSKFLKKRQAKDLDPIKQASLENILRENLKACAAHHGDSTFNAAISRIHPSSFAQLQQALNSA

SEQ ID NO: 114546 - protein, 112 aa, Triticum aestivum
  Clone ID: PAT_TA_8964.pep
SIERVRTHTVYDYMSTVPPLVHTDIPIIRLVHHFRSAGFYTPQKNVTNCYVLRRTWLWLLLRSAPDQPLPPPPQLSSSRTSASSTPAPSATMGSCFVLRQEEEDEQPSCRIR

SEQ ID NO: 114547 - protein, 214 aa, Triticum aestivum
  Clone ID: PAT_TA_8965.pep
RALSNDSLYDGGIAAADEFTYVVEQDVSELDDDCDRVYTVDAVHRVPVAAPEDCCYFQTPMGNDVGFVDGVGAWAEEQRIQKLSARLQALEADRESMRHAIMSMGAEKAQVVMLKDIAHQLCEEAAPLPAVSLKLHPVPQAVVAPKRKLVKRQPFCVKFFIVTAIKWIVSVFSRQKKLDRIKYPFGLCGSYVGLMLLLDRSHKQRYRRFLKRAR

SEQ ID NO: 114548 - protein, 98 aa, Triticum aestivum
  Clone ID: PAT_TA_8966.pep
AHASAYNRAPSPFDQLALANSLFLHLKNDKTPTYLINAKSSGKQIDGKDLMRLIELAQSNGMPDSSKPEDTRVAELKGKYRGFISGKFGKFLPEEFSF

SEQ ID NO: 114549 - protein, 237 aa, Triticum aestivum
  Clone ID: PAT_TA_8967.pep
HAAETLFPLPPGRCGGESGLRRGAGGVTLRPSPPPPRPLRRVANPPRPHPASPRLVSSPNFSRSPPSLSKQTLINPPPKQRLAWRKGRHFHWGYALCSPDATRVRVRAGAPGTVPRGGAVCSAAGRRRGGRCSSCAFFRRSSHGRRPAPALPCPVRGWGAGLLRLHGGRGGAAAGARPRSGRPSPSMEVAAPAPRHGLEPNCRARPGSPALLTLLLTPVPVFCLVLAPDRPIAAGLL

SEQ ID NO: 114550 - protein, 258 aa, Triticum aestivum
  unsure (1)..(258): unsure at all Xaa locations
  Clone ID: PAT_TA_8968.pep
PARDAGGFVFPRPETPLCDVVGNEPPASXCMGSDFGDILSGDTVPLARTHTHICSSPRDALAQHTHTFVAVLTMILSTPDEXPKSFGFAGGKPSPSLSEKCRPCCNRAAVRKYREKKKAHTALLEEEVAHLKAVNQQLVKKLQSHSALEAEVARLRCLLVDIRGRIEGEIGTFPYQRTVKSNDFVDQGSFLGGAQVMNSCGFRCNDQLYCNPGMQQARTMDDDGVMSGQVLGQGAGDSMGCVKQGSLNPPGCRGGQML

SEQ ID NO: 114551 - protein, 111 aa, Triticum aestivum
  unsure (1)..(111): unsure at all Xaa locations
  Clone ID: PAT_TA_8969.pep
GAERMSEFSNXGVIFVLFLGCKSWVCELTSCVLLRWPPLASNHIAYKNDSRNATVMCVKRIRYVHVHNLQQLYGELMDYSVVVAATTDFFLRWSTSPFNNSLVSWLHLKKK

SEQ ID NO: 114552 - protein, 300 aa, Triticum aestivum
  unsure (1)..(300): unsure at all Xaa locations
  Clone ID: PAT_TA_8970.pep
SARGGKEAAVKXLSKISRQVADEFKNEVILVSKLKHKNLVQLLAYCAHEDEKLLVYEYLHNKSLDAFLFDTTRRSILDWPTRFKVIKGLARGLLYLHEDSRLTIIHRDIKASNVLLDARMNPKISDFGIAKIFEGNEPQAKTTHIVGTLGYMSPEYATEGFYSVKSDTYSFGVLLLEIISRLKISSVHVIADDSPSLTAYAWKLWKDGNARGLVDSSIVENCPLDIVVRCVQIGLLCVQDYPDDRPCMSSTVSMLENETVPLLPPKEPLYFRQQNHGTGDHGDNVGMSVDDITITEVEAC

SEQ ID NO: 114553 - protein, 283 aa, Triticum aestivum
  Clone ID: PAT_TA_8971.pep
MEKGQKVEPDSAAAAAAATQRWVIGVGFWVQGFRLFPWLGVNFFLKDAMGVPSSSLQILQASATLPMVAKPLLGLLSDAVPIRGCRRLPYVAIGALLQAVSWLGIALWPSLSLPVLTIFLLLSNFGASICEVANDAIVAEAGKQATSSSGGQLQSFACMFGASAGALGNLLGGIALSYFSPKLMFLFFAIVLVLQFFTTVAIPERSLKLPKASTNTSVISSIRKQTKELSCALCMPEIFWSIIWFQYLCCIQFPDSSHLNVRLTITSLSRFGKWSWLRIKMLR

SEQ ID NO: 114554 - protein, 117 aa, Triticum aestivum
  Clone ID: PAT_TA_8972.pep
MDFDRAMARSAACDRLGASVSRPSGNLSSDTKAVLCIGAAAALGWAAWRYYQRRVCLEKFGRDMTALAGKADPVIGRDDEIDRVISILCRRTKNCVALVGAAAGLARGASRCDCVTK

SEQ ID NO: 114555 - protein, 374 aa, Triticum aestivum
  unsure (1)..(374): unsure at all Xaa locations
  Clone ID: PAT_TA_8973.pep
MAGAGSGSSAPGEGGFHLMSCLKEVPTLRGDNHTERRKKVELAFICADPDWVVVKPQPVRPTEPVREATDDDAAWAKKKGDYAPLEQSYLIDNQKWVNASKKCMTFIKNTIESAIVGSIPECTSAGELLTKIKSQFTGSSKIYATQXLEQLVTERYXGGSRGIREHILRMSNMAAKLKPMDADLEIKPALLVHLVMASLPQEFATFVVNYNMSPGTWDIKKTIAMCVQEEDRLKAAHGGSINYVKDWKKKNYNQNNKSSPSKNGKAPYQHQHQQQPFSVDKDTCLHCKQKRHYKKDCAAWLKSVMAKRGXHLTRTTLRSERRIEVANGVEAEVEAVGDISLELAGGFNLLLRDVLFVPSCHRNLISVSCWTKII

SEQ ID NO: 114556 - protein, 118 aa, Triticum aestivum
  unsure (1)..(118): unsure at all Xaa locations
  Clone ID: PAT_TA_8974.pep
EGSQLLTASGDQSVKIWSMENKKCLGVLSGHTRSVKSLTCHSSNPGRPPSPSPLRSSCASRSPAAPPTPAGGSRSLTNSCPVPCARGXDLIISGSRDGSFALWDLRCDPQTPNGHGEA

SEQ ID NO: 114557 - protein, 93 aa, Triticum aestivum
  Clone ID: PAT_TA_8975.pep
SHECFSDRTRYQLPPPFVPSRRPVVSMRCQDEVARRSAGNLEACYLAASARLPAASNLFATSLWLDPLKKHSLLGHTLPWTAMLLCHNHCGLV

SEQ ID NO: 114558 - protein, 407 aa, Triticum aestivum
  Clone ID: PAT_TA_8976.pep
AGRRRRAQQHKICVGFGQPETSDLTVMLYGKEGIAVRMSVHRDVLCGSSAFFTEKLSDGHVGSPVPCVEIHDCDDAEIYVETVGLMYCDEAKHKLLKQNVSRVLRIMKVAELLGFHACVKSCLDYLEAVPWVGEEEDSVVSSIRHLQSKSYGVSPLLKRVTSDTPYSPTDTLSHIMEMVLKSNDDRGRREMKALVLNLLKDSSRCADGTSDICSELFYGSCRGCLERLQPLFVEASEAGFPSQVTRQITLETDNILWLVEILVNQRICDDFVVMWASQSELASLHAKLPIASRHTVSSITARLFVGIGRGEMLPSKDTRLLLLQVWLQALIDDYSWLQCSCRSFDRKLVEEGIGQTILTLPLEDQRSILLSWLGRFLKLGDNCPNLQRAFEVWWRRTFVRPYVNQAR

SEQ ID NO: 114559 - protein, 489 aa, Triticum aestivum
  Clone ID: PAT_TA_8977.pep
GTRPPTRPGVSKAVLAQWSNQGIRVRSDPETGMGLVQHEGGVLATVQAYVLKYLLFFSDNLGNPEVSDPSFALGQRRFYQSSFAARDDFSSLTEDGKTRALVHAMVEILFLCGTGKRAVAAFIGGVTREKVDAALEGLSLESAIDFQKVLRISTFTSRKDAFNMLLANIPLFQSRLGAMLFLISSLLSRGLDCIQADRDDPSQPLVTAPFGHASQEIVNLLLCGEAVPNVFDGKMDLGGGMSLKGIPNDVEVGFLTLLESLNLCKVGQYLKCPKWPIWVVGSESHYTVLFALNPNVQEENELEERESKIRRAFDAQDQSGGGGFIAVEGFQQVLRDTDITFPSDKLDDLCNAGVIVWSEFWQALLQLDKRAGGMKDPTGLMGKKQFTIYHFNGIAKSVLNGSGNTGGGSTPIQRPRICKLNVSVPPRWTQDEYLADVVSSSASGSKNDSVLSLAPPVQTACQHAPLVDCIRTRWPRAACSWSGDVPSIV

SEQ ID NO: 114560 - protein, 109 aa, Triticum aestivum
  Clone ID: PAT_TA_8978.pep
PLEPRGVAVAVAAGDELRGPQEHEDGLLEGVPHLDRRVGPLQEPAPRRQPVAPQRAAGGVVGGVREGQQGPVHDAPRKVRRVRGLHLLVAWRELRREVGHSLDGVERPG

SEQ ID NO: 114561 - protein, 130 aa, Triticum aestivum
  Clone ID: PAT_TA_8979.pep
IRKDQAFANIWSDMVYGVALFLLMYFNQSKVAIIKFTGYKLLNNIWDSGKAFLIILVSDILLGYHSEAGWHSLVEIILDHYGLETDQAAVTFFVCLVPVALDVFIKFWVYKYLPRLSPSVGNILDEIRRH

SEQ ID NO: 114562 - protein, 130 aa, Triticum aestivum
  Clone ID: PAT_TA_8980.pep
EPGVRKFHTRRGEKRENPARKEMGPKREYDDLAQPSSEGSSGDDDGGGGDARPTKAPRLPAAPAPPAQSPSRDQTGLPTSPSPLQPPGSPPPPADKDPVELEEGELGDDEYSGEDEEDDHDSEGELGGSL

SEQ ID NO: 114563 - protein, 146 aa, Triticum aestivum
  unsure (1)..(146): unsure at all Xaa locations
  Clone ID: PAT_TA_8981.pep
VVRQVAIGSSQPPHTLPWLVXDAGKHGMSSPLDLALCREDDGPGLDPPANSRLRVMVGTGWRLTGSGCGGAAGEGARRRSRILPGSSKEDGRRHEARLDPWVPGSARFEGARIRRDGGVGGAPSRRWSLGSTGSVGGGGVTGRVRP

SEQ ID NO: 114564 - protein, 126 aa, Triticum aestivum
  Clone ID: PAT_TA_8982.pep
MAMSHAHTPLLSSIFLGAFYIILAIYVMFVGGQMLSLVINKGLRRRIYMLIFATMILLPRATLLGLSVVSWPGETAHETLVFTSFLVLMLAAMAGIVILVYFPVADAFAIVDQGNIEMQTDQETIL

SEQ ID NO: 114565 - protein, 138 aa, Triticum aestivum
  Clone ID: PAT_TA_8983.pep
ARGPPPHSHTKSLNTSSPLSSTSPVPSKASASAHASASSPYSPPSLRHKLRTTVCSCFGSPGSGAERPHTGGGRSRWRRRFVPTGEFRYDPLSYALNFDDGSSDDGDANAEDAAFRHRNFSSRLPPSPVPASRAVAIA

SEQ ID NO: 114566 - protein, 237 aa, Triticum aestivum
  unsure (1)..(237): unsure at all Xaa locations
  Clone ID: PAT_TA_8984.pep
DNDISKEAEPSEFIRTALPVLQKNGVVHFLGFGNRLGFDSVPADLQRLRCRCNFHALKFAPEIQKLGSLLVQRLRGVSAMQTEMDTQLFGSNMLERPFGEKGDDAGGPSRYLALHLRFEEDMVAYSLCEFGGGEEERRELQAFKETHFPALVTRLRNTTVSPEELRSXGRCPLTPEEAGLMLCALGYDRRTFIYVAGSQIYGGATRLRPLTRLYPNLVTKEDILYYDELDALKNFYG

SEQ ID NO: 114567 - protein, 163 aa, Triticum aestivum
  unsure (1)..(163): unsure at all Xaa locations
  Clone ID: PAT_TA_8985.pep
MADGALLDLLPQIHALFSDQLRVISYKWLSVRGRVGGRVGKRLLQEFVNKHGSDHEVIYSVSGWLKNNPQNYCVKLTSSSKLEEARRTFKDSCSVQVYSIQACIPKDTAVLWNPEFVQAEELFNQPFDEENCLRDNRFCGVRNSFVKRTTTXRHASSMPPKPK

SEQ ID NO: 114568 - protein, 232 aa, Triticum aestivum
  unsure (1)..(232): unsure at all Xaa locations
  Clone ID: PAT_TA_8986.pep
RGEARVRFIPVIRHCVNLRTLWVLDTVGDEGLRAVAETCSNLRELRVFPLDATEDSEGSVSDIGLQAISEGCRKLESILYFCQRMTNAAVIAMSENCPDLLVFRLCIMGRHRPDRITGAPMDEGFGAIVMNCKRLTRLSVSGLLTDKAFAYIGRHGKLIKTLSVAFAGNSDMSLQHVFEGCTRLQKLKSEIXPFGDKGLLSGLNXFYNMXFFGXTHQANCEGCGDFLNKCLK

SEQ ID NO: 114569 - protein, 200 aa, Triticum aestivum
  Clone ID: PAT_TA_8987.pep
AAASAVGGRVSRRYPTAGATPRTKDPLLRRIRSLTIAPPLLSGQPAAGAEDVTGCPGVLVRKPAAAAAAAAGLLRPFLFSELFAMYREWQEEMAKEISGKQGELENKIETADALAVKLLQRFNYSVTSMRSASHNLAEVHPLQVEVGELKGRLTEVISNCDALCKRITAEGPESLRTSVEPFTTGILGTGGGSPDPKEQP

SEQ ID NO: 114570 - protein, 102 aa, Triticum aestivum
  Clone ID: PAT_TA_8988.pep
KLLCIETLPCQRLILQSLTLHLNLSYYSLNILHRSANCSCAILLFPIHGRTQLIAVMGTMPKKESVSSMQKIPIHSNHRKKNKMKLSTIGGVTNSATPCPEL

SEQ ID NO: 114571 - protein, 191 aa, Triticum aestivum
  Clone ID: PAT_TA_8989.pep
IRSLETGPLPRRANGRGQEAGAPRPLLHSRQLPSRLGGGVRRLLPGGPIPAIVQATQPVDVVGFDVRCLPVECGATGVTDEVAVFRRLGAHQCRAPGPHSRRVGRRVLHLRLGVRRPRRRPARYPAQLLPPGGHRVLNVPCRRCDRMRRRGPLRHVGTRDALDPRLPVPPGSCGLVSQAPVPWLAYVHILT

SEQ ID NO: 114572 - protein, 363 aa, Triticum aestivum
  unsure (1)..(363): unsure at all Xaa locations
  Clone ID: PAT_TA_8990.pep
RPTRPKEMYGFTIQQSHLPCLMVGNQKKANYLPMEACKIVEGQRYTKRLNEKQITSLLKVTCQRPREKEMDILQHSXQNGYDQDPYAKEFGINISEKLTSVEARVLPAPWLKYHDAGKEKECLPQVGQWNMVNKKVINGGKVSHWACINFSRSVQETTARGFCQELAQMCQISGMEFNSEPVLPIYSARPDQVAKALKHVYNVALHKLKGKELELLLAILPDNNGALYGDIKRICETDLGLISQCCLTKHVFKISKQYLANVSLKINVKMGGRNTVLVDALSWRIPLVSDIPTIIFGADVTHPETGEDSSPSIAAVVASQDWPEVTKYAGLVCAQAHRQELIQDLYKTWHDPQRGTVTGGMVR

SEQ ID NO: 114573 - protein, 205 aa, Triticum aestivum
  Clone ID: PAT_TA_8991.pep
MDYISPERSLDGTCGDPGPLFGDQDGCLLEHMDYHGEGITQPESPLLNDGLLVDAADQISYLSADSVPYMNDQIMCNTMKSASTSPASPLKQDEEHHVHIESDMQNDAAERKVHHNDDCEVRTTSPGYDVHQNTEAVEGVLPPELHESSGNDISNFQQETTHSDAYLGDSMLADNSSRDYQFSNSGDDDDDEIPNSSAPQMGNKD

SEQ ID NO: 114574 - protein, 154 aa, Triticum aestivum
  Clone ID: PAT_TA_8992.pep
MAEAPLLPRKDQEATGYWRSEARKLAYLALPMVAVSLSQYAVQVSSNMMVGHLPGVLPLSSAAIATSLASVSGFSLLTGMASALETLCGQAYGARQYHTLGLHMYTAIVTLLVACVPLSLLWAFMGNLLVLIGQDPLIAHGAGRYIVWLIPGLF

SEQ ID NO: 114575 - protein, 143 aa, Triticum aestivum
  Clone ID: PAT_TA_8993.pep
RVSVVAKLGNDHRGTGGGVRCTDGRRRNMGRWPWWSSSSSKGDGGGVASGGAMQRRPRPTSSMWRWMRRRLGCGMQGCSGDSTVQENGGRIRGGAREAMARSSGAALARAVAAGPASRRRARCRGRRRLEAGSCAKAPTRPRT

SEQ ID NO: 114576 - protein, 214 aa, Triticum aestivum
  Clone ID: PAT_TA_8994.pep
EFGTRLRSALRPDAYTLPFLLLAAAQCPAPAFAVSAHALLQKLGLHSHDHTVHSLITMYSNLGRPHAARRVFDGILRRDVVSWNSMIKAYQAAGMKDDALRMFHAMVAEGAVAPNAVTVAVVLAACRDTGDLALGRWLEEWVRSAGIEVGSLIGSALVGMYEKCGEMAEARRVFDGIADKDNVAWNALITGYAQNGMSKEAISLFHSMRQAGAR

SEQ ID NO: 114577 - protein, 389 aa, Triticum aestivum
  Clone ID: PAT_TA_8995.pep
MSGSSSRGRLSPASGGGDSEPRSAGSRTRSVSATRGRKASPRPGRDVASATATVEEKKPAAVPTLLPSLSVPAGMRRQELLLRSGFSLDASCSSDASTDSFCSRASTGRIGRPVFGPRKKKTVSQADHKVSAMLEREAGSASPSDASGLKRRCAWVTANTDPCYVAFHDEEWGVPVHDDKKLFELLVLSGSLAELTWPTILNKRSIFREVFMDFDPASVSKLSERKIIAPGSPSSSLLSEQKLRGVIENARQILKVIEEFGSFDKYCWSLVYPWPALCASWGPRPRPVKTSKADAISKDLVRRGFRSVGPTVVYTFMQVSGMTNDHLISCYRFAECAAAATGAKPTTESGSEANSGASNHATEQKANGAANGLAVDIELSRTIDELSIS

SEQ ID NO: 114578 - protein, 82 aa, Triticum aestivum
  Clone ID: PAT_TA_8996.pep
GEGERPRKDGEASSSADREKPWRRRCGLAREIGRVFATHAAALPMPNFGGSSSQNPNGLHLYRSSPKATCHASRQSSHGGRW

SEQ ID NO: 114579 - protein, 134 aa, Triticum aestivum
  Clone ID: PAT_TA_8997.pep
RPRTRGRAPRITSKVKKPNEVPWCSRRSSLASVGELRRHFVLLSISSSSWSAATGRAGTFPSPAFLSCFFSWFLGAISASKFLLLGGNRCRLDREHSIRVSFWVWRSRSHLGFLALGFGQMGCTGAHLGGLLVW

SEQ ID NO: 114580 - protein, 166 aa, Triticum aestivum
  Clone ID: PAT_TA_8998.pep
MGSKGRMPPPYHHRPLPGPGSGPPHGMMHHDPYGPSMHQPPGPGPYPYDMLPPPEILEQKLAAQCGEIQKLAVENERLAASHASLRKELAAAQQELQRIQAQGEAAKVAEEQEMRGLLDKAAKMEADLKSYESVKADLQQAHAEAQNLAAARQHLLADAQKLNKDL

SEQ ID NO: 114581 - protein, 175 aa, Triticum aestivum
  Clone ID: PAT_TA_8999.pep
MDPGDAPERIREETGSRSRDGLPQRDATGAGPDANRHGGDRVLTKRLKDESPDTSEPPPSRLKKAVELEPHPAQNRDEQFVWPWMGVLVNVPTEWKGGRQVGESGNRLKEQLSAFCPHKVSPLWNHRGHTGNAIVEFGKDYASFCNAFKFENHFEAEGYGKRDWEQHKYRGPEMF

SEQ ID NO: 114582 - protein, 128 aa, Triticum aestivum
  Clone ID: PAT_TA_9000.pep
PAGPPTRSARRIVPSPAAKKAGAPATSDDLLSVAAARSTPPMSGSAAALSCLAHLLADPWLKFFLRACEVHYCSSAPSSCVCSSLCFCRAAIEGGKKGEANPQSPPRSYAPSGKVRGHFNSHVQHAVS

SEQ ID NO: 114583 - protein, 137 aa, Triticum aestivum
  Clone ID: PAT_TA_9001.pep
GPACSFTLSPTSSLFPVASPLYKQALELLLFLSMSGRHHPLLPLNLSCWTPAPWRSRFRCKKPSTKATLVAGCAPPAAPPPRAGQGRWLQREKKAMLLYPPAPLLLSRGRAPPAKAGSRPTGAGRARGGRGLVPNSS

SEQ ID NO: 114584 - protein, 127 aa, Triticum aestivum
  Clone ID: PAT_TA_9002.pep
MAVYLNDDLEDLQDDHFDSDGFGVSGGRDGHPSSPNKHKSDTSAVQYRNGKDMQGIPWERLKYSRDQYRKMRLEHYKNYENLARSHQGFDMECKQVETNDRFYDFCFNTRLVKPTIVHFQVQFPSPF

SEQ ID NO: 114585 - protein, 201 aa, Triticum aestivum
  unsure (1)..(201): unsure at all Xaa locations
  Clone ID: PAT_TA_9003.pep
TRVDQAVEDGVDVISLSMAPSSVSPGPAAFLSGLRTRLLLATRAGVSVVQAVGNGGPDASSVVSFSPWITSVAASTTDRKYNKTIVAGNGQIFSCGGLSPPTPGDTMYPLALADDVSTDNSALDGSNGCQDPKVFIRSLVQGXXIVCMIVSSNYYQGDNFAGIIDTIQKIGAAGVVIIDRYSGDVDYEYQPIFPTAVPSVV

SEQ ID NO: 114586 - protein, 121 aa, Triticum aestivum
  Clone ID: PAT_TA_9004.pep
FFFFFFFFLINQNISSNIYPTMVHTNYITTKPGPEFKVRTCIHTQHKFTNEWTVSEFQVRTCIHIQRRFTTTYIHRHPEFTNERTVAVSSKLTPGVNLKDAMSSTAACMPTPNGIHDANLE

SEQ ID NO: 114587 - protein, 216 aa, Triticum aestivum
  unsure (1)..(216): unsure at all Xaa locations
  Clone ID: PAT_TA_9005.pep
MAGALHSSCCRALLLLAVLLLTLSPGNAFYLPGSYMHTYSQGEDIWAKVNSLTSIETEMPFSYYSLPYCRPPGGIKKSAENLGELLMGDQIDNSPYRFRVNVNESLFLCTTKGLNENDAKLLKQRARDLYQVNMMLDNLPVMRFAEQNGITVQWTGFPVGYTPAGSADDYIINHLKFKVLVHDFXGTNVEVIGTGEEGSAVISEMDKKGMSGYQIV

SEQ ID NO: 114588 - protein, 89 aa, Triticum aestivum
  Clone ID: PAT_TA_9006.pep
MEEKPYEAPFARVTSLEDASSKTPAYNQHPLPAQEPETLARAASVRARVPEPAAYAVSAEETHGENGKPRSKEPKGFRKLLKFGKKSHT

SEQ ID NO: 114589 - protein, 204 aa, Triticum aestivum
  Clone ID: PAT_TA_9007.pep
MDNPSLEQEYVGIRAPPSTIDLPEDANPTIHASDSQLNSYEVDVPEYKKDELEKPAPLALMEEKPYEAPFARVTSLEDASSKTTAYNHHPLPAQEPETLARAASVRARVPEPAAYAVSAEETHGESDKPRSKEPKGFRKLLKFGKKSHTSTMDSDASSVDEAPAGDGSMLKNLISQDDSAGSSYKASRSFSLLAPFRKNKVVVL

SEQ ID NO: 114590 - protein, 200 aa, Triticum aestivum
  Clone ID: PAT_TA_9008.pep
GIRTRRRWTALTAPQGLYPRPAARRKKLRRLILEAKLAPCHPGADDPRPDLDECPICFLFYPSLNRSKCCAKGICTECFLQMKSPTSCRPTQCPYCKMLNYAVEYRGVKTKEEKGVEQIEEQRVIEAQIRMRHQELQDDAERLKNKQVAASTDEVTTARVESCDTGGTSTPAASAAQGNDVVSGQVQHSELLLKNAERLR

SEQ ID NO: 114591 - protein, 98 aa, Triticum aestivum
  Clone ID: PAT_TA_9009.pep
RLKWYLLGLCCPYRFDLYIHLKLAIYGWVAVFFLQKKRDVLGLFAYLLFAWPSIKTITDYMVLVFFLYTGMISKTSRKPYIGFSSCVLFSYYIEKLST

SEQ ID NO: 114592 - protein, 208 aa, Triticum aestivum
  unsure (1)..(208): unsure at all Xaa locations
  Clone ID: PAT_TA_9010.pep
RNSAPRPTAVSMAANGQPAAAAATIDDLPEILLLDIFLRLPSLSDLVRAACTCLPWRNXVTNFPPFRRQFIDLHXAPLLGLFFDTPFQAVPGIPAFAPARRNDPELLAAILSGDFFLTALQARDGPEANWSFLDACGGYLLLIKEDEVLLLLLTPWARSCVRFFGPPLSRIFDDDDDDREGDRQLLYAGLICDDENPASFGIFCLAAH

SEQ ID NO: 114593 - protein, 146 aa, Triticum aestivum
  unsure (1)..(146): unsure at all Xaa locations
  Clone ID: PAT_TA_9011.pep
LGGYPLGSAHPPSAGPTRAGVGDPKDPALNKVVQCVGNKGLRMDGESAEKLVGAEDRSRIAPIPXGVLVAISPGHVTDRKLRKGGFGQVYVGRRVSGGTARTGPDAYEVALKFGPRRAQACGPAPPVEGPVLHTRYRAVGRPAVHY

SEQ ID NO: 114594 - protein, 186 aa, Triticum aestivum
  Clone ID: PAT_TA_9012.pep
RLFLPSALPHGCFTCMLLQFTCPLRAASPPCECHCVMYSSPAELRGRQDAAGSVGKGTASPSKPTSCLCRALRFTLPPGDDSGRCARLDVLPLAASPAGRPACTGRMRLPPRLADRQHATPVAHRRHGVRVESRDRSLLRCCFDGLTASSSRARRHSSRGSTSLLISTRRAKFRNTIIVPALSRCL

SEQ ID NO: 114595 - protein, 170 aa, Triticum aestivum
  unsure (1)..(170): unsure at all Xaa locations
  Clone ID: PAT_TA_9013.pep
LGRLLIWGCACPQAHQNIADIPLXTGWGEKHRLFVKWRHLEAKAPVYDYXGLITDYGYTEKIYGADVATIHSAEESMRESTAVCEAVHTPSHFTRRTRRSIRAPKARMASTRTSTAMLTGHTRWCRHCEIERVPSSQLGAGCTVLEPRLRINPWLPIVSFPFGVPWFSTG

SEQ ID NO: 114596 - protein, 246 aa, Triticum aestivum
  Clone ID: PAT_TA_9014.pep
NGGVRNHPSHRRQTGPPASAVNRSKRTVAGPGPGAAGHAKGAARPAPNAPRKYCATITKPATRRLARRGAVKRISERIYEVIHGEPRSVLKNFIRDVVTDTVPSRQKTRPATDVVYAVTHHQPPPLLQPHIRSSAARSGSSATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 114597 - protein, 200 aa, Triticum aestivum
  Clone ID: PAT_TA_9015.pep
GIRHVGNFIFILFVSLGIPVLNMGDECGHSSAGSTSYKDRVPLNWKALKTSFVKEVTGFISFLAALRSRRGDIFQRREFLKLENISWHGNNLSEPRWEDPTSKFLCMHIIAENDVNTPELTKGDLYICFNSNEEPASATLPAPAEGSVWLRLVDTSLALPGFFTTESNLKVHQVLGYSSYEVKAHSCVLFESKRDLPQFL

SEQ ID NO: 114598 - protein, 234 aa, Triticum aestivum
  Clone ID: PAT_TA_9016.pep
MTDGHLFNNILLGGRTGTNLGQFKVHSGGLAWKRQGGGKTIEIDKADLTSLTWMKVPRAYQLGVRIKDGLSYTFIGFREQDVSSLINFMQKNLGISPDEKQLSVGGHNWGGIGIVGSMLTFMVESKQAFEVSLADVSQTQIQGKTDVLLEFHVDDTTGANEKDSLMDMSFHVPTSNTQFPGNENRTSAQILWEAILARADNGSGSSGEAVVTFEGIAILTPRGRYAVELHLPFL

SEQ ID NO: 114599 - protein, 96 aa, Triticum aestivum
  Clone ID: PAT_TA_9017.pep
LGGARTGGAQAGPRAGPPGPPPPPPRRPRPPCRRPPHRPPHPGKPAGPSHVHESAAVLHQGPPFPRPLPPPGGLGPPGSLRGPFAFWSPPRGVLSL

SEQ ID NO: 114600 - protein, 113 aa, Triticum aestivum
  Clone ID: PAT_TA_9018.pep
SAPNSPHRWRSRLSLRHPVAGPVAPPPYRRPRHSPAPSPSLPRPVAGPPPTRHRPSPFTLAAALSLTRPGAKPTPRARAALYRCRDTTDPSTPASYTPPPSTLDTEMTELVML

SEQ ID NO: 114601 - protein, 111 aa, Triticum aestivum
  Clone ID: PAT_TA_9019.pep
AAPTCAADLAGSTMPKSHSHPDPPVPILHVAGSYGSKAHCLHLRPSRDPTLPCHAIQLLESVAPLPRRHRVPATRIRWIRRPGTLGCGSSRNSVVPLLRDSFIGRMAWFVC

SEQ ID NO: 114602 - protein, 152 aa, Triticum aestivum
  Clone ID: PAT_TA_9020.pep
MPDYTDLLGSMDPAMLSQVHALSLKQAGDMSPYSSMPDTQLHMPTLPMVGANNSFGLDHSMAKAIMTSRASAFAKRSQSFIDRGARAPAARSLMSPATTIGEPSMLTDWGSPSGGGNLDWGSPGGKLDWGVQGDELHKFRKSASFGFRGQSA

SEQ ID NO: 114603 - protein, 464 aa, Triticum aestivum
  unsure (1)..(464): unsure at all Xaa locations
  Clone ID: PAT_TA_9021.pep
APPRPAQVPLLRHRLPGLPQGRVQARGRLRVRARRLRVLAPPGALPHAALQGRHRLPPPRLLLRAHPGPAPCHAVPALQPQEHAPVAARRVLRRLAAPPPGVRELPQQEHHVLLAHQHPALLAAQVAPLRVAAIVSRRXRLLSPRFLARGGPTHRPQPQSSTSRSLLPIEQSEQSSQHTAMTMMRQGGPPPPRGHRLPVRPPRRGGRACPDQTPPLCAPPGPSLPCSDVLAGGRRRPAHKHKGPLRRRGPDGGHARGRARHRRLPHVQAQGQPVLPRLHARLDRVPRRPPGRERPPPRPARRPIRLRSPPGRPPGPGAGAARASPASTRTRRSSHGCTRGSTSPGSAPTRSAAPVASATSRTPPASSAPSATSRLKEPRKLAAHFPPVARARAEGGLIPPRRRSTHHWLIASSSPKVFPSTLSAPFICVICFPICRFLRAYIYPVHKTNIDALQAIRMDAQTAH

SEQ ID NO: 114604 - protein, 134 aa, Triticum aestivum
  Clone ID: PAT_TA_9022.pep
MDQEAAAVAAAPVHPPPPAQEAALAVPAARHHPDLHLSGQGRRPCAAGGEVARWRASWTRSSASTRRSDAWCGSYSDAHEQPRHHLAAVAVNVAGASPAPESIIAAGTPSWTLAPEPAGPWWLRRRRGEAVDLA

SEQ ID NO: 114605 - protein, 148 aa, Triticum aestivum
  unsure (1)..(148): unsure at all Xaa locations
  Clone ID: PAT_TA_9023.pep
MAEALASAGGLAMAASTSFTPGQLSAFLGFLWVLAACVYXEVLFHAKNAASLKTHSDINXHDMDSSSNKGEDQTMLLEEGGPVAGAKPVYASFTSQMLTLFCMDETLLLEHRLTLRATSELGGHLLYFYICDRTNIFGESEKNYSRDL

SEQ ID NO: 114606 - protein, 110 aa, Triticum aestivum
  Clone ID: PAT_TA_9024.pep
MTWATWPPKCAWLPLRMSGKSHSYTLVSEYHKIWKDAISAKDISRKEPVGGVIALKESMKYFDADFFNDSKLREMENGAQEFNVPAFREDRRLVAIKDGGLHDPSVLVFK

SEQ ID NO: 114607 - protein, 92 aa, Triticum aestivum
  Clone ID: PAT_TA_9025.pep
YIYYIKSIKPSGIRKANWSIAQYGINSFYSSTSCISQSLIGIQVCKINRNQGSSLQDGQSANHLPSSPSHCYITYPKMEGAPKERLIRRRRL

SEQ ID NO: 114608 - protein, 108 aa, Triticum aestivum
  Clone ID: PAT_TA_9026.pep
PPPLRPPPAGGAAATVTPGGYVGKHRLSAAIQRLDQELQSLQDELNELETMEPASAACREVITSTEGKPDPLLPITSSPENSSWDRWFQRVRSSRSNKWWQSKGSDFA

SEQ ID NO: 114609 - protein, 294 aa, Triticum aestivum
  Clone ID: PAT_TA_9027.pep
MRSALSRLIRSSCSVSPSRLSSPVLLKNGKAFSSDATPRDSGRVDEPFKVEEAEPVKVPPPPPSPHKLLVLGGSGFVGSHVCKEALERGFVVSSLNRSGKPSISESWADKVIWNQGNLLEPASLEDSMDGVSAVVSCVGGFGSNSQMFKLNGTANINAIRVAAEKGIKRFVYVSAADFGLVNYLLQGYYEGKRAAEAELLSKFTYGGVILRPGFIHGTRRVGSVNIPLGLVGSPMQMVLQNAKPLTRLPLVGPMLTPPVSATSVAKVAVRAATDPVFPPGIVDVYGIMRYSEQK

SEQ ID NO: 114610 - protein, 143 aa, Triticum aestivum
  Clone ID: PAT_TA_9028.pep
AGQRSLPPQPAATAPPPPPPAAMYIGSRPRAWPRWVSASLPPSSKARSSPPRRIGCIKAVATVALLPYRSSKPTPSPASVAPADPPSAHPHTGLSTCLFFSEGTLISLSLREENRPGLPLAVDVQIKVSVGGTRFVVVGSMKI

SEQ ID NO: 114611 - protein, 193 aa, Triticum aestivum
  Clone ID: PAT_TA_9029.pep
REGSSDKVRPKSTSASALRRRLHPRPSSRGRPWRSGPARQQPWMETPGTLALQGRAPAAGHLPARASPASSSTGPPTMLLRSGRGGGAAAAAGGRDTSSHGCSLLLPPDVVALMRTSCFCRWTGPHGRRTLSSGVGRRSVGRRSRRAEPLVAASLTSFPSVLASVRCPPAVARIWLYGAGSWCRTQALKLKAY

SEQ ID NO: 114612 - protein, 257 aa, Triticum aestivum
  unsure (1)..(257): unsure at all Xaa locations
  Clone ID: PAT_TA_9030.pep
MDTMLLSNTKNGVRVTTFRNGLRVTSPVYSPGTAGVLVVSSTNVHIKNDLFSVGGDCVSIVGNCSDVRLMAISCGPGLGISIGGLGXTSSSHKIEKIKTDTMFISNTKNGVRVKTYEDGCGFARKVKFAQIMMRNVANPIGIDQHYSAAHRGTPCGAPNGSAVAVENINYIDITGTSATERAVTFACSDAXPCRRLYLDGVNLTTAGGGSTSAFCHQAFGKHVGDVLPESCLGKEDFVQLQAPTAGDAQDEEDAADW

SEQ ID NO: 114613 - protein, 62 aa, Triticum aestivum
  Clone ID: PAT_TA_9031.pep
LSDKLQKHRQGYVGAFYRVLMFSVKYTSNVVFHALDVSPSTVVSLNSSKQLNVNISEPFIED

SEQ ID NO: 114614 - protein, 53 aa, Triticum aestivum
  Clone ID: PAT_TA_9032.pep
RKSQLPIHWSPKNTNLRSISRLITTAYKLTTNLPGYYYSKQSATLSTVTKQVS

SEQ ID NO: 114615 - protein, 68 aa, Triticum aestivum
  Clone ID: PAT_TA_9033.pep
TTRYMHTTLLVFTFFTYYSHLNTLLEKVNIPMEDTFLPVYFFLKYLKSSVYRVWVGYYIGVIMDISNL

SEQ ID NO: 114616 - protein, 314 aa, Triticum aestivum
  Clone ID: PAT_TA_9034.pep
MTRRCSHCSHNGHNSRTCPNRGVKIFGVRLTDGSIRKSASMGNLSLLGGSTSGGGGASPADVGHDAAAEGYASDDFVQGSSSANRERKKGVPWTEEEHRRFLLGLQKLGKGDWRGISRNFVVSRTPTQVASHAQKYFIRQANMSRRKRRSSLFDLVPDESDLPPLPGNQEPEAQILNHPPLPPPMEEEEVESMESDTSVIAESSSASAIMPENLQSSYPVLVPAYFSPFLQFSVPFWQNQNDGDDLGQGTHEIVKPVPVHSKSPINVDELVGMSKLSIGDPKQDTVSTSLSLKMVGGQNRQSAFQANLPTRAQA

SEQ ID NO: 114617 - protein, 467 aa, Triticum aestivum
  Clone ID: PAT_TA_9035.pep
MYGDQLNLVSFPDQVRPWLLMVEHPKKLIFHGTRVTISALKAPGTPHSWPPLLSVLYWLTLLCRATDGLAASPPPSTDLMTYITESYYLFLTGEDDAVAALDDDYHSKARAQVGALGVAIQDLEKEVQDLEAKRSKQLSAPSRLKALEEKKDAFTADVQKFEAVVKSWSTKIKEKEDALVEKEKELEAKVMNCQQTMAENEELLKQVETQVVNVRDVDRMAREMQAVEHDIAKLENANAVLEEKGWELEAALVSKLEEIEGLAELCNQSLRKLKPSIDFQYEVNAKGSSPAEILGTTYKTILKPALNALANETKRLVRPRTRGRTRGQKQLQGIVKMLEEKRSHVSVLQAKNNEMTAQVDSLDREIQSHVSRCAADARKMKDELEKKEHHLSTIEKEAEVFLKNSEEGLQAALRETDEETQMCARELLKLIDSIAEYKEFVEQSTAEMKKELYECVDDIASLSANIV

SEQ ID NO: 114618 - protein, 326 aa, Triticum aestivum
  unsure (1)..(326): unsure at all Xaa locations
  Clone ID: PAT_TA_9036.pep
EPAECWARVLGVAFPVVSLPVGVPFLSPVISTVVLGGWVPLAFAAAFRLIMYVWHYGTLKRYEFEMHSKVSMAWILGLXGPSLGLVRVPGIGLVYTELASGVPHIFSHFITNLPAIHSTLVFVCVKYLPVYTVPLDERFLVKRIGPKNFHMFRCVARYGYKDIHRKDDDFEKMLFSSLLLFIRLESMMEEYSDSDEYSALDQQELIDEASSDARSAADLSYASRDSIVPVRSPNHLGAMSSAQATTATPGFETVGDEVAFLNSCRDAGVVHILGNTVIRARRDSGPLKKLAIDYLYAFLRKICRENSAIFNVPHESLLNVGQVFYV

SEQ ID NO: 114619 - protein, 212 aa, Triticum aestivum
  Clone ID: PAT_TA_9037.pep
QSRRARGLRIGTIIAILILAASPSPASGKGAEGGHHPPWDSLRPPPPPGPVPAPRPPAAPRLWPDSCARMATWTQIWRQTGWPPLHPPVPLQRSREPHDDDEEAQCGLKGEWQEPAKSPAGGATAIRECQSQRRCRTEAAYLHGRKGLKQRPASLDFGSAGFNSGTPFSPGFVVGGAGFVSKGLVSSQISSGVFPSPGTPSYPRRLRPSALG

SEQ ID NO: 114620 - protein, 133 aa, Triticum aestivum
  Clone ID: PAT_TA_9038.pep
FAQDLITPNQHHVSVAKKYHVSNSNHSSPLSPSCHRTPPCSHRRRPPLLLSSATPGARNQPPEAIGAAKRRRNAEMASAMTGKKMGRASYIRIKHEEERHEASWKEPEGWVFSGTTRTDVAARLGELRDQILP

SEQ ID NO: 114621 - protein, 260 aa, Triticum aestivum
  unsure (1)..(260): unsure at all Xaa locations
  Clone ID: PAT_TA_9039.pep
MARGLKKHVKRLNAPKHWMVEKLGGAFAPKPSSGPHKARECLPLILMLRNRLKYALTYSEVASIMMQRHIMVDGKVRTDKTYPAGFMDVVSIPKTGENFRLLYDTKGRFRLHSIKDEEAKFKLCKVRTVQCGQKGVPSLNTYDGXRTIRYPDPAIKPNDTIKIDLETNKIVDFIKFEVGNFVMVTGGRNTGRXGVIKSRERHEGSFETIHVEDALGHQFATRLANVFSIGKDRKSWVSLPKGKGIKLTIIEEARKRIAAA

SEQ ID NO: 114622 - protein, 127 aa, Triticum aestivum
  Clone ID: PAT_TA_9040.pep
MMGKTQKFSKGHPLGFVPDYRYGVETVGVSKGLGNPARSEAKRKCINLNTDEGADAPGFNVPRVVFELPRMSASDRNELEMRLRNELEQVRALQSRLFSRGATTSMNGGTASAPRGDFNSNGSSKKK

SEQ ID NO: 114623 - protein, 241 aa, Triticum aestivum
  unsure (1)..(241): unsure at all Xaa locations
  Clone ID: PAT_TA_9041.pep
MPCGWRPVPGICGALWTAAARDFALCPCVLPSVSASPSWSGPLSAFPISRPLRSGAVPVSGVLAAVLALASPLPPGVLDWDDCLSEKSAWDTLSWFAVLVAMAGQLTXLGIVSWMSTSVAKLLESFSLSWPAAFVVLEASYFLIHYLFASQTGHVGALYSAFLAMHLAAGVPGVLSALALAFNTNLFGALTHYSSGQAAVYFGAGYLELPDIFRLGFVTALINALIWGVVGTFWWKFLGLY

SEQ ID NO: 114624 - protein, 157 aa, Triticum aestivum
  unsure (1)..(157): unsure at all Xaa locations
  Clone ID: PAT_TA_9042.pep
RAPRPPSCSACCSALALNRSRTRRRAPLARPPPPPPPAAAARAARTAAPSPAPRARGRGPRRRPCPRPAPPVPPPLWRXPPPPCPRARPPPPPPPPPTWTSPSASPISAPGAGARGPLPPAGPVPARPPPPPLVGGRRPPSPARARGSLMRPLPPGS

SEQ ID NO: 114625 - protein, 349 aa, Triticum aestivum
  Clone ID: PAT_TA_9043.pep
MERAIMALALLLATLAASAVASPVNKSCVTGSAGASVSIGYGGAGASAGAGVSLGADCPRAEEIVRAAVEQAVAADPRMAASLLRLHFHDCFVNGCDGSVLLDDKPFFVGEKTAGPNINSLRGFEVIDAIKAELEQECPETVSCADVLAIAARDSVVASGGPSWEVETGRKDSRTASLQAANSNLPAPTSGVATLVQKFTNVGLTAKDMVALSGAHTIGKARCTTFSARLPSVGESAKDTGFLQSLQQLCAGSAGSALAHLDLATPATFDNQYYINLLSGDGLLPSDQALAAPSGPPAPGRGTSRRSCPTSPAARRSAASAAPPPRCGWLAPAPARAAGEVRRDCRVVN

SEQ ID NO: 114626 - protein, 89 aa, Triticum aestivum
  unsure (1)..(89): unsure at all Xaa locations
  Clone ID: PAT_TA_9044.pep
GNSHRTLMPALIMRLWYAPHIAXPGRVLLKGATLVAIRPSDDVLREGGGVEAAGPAGASWISDAFEEPYRTAAKVLFKRRTYSLEMNSF

SEQ ID NO: 114627 - protein, 151 aa, Triticum aestivum
  unsure (1)..(151): unsure at all Xaa locations
  Clone ID: PAT_TA_9045.pep
MHRGRKFQEILEEAIVHPLHIXGELYVGIPPGVESRLATLTEDMEEIQKLQGIKPGPDVPPELLSGIAQMAAGVPAMFNTLNVRRAIIPAANGHLSARALARYYAALAAGGAIPPPHSSNAXPLLGSHVHTPAFPTAATSKKKKRGSAKKS

SEQ ID NO: 114628 - protein, 249 aa, Triticum aestivum
  Clone ID: PAT_TA_9046.pep
CGTAAVRLSPRLRSIPLLLPGLDPAAAVHRSSSATAAARAMSSSSSSASSPPTPYTTLVGRVRCEREIKRSKFIAVAASVPDERAAMSFLNEVKDPRATHNCWAYKVGEQFRYNDDGEPSSTAGKPIYSAIISSGIDMVMVVVIRYFGGIKLGTGGLVRAYGGVASECLKDAPTCLVKPKARVGMEVPFDLLGTVYNQLQHFHAEDIKQDYDTGKDGTVVVMFKVEYEKIESLGNAVNSACSRKIELLQ

SEQ ID NO: 114629 - protein, 76 aa, Triticum aestivum
  Clone ID: PAT_TA_9047.pep
QVGRNRLGPGKWGEQFLKKKKGKWGEQQAPPRADLGIRSQDFSTTLPASRSPRADDDFIPRCSVVLLDICYWLRPS

SEQ ID NO: 114630 - protein, 227 aa, Triticum aestivum
  unsure (1)..(227): unsure at all Xaa locations
  Clone ID: PAT_TA_9048.pep
PGPADVWHQCGSRAAGRQNRGSFSAHQKQALAEHRGTASDGKWSAGEDAPKYPETDEAEDNAAPSIPEAELRETKSSEKSLPANAVLGRDLMSNVQIISNDDLEDLREMGAGAFGTVFHGKWRGTDVAIKPNTLSRSSFQPSPAADLVALFWXEXAAFNSKLHHPNFLALYGXLNNXQGGHLLPXTXFKXHGSLKKVPFPRNSRLAQEVLAIPPLKGKLTQRNHFVK

SEQ ID NO: 114631 - protein, 232 aa, Triticum aestivum
  Clone ID: PAT_TA_9049.pep
MLLLLALLLLCNGVGNVHCARIHESSVDLHALLDFKQGINNPQEALSSWNITTHFCHWHGVNCTTAPPFRVSSLKLTDLDLAGQISSSLGNLTFLGTLDLSYNTFVGPLPVLGHLQQLQTLSLNNNRLNGMIPDSLTNCSSLDTLDLSVNSLVGPIPPNLDFLSNLTYLDLSSNMLEGQIPPKLVSLSKLDTLDLSSNMLVGQIPPNLDLLSSLTYLSLSSNMLVGSKFLRN

SEQ ID NO: 114632 - protein, 124 aa, Triticum aestivum
  Clone ID: PAT_TA_9050.pep
QYSLETVLAPSGRLGPILTRSILPILPNRPTITVLLPRVRRTPTRTPQPAGKKLAPAIARRKATASAWKIRSRHKSASEIPSSNYPNLILFVEGDQPGKYARMHRPSNHCFRKHLHYREEPSNI

SEQ ID NO: 114633 - protein, 218 aa, Triticum aestivum
  Clone ID: PAT_TA_9051.pep
MLFQKSGEKGYNKLVGRKSGSRVVPYNNARGDSEESTEVEDDGPEEVQSDHSSEELQLVHKDEDLSKIRMQLVQIENQQTNLLDLLQKFMGSSQNGIRSLETRVNGLEMALDEISRDLAASSGRMPSSEPDMNCCIPSPKFWRKNEGGRYTSRYPVSDLANHSEESRASSKWERQKFGVQGGFVTNPLAEPNTSYVRSTLVAQEGRRQNSAQYKARSR

SEQ ID NO: 114634 - protein, 153 aa, Triticum aestivum
  Clone ID: PAT_TA_9052.pep
LAVKAVRALLVVQVLRGRSGERWCCAPRGRRGRPPKEIASGRQRQDQLPWGRILVAFWIAGSSFLLSRLHLFKLLCSSFFSNPWFLHLCKSPVPAPKITNCSFLIRRLYHFGSQYRFPITGCSFLTRKGNLSNRRLQLFWIAVLAPKKKKKNS

SEQ ID NO: 114635 - protein, 82 aa, Triticum aestivum
  Clone ID: PAT_TA_9053.pep
GRFTAQCAWRGETFGRPTVAVSQRGEPSLIHHTRCPPSASPTQRPPTQGESLFPHPSLHIVVVGYVRLLVASLGQTRSEVRL

SEQ ID NO: 114636 - protein, 125 aa, Triticum aestivum
  Clone ID: PAT_TA_9054.pep
MQMQFPEGSLQQWPPRLEPEPAPMMSAGLGLGLPYDSTGGPMGLPELMMGQSSLFSAKPATLDFLGLGMSPTGATTSRGLPVFMQPMGGAVGMARTGSGPPDTFGSGRGAQAKPWERNPSSSPIL

SEQ ID NO: 114637 - protein, 131 aa, Triticum aestivum
  unsure (1)..(131): unsure at all Xaa locations
  Clone ID: PAT_TA_9055.pep
LRNSARGPRRVLRGQAVYHPANPXRXVATVPTLGTAGTFLVEFLTTFVLLFVIVAHATDPKAVKELIAVAAGAAIMMNALISAESTGASMNPARTLGTAIATGTYTKIWVYMVAPPLGAIAGTGAYIALKH

SEQ ID NO: 114638 - protein, 276 aa, Triticum aestivum
  Clone ID: PAT_TA_9056.pep
RAPAAAATAAPPPPQMYYQPPPPPYGGNNNQAPPPPPPMSPPPSAPPPPPAQPPPRVALPPPKEQQAKAALPRVETEEERRARKKREYEKQKAEDRKQQQMMRQSQATILQKTQQVRAAQQQQQPQPQSRHLQPSGGTRVATTVSRPASAANTERFENPRVRPTTFLCKHKFRNELPDPSAQLKWLPLNKDKDRYTKYRISSLEKNYLPKMIVPEDLGIPLDLLDMTVYNPPASQLPLAPEDEELLRDDEVLTPVKPEGIRKKERPTDKGMSWAGQ

SEQ ID NO: 114639 - protein, 239 aa, Triticum aestivum
  Clone ID: PAT_TA_9057.pep
CPRRGRLLPAAQGPAAGSPGGPAAAVRGVDALSAVRNPPAPPAGTPGSTHRPSPSGSARFHPLTMRLARRPPRRRRPLPPGVGPSPPVRTLRPRVAPAPARHQSAGAPAPGGPQGAPLRARRPPGPPGRSHFMEPELRPSPPTVSDVGVYARPKAVARGMPGAANMRSGPQLLPASVAHVHAHAFPAALAQVGLRTTNGRARPHAPDPVLGLDAPPAAPARHAPVASGLLSKLGASPLS

SEQ ID NO: 114640 - protein, 102 aa, Triticum aestivum
  Clone ID: PAT_TA_9058.pep
PHRSNKHCSIQLSATLIDKKKIKPCLTGRKHGGGYGTTASMFYTTRRRPARDRHVGPAISPSLKFTFPLRGSRLYHHLLYKSIFSIDSSLFSWNERIRPPFL

SEQ ID NO: 114641 - protein, 133 aa, Triticum aestivum
  unsure (1)..(133): unsure at all Xaa locations
  Clone ID: PAT_TA_9059.pep
MDSGDAPERIRKERGFRRSDPSRDSPPRRHATGAGSDAHRHGRDRPTHRVPAKRVKDELPESSEPPPSSRLKAVVPRPLQDRDEQFVWPWMGVLVNVPTEWKGGRQVGESGNRLKEQLSRFCPQXXIPLWNHX

SEQ ID NO: 114642 - protein, 150 aa, Triticum aestivum
  Clone ID: PAT_TA_9060.pep
FMFIRKDKHPLQLVHTCKSDLMNQQHQHSIHKYIHTTNLSLSNQKKYQHKQTNHSFLAATQWPSPCMHQPPLLVSNPKCDTPSSYATAHLLSSSAVAIQLGCPTVGHFAHCGPRPPSFLQCHLPCPLFCVRPFNRIIPVAASSPFAHTVT

SEQ ID NO: 114643 - protein, 110 aa, Triticum aestivum
  Clone ID: PAT_TA_9061.pep
AKFAKQPYTSADAWVPAVSFTGGLTLSEAGFDLLNRMLTYDPETRISAEDALNHEWFCEVPLPQSRDSMPTFHSLNEQDRRMMKRMKSPDPLEEQRMKELGSIHDRGIFG

SEQ ID NO: 114644 - protein, 377 aa, Triticum aestivum
  Clone ID: PAT_TA_9062.pep
AAAARARVADTYVSWVVGVGNRRGVPVCSLFPMPASFFSAYYHFESLPPRLVDEHAPAAGATTDKSDKRLEHYISGFASSSVTLSDLEPLIHNKKTVNHVLAAVSSIKNAQCLLFTTMYELEAGVINSLRSALPCPVLPVGPCIPYMTLEDQHSKSNGEVTTSPGDCFTWLDSQPVNSVLYVSLGSFLSVSASQLDEIALGLASSGVRFLWILREKSSRVRELVGDTDRGMIMAWCDQLKVLCHPSVGAFLTHCGMNSTLEAVFAGVPMLALPLFFDQPIDGRLIVEDWKVGLALREWADKDGLIGSQDIARAVKRLMACDEADTKAIRRRALEWKEVCGRAVEEGGSSYDNLSSLMQMVCASRCAELDQQCSKTDA

SEQ ID NO: 114645 - protein, 80 aa, Triticum aestivum
  Clone ID: PAT_TA_9063.pep
IDRPHHLWKQHHSQSQIASTKLEKSLCPLTPLLSVAGEHQPAFSMICMHGNEAKCRQMHTWSLFRRLLSARQACHLFCSS

SEQ ID NO: 114646 - protein, 187 aa, Triticum aestivum
  Clone ID: PAT_TA_9064.pep
MLNSRWQTLHVNRKQYPSMATSSLAPPEVPMELHAGNRDRLLTALHAHLSAAASPPRGLALLQGGEEQTRHCTDHLELFRQESYFAYLFGVREPGFYGAIDIASGQSILFAPRLPPDYAVWMGEIKPLPYFKDRYKVDLVFYVDEIVQVLQDRFSQHGKPVLFLLYGKSTDSGNYSKPASFEGIEEV

SEQ ID NO: 114647 - protein, 286 aa, Triticum aestivum
  unsure (1)..(286): unsure at all Xaa locations
  Clone ID: PAT_TA_9065.pep
MEVFGPVTPGQVSFLLGLFPVLIAWVYSEILEYKKSSLHGKVHSDATLENETSKEDEKAILIEGGQLKSPSAKFRNMSTKANLIRFITMDEPFLLENRAVLRAMAEFGIVLVYFYICDRTNIFPESKKNYNRDLFLFLYILLIIASALTSLKKHQEKSAFSGKSILYLNRHQTEEWKGWMQVLFLMYHYFGASEIYNAIRVFIACYVWMTGIWEFXSYYYTKKDFSIARFAQMMWEAKISLGAFRCIVLDNDXKLYYXGXMHTLFHLWXVRTLGRVNKXNXIHQLW

SEQ ID NO: 114648 - protein, 129 aa, Triticum aestivum
  Clone ID: PAT_TA_9066.pep
DLQSFWKLLDSSESPAITAAADARRGAAVVLGGGASLARGGWTTSAVACLHVGLEESPETLVSNSESAELLRLLISKMSIEERKISLINRTTSLNPNAVEFVPSCLISVSDASNRSDTTMFPVSESSKE

SEQ ID NO: 114649 - protein, 567 aa, Triticum aestivum
  unsure (1)..(567): unsure at all Xaa locations
  Clone ID: PAT_TA_9067.pep
TRPGKKSLQNYCEGERKREEAEKQGEASEGLEESPETLVSNSESAELLHLLISKMSIEERKISLINRTTSLNPNAVEFVPSCLRSMSDASNRSDTTKIPVSESSKEISADQPESVPSNPDEEAHRYWQQQLPDDITPDFNVLGQDETPGPDSLSLTGLSVNDGFGASLFSPKPTARMQHHASTFDTGAGSTEGXVETFVELGLPQACSMSSTARCTLPTADPXGINRTTTVKPYRARSWSAMXRTVSYSTDCPRHTQGSCLXSASQWKSAKANLSPVENQPXGRNNTDLWSLQFPXKSPHIXASFAQDGTPGPNTVSFGRPTSNDRFGVXIISSKQNITPAAACALLSLDPPXRGSSKFTNSPLTRLGSSMRLSXLLAGSYNGNHDMISNNTLQNIAGVQTGPTWLHTDATASMFLEKDEVHDFASLRHALVEQQDRQAFLTGGNPLAKELNIKELYSIQSRLAQEKARESIYQQRFQMPELQGLIQEQNPAIDLCGLHASEAMHVLNNELNNRRKIARSTGRRLQAIIISNPRTPARLTAAIEQYLLEHGLQYTQAQPGLFRVLLQ

SEQ ID NO: 114650 - protein, 84 aa, Triticum aestivum
  Clone ID: PAT_TA_9068.pep
LAILSFDSHITPILTNLKFQLLSYQLKINQPYFNVPIKHCLYSLSHYTKGKSTKLIIPKQTPYSITIKKIQHSFTNTKQKRIKS

SEQ ID NO: 114651 - protein, 253 aa, Triticum aestivum
  Clone ID: PAT_TA_9069.pep
GGRPPSEYASRFSSVPAAEQGPGFSKSNQSRQHQLAVPNKVSMQPVSRYNEVRLGHQQPAVANQVQSTANHLQPGPAHCGRTASVATKPSYDPWNKFKNIAETRPGPSQFSLFPENSSSMTQMTPISNCMSGYSVQSTAAPSTTQTKFTSLRPLPPSMVSSHVFSSEAARPHGSTAPRPLVPLPREPGKSNAPGGVIFEDKGSMKQATVVASRSSLESSKQINKSFKGPAEKDDVLLTSPKKPCIAVPRPRPR

SEQ ID NO: 114652 - protein, 177 aa, Triticum aestivum
  Clone ID: PAT_TA_9070.pep
KAHGQFCRADRGYLPTYCTSALPWSGRGRGPLCRSSWPAACSGERLSPPVPVPLPPSGPARGCAFQPSLALPRGCRLCAPGSRCGGDLFVCCLPLVEMGCTGKASKCMRGVQLCIACELAYVLYHIFAELGWGTWTPVQENAPHSVKRRAALVYSSVYCQDFRSVALFCFPSIDCNL

SEQ ID NO: 114653 - protein, 115 aa, Triticum aestivum
  Clone ID: PAT_TA_9071.pep
AVGSARVRARGKRRRTRGGWSSGARSLAARSSRCSGPAPPPAAPPVRASAREGDRERRSYGNNTGYYPSAAAEKRQAGGGKKSHRGSTKSRGEKGFIEGCLAALCCCWICEMCCD

SEQ ID NO: 114654 - protein, 117 aa, Triticum aestivum
  Clone ID: PAT_TA_9072.pep
MATARGASGASMPTITPTTSGGAGSPEGEKHWEALAPVVEVQQHDDTSMDVVLVCSKERPIMLHQVITILEEEGAEVVNANHSIAGHKIFYTIHSRAFSSRIGIDVSSVSERLRALV

SEQ ID NO: 114655 - protein, 453 aa, Triticum aestivum
  unsure (1)..(453): unsure at all Xaa locations
  Clone ID: PAT_TA_9073.pep
GVAKCIAGRGQHYLLALRIQAFLTRIKKDHGSFDLDWLRCLPRESAKKYLLSINGLGAKSVDCIRLLSLEHKAFPVDVNVARIVTRLQWVELQCCSEEFHSVDLYPLMQDVQSYLWPRLCTIDKEKLYELHCLMITFGKVICTKVDPNCNACPFRGDCRYYKSKLTRPLLSPAEEHVRGGEEKTXIVTSERLLSNGSCMPSHQIEENRTAGRQPSRSCEPIIEVPPTTVYEFGVQTXPMVSNXLGHQIMXKDLALSNSQHTSRKMKHIGRLRTEHLAYVLPDDHPLLEEFEERVPEDPSPYLLVLHPCPDNPPPGAVENCMVKGTILIPCRTASRGNFPLNGTYFQDHEVFADDSSSRLPIDFSSECLNDLGKCIVYFGSSIHSITKGQTRQDIEDCYKKGYVCIRGFDRRTRSPRRLCAALHSINEKKEDNSKNKEGAGLGKSNEQKAPLTN

SEQ ID NO: 114656 - protein, 162 aa, Triticum aestivum
  Clone ID: PAT_TA_9074.pep
MLPGCSPAGLPSALYRPLHEPLPPHPRCGRKYMFFLQTNVATPIVITAAAPGKGGGVLDRPAEKVSPGRQSEFDKKKSRKMSPPFRVVLHNDNENRREYVVQVLMKVIPGMTVDNAVNIMQEAHVNGMAVVIVCSQPEAEEHCTALRGNGLRSSIEPASGGC

SEQ ID NO: 114657 - protein, 171 aa, Triticum aestivum
  Clone ID: PAT_TA_9075.pep
MARKCSSCGHNGHNSRTCGGHRGVESGGGGGLRLFGVQLQVGAAPLKKSFSMECLSSTASAYYAAAAAVGVAASNSSSSVSSSSSLVSVEESPEKMGHGYLSDGLMGRAQERKKGVPWTEDEHRRFLAGLEKLGKGDWRGISRHFVTTRTPTQVACRPPKYFLRQARRALN

SEQ ID NO: 114658 - protein, 221 aa, Triticum aestivum
  Clone ID: PAT_TA_9076.pep
HISSSTFINFMVAMRDPMGSALSWLVYNLATHPHAMLAIREELAPIVATRKSGDGVVVFDPDETKDLVYQRAAMFESLRLYPIAPMERKEVVADDLLPSGHKVQAGSTILISTYSMARLEQVWGDDCREYRPERWLSSNQDGSGHTLRHVPSHVFVAFNTGPRACLGKNISVALVTSIVATVVWNFDVELLDSNTVKPKLSVILQMKNGLMAKVKRRPEDD

SEQ ID NO: 114659 - protein, 211 aa, Triticum aestivum
  Clone ID: PAT_TA_9077.pep
MELLSDCPVHASVPDKYVLPPEKRPSLLNDEPSSDVAIPVIDLHSADDCRRQLVAAEIIKASKGFGIFQVVNHGVAEDVVQGFREAAAGFFAMPAEDKLPYRSDDLSKHFRVSSSTPYDRNGDRYWLDYLKINCHPVTDEHVREWPDKPGSFRSSLAEYSAAVHELAQTLLRLIAEGLGLDGGFFAGDLSGGSTQMNVNYYPPCPDPSLTL

SEQ ID NO: 114660 - protein, 120 aa, Triticum aestivum
  Clone ID: PAT_TA_9078.pep
RVRAPGSLRRRHNGHPRQETTGCGAHEHAEHQEHVAAEVGAEAGTVVRRRGDSRRREQQQHGQHRHRYLDDLGLVLVRSRGSSDITQQIAAIHLSSTTLFPNHGGVLGIWAGPDAWAHAP

SEQ ID NO: 114661 - protein, 425 aa, Triticum aestivum
  Clone ID: PAT_TA_9079.pep
MSLKSIVRELKEMRDGIGSMSRRGGVSDGRAGHGRGGSRHSWPSLWPEPQPQRPGQEPQQQGQWANLPPELLIDVIQRVEASEVAWPARRHVVACAAVCRSWREVTKDVVKTLEECSRITFPISLKQPGPRDCPVQCFVRRDRATSTYLLYLGLSPSLHGENDKLLLAARKIRRAARTSFVISLISDDFSHSSSTYVGKLKPNFLGTKFTIFDSQPPCDAAVLPNNKPSKRHSKQVSPRLPLGNYNVATVSYELTVLRNRGPRRMQCTMHSIPAVCIQEGGKAPTPTGMVHSLDEQVSTLSTSSKGKEPNIEFLSTSLSADLSGPISTSEAPLLLKNKAPRWHEQLQCWCLNFRGRVTVASVKNFQLVASVDPSLGVPAAEQEKVILQFGKIGKDIFTMDYRYPLSAFQAFAICLTSFDTKPACE

SEQ ID NO: 114662 - protein, 90 aa, Triticum aestivum
  Clone ID: PAT_TA_9080.pep
ADLEKAKLDYLQASLVVTSTRRLMIPSLIHSNTHDFAKDMESLLRWICDQLPTSWSLRKSMADCLRGHLKVEDVVEVIPYDYEFQYLLPK

SEQ ID NO: 114663 - protein, 95 aa, Triticum aestivum
  Clone ID: PAT_TA_9081.pep
RPRTQGGNQGAGYNNPNRGGQGSGYGSAPYPQQGRGPPPFPAAGAPRGGAGSGYGVGGPNYPPGGPPYGTSGPGRGGPNYPQGGSRNQQQYGSWQ

SEQ ID NO: 114664 - protein, 318 aa, Triticum aestivum
  unsure (1)..(318): unsure at all Xaa locations
  Clone ID: PAT_TA_9082.pep
FLTNTGFAPAVGPPAVRRGCAELRPAVDMWSGGCIFAELLNGKPILPGKNEPDQLTKIFELCGTHVEPPWPGVTKMQGAFKHFDRHALDLLERMSTXHPSQRTPELPARMLALDPSXRISANETLSPKFLPHDPLPCDPKSLPKGEPSQLHRAKKXRLLPRLPAGPPASRQKTHHPQPPHARLPPIQQSGHQIRPAQPTNNPHPPMASGSDHHYGKPRGPGGPNRYPPGGNQGGGGYPNRGGQGGGYGSGPYPPQQGRGPPPYPGGGPRGGGSSGEDGGAPNFPQAGPYGPGGGPGRGPNYPPQAGSRNQQQQYGNWQ

SEQ ID NO: 114665 - protein, 272 aa, Triticum aestivum
  unsure (1)..(272): unsure at all Xaa locations
  Clone ID: PAT_TA_9083.pep
HEDGSPSTXYRREQYRLRSAMKRGITPDLVAKYPELGSVAAKVREQPKDMVLGTQQQPKDMANKSGILDGGGDDRGKSPVLEEQVPIADWKFKPEMEVDSVTHTNESPRDFSIVLNTDESPMDSIMLNTDESPTLEPVLSCVPDIQSEDKSSTLQPVLCCGPDIQSKVHVRPRPPHCRKQEDTVLPPKHLLQQQKQPSVHNHHEICPQGTNDDVATTLGAQFQNLDLSVSKLVELDRGESLSEGTGQISGDPAAAQGYGKQVRHIIVWGNLS

SEQ ID NO: 114666 - protein, 294 aa, Triticum aestivum
  Clone ID: PAT_TA_9084.pep
SPASPPPSFHLFLLRVASCAGPARAPLLSDGAAGPRLGPLTSRVALQNGSRAGRIAWVAVQSACKVVFRTGVMPMGGVRLVQASCVQRVAVVMLLFVLLRWSEPEAEVVLVAVPPPNKLACVPDLKLKFLLLYFFLCCHGGGRKDTGGRGSSSRRTIFVRSWGPISAANPKGCFNNMLRFLLVEGRPIRAPATHAGSSYSSRPSSQKGGSSSELRTSNFQCLPPVFCWWCCSHSSTPSGFVPGGGGIGPGSKQAVPRTRLLFTFVYWGPICKVSDFGCNLYFLLGLVVKCCMLI

SEQ ID NO: 114667 - protein, 440 aa, Triticum aestivum
  Clone ID: PAT_TA_9085.pep
ADIDRTMKKYADNVLHAMEGVSSRLAQLEGRTHHLEDSGGELKLTVGNYNGSTDGKLRQFENTLREGQAGVQILRDKQEIGEAQVQLAKLQVSKAEDVESENASAGQVDSRQQPTAPQPTVQPQHQAYPPSQPTALPALPAPNAPPPPMVHNQPPPQFQGHLPHPQLQSVAPAPSVPTISQESYYPPSTQTTEAAHQQYQAPPASQPQAPPAAPQHYQHPPQYAPYSQPPPPGSVNPQTPAAPLPHQPEEAAPYGPPAQSYPLNVRPPSPYMPPPSGPVPPFYGPNPGMYEPPAVRPNSGPPPPYSAGYKQQGGGGFPEQYGYSSGSPSHRANAGMNPPSPFAPTGPSSAGSGNYGKLPTAQILPQAAPVSSAPSASSGNRVAVDDVVDKVSTMGFSKEQVRATVRRLTENGQNVDLNVVLDKLMNDTDAQPAQRGWFGR

SEQ ID NO: 114668 - protein, 150 aa, Triticum aestivum
  unsure (1)..(150): unsure at all Xaa locations
  Clone ID: PAT_TA_9086.pep
MQQQQHMVAALPLPGPSLRRPLLCKPPRPGAPASRTAVRRRCQEGRQQQQQSGDGGEKKKKQEKEKRTFLSLEEAGLVEMSGLSTHERFLCRLTISSLNLLRVISXEQEGXRMEELNAGRXCELVPQRTMLKREQNLDTAVLQWDDPPPI

SEQ ID NO: 114669 - protein, 268 aa, Triticum aestivum
  Clone ID: PAT_TA_9087.pep
MAIPEELRRYWLTILLAAAGFLFQLLVLPKSFPPSHYDALGIQRFAPVEKVVEAYELLSKEWLAETNDRSTVDIIKIRYAYELLTNPVWKRDYDLFGLDHHTDIFERVKEQYQKEHFLKIDLPLLKDSLSHSTGHAFNVLTRDSLMSAIAEDYPLLIQVYSKGSPRCAQFFEYWKQIDTRLDGVANTAMVELGDVQLAGYFAEKRFSQQPFFRNGIPALVAYPANCRSPSCYMRYPGELTVDSVVNWVASSIVGLPRILYYSKETLGP

SEQ ID NO: 114670 - protein, 239 aa, Triticum aestivum
  Clone ID: PAT_TA_9088.pep
MSLQIPARSRGLRRLLLLGGESRIRRSYSTGDRRRRVIREARDEEDDEAFLRPLICRADPENNPLPPPPRRAGGAPDPSAAGAFPADILRRAAGKQQQQQRPERSAQKAIGESLMEKLQLGDAASSTGSNIEAQQPEHEPGQPPQTEDVDEIFRKLKETGLIPNAVAMLDGLCKNGLVPEAMKLFGLMREKGAIPEVVIYTAVVEAFCKAAKLDDAVRIFRKMQGNGVIPNAFSYWLII

SEQ ID NO: 114671 - protein, 156 aa, Triticum aestivum
  Clone ID: PAT_TA_9089.pep
EEPKNGERRLGVAPQASAGGAGPSAGPQPVRQERSAVRHSVMQSFASSSGLSMQKLPQSSAMLTQPMKQSTTECVGTRSPPMSRSPAPGATDAKGARTTPLILPSAVDMKAATSSRSRRTPPMGFPAAAMETRTGTALRCAKCVWEADVLLCAVSF

SEQ ID NO: 114672 - protein, 82 aa, Triticum aestivum
  unsure (1)..(82): unsure at all Xaa locations
  Clone ID: PAT_TA_9090.pep
XTTIEMSVQEKMWMNGSCEDGGVIRDTGFPMGRRHGNRGGMTNVHGRKQQLNMHLIQHMLSSMGHRLGGYTFQVHSLSGPGS

SEQ ID NO: 114673 - protein, 113 aa, Triticum aestivum
  unsure (1)..(113): unsure at all Xaa locations
  Clone ID: PAT_TA_9091.pep
ATAGFTPKERAIRRAGYNYQIASKINTEEIIRRFEDRRARVLVPRGIQRMMRXEMVPKAQLMPAFDKPFHPQRSRRPLTVPKEPSFLRLKCCIGGEFHRHFCYNSGGGAKAVN

SEQ ID NO: 114674 - protein, 136 aa, Triticum aestivum
  unsure (1)..(136): unsure at all Xaa locations
  Clone ID: PAT_TA_9092.pep
PISLPISLSLSLSQGFRLFARACRSSLLRSLACPARRFEGASERFLVSANGDSVVLQYGDGRAEFLPPVAVGRDAGAVHGAADRRGLRAGGDGGGGADAAXASVRRGGGGRAPAAQGGQSQHQLGLVRHGAXLPRR

SEQ ID NO: 114675 - protein, 255 aa, Triticum aestivum
  Clone ID: PAT_TA_9093.pep
MMDSSPREKHASSDGVDKLLSHYFTADKVQENISSLECPTIIDQQQMAESMDGKSVQSPDSGVATNRSMSIPETPQGRDYACPRLRPSSNGESNSMNAPITYQVVTEDELLASTAAQTLVSLFTDSAAWITDSHCSNNQADAQDGGDEPHVSLDSFEEGVMNLEALRDDGDSVAVRAPDKDGPSCGIKLRRGRGMRDFQREILPGLVSLARHEICDDLHAIGYEIRKTRQRRAPGDKYGPSTRSRLPRRCSNAWN

SEQ ID NO: 114676 - protein, 321 aa, Triticum aestivum
  unsure (1)..(321): unsure at all Xaa locations
  Clone ID: PAT_TA_9094.pep
MKFMKLGSKPDAFQSGGADVRSVVSDLATDVIVHIGEVKFYLHKFPLLSKSSKLQKLVLKATEKGTDDIHIDDLPGGAKGFEICAKFCYGMVVTLSPHNVVAARCAAEFLGMTEDMDKGNLIFKIEVFINSSIFRXXKDSIIVLLSTKALLPWSEELKVVGRCIDAIASKTSVDPANVSWSYSYNKKGVACTEIIESAGKTSGAPKVGSGEDLCELDVDLYKRVMVAIKSKGRMSPDLIGEALKAYAVRWLPDSYDALVADDYMSTRPRLVETIIWLLAVRXSSGCSCRFLLKLLKVAILVGSGDHVKEEPHEKDQVSSCT

SEQ ID NO: 114677 - protein, 140 aa, Triticum aestivum
  Clone ID: PAT_TA_9095.pep
ERERAKPGRTGRRLLPPSADPRVLGVGEMTAMLRSALGSALRPPAPASRFFRKGVSGSRDATRRKLSSSGRDGSNNSTPADLFGDGSSKTWRRPEVVFITAAALSMATYTYIVNGKTVLGYQREVMENQDEVKPEKDNAI

SEQ ID NO: 114678 - protein, 77 aa, Triticum aestivum
  Clone ID: PAT_TA_9096.pep
RQIHKKHRSTSYMEHNMKTHAFISLDQTSCPRKHHKVQGHCKFAIEQSLSFHYSAGNIGITNSVNLVTEYITTLFSI

SEQ ID NO: 114679 - protein, 68 aa, Triticum aestivum
  Clone ID: PAT_TA_9097.pep
FFFYSNLSTINNYSPSAQSKGKRYSRYKIDNSESTRFLFFTTLHHHHRNRRAAKLTSRMATPGKFYRS

SEQ ID NO: 114680 - protein, 203 aa, Triticum aestivum
  Clone ID: PAT_TA_9098.pep
GVEKGESKFNASLGKPTASTRPRAAYHGAKTQGHPNTELALNDIIQRGFDTAKELMQEQNESAHTGAARPQIKTKAHDQDEINMTQLRHRSSSFSPAPSCLKPHKSSSCLMRWLLAFFILSPSPPGPSQSSYLELIGSMLVIGHSTKPRCGLPAGSRVDRVFPTSGDDVDTRRSHDVNCEGLGRVCIVASSAWRTVCWLEMHL

SEQ ID NO: 114681 - protein, 209 aa, Triticum aestivum
  Clone ID: PAT_TA_9099.pep
IEHCRATRDLSSCGRYVQHVLNSCGHASLCAECSQRCDVCPICRSPIPDNGKRVRLRLYHKCLEVGLISKQHDERFQEKEGHGDPVNMDVQRLHSLFDVALQNNLVSLICHYITDVCLDENAVSSDPLLAFLLDEVVIKDWCKRAVKALISEIGTIYRSGLETMKSKLSQMQKFAVQLSGISTVVEAMIASFREAVHVNDLHRLIENTM

SEQ ID NO: 114682 - protein, 145 aa, Triticum aestivum
  unsure (1)..(145): unsure at all Xaa locations
  Clone ID: PAT_TA_9100.pep
GIRTRLESIVNPVQXPTLATECTEAGRFTLNITRFNGSVAIDTGVVQASITRTVFDQNPVAVFAVSKVLLPKEMFSRGNTINPGAATPPATMTPDVSDGPRTPPTKLSSPPALRGQDSKPSSAPARNANWWCTGIGLVCLLLPLL

SEQ ID NO: 114683 - protein, 117 aa, Triticum aestivum
  Clone ID: PAT_TA_9101.pep
GHPPGGIQKGSNITTRSSFKLSKIFLYLKCFYRERGHAVAVHCWFRGELSSISFNFHAVAMLSFYGLIQDDRYIFGLESVGYTKSHQRMGTPTLLDEKVVEGQCVGAGPIFPPSSVS

SEQ ID NO: 114684 - protein, 181 aa, Triticum aestivum
  unsure (1)..(181): unsure at all Xaa locations
  Clone ID: PAT_TA_9102.pep
MGGGAWPFLVGACEDDCWIWPSITQRAYQAAEIIAAANSINRSKIVPEYSFLDARGLGAYEGKRLEALPEVYASDNISPDIKPPPTYDGTPNESVADVFVRVTQLMSILETQYSGDTVVIVSPDSDNLSILQAGLIGLDLRRHDSLFFQPGEVRAVDPASIPEYKQPASXVFKCTNPPSCK

SEQ ID NO: 114685 - protein, 156 aa, Triticum aestivum
  unsure (1)..(156): unsure at all Xaa locations
  Clone ID: PAT_TA_9103.pep
GIRTRQHRGGQKWLLEGDANTTXFQVIANGRRHKCSIPCLWEGDTLLKHPDEMRTHIYSFYKGLFTAEPRRXVSLAENFWTLADRVSDNENVELILPFSPEGVGRAIASMKAGLASGPDGLLVAFFQKFWNVLKPVIMPMFHEFYIGTFDMSRKKK

SEQ ID NO: 114686 - protein, 231 aa, Triticum aestivum
  unsure (1)..(231): unsure at all Xaa locations
  Clone ID: PAT_TA_9104.pep
PRAEEFGRGYRENVASXLQKYRLYLRRLSAVASQQASIAAAFGGRDPFLHMGAFEGLHSYHQPFAPPAALPSLNPHGLLSGAGAAAFGLQDLASPKANQCSSSNGAVSHCAGDTEKFHIVSLQDNQQADLSQGLTSSLGQPQLHQKWIHQETSDLCSVFSGGALANTMSGTLQRVTSSSLPPEDLLECTAHIKVGAHPSIGIPTGSSGLLERSVGVSADLRDSCISQQCAL

SEQ ID NO: 114687 - protein, 192 aa, Triticum aestivum
  unsure (1)..(192): unsure at all Xaa locations
  Clone ID: PAT_TA_9105.pep
LTLWLTRIVIDLHAVDSDTQLVSISNKPIQAKPLDHAAIGVATILGDAHHQVIVRPQHVCAAETRMLLAGSRREGRARAPAARANGASGVSAVAGCSVAPRCRGCTIGREERHVHVGGTKDLLLVHACCWELRRGEKGGGGLVGEVRGGGPVGRAVLXXXXXXNXCXPXDXLXXERXXPXXXXXXXXLXXGX

SEQ ID NO: 114688 - protein, 162 aa, Triticum aestivum
  unsure (1)..(162): unsure at all Xaa locations
  Clone ID: PAT_TA_9106.pep
EEDTNYKRVVRGRRGAALRGCCANTFRGPFSGPPHYKRGFTFSCHGGWVLTNDEVGNPYLLNPITGAQAALPPVKTAYXSDTFYDDDGKHVYKPRKKCDVPWISWARHMEYTRVAISTAAYVRACTVVIMHMPMFKVSFARPGDKRWTLLSELKKTCLRHSL

SEQ ID NO: 114689 - protein, 144 aa, Triticum aestivum
  Clone ID: PAT_TA_9107.pep
ASRTSANPASSSSINGSSPSSSSKYKSLSLATIIKQLRRTILCSCNRTDVNSSLAPTTSGRAEGRKSAGTEATGGGKPALDPRRPMALLLLTGGWFCCSCPVALEGAAAPVWWRLTALLLLSATDGAAAPGWMVPCGEEGQGWS

SEQ ID NO: 114690 - protein, 271 aa, Triticum aestivum
  unsure (1)..(271): unsure at all Xaa locations
  Clone ID: PAT_TA_9108.pep
LGCRDFLRRYSQVYLFQFLVGAAQFQEGTLALGTQRFAGFWQLPPALSPRWLFNGRLPSHPVGLVGGGHRSSLRQVSSSGPPLSRPDPCPGHRASMEVSPSSPPALAASSVVDDELFLTNKLQLGQFIYVEKVQSSVPVPVLVGVRAVPGRNPFIGKPKGXLMQMSTPSGVLEALDQQRKTTKPTELSESEKENSQRKVVIKEQXKAGVASRYMLXGISSNNGKITNLNSSMDSDKSSNGRKYVCDANQKLVSSATKVKQDQNSXKANITP

SEQ ID NO: 114691 - protein, 216 aa, Triticum aestivum
  unsure (1)..(216): unsure at all Xaa locations
  Clone ID: PAT_TA_9109.pep
RPGRLRRPRPLSPDSSVSSAPPAPPLAGGPPRPPPSAAVARRRPPTELHSGWAAPPIRTFRMNSLFGQAKDNASDAETKKAAADESGSQKDKETEKKVRVPGWVKVNMDGEVIGRKVDLNAHRSYKTLALALEIMFTKPSAGLCASNSTKSLKLLENSCEYQMTXEDRDGDWMLVGDVPWEMFVGSVKRLRIMRTSDASGLGPRFQANHRTRADMR

SEQ ID NO: 114692 - protein, 264 aa, Triticum aestivum
  unsure (1)..(264): unsure at all Xaa locations
  Clone ID: PAT_TA_9110.pep
GIRHEAALNPYXXTWTITARGSAKSQVKHYNNARGPGKLFNFDLRDAHGGEIRAVCFNTQLDQFYDLIEVDKVYLISRGSLKPANKQFNHLNNDYEVSLDAATTIEVCSDDDSSIPRQQFDFRQISEIANMDKDTMVDLLGVVTSVSPSSPFTRKDGVETQKRVLQLRDMSGCSVEITFWGGFCNAEGQQLQSLCDSGSNPVLALRSVRVGEFKGRNVSTIGSSFLKIXPDFPAAESLRHGYHNLKGKNAVAFLSMGRVRHGPD

SEQ ID NO: 114693 - protein, 238 aa, Triticum aestivum
  Clone ID: PAT_TA_9111.pep
MNDPVKVVALGGGLLGCLILSEGILICDVLDPGVTALRFVPMPKLLPSNNELYDNESRVRAIRDVTFSRGYIRCVEFEELVERRATTGSVVPDPWDMDELQDSEPAIDPPQEEEEDVIVGWRLITWYRTLTWNCWRKGNTVHSDELGTVSLPQIGGGGACALKVPLKDLKTAAPTLRGDGDVVYLATELHEQGETAWIVAVDTKRKLVEVAAAASSDLLGVWVQGHDKHFRLPTWSFI

SEQ ID NO: 114694 - protein, 72 aa, Triticum aestivum
  Clone ID: PAT_TA_9112.pep
NAGSDTFIAHLETRVVSHDITFQIFKVKSSLYVNLMKVEKLLCLPTVKKSFRSVVQLLIILIRCHATSPEPP

SEQ ID NO: 114695 - protein, 135 aa, Triticum aestivum
  Clone ID: PAT_TA_9113.pep
SQITRYSPSALSSCKSTTIVTLSPSPSTSTGQGAPARSPASAGAPAGRRTSTPAGGEREAGGDRADAAEHGAAQSGRPGAARTGGSPGTRRRRTGPQHTHRGEQAGGGRQGERAPGGAREAAARERDRDRREPAA

SEQ ID NO: 114696 - protein, 91 aa, Triticum aestivum
  Clone ID: PAT_TA_9114.pep
PKLNWMDHARRTNTYIKEVKQFRQLAARILHVLSVKTEEATLPLSPQRDSTANDAPTPQAGSMESGSQVSLENGDWVYFACSNDMGLVAVF

SEQ ID NO: 114697 - protein, 233 aa, Triticum aestivum
  Clone ID: PAT_TA_9115.pep
MAESDTAAGNMAEPDAADGKMANGEVSDDGRAVEVSGGGDDTLPAVLRGFVDGVWPPPGDGGDPLLRRLRAATCEAAPRLRDASRNSARDLLAWTKQGSGLRAILVISVGTITMISLTGLLIFMSFLLVATANAIIVSVLMSLAAAGGFLALFFACLVAVYVGAVSIGIFVVSATVISAIVGVMIATGWIGFFWMIWFAARKSLDLTKHSIGMTTSAMQSYSASRSVGQKLTD

SEQ ID NO: 114698 - protein, 190 aa, Triticum aestivum
  Clone ID: PAT_TA_9116.pep
PPPTGEQRLLPIPSEFKFTDDVNGAVLCAASDHGHVHGSCHSSPFKQSLAVIKGPPITDDFRHASHWIVQAEDGAVGFAILTCSHLQMWQRIINFHGVATWVLWKTIDMHTIRGLPPQIDMIRIAGCIEDTDGLFLFVGHDVYMVQLNSMQSRKLFENRGYTYYHSFKSFYPPGTTIAGACDAAEMLHDT

SEQ ID NO: 114699 - protein, 513 aa, Triticum aestivum
  unsure (1)..(513): unsure at all Xaa locations
  Clone ID: PAT_TA_9117.pep
QAQDRAHRIGQKKEVQVFRFCTEYTIEEKVIERAYKKLALDALVIQQXXRLSGQKTVNKDDLLQMVRYGAEMVFSSKDSTITDEDVAGITSAGEETKAALDAKMKKFTEDAIKFKMDDTAELYDFDGDKEENEADFKKIVAENLVVELPRRERIRNYNESEYFKQALRQAAPAKPKELRIPKMPTLHDFQFFNSQRLNELYEKEVRHLVQTNQKKDTIDGEDEDQVEPFTAEELEEKQRLLEAGFATWTKRDFNTFIRACEKYGRNDIKGISSEMEGKTEEEVQRYAEVFKERYTELSDYERIIKNIERGEARITRKDEIMTAIGKKLDRYKNPWLELKVQYGTNKGKFYNEECDRFMLCMAHKLGYGKWDELRSAFRMSPLFRFDWFVKARSAQELARRCDTLVRLVEKENQEYDERERQARKEKRLAKKMTPTKQKMTPTKQKTTPTKQAASRVSDGETAPANPSKKNKTPTKQKMTPTKRAGETAPATSSKKRRQSLMDDFLGSGKKGKA

SEQ ID NO: 114700 - protein, 334 aa, Triticum aestivum
  Clone ID: PAT_TA_9118.pep
WNSNSGRGQSSNRAAEEKEWKSIWSVIAPNKMKIVLWRFAHNCLPSGEQLCRRKVPAPAACAFCGRLETIEHALLFYHFARNVWDEVKNFFHVQLRRGEFRSPKQWIFDFLSRCSAREATVMTVTIWHIWDARNSARNTPEGPIPRSNAGKIRSYVQMIFEHAYKPVPVNRCETIASSSNWSPSPPGTVMLFSDAALFHNSNKSGAGVVALNHMGHCIKACTDVLPGALTPEMAEALALRIAVDMARQEHFSHVIFATDCLSLMQRLKSKAQDRSVVGSIVADIKLATLGFSSFSFVHVRRPCNVLAHVLARSCYNSTGLCVFNYAPECIRETL

SEQ ID NO: 114701 - protein, 148 aa, Triticum aestivum
  Clone ID: PAT_TA_9119.pep
HPDARDIESAKSWRGDSLFLPCVGVSSSSVALEKWSSEAALPNLNPKGPQVPPNGQIGGWYSSGTHECGSDIFLRIGASIGQCSYICTHLSCRARGRTKKKGGPGVGDQSRRSKKGRKRVMDRVLAAVCGGVGEALHMAPRWIPPSIP

SEQ ID NO: 114702 - protein, 84 aa, Triticum aestivum
  Clone ID: PAT_TA_9120.pep
MPIGVSDELLGTFVPIAVYWLYSGLYVALDGVERLDSYRLHPRGEEAARNVVSRGAVVRGVLVQQAFQVVVALTLFAVIGDESG

SEQ ID NO: 114703 - protein, 143 aa, Triticum aestivum
  unsure (1)..(143): unsure at all Xaa locations
  Clone ID: PAT_TA_9121.pep
MITFSGLRRVHMMCQKSLRPRGGVTPPALLPKKAQFEXWHRRYTERKASQGEEANPEAANTPSLDHVNERRITIEEVEIRLKEEEKLHLRLARQVREKTLAYLRVHLPELFRNMADFSFFCHDMYSSLRKSAVLPMLRDEVQG

SEQ ID NO: 114704 - protein, 124 aa, Triticum aestivum
  unsure (1)..(124): unsure at all Xaa locations
  Clone ID: PAT_TA_9122.pep
MADKKGGAPRKEEVVTREYTVNLHKRLHGCTFKKKAPNAIKELRKFAQKAMGTTDVRIDVKLNKLIWSSGIRSXVPRRVRXVRIARRRNEEEDAKEELYSLXTVAEVPAEGLKGLGTKVVDDTE

SEQ ID NO: 114705 - protein, 228 aa, Triticum aestivum
  Clone ID: PAT_TA_9123.pep
MFGACCNSKRLYATFSASKEIVQLYPPRQPRLENSLVVARIPDIFGEHIFCQFFLVESGGRMLLVVPVPPARGGPRVRSRQVGFRLYAVDLCSKGIGNLIPVSCLGDRALFLNSDRCLAVLARDLPSLSSNSIYFSLPDSPVVVHSLRTGLSEQLAEHCQIHNSVDRIRPSVRPFSIVDHLLTYCHPSHWIEGLMFHEYHHIPDSFKELRKNIQAKDSRLRIPRIMGQ

SEQ ID NO: 114706 - protein, 214 aa, Triticum aestivum
  unsure (1)..(214): unsure at all Xaa locations
  Clone ID: PAT_TA_9124.pep
MAKRFRKEQPEAPAASLPEDLLVEVLARVPYRSLCRFRCVSRPWRVLCSDPALRKRSPQALSGFFCYTRDDESDELRFLNISGXGRPLVDPGLPFLXPSGTEXVRAVDCCGGLLLCQCWTKSSMLDALYDPDADPDIASDSEAEADAVEDVAKYVVCNPATEEWTVLPAIEDLRPRNVIRLGFDPAAPSRFAVFVLLQDVDDHDAGVQIFSSET

SEQ ID NO: 114707 - protein, 226 aa, Triticum aestivum
  Clone ID: PAT_TA_9125.pep
PELLAVTPEGLLVLLYDHNHVRLLNPLTRHLTELPPLTTLLPSKDHDMLSHFDIGNFIATGSGIASDDSTVVLCFNKLHTLGMAKPGDDHWMLLEYRTDGLTRRPLMFAGCFYHVNVDGVMVLQFRPNKPPRLEVAAKLKMHVSPISESMHLFNNCGELMVIRRGIVPFTSRNNSGFHHRYNMYRVNLDTGTLSRVKSLSGGAGRALFLGIYCFFSVSPEVFPSAP

SEQ ID NO: 114708 - protein, 124 aa, Triticum aestivum
  unsure (1)..(124): unsure at all Xaa locations
  Clone ID: PAT_TA_9126.pep
LRSNSPSCTTTPPRPXSVSGDSCDPEPVAPIHGHLAILLLPLVRFPHPSFGSLFEINHMDLSELRYPKLHRSSIPSPPAERTHRPPPEQNTAARASLHGQFRRESSDSSYPTHTKDRCCRRCSS

SEQ ID NO: 114709 - protein, 221 aa, Triticum aestivum
  Clone ID: PAT_TA_9127.pep
AGSSARRPAAPALLRPPGPPLAASPSFPAAVICAYLATVLLLHRRILPLPPLPPRALRAVSALHNCVLLALSAAMAAGCVLSAAATAPSPRWAFCFPPGGATEPSGPVFFWAHVFYLSKMYELGDTLLILLARRPLTLLHVYHHALVIAMCYLWLATRQSLMPVALVTNAAVHVVMYAYYLCCTLGLRWPPRWKRAVARLKSGKKGLDYIVFLIKPWPFDS

SEQ ID NO: 114710 - protein, 286 aa, Triticum aestivum
  Clone ID: PAT_TA_9128.pep
RQNPFSVIVLECIDQLDIVVRGKIKRAMETGRLPDSRGREVSLGNVIFVLTTNWVPDELKGPDVESLLQGELRMLEMAGSSWQLELSIGDKQAKHRADWLCDDVRPAKVAKELSSSHGLSLDLNLAVGALDDTESSHNSSDVSVEQEQEKGQLAVLCSTPAPDCDLLELVDDAIVFRPVDFNPFRKTIRDCISAKFELVIGSINSFRIDEDAIDHMVSSVWLTDERFEDWAGEVIMPSIERLWRNVKHDCARAVVRLALVADEALPRWGEGREGLPATVTIAIDGM

SEQ ID NO: 114711 - protein, 59 aa, Triticum aestivum
  unsure (1)..(59): unsure at all Xaa locations
  Clone ID: PAT_TA_9129.pep
MAHRLLHGTLHATILEADNLTNPDRATGGAPQIFRRFVEGFEETIGRGRGXTQLYATVD

SEQ ID NO: 114712 - protein, 132 aa, Triticum aestivum
  Clone ID: PAT_TA_9130.pep
RGARPPTPGRASVAPPWRALSTRIEQASRAPDRLRAPPPATECDSPDPLPPVLRIQLPPLQRRRRTTVVTVLLPRIQPPASKLQSPSATAMATASVPRTYSISSDQGLSTHYSILTLLSLSVIEKKKKVQST

SEQ ID NO: 114713 - protein, 97 aa, Triticum aestivum
  Clone ID: PAT_TA_9131.pep
MFDCNGESQQQVGDGIWAELRENEDHITPCPKDTKDSRSICVRDQKKNDDEAASVVGLTECTSGGQTEHPGLEKQAATEASGHYSAAQLDIESWPDL

SEQ ID NO: 114714 - protein, 236 aa, Triticum aestivum
  unsure (1)..(236): unsure at all Xaa locations
  Clone ID: PAT_TA_9132.pep
GRRQILQXAHDTLTNQSSRTEYDRALSEDRDAALTLDVAWDKVPGVLCALQEAGEAQAVLAIGGHLLEDRPPKRFKQDVVLAMALAYVDLSRDAMAASPPDVIRCCEVLERALKLLQEDGAINLAPGLLSQIDETLEEITPRCVLELLALPLDEKHQIERQEGLRGVRNILWSVGRGGIGTVGGGFSREAYMNEAFLQMTSAEQMDFFSKTPNSIPPEWFEIYSVALANVAQAIVS

SEQ ID NO: 114715 - protein, 123 aa, Triticum aestivum
  Clone ID: PAT_TA_9133.pep
KPTDLNYPSVTVPHLSASGEPRTCGRRVRNVGPAPAAYDVRVHEPRGVSVSVRPSRLDFAAAGEEKEFAVMFRARAGHFLPGGRLFGRTVWGAGVGRRRHRVRSPVVVRVAAHRTSKTSVPVA

SEQ ID NO: 114716 - protein, 224 aa, Triticum aestivum
  Clone ID: PAT_TA_9134.pep
MEELRKSMLVALILAVTCSVAVAYDPLDPTGNITIKWDIQSWTPDGYVAMVAMNNYQQYRQIMAPGWTLGWSWAKKEVIWSIVGAQATEQGDCSKFKGGIPHCCKHTPSVVDLLPGVPYNQQIANCCRGGVISAYGQDPAGSLSAFQVSVGLAGTTNKTVKLPKNFTLMGPGLGYTCGPATIVPSTVYWSADHRRKTQALMTWTVTCTYSQQLASRYPTCCVSF

SEQ ID NO: 114717 - protein, 477 aa, Triticum aestivum
  Clone ID: PAT_TA_9135.pep
RVRPRVRPFREIGSAVGNGGAQVVADLREKCATPPSLLCDVAAAMADEMCAGLGKEGGSRVQMLLSYVDKLPTGREEGLFYGLDLGGTNFRVLKVQLGGNDKHVISRESREVAIPPHLMSGSSSELFGFIASELAKFVADEEQGTSLSNGKTRELGFTFSFPVRQRSVASGTLVKWTKAFSIEDAVGKDVVAELQTAMQKQGLDMHVAALINDAVGTLAGARYYDEDVVAGVIFGTGTNAAYVEKANAIPKWEGELPNSGEMVINMEWGNFYSCHLPVTEYDQALDSESLNPGEQIYEKLTSGMYLGEIVRRVLLKLSLQSGIFGEIDHTKLKTHFHLRTPHISAMHHDDTPDLKIVEEKLKEILEIASTSLETRKMVVEICDIVARRVARLAAAGLAGILKKLGRDGSVDKRRSVIAIDGGLFEHYSKFSKCLETTLNELLGEESSKFIVVKHADDGPGIGAALIAASQSQYRNVE

SEQ ID NO: 114718 - protein, 163 aa, Triticum aestivum
  Clone ID: PAT_TA_9136.pep
VPDCWGIQQLFPMMPVSRLHERPTNMATLIDLTCDSDGKVEKFIRGAQTLPLHPLDPKLGGYYVGVLLSGAYQEALSSKHNLFGGPSIVRVDESGGIVTADLGATTEELISTMRYDVNQDILDVIHERAEEHGVWKMVGEIVKAGLTTMPYLIEYQVPLPGTA

SEQ ID NO: 114719 - protein, 188 aa, Triticum aestivum
  Clone ID: PAT_TA_9137.pep
TSRRGQGEGAARQGQERRRRRLVRLPRAMGQRGLERDQQQWGEPEEEGAGAEAGQGKLVVVSIHRIFLGLVGEQLDGHGLGQPRGGRAAPRRRLLAPRLRLEELVMAATTASAEAAGRPALLHLMIGSSFSGSFPPDCCKLQLSSEQCSCAVLRARLTKKLFITTSIAKDFQQLDEPYYDLCSVKFKI

SEQ ID NO: 114720 - protein, 364 aa, Triticum aestivum
  unsure (1)..(364): unsure at all Xaa locations
  Clone ID: PAT_TA_9138.pep
PSRPRRFKQNDGIIXIAATNFPQSLDKALVRPGRFDRHIVVPNPDVEGRRQILETHMSKGLKADDVDLMTIARGTPGFSGADLANLVNVAALKAAMDGAKSVSMTDLEFAKDRIMMGSERKSAVISDESRKMTAYHEGGHALVAIHTAGAHPVHKATIVPRGMSLGMVTQLPEKDXTSVSRKQMLARLDVCMGGRVAEELRFGESELQVGAWSDLSQATXAWPKAMVTKYGMSKRVGLVAYNYDDDGKTMSTQTRGLVEQEVKELLETAYNNAKTILTTHNKELHALANALIERETLTGAQIKNLLSQVNSSSDTQQPQAAEVPQQTPAAPASPQSPAAAAAAAAAAAAQQAAAQAKGVAGIGS

SEQ ID NO: 114721 - protein, 124 aa, Triticum aestivum
  unsure (1)..(124): unsure at all Xaa locations
  Clone ID: PAT_TA_9139.pep
QLFFLIIFHVSMFASPECMIQYYLLARAIDFVRVEMQAHRRHYRRPTARGEPYLHRPANDGSGQSVQPLVPDRRAAGHGHAVHVHLVPLHPLPQRHVLLYPNNVERPRTRSRRXAVARPSTRPC

SEQ ID NO: 114722 - protein, 351 aa, Triticum aestivum
  unsure (1)..(351): unsure at all Xaa locations
  Clone ID: PAT_TA_9140.pep
SARGAAAALGFGLQAMPLVPLNDCPRHARYMDGVFVAADGRPYVRDNMICVFERYAGDIAWRHSESPITGMDIRESRPKVTLVARMAASVANYDYIVDWEFQTDGLIRIKVGLSGILMVKGTPYSHMNQVRQNEEMHGTLLSENVIGVIHDHYVTFRLAMVVEGADNSDTAPGESPRRSYLKATRHVASTEKDARVRLKLYEPAEFHIINPTKKTRVGNPVGYKVVPAGTAGSLLDPEDPPQKRGAFTNNQIWVTPYNKNEEWAGGLFVYQSKGEDTLATWSERDRPIENKDLVLWYTLGFHHIPCQXDFPIMPTVSSSFDLKPVNFFESNPILKQRPTMEKDLPVCAATA

SEQ ID NO: 114723 - protein, 149 aa, Triticum aestivum
  Clone ID: PAT_TA_9141.pep
PTGRIDRCIGRRATTCHPLRRRRLLRWRRRRCLVGRAGMRGWTWTSCRCTTRTRTRPRKRPSTPPVPTSPTPLSTSSPSSSSSAGSSSGRSPPPPSPLRRGGRDCAKEGETNGAEEWARAQLERPSHGGCDGGSGSGRQHCWEKNKGRI

SEQ ID NO: 114724 - protein, 134 aa, Triticum aestivum
  Clone ID: PAT_TA_9142.pep
ARGRERIPSSSSQEKNSLAKAGREKVKENSDTKDKLLPAELNGKGDQAVNSKSDRSEPNVDRAEERERSRSRGRDRDIRGRDSDHERERDRAKRHRSRDKSSGYSDKEKSRHRSSRDRAGYYSSGDKDHRHRRH

SEQ ID NO: 114725 - protein, 80 aa, Triticum aestivum
  unsure (1)..(80): unsure at all Xaa locations
  Clone ID: PAT_TA_9143.pep
SDTSSHKLGACSSLSELNKLMTSIWLQVVTQGHLFVNRCGFKFPSKRITSSIDQFIMNYVLTYQRLLGIGCSFASXCSXS

SEQ ID NO: 114726 - protein, 97 aa, Triticum aestivum
  Clone ID: PAT_TA_9144.pep
KSLYDFYVSHISSGRRETIGGDERTGGGEKGCLPMFSCFSSHVVEVCVADLGGITLSGGASPCSSTYMWLFQCILSMQLTFLSGFYTVKLLKLQCIY

SEQ ID NO: 114727 - protein, 218 aa, Triticum aestivum
  Clone ID: PAT_TA_9145.pep
MARPSRLYLLAYNSVQAIGWSLALLRLLPCLAPPVSVRPAYAAAGDLICFLQTCAVLETVHAAVGLVPTSPFLAFLQWGGRTHFILALLRQIPEVQGSPSVFITFMAWSISEVIRYSHYALTTLKVCPAWMTYLRYTAFIPLYPIGVGPGEMWTMYQALPFVKERGLYSGFFAKFSMSYHSFLVGVLLCYPLLWLKLYLHVFKQRKSKLGKGGRKKRA

SEQ ID NO: 114728 - protein, 350 aa, Triticum aestivum
  Clone ID: PAT_TA_9146.pep
SHRARADAPQRCKQALLLNPRLVDAHSNLGNLMKTQGLVQEAYACYLEAIRIDPHFAIAWSNLAGLFMEVGDLNKAMQYYKEAVKLKPSFADAHLNQGNVYKAMGMLQEAVSCYQRALQARPDYAMAYGNLATIYYEQRQLDMAIHCYNQAILCDSRFVEAYNNMGNALKDAGRVEEAINCFQSCLVLQANHPQALTNLGNIYMEWNMISTAASFYKAAIAVTSGLSSPLNNLAVIYKQQGSYADAIACYTEVLRIDPTAADALVNRGNTFKEFGRVAEAIQDYIQAVTIRPNMAEAHANLASAYKDSGHQEAAIASYKQALCLRPDFPEVTCNLLHTLQSVCDWENRDT

SEQ ID NO: 114729 - protein, 201 aa, Triticum aestivum
  unsure (1)..(201): unsure at all Xaa locations
  Clone ID: PAT_TA_9147.pep
RLCRRPAASAAASSPTNYGTEHPPAPRRGPCPGPAPARGRAGAPGRLLGERPRRAPSVAAPPCAHLVWTTPGTRRADGGLPPSRRGRRPSGTPVGATTLLPRPFVTPPASVLVDFAMVQLLEVGDGTTSVVVLAGGLSWGAVRWLFLHVPPWPLSAPHRLAAECARNALLKKTMDNKDNTDKFRSXLMNIAMTTLSSKIXS

SEQ ID NO: 114730 - protein, 154 aa, Triticum aestivum
  Clone ID: PAT_TA_9148.pep
QIGGELTDFIIVLHDLKAVKAFSSRMHLSLGAGLSAAAGPIGRALEADVRASEKGSGICYTYSCSKGAFVGVSLEGNVVTTRSDTNLRFYGDAYLTTTDILFGRVEKPRAAQPLYSALDDPFPKKWLLLTMVSQQLVYIHLKYTSLGKKYPKKN

SEQ ID NO: 114731 - protein, 196 aa, Triticum aestivum
  Clone ID: PAT_TA_9149.pep
DEWINVRKCVRLRSLPCEAAECVAVLPGDLILVCQEGKEQAREGDARVLAAQRRSPHASGHDVRGCRCRFLVRYDHDHSEEIVPLRKVCRRPETDFRLQILHASRAAASADAQNVSPVEQKPQKAHKMMDVNTAEVTVVCNPDQGGPSDKPAAPLPAAAAGTRGDSVSDVQMGNVEVIPKVEAANEAHDDKMNVGA

SEQ ID NO: 114732 - protein, 221 aa, Triticum aestivum
  Clone ID: PAT_TA_9150.pep
AVLWLAGLPRSCAAPAAQFRRAAPPAPRGAPLWRRPGVLWGASVLRRGLVPVLALSHTMCSSRACPRHAEVTVKYLDDMAIYGAFPGTDTYNVVLKLLLKGRKLREASAIFKEMVKNECWPNEANCSLALSVFLDTRDWETGIKVWKCMTANSLPPLEEGGNMLVSKLKDEMLPEACKYAEDMIDQGIKLSSSTLAKLRHSLGKVKKGDIPVRLLAKWKAH

SEQ ID NO: 114733 - protein, 262 aa, Triticum aestivum
  Clone ID: PAT_TA_9151.pep
SARGDMLLGQEVVNHEENMRPYHVSDSLLEKEDDISFSRSSVSNHQQTEPTSEEHGPYGGQMDSCNHGLPPCLSESNCQHNEAVSETAFGDNSHQLGSNIHPFPKVESAEGAGISVLLHQKSSSNKWQIMEGRALAAANIVCSEPYYTRDGINMMKCSFGRDSSSASSIDLGSSRQSDARFERHSSSKKGDFEKAQLSSTMSHQSIASVSDMSVSGSSASLCHQSDAIEDTCSRIDTFESSASRTVVSTIEDSSSNDAGSNA

SEQ ID NO: 114734 - protein, 69 aa, Triticum aestivum
  Clone ID: PAT_TA_9152.pep
LWRISVAWRSGDSTPDMRRWTHAGGGRCLASMAERPGKVNTSVSALKMDRWKTVSTTYESASDRFVPQT

SEQ ID NO: 114735 - protein, 70 aa, Triticum aestivum
  Clone ID: PAT_TA_9153.pep
EVPPSPPPFHLHRVQQLDERSAAAAEPRRRRRPREVSRRRTRGQGVFGFREIVGEEFMTMFLSVFSSMVQ

SEQ ID NO: 114736 - protein, 108 aa, Triticum aestivum
  Clone ID: PAT_TA_9154.pep
FGTRHLPSFYRVIPDPDSSYSSPSSPPQLRPVISMSRTSPSLQHLPPLPPRQIQDTPPNANPAASTERDNVDRPARRRLAGLDGAEPSRAGESSSEARPPTAPSSPSS

SEQ ID NO: 114737 - protein, 222 aa, Triticum aestivum
  Clone ID: PAT_TA_9155.pep
MAKVTLIFKLPYYTEWGQSLIIAGSAPALGSWNVKQGLALSPVHEGNALVWCGQVSVPAVFTCEYSYHVVDDHKNVLRREAGEKKKLVVPEGVKDGDVVEVRDWWQDASEALFLRSAFKNVIFSATDNAKRQLQPPSLSKTLDPEDIVVQFIISCPRLAAGSTVVVTGSNPAVGNWKAQNGLKLNYVGDSIWKAYCVLRKSEFPVKYKYCQVSEAGVSSLEF

SEQ ID NO: 114738 - protein, 172 aa, Triticum aestivum
  unsure (1)..(172): unsure at all Xaa locations
  Clone ID: PAT_TA_9156.pep
QKIPSKQSEEKDEAHTLDNQQEKSRPLNYMLIGEAKENHVQNVAESAKEDIPTELIQSKIIFMESKQTTFSGFQNTSIQELDLQRKKFRGRPDNLSIDINVKAQPESGTHTDEVFARGYKIISDFLDKAREKYFFADDSTPSFRISEDVDECGNIIEEHEXWRPVWIKDEWC

SEQ ID NO: 114739 - protein, 315 aa, Triticum aestivum
  Clone ID: PAT_TA_9157.pep
GRSLVRGRGSPCGSRYAGRGESSGEGLKVAYQGFPGAYSEAAAKKAYPNCQTVPCEHFDTAFQAVQNWIVDRAVLPLENTLGGSIHRNYDLLLRHELHIVGEVRLAVRHCLLANRGVKIGNLRNVISHPQALAQCEHTLTELGIEHRQAVDDTAGAAKLVAEQMLQDTGAVASSLAAELYGLDILAENIQDEKVNVTRFMMLAREPIIPRVDKPFKTSIVFSLEEGPGQLFKALAVFALREINLTKIESRPHKKRPFRVADDAFSTRVKYFDYLFYVDLEASMADPKTQNALRNLEEFATFLRVLGSYPTDVSEA

SEQ ID NO: 114740 - protein, 75 aa, Triticum aestivum
  Clone ID: PAT_TA_9158.pep
RSRFHGTEKEAPGKWKKQQLALYTLYCYIRYKTEESWPEKPSLLQQRLQIFINICQTWPMICSYPDQCGGIAYFH

SEQ ID NO: 114741 - protein, 286 aa, Triticum aestivum
  Clone ID: PAT_TA_9159.pep
APRGGLPRPLPGSALQPLRPPRSPGGRGGRTAGLMEANFIRPTHDKQDFEKTELFQRLETRLKDMTMEYWRHHAHLIGYQPVTKSLPPAYYTSIAATNDSSVAQATATTYARNSRAKASGVLNSRFNGGNSLNPLHVGALRDQMDYGACSLARRNMRTSLYMPSTPQQTELCKRRNSGSMIEMRAQKRHNTNGDADHVGSVNVVEIGEERSSLLLCQNMMLKAECSELEAAGQTLRSKADRLMGELREWQRKRRSLTDELEFYNGLSAIQRRIPIASTSSMGVGWI

SEQ ID NO: 114742 - protein, 372 aa, Triticum aestivum
  Clone ID: PAT_TA_9160.pep
MGFVLISGAQFPKINNASQYAAADPGGGSFCVLTSGFAVPMIRLSDVPPGGATSILSIDDPDEYAVVFNNCQEGAEVTMDVRTEMYNVRGGVPDGLRDYLPVGLQPLPNIYTVVSVVYFVFLAVWVWTCLRKRAAAERIHVVMGALLLFKALKMACAAEDTWYVESTGTPHGWDVAFYVFGFFKGVLLFTVIVLIGTGWSFLKPYLQEREKNVLMIVIPLQVIENLVLVVIGETGPTGRDWVVWNHVFLLVDVICCCAVFFPIIWSIRGLREASKTDGKAARNLHKLTLFKRFYIVVVGYLYFTRIIVSAFLAVLNYKYQWGVNVAVEAASFAFYVFVFYNFHPVEKNPYLYVGDDEEESASGQLEMDERAF

SEQ ID NO: 114743 - protein, 193 aa, Triticum aestivum
  Clone ID: PAT_TA_9161.pep
ETRVGPARRGVVWRRRSWGRRGCGRRARARASPAAPAARGRRRSAPAATARPGPRASPPSPPPPRRSSSASAPRPPPPRRRPRGAVPTRPGPRPPGRSSARCWWGTPCPPPPPAAPPPAAPSSSPAPPSSAPPQGTSTRRRKGTLGGLRWGRPSTGIVEGPESDFQAWVKGLRPQTPPVAARHGGPNSGAPPA

SEQ ID NO: 114744 - protein, 200 aa, Triticum aestivum
  Clone ID: PAT_TA_9162.pep
MALLATTPLLAPLALSPAPISASQSSLLFLRAPALLSLRSASPGARLLAAVASKEPELGGGGDGAGSGSGSGGGSGPQGGGDEGEEGKMGEGLSMSQKLTLAYAALVGAGGVMGYMKSGSQKSLAAGGISALLLFFVHTQLPVRPVFASAIGLGISAALLSVMGSRFKKSGKIFPAGVVSLLSLVMVGGYAHGIMRSSHA

SEQ ID NO: 114745 - protein, 170 aa, Triticum aestivum
  Clone ID: PAT_TA_9163.pep
MRSRGSFAPGHAVVFLAWWMAHCGGGLVAAVPPDGWYDYTAHTDCRGRPEPAQYNGGILKYGNGDDPNGYKTTETGVLSPAFVVYNLNKSTMYTFSGWVKLEGSPSALITARLAPDNSGTRCIGTVLARSNCWAFLKGGFVLDWPTQTSVIFFQNADRTPMKITTASASL

SEQ ID NO: 114746 - protein, 372 aa, Triticum aestivum
  unsure (1)..(372): unsure at all Xaa locations
  Clone ID: PAT_TA_9164.pep
PPAARXGLLWYKDAGQAATGDFSMAVVQANNLLEDQSQVESGPLSMADPGPQGPSLAVWGGHGGPETSRFINDNMFHHLRRFATEHKCMSADVIRKAFQATEDGFLSVVSKEWSMKPQIAAVGSCCLVGVICSGTLYIANAGDSRAVLGRLVKATGQVVAMQLSAEHNACYEEVRQELQSSHPHDPQIVVLKHNVWRVKGLIQISRSIGDVYLKRPEYNRSPLHSKFRLRETFKKPILSSEPAIAVHQIQPSDQFVIFASDGLWEHLSNQEAVDLVQSNPRNGIARKLVKAAMQEAAKKREMRYSDLKKIERGVRRHFHDDITVVVVFLDASAVSRAGWSKSPPVSVRGGGVSVPANSLAPFSAPAMVSSTY

SEQ ID NO: 114747 - protein, 208 aa, Triticum aestivum
  Clone ID: PAT_TA_9165.pep
MIKRRCFRQDHGDNSASSSSSSSGSDSDRDPAEEEVSEEEVEGEQEKEEEDDDEEAEVESGEEQEKEVDEQAEDEGSGYQSEDSSGHHVDSPCAEENENSSLVYEQYQAIRLPGKKASSGDADSAEGAVNKDDSVGPGSIQAGSDKIGEDRRGRRIVSRSLSRDTARVRKVQGRTMELLIRKCRMLNTAAKKMPNLETAAKKRRKTEK

SEQ ID NO: 114748 - protein, 262 aa, Triticum aestivum
  unsure (1)..(262): unsure at all Xaa locations
  Clone ID: PAT_TA_9166.pep
ILEISSNRYQHLCPKYVRLVARASECEESSRVLDQFWGELGDKVEQILQKQTSVSSAPVTLQPDVQNLKMALSSITDGTESENVLDISSRAVAETVKKKGQKSKNHPRNCVEKGLTKKQKVHSEEPALVHYGLADGSAQSGNAMFQGLEAPPNMSKMGSQTPTYVPYMGTDFSNPMAMGTLNYEEMHRGASLGLTLLPSQDPGFVACHTSQASSDSQGLVRNQCLLLKVSLWEHNPNXRFLMMSNAXKKSSXMMSHNCXMEI

SEQ ID NO: 114749 - protein, 225 aa, Triticum aestivum
  Clone ID: PAT_TA_9167.pep
PAPSATWCASCLASACAGCACNLCSSAAASVTRRSARLAYCGLFAASLILSFLLRQFAAPLLQHIPWINTFDDTPPEEWFQMNAVLRLSLGNFLFFAIFALMMIGVKDQNDRRDAWHHGGWIAKFAIWVVLVVLMFFVPNIVISVYEILSKFGSGLFLLVQVVMLLDFTNNWNDSGVEKDEHKWEIALLVVTVICYLATFAFSGVLFMWFNPSHLHCGLCAFLNC

SEQ ID NO: 114750 - protein, 227 aa, Triticum aestivum
  Clone ID: PAT_TA_9168.pep
FYDDTALPKLVADFASLELSPVDGRTMTDFMHTRGLNMCSLGRLVELGEKLPHIQSICIHEMVIRAFKHVIRAVIAAVDDMQNMSAVIAETLNILLGSPRLENDLDTDANEHNLRLKWVESFLSKRYCWTLKDEFAHLRKPIILRGLCSKVGLELVARDYDMNSPNPFDKSDIVNIVPICKHVVYSSIDSRNLLESSKMALDKGKLDDAVNYGSKALSKVIAVCGPY

SEQ ID NO: 114751 - protein, 120 aa, Triticum aestivum
  Clone ID: PAT_TA_9169.pep
PRRSTGPTHACADAWDAPCFILASPAAPLLCAATARPPPLLCAAAAQPPPLLCAAAARPPPLTSRPHGPATPLSLLPSDLDAARVRRRRTRRRRGEEEHEPPQPPTRRCCHGCRRCDLQR

SEQ ID NO: 114752 - protein, 182 aa, Triticum aestivum
  Clone ID: PAT_TA_9170.pep
HRPWSPFSLCFSLLMHDTENKHRINLGKKRRCKWVTNTAHHRAIDVGGEEAKGTQDSDNILKIRCTSPGNRRSHLPITAFCARLIQLTLRRSHRQRRTHRRHVEVCRGRWRAWAAAAWRRGGADHARGAAAWVGRRHLDGRGRGGDGGPRLRRPHGGGGSSNNSAAASLAPRRRQRDPPRSE

SEQ ID NO: 114753 - protein, 56 aa, Triticum aestivum
  Clone ID: PAT_TA_9171.pep
ARAIYEETRGVLKIFLENVIRDAVTYTEHARRKTVTAMDVVYALKRQGRTLYGFGG

SEQ ID NO: 114754 - protein, 106 aa, Triticum aestivum
  Clone ID: PAT_TA_9172.pep
SEGCFPHHGYLIMSTCSCMARDELGLATSPPFPNGSLSGSQSHALGREEGRHLAERKSIKEMERYYVDVQKSPKAMSLEGAKKFPSFIQQYWICKQKKKAKTHFGS

SEQ ID NO: 114755 - protein, 109 aa, Triticum aestivum
  Clone ID: PAT_TA_9173.pep
HLERPPLVASPASPPSLVLIQNDVLKNPATDPPTTGTSPPSPTRRSSLGGQVDTIELVVLNLIDHTPAGRSPETSCMGDGLWMTGSRRCFFSLLGCFTRRRRCPGSAPG

SEQ ID NO: 114756 - protein, 175 aa, Triticum aestivum
  Clone ID: PAT_TA_9174.pep
VAAAIPILLLTFLLAAATPSAGPSYVIKTTCAAVTNATVGTPYRYCLRTLSANPAAAAAKDARGLAIAATNLTATNVTSTELTITRLIDALYNCLVTYQSMQESIAGALQDLNAGRFDVASPKLRDASFQPDFCELAMMESDTDKDPMSDENSANYLVSGMAYNIAELIARHAAK

SEQ ID NO: 114757 - protein, 141 aa, Triticum aestivum
  unsure (1)..(141): unsure at all Xaa locations
  Clone ID: PAT_TA_9175.pep
MLLLLLRRTAHLEQELDLRFRLFRYWDCRANAHAXFLHANASAIGTVIGXPRCRIDAPPSFFVGMDCVHLPSTXERRIRVTNISNFLTDDVAGLAISVPSKTTHADRYMRAGLCKARXDYTVTTRVGIRCFSVDFCSYLFP

SEQ ID NO: 114758 - protein, 137 aa, Triticum aestivum
  Clone ID: PAT_TA_9176.pep
MAGQSPNQLSSAEAILVGALSSGVNAPTWVVLQITFLLLAFCFTAMLYLAFFSSDFVIVGHVLLLITIGAVLSVLLNRVLAETGFVPVEQQMQEMGIRKPRSHTERQEQMSPLGPTFLHYIMMIKQSAPRCTQRLHT

SEQ ID NO: 114759 - protein, 106 aa, Triticum aestivum
  unsure (1)..(106): unsure at all Xaa locations
  Clone ID: PAT_TA_9177.pep
MASSVAGGLPSRSAIVADTTSGHHLLTIHGYSRTKDIPTGERVKSHPFIIGGXHRWRIDYYPGGVRPEVADYVSLSLILEEDGPAPVKAQYDICLVTKEEEGASPV

SEQ ID NO: 114760 - protein, 113 aa, Triticum aestivum
  unsure (1)..(113): unsure at all Xaa locations
  Clone ID: PAT_TA_9178.pep
DRRCPRXAEEEDASPRSEVTMGYEAKVSSAFDAASRCMDNSGAKPSCTKGASVVPTLVGEKVSTREENQKRLQQNMELLREAGSPQQGFSVMFVLLVFMSSVFIGHLMKHIKV

SEQ ID NO: 114761 - protein, 196 aa, Triticum aestivum
  Clone ID: PAT_TA_9179.pep
PSSGDREYIIARRIWKLGSAYYCVTKGVPCSSIPRRSKPRRVDLYYSSWCIRAVESRRGNGGSTACEILLFHHEDMGIPYEIAKIGIRQGMWGCVKRIEPGLRAYQKARAAGEPPSPSALMARINTKVGDNFVRGLESNSDQDIMEAEEKPVKNRMARFLVLGGAVALACPLDQGLLTKALIFGVARRFVGQRNTL

SEQ ID NO: 114762 - protein, 178 aa, Triticum aestivum
  Clone ID: PAT_TA_9180.pep
MATGGMTLESLPNELPLDFLSKITNNFSGELLLGQGAFGSVYKGILDDGVVAVKKLAENSPVPRDTIFANEVQNIMVLEHENIVKLVAYCREAQNKLVQSNGRYITAEITDTVLCYEYLPKGSLHKNLFGESSSIDWDMRFKIIKGVCEGLHFLHTLPSPVLHLGLKPQNILLGDNMT

SEQ ID NO: 114763 - protein, 258 aa, Triticum aestivum
  unsure (1)..(258): unsure at all Xaa locations
  Clone ID: PAT_TA_9181.pep
MAIARTGVYVDDYLEYSSTLAGDLQRILSTMHELDERAHGILGQTKGQIKYLLGVPSHGFDRPNVVHDENASEKMTRDIENSQDNALSLCTEKVLLARQAYDLIESHIKRLDEDLGQFAEDLKQEGKIPPDEPHILPPMPVGGRDERRRSSFSTPQAARKFVREKEWERDRERGMDFDLXPPPGSSNKKAVASMDVDQMIDPNEPTYCICHQVSYGDMIACDNENCEGGEWFHYSCVGLTPETRFKGKWFCPTCRNLQ

SEQ ID NO: 114764 - protein, 159 aa, Triticum aestivum
  Clone ID: PAT_TA_9182.pep
AATASCPARPWELHHRRGAARSLSRDRQGAQARRRRRSKRCPLSLSTMTSLLNHWTRLLNCSRGSGPCRLPTRLPATRGARSGPPIWSGSDPSSRRPQPAIAVPFPPTRRGSSKLKHRRRQQQQQRPWAMRQPQQERPWAMRQQHDFDPFMIGRSACLT

SEQ ID NO: 114765 - protein, 170 aa, Triticum aestivum
  Clone ID: PAT_TA_9183.pep
RPPTRPVVYPVLFMAILYFMAGLRRTVPCFCLTLLATLLIVFTSQGTGELLGAAILSVKRAGVMASLVLMLFLLTGGYYVQHIPKFIRWLRYVSFMHYGFNLLLKAQYHGHLTYNCGSRTGCQRLQSSPSFDTVDLDGGMREVWILLAMAVAYRLLAYFCLLKRITLTPL

SEQ ID NO: 114766 - protein, 278 aa, Triticum aestivum
  Clone ID: PAT_TA_9184.pep
LLSRLNKIRVIERPHGQHSVVLAEDAAKYSDCRSDRGGEIPASSHQIYLTFPSDSNFTEDDVANYFGQYGPVRDVRIPCQDQRMFGFVSFQNPETVTALLMRRNPHFICGSRVLAKAYREKTKCINERTNNKSTTHCYPPRWIETDPEFYPDQYDSPRLERRQLARDRQQLLELERRHLAGLRVVEPQCAAYFDCSIGDVAPFNSHSQSQSQSAGSKEVGRTMDPLSTADQLDDIVSTSQSQAPPIQANNNYDDQESNQIELLPESPFASSAPTGNAI

SEQ ID NO: 114767 - protein, 159 aa, Triticum aestivum
  Clone ID: PAT_TA_9185.pep
TPEEQCSLLLLSITLKPRDQCVSLPFVVQRCQDASQVHLAPYRKLPPSRELGELSATANCGITVRICTLSSSSILRGVAHCIFHDFSPAVIRSITVHTSEHFISCRSMHHAQISSVRVAPAPPKYQDASSTSIGLYLYLPPVVSLILYNFGRKSGNAPP

SEQ ID NO: 114768 - protein, 111 aa, Triticum aestivum
  unsure (1)..(111): unsure at all Xaa locations
  Clone ID: PAT_TA_9186.pep
HLRDAARAACASHAFRRNWXCRPNLTFSXGTLGLNRNASRDVITRDLISKIDLIMQNHSGIGVKTLDIDLYSCDNIDFAYLDSWLRIAVTPGIEELILTLPLPSIVFENAL

SEQ ID NO: 114769 - protein, 145 aa, Triticum aestivum
  Clone ID: PAT_TA_9187.pep
GWRPIEIIESSAHQSFSKCTCKAILSRSELRTLLSHRDGLYRCRRRRRRPNTEDRLRVSSCRTQPQGPAAPQHPTYVTARCRASTAGSPRPRQGAPLVARQHRRQWASRCLGPAAPQRPANVTGRSRGTTGERPRAREGGPLVAP

SEQ ID NO: 114770 - protein, 45 aa, Triticum aestivum
  Clone ID: PAT_TA_9188.pep
GIRCALPCGVLGIFCTCSISCRNYSPNAAYCYYFISLIDDLFFHN

SEQ ID NO: 114771 - protein, 129 aa, Triticum aestivum
  Clone ID: PAT_TA_9189.pep
MVLLHGAASSLLLLFLLFAAAAAAAPMELYFSRAELARIAGYGEEPVSTVLVSGQVACQLCLRPGSDLLTFDLPGSKVAVTCTTEGPNTMANSAFATTNEYGNFSIELPSRLHAIPSLENACSVKVLEL

SEQ ID NO: 114772 - protein, 211 aa, Triticum aestivum
  Clone ID: PAT_TA_9190.pep
MRGTRREWMNVAFWALRILLPDPKDDRVSNVEDAIEYIHELNRTVKELKILVEQKRHGTNRKKMIKMDEEAASDGENSSTMPVRDEQDNELDWAIRSSWVQRRSQECRVDVHIVENAVNVQLTEWKERQLPASCREGSRTSSIFEIIKRGRAENCWRSPQYSSSTTKYLKGLARCNAPFNWAEKALKQVCSNQGPQTIPGGSQPKLNYLKE

SEQ ID NO: 114773 - protein, 106 aa, Triticum aestivum
  Clone ID: PAT_TA_9191.pep
PLPVHVHFTSGEWRHGGGDGPPPWPPRLQDRHGRRDRLAGLLRLSASWWKGTCLIWSEHFYLIGVNWPTCVLSRVNYVQDRNYLCATGTKTSTSISVLPPGTFFLF

SEQ ID NO: 114774 - protein, 431 aa, Triticum aestivum
  unsure (1)..(431): unsure at all Xaa locations
  Clone ID: PAT_TA_9192.pep
RHPLAPSDATGIVRSRCLRIPRPVAVPETGSGAATAATGWGRGRRGGSDVVDLRTLLIHCAQSVATDDRRSATELLKQVKLHARPDGDGTQRLAHCFAEGLQARLAGTGGLVHQSLMATRISAVDMLKAYQLYMAAICFKKVSFLFSNSTIYNASLGKKKIHIIDYGIQYGFQWXCFLRRISTRPGGPPNVRITGIDLPQPGVRPSERIEETGRWRKKYAHEFNVPFEYRAIATAKMESLRKEDLKIDPDEVLIVNSLFQFKNLMDESVVLESPRDVVLKNIRKMRPHTFIHAIVNGSFSAPFFVTRFREVLFYYSALFDVLDTTTPRDNEQRMLIEQNILGRAALNVIACEGTDRVERPETYKQWQVRNQRAGLKLLPLNPEVIELARDKVKNCYHKDFVIDIDQHWLLQGWKGRILYAISTWTANDASS

SEQ ID NO: 114775 - protein, 93 aa, Triticum aestivum
  Clone ID: PAT_TA_9193.pep
FRSVGLEASLYRSNISQFFCAFLARSIRGPCTTHPCSPSNGVSELLMPSSFMCQSLSQLCVLPLVHVYTSLASRLGWAARQLVVELEMLLLLL

SEQ ID NO: 114776 - protein, 150 aa, Triticum aestivum
  Clone ID: PAT_TA_9194.pep
SSPPTPRPCPRWASPSCAAPSRAAGPSPSPPTCCLGVHGAGLTNMMFLAPGATMVQVVPWGGLQWIARMDYGDPAEAMGLRYVQYEIGVEESSLKDKYPRGHKIFTDPTSLHKKGFGFMRRTLMDGQNITLDLGRFRGVLQQALGNYLVQ

SEQ ID NO: 114777 - protein, 179 aa, Triticum aestivum
  Clone ID: PAT_TA_9195.pep
VSPFLPHAATPCASYLVSGRRWPSPAVSSSLPGPVSLPVCLLFYRPLHRARAWSLKACRRPGFPPLHPLPRVRLLVSYRRRRPRPISGLAASSIGGCSRSVVSAWACLLLLGSSARAAPAQGIQSLSAGFPSSGLASCSIQNRGARFFSDIADGLLSPCSSLASMRLRREEPRPNSSAR

SEQ ID NO: 114778 - protein, 116 aa, Triticum aestivum
  Clone ID: PAT_TA_9196.pep
AARNNGLMEVPVIHGRLAVVNTAKCRLADMACSVQLHCEFHPNFGRSARCRVTSPVTYHQGPCRRATRQRRRAGSGRGSSRPDGLGPAGSGRLWRRGGGERRLSGRAAGGGNREQS

SEQ ID NO: 114779 - protein, 152 aa, Triticum aestivum
  Clone ID: PAT_TA_9197.pep
NWKIIKVLHYLPFQIFLLVVDIMGSGSVTLKQKKRVKHTKNKYLKPGALAQIRYSRSTSRDIGKKRILLNVEKDDELETSPHAEVVFESSTPIMSPARLSFETFSGIKGQLLPTTPKTPQAAECDGHSRLESLPLDLLIKIVCYLHHDQLKA

SEQ ID NO: 114780 - protein, 214 aa, Triticum aestivum
  Clone ID: PAT_TA_9198.pep
QISQLAAHPVDLPPLDTSRASTAARTRRRQRSEGKGAHRATVGSRGPPRTPRPSPPPPPPAHPGPAPAPAAPCPHPPPAGDARISQLAAHPVDLPPLDTSRASTAARTRRRQRSEGKGAHRATGGGALSRSHISDLNHPPWLSSFPSHPTQSTASGNGSSPSLRLLALDWRPPDPNRRPPDPIDRILCSLLWRRCCHMQRRWSQLSEECLPVCH

SEQ ID NO: 114781 - protein, 77 aa, Triticum aestivum
  Clone ID: PAT_TA_9199.pep
WEACRSKTKTTCADKYAQESAALACDAYKGVKQDSTLGDEYYSAALPVVEKRIAQGGVRLAAILNRIFSRNGRPQSI

SEQ ID NO: 114782 - protein, 227 aa, Triticum aestivum
  unsure (1)..(227): unsure at all Xaa locations
  Clone ID: PAT_TA_9200.pep
DCLPELDPSAGARGIPVCRSAGKTGKYSALLPLPSVGRIQESVGILEKRERLRKKLSSAQIQKAKDYTKAXNLYAAIRCFNKKKLSGTQIEQLSNFQLRVHVLEMQHLTLLMHSVVGLRSGSSAVNASLPXVECSLGEANGRAERTYRIQDALATPFGASAECDEDELEAELEDLEEEELDLELPEPPRGTRVAPPALAASSSRLAASDLAGTDQTSGRDGDLGILR

SEQ ID NO: 114783 - protein, 208 aa, Triticum aestivum
  unsure (1)..(208): unsure at all Xaa locations
  Clone ID: PAT_TA_9201.pep
IRHEATDTSAPASARSRHGHRHRRAPPPPPHPPPGPPPHSARVPXDSSATTSRRGLIADTATAAVAAAAAPLLLPRLPAARAEDLSEWERVGLPIDPGVVLLDIAFVPDDPSHGFLLGTRQTILETKDGGRTWFPRSIPSAEDEDFNYRFNSVSFSGKEGWIVGKPAILLHTKDAGDSWERIPLSAQLPGDMGYIQATGEQSAEMVTD

SEQ ID NO: 114784 - protein, 136 aa, Triticum aestivum
  unsure (1)..(136): unsure at all Xaa locations
  Clone ID: PAT_TA_9202.pep
MSRRFSAVLFFPSAVATKSRKIGRIGFHIPLLHLQVFLSRIAMDEKQLDTEIHRNYIYEDHVADYMKVTESYFNFCPTVIXSIADAVPEKXQFHFSEYIKKGIAADDMEELHKKVNAXIRADLHXKSTRNSEDHKV

SEQ ID NO: 114785 - protein, 280 aa, Triticum aestivum
  Clone ID: PAT_TA_9203.pep
CPPPSLPPPSLPRKPLTASLPCFRPLRTSRNPSRSLPPPVIQFLNRWPPAADSPRSASPPEEKDKLVAEVMRYALFKTHQNSGCPIKREELTQIITKNYRQRALPALVIKETGDRLAATFGYEMRELQRTRATSTRSGPPSPQHPRIQDAKSYVLVSKLDPEVYSKYVEDKERAHVSGFAFVVISIVHVAGGKISEEDLWRQLKRLGLNETDENHPVLGNNKQALELLVQQRYLLKEKIAGPEGHSMVYELAERALDESISSKLKEYISQVVGVSTATAE

SEQ ID NO: 114786 - protein, 90 aa, Triticum aestivum
  unsure (1)..(90): unsure at all Xaa locations
  Clone ID: PAT_TA_9204.pep
TXEQXRFPGGFVGRQRATSASAPSSSSMAAAGVPRAYRFAAPGAADALLIDRSTPLGTWFSRRGWTVYFCEINEDTTYILRNLVYMLRGP

SEQ ID NO: 114787 - protein, 164 aa, Triticum aestivum
  Clone ID: PAT_TA_9205.pep
GSTGKENSPLKAIDFGLSIFFKPGEKLSEIVGSPYYMAPEVLKRNYGPEIDIWSAGVILYILLCGVPPFWAETEQGVAQAILRGNIDFKREPWPNVSENAKDLVRRMLEPDPKLKLTAKHVLEHHWLQNAKKAPNVPLGDIVKSRLKQFSRMNRFKRRALRVCT

SEQ ID NO: 114788 - protein, 469 aa, Triticum aestivum
  unsure (1)..(469): unsure at all Xaa locations
  Clone ID: PAT_TA_9206.pep
MSIVPKETIEVIAQSIGIPSLPADVSAALAPDVEYRLREIMQEAIKCMRHAKRTVLTADDVDSALSLRNVEPVYGFASGDPLRFKRAVGHKDLFYIDDREADFKEITSAPLPKAPLDTAVVVHWLAIEGVQPAIPENPPIDAISAPTENKRTEHAKDDGLPLDMQLPVKHILSIELQMHFDKIAHLTLTRSRTLIFREALVCLSKDXGLHPHASYFSYFIADEVTRSLADLPVLFALMRVVQSLLRNPHIHIEPYHITSKMATLVYCQLHQLMPSMITCIVAKRLGHRLSDNHWELRDFSANLVASVCRRYGHVYHNLQIRLTKTLVHAFLDPHKALTQHYGAVQGISALGPSAIRLLLLPNLQTYMQLLDPELQLEKQSNEMKRKEAWRVYGALLCAAGKCLYERLKLFPNLLSPPARPVLRSNSRVATNHPDERKSSTDLSASQPPLKKMASDVSMSPMGSAATVAG

SEQ ID NO: 114789 - protein, 225 aa, Triticum aestivum
  Clone ID: PAT_TA_9207.pep
RGSMSLRTSLERRVLPLAARASPMFAYTGLEDSMCVTVEELNKDEAGLCPRFDGVGARQVPFDVIVEPFHSGNAPANGSFQSHFLSSLSVFTFYPLLTSRDHLGACGLHRFHVGAPVAGVGLDPMMAKMLEPEPKRAPVARCSPTKKRKIVTHPRRKRAMMTMVTRRKEMTRRKTKKGPPQRNVTLRKKFGGFTGMGSEEGPQRGNFCRPGVAGARASARFFKDP

SEQ ID NO: 114790 - protein, 213 aa, Triticum aestivum
  Clone ID: PAT_TA_9208.pep
GDNLRRSPPLKTGRSENFAVAIAITHGSPSSGTLAILLPYPSASRWISAAPPSLEFVFRRFVRGLLKVAADGAIHGCDYGAGGWGRGQRTDGARGGGRPELAVGAGGWMSSCYLRLGDSDLRLGIAGTNDQKLRQSLTARSPETSPAHPTPRWLPVPEPPCRRHRGTDGRPCPARRRDLTLPPLGDSLPCAPEIQIEKIRGYEAGGGGARDGR

SEQ ID NO: 114791 - protein, 205 aa, Triticum aestivum
  Clone ID: PAT_TA_9209.pep
QDEEEEDQQDMAPVKMALGPQVPLKDLLHLHKEEEEGEDESLRRWKEQLLGPDAVHTTNLLHALGAETVEPEVTILNLTILAPGRPDLLLPIPFVPDDKGHAFALKDGCAYSFRFSFAVSNNIVSGLKYSHTVWKTGVKVENQKVMLGTFSPQQEPYTYKAEEDSTPSGIFARGSYSARLKFVDDDGKVYLDMRYSFEIRKDWPN

SEQ ID NO: 114792 - protein, 56 aa, Triticum aestivum
  unsure (1)..(56): unsure at all Xaa locations
  Clone ID: PAT_TA_9210.pep
FFXXXFFFFFFFFFFFFFFFFFFFFFFFRIILIIAPKFTSEPLYALIENLHRELRS

SEQ ID NO: 114793 - protein, 488 aa, Triticum aestivum
  unsure (1)..(488): unsure at all Xaa locations
  Clone ID: PAT_TA_9211.pep
QGSAPPLETPXHFQDXLASLGPTIASLFFPRGASEDAGAGGWLGFLKGFNSCCARARASLPLAVLLRVYAAACAAAGAPCGVQFRPGEDGGGDEEGGKVVGELAPGEIAVLLSMCWVMAWSGLAPRVSGGEEGGKGEAVLLPDVSHLVLSALVSAGAVADDEGVWGWEVSGAGKGVSVQEFTSWVISTVPGLGNCLSRYVQDRFRSSESDPAKESSVSTGNTTFDTCDAYLLTRGRAWSISLSVRNTLSEKFLSASVIGMDTGDLLYRSSLHGKGLSRFWSCVEGYKGPALILLSAFSNSGSENVDAGRKWGLGVLTEDGFENKDTFYGSSGFLCATYPIFRMLLPSGKEKNIMYCHLHTQLKTYEATPKPLGLAFGGSIGNERIFIDEDFSKVTIRHHAVDKTYQHGSLIPNQGYLPVEASILDFEVWGLGGQTTKRQQDIFKKREDIFSGQRRKIDLAAFGNWEDSPEKMMMDMVSDPNKARREER

SEQ ID NO: 114794 - protein, 300 aa, Triticum aestivum
  unsure (1)..(300): unsure at all Xaa locations
  Clone ID: PAT_TA_9212.pep
RPIRSEICTLISLLCPSNSSRQCQLLNLLMSLLPRTLSAGESAAEYFELLGTMIDSEASRLFLTGRGCLATLGYMVTKXRTTFXSQERSLSIDISQGFILHKLAELLNKFLEIPNIRARFMSDKLLSEVLEAFLVIRGLVVQKTKLINDCNRLLKDLLDSLLIESTANKRQFIRACISGLQKHVKEKKRRTSLFILEQLCDLICPVKPEPVYLLILNKSHTQEEFIRGSMTKSPYSSVEIGPLMRDVXKNKICRQLDLIGLIEDEYGMXYLGAGNIISLDLXISQGYEQGWRKHPSPTQH

SEQ ID NO: 114795 - protein, 232 aa, Triticum aestivum
  Clone ID: PAT_TA_9213.pep
GLFIFDLRLFALAAGSFQLLYPPPEDESDWDDFVCTWHTLPEPPFLHELVTCCAVHSDQHTIFVSTGEHDPATFSFDTEMEGDGEWKRHGRWRMPFIGRAYFVPELDLWVGLGKHRRIFAIDVVSEEPDAVHVERYVDLPFKVCVDKPSCCHFTDQEPIGATLLSMGGGSTFCLLEYFGVNEMERIMRLMTFSLKYDKYGDLTMGKSIQTRYNRVPSEVSLSTLKTPVAFWM

SEQ ID NO: 114796 - protein, 174 aa, Triticum aestivum
  unsure (1)..(174): unsure at all Xaa locations
  Clone ID: PAT_TA_9214.pep
GYPAXTRGAAIIGPRLLGPVAHRRVGGQFWALAGSEDDEADEDGDEPTSSPPTPTPSDLFCELFHSGYDEDEVASTVDRILPVDDPARVGLHADDRKEMVHRVIHRRTAATAVRPWKGPLPKVLFRATALIRMWSLLTPMEARKRLVTGSVRWEMVARDIFNRFGWRSCNRIGD

SEQ ID NO: 114797 - protein, 144 aa, Triticum aestivum
  Clone ID: PAT_TA_9215.pep
RGLHLLPWRQTPSSDDTRRNFSSRRIDAPSRNNGRFPAGRTRATPVTTHTGGSYTLGRARARTPRPSPRRAPGPARPVHSRDMQAHVRVTRARLGPTPRSPDLANRTHTRWTRVRTCPCTPHACTHTTRRGPDAPNAPGARPYT

SEQ ID NO: 114798 - protein, 90 aa, Triticum aestivum
  Clone ID: PAT_TA_9216.pep
MAWGQGARRPILGLLSRAQRQAARGYTSATFETHLSSNHFAPNGMICRRFSSEVPASEQMNLIKRLRERTCAPIKDVKASLVRCNWDIED

SEQ ID NO: 114799 - protein, 433 aa, Triticum aestivum
  unsure (1)..(433): unsure at all Xaa locations
  Clone ID: PAT_TA_9217.pep
KGFLFLFLLLVQPLTKPYRAHPPLVSGAPTLSGVRRRRLNGGRHRPICRAIREWLGVRVLGRPILGLLSRAQRQAARGYTSATFETHLSSNHFAPNGMIRRRFSSEVPASEQMNLIKQLRDRTCAPIKXVKASLVSCNWDIEDAQKDLRKRGVISAAKKSXRTAAEGLLAIAQDEKRAXVVELNCETDFVARNDVFQYLASSLAKMALSAQDPGKLVFPFAPAYLENMSINLDHPKLSGETTVQNAVTEVAAMVGENVKLRRGFMLSTTAHGVVSSYLHTCPQPGLGRIAGLITLEAEDSSASLDALKRVGSSIAMHIVAAKPLFLSKELVSAAALENERDVLRTQAESSGKPQMAIEKMVEGRLRKYFEDVVLLEQKYVVNDSTNIKTLLNDLSKEVGSKVTIGNFIRMEVGEGIESRPEETAKKEAMACAA

SEQ ID NO: 114800 - protein, 58 aa, Triticum aestivum
  Clone ID: PAT_TA_9218.pep
MAAAGDGRKINRGVAICHLDTSDWSPSHGAFVLLGGEPGKTEVCHWIFEGDMTWTVAD

SEQ ID NO: 114801 - protein, 123 aa, Triticum aestivum
  Clone ID: PAT_TA_9219.pep
MTYPRKLAQLAKKCQRMLVARAGARHRRASDTADDECCSTVSSVVADEGHCMMYTADGTRLEVPLAYLGTTVFAKLLRMSEEEFGFVSSSDGGRIMLTCDASVMEYVLCLVRREAPEEVERRS

SEQ ID NO: 114802 - protein, 171 aa, Triticum aestivum
  Clone ID: PAT_TA_9220.pep
MGDRPKLPARYEQVKLLGEGNFAKVYLARHMDTKEEVAIKVMDKEKLIKLGAVQQIKREIAVMRRLRHPNIVQLHKVMACKSRIFVVMEYVRGGPLYRHIPANGGLKEDETRRIFQQLVSALTFCHAQGVYHRDIKPDNLLVDEHGNLKVADFGLSAHADTARREALLHNV

SEQ ID NO: 114803 - protein, 311 aa, Triticum aestivum
  unsure (1)..(311): unsure at all Xaa locations
  Clone ID: PAT_TA_9221.pep
MLAMDQHNHQEESCVPPGFRFHPTEEELVGYYLARKVAAQKIDLDIIQEVDLYRIEPWDLQERCGGGRGGRGARQVAAEDEQSSEWYFFSFKDRKYPSGTRTNRATAAGFWKATGRDKPVTSSSSRGVIGMRKTLXVFYRGRAPNGRKTDWIIHEYRLQTSEHAPTQEEGWVVCRAFQKPTPNQRPSYIFPAYAAAPGLGGYYEARPWLHGQGGDLHYLQSATCAAGAGGLGFPGQGIQYSDDLLESKQSLFGNIPQLIESPPTTTAVAGGGDAGYDVVQQGRAAAAFDCCFRVTPPASSRLRLHLRTSLS

SEQ ID NO: 114804 - protein, 351 aa, Triticum aestivum
  unsure (1)..(351): unsure at all Xaa locations
  Clone ID: PAT_TA_9222.pep
MAGAAWPLSAAAGLLPASLSLTLLLGSLVVVLVLGVAAVFLEHIRKIGCMHSIERTAVSDAFFEDPGSLKKVPCPSIFDPAEKYISLIVPAYNEECRLPEALTETLNYLKQRSSADKSFTYEVLIVDDGSTDRTSKVAFEYVKKHNIDNVRVLLLGRNHGKGEAVRKGMLHSRGELLLMLDADGATKVTDLAKLEAEVRALAGKAKSSLAPSASSSQRLSDAEIAVFGSRAHLEKQALATRKWXGNFLMKGFHLVVLLTAGPGIRDTQCGFKMFTRSAARKLFTNIRLKRWCFDVEIVYLCKHLRIPMAEVSVSWTEIPGSKVRMTSILHMVFELLLIRVGYGLGIWKIYS

SEQ ID NO: 114805 - protein, 180 aa, Triticum aestivum
  Clone ID: PAT_TA_9223.pep
RQPRHPFSPFLLLPPSRWRRQRDHALLRSFLPPAARSRALVARKPRKEELNRASPAGEGGQSRMPAKEADRLASVVNTAAAPPPSSAGSFGEIHRLLRSLSTPAREEASGGGEPSSRGSRGRRSSTGRRRPEKEERRGCLPGRRIGSSPRLERARWYVWLFLISQRALLGLFVDFLAEPY

SEQ ID NO: 114806 - protein, 216 aa, Triticum aestivum
  Clone ID: PAT_TA_9224.pep
SREFFSGFMDSVFKAPMLFFDSTPTGRIMTRASSDGTRLDFDIPFTMTFVISGTVEVAATVVVMIMVTWQVVLVAVPAVIGVLYIQRYYIASARELVRINGTTKAPVMNYAAESMLGVVTIRAFAATNRFIQTNLQLIDMDATMFFYTNAALEWVLLRVEAMQILVIVTSSILLVMLPAGSVAPGFLGLCLSYALTLSSAQVFLTRFYSNLENYMI

SEQ ID NO: 114807 - protein, 190 aa, Triticum aestivum
  unsure (1)..(190): unsure at all Xaa locations
  Clone ID: PAT_TA_9225.pep
VKSGATTTTTTQYRTTRTRSSEVKPRDPPLKTNAYTPTYTSTTESLRLRVRPNQQQNTAQGNGLRNPNRAGIGLRPQQKTQDHGMEDYGALQAPTKTQAHNHGGLEHHGSNMHLAADKKVHLPLIRETKNHLDLGLHSHESTSKTRETRTTNQGSWGTKKKRRRNQNPVVDELRIAMNRRNRPPPPPXRA

SEQ ID NO: 114808 - protein, 85 aa, Triticum aestivum
  Clone ID: PAT_TA_9226.pep
PQFNASAPVYVNIGDGGNTEGLANSFRSPQPDYSAFREASYGHATLDIKNRTHAYYEWHRNQDGVKVVADKAWFTNRYYMPTHTN

SEQ ID NO: 114809 - protein, 76 aa, Triticum aestivum
  Clone ID: PAT_TA_9227.pep
QALVAYVNIGSYYLVGVPIGIILGWPLGFGVRGIWSGLIGGTAVQTLVLVYLTMRCDWDDEAKTTSARMRKWASTK

SEQ ID NO: 114810 - protein, 34 aa, Triticum aestivum
  Clone ID: PAT_TA_9228.pep
CCPGLLLHLVMECFVAHSGFYQDNKVVCKLRLRI

SEQ ID NO: 114811 - protein, 67 aa, Triticum aestivum
  Clone ID: PAT_TA_9229.pep
MTTSRRVADRKIAVFEKNITKRGSVPETVKKGNDYPVGPIVLGFFVFVVVGSSLFQIIRTASNAGLF

SEQ ID NO: 114812 - protein, 67 aa, Triticum aestivum
  Clone ID: PAT_TA_9230.pep
MTTSRRVADRKIAVFEKNITKRGSVPETVKKANDYPVGPIVLGFFVFVVVGSSLFQIIRTASNAGLF

SEQ ID NO: 114813 - protein, 228 aa, Triticum aestivum
  Clone ID: PAT_TA_9231.pep
APGENSTTHTRPEEEGKREARRRMRQASRFKRMCVFCGSSQGNKSSYHAAAIDLANQLVGGGIDLVYGGGSIGLMGLVSQAVYHGGRHVIGVIPKTLMTPEIVGEMVGEVRPVGDMHQRKAQMASLSDAFIALPGGYGTLEELLEVITWAQLGIHHKPVGLLNVEGYYDSLLTFIDQAVEEGFINPAARRIIVSAPTAHQLMDKLEEYVPYYEMVAAGLDWEADRLDF

SEQ ID NO: 114814 - protein, 68 aa, Triticum aestivum
  Clone ID: PAT_TA_9232.pep
RYHSFIYSHTPSLRPKGLFKFCHTYKCNYLSCVLLLVALELPPRTTHNTTLLAQVINLNKTNYTHLVT

SEQ ID NO: 114815 - protein, 236 aa, Triticum aestivum
  unsure (1)..(236): unsure at all Xaa locations
  Clone ID: PAT_TA_9233.pep
RSQLATARSVMYAKRYAFKHRKNVTKVEKKMDVTHKLKTIGGDKNGSTRFVPTKKMPRYYPTEDVPRKLRSHGKKPFSEHKRKLRSSITPGTVLILLAGPHRGKRVVFLKQLDTGLLLVTGPHKLNGVPLRRINQVYVIATKTKVDVSGVTIPKRVNDAYFKRKELSKPKHGEGEIFETDEQKYTVSDERKEDQTAVDKQVRAVLGKDEXXKXYLTGKXSLXNGQYPXNRSSRKAK

SEQ ID NO: 114816 - protein, 438 aa, Triticum aestivum
  Clone ID: PAT_TA_9234.pep
ASVASSISYLDNGVVYVGSRFGASQLVKLNLQPDATGSFVEILERYVNLGPIVDFCVVDLDRQGQGQVVTCSGAFKDGSIRVVRNGIGINEQASVELQGIKGLWSLKSSFSDLYDMYLVVSFISETRFLAMNMEDELEEIEIEGFDAQIQTLFCQNAINDMLIQVTANSVRLVSCTSRELVDQWNAPEGFSVNVASANASQVLLATGGGHLVYLEIRDAKLVEVKHAQLEHEISCVDLNPVGENPQYSSLAAIGMWTDISVSIFSLPDLELIRKENLGGEIVPRSVLMCTLEGISYLLCALGDGHLFSFLLNASTGELTDRKKVSLGTQPISLRTFSSKGTTHVFASSDRPTVIYSSNKKLLYSNVNLKEVNHMCPFNTAAFPDSLAIAKEGELSIGTIDDIQKLHIRTIPLNEQARRICHQEQSRTLAFCSFKYTQN

SEQ ID NO: 114817 - protein, 75 aa, Triticum aestivum
  Clone ID: PAT_TA_9235.pep
LQPLLMLLYITVDHHSCLLIHLRHWQCQIHFLSAPPRSSGSPRINKTWQGDEKEAQLNDFNGFISGNEKRWGEWP

SEQ ID NO: 114818 - protein, 74 aa, Triticum aestivum
  Clone ID: PAT_TA_9236.pep
IRHEVGMLRMDSSFAELMAAAGMGRELRHVAETTSELECFHVFSGSAGVSRHAVSLCALVSEARELMDMDFRSQ

SEQ ID NO: 114819 - protein, 90 aa, Triticum aestivum
  Clone ID: PAT_TA_9237.pep
DSHEQEEEGSRRREERSAARPTERRPGLTGADEGRWTKTAGRQHGETQCLRGGPNRNHTRDMWAGGRRPRPRHTASEGAPETRPAGGAAG

SEQ ID NO: 114820 - protein, 186 aa, Triticum aestivum
  Clone ID: PAT_TA_9238.pep
EDLRVYTQLSTANITQRIAVPYSGSFEVIKYRLKQIYESVESSAEEDVPTLTVHERVAIRLDSERYVTLQWSSDPISDMVSDSVVAMILNIGREGPKVVPIEEAVKTEEETEKVARKVVYSLMVSLFGDVKVAEEGKLVITVDGDVAHLDGRSGDVECENAGLKERIKTAFRRIQGAVRPIPLSAS

SEQ ID NO: 114821 - protein, 665 aa, Triticum aestivum
  Clone ID: PAT_TA_9239.pep
QMVITPLGAGSEVGRSCVHMTFKGRTVLFDCGIHPAYSGMAALPYFDEIDPSAIDVLLVTHFHLDHAASLPYFLEKTTFKGRVFMTHATKAIYRLLLSDYVKVSKVSVEDMLFDEQDIIRSMDKIEVIDFHQTLEVNGIRFWCYTAGHVLGAAMFMVDIAGVRILYTGDYSREEDRHLKAAEIPQFSPDICIIESTYGVQQHQPRHVREKRFTDAIHNTVSQGGRVLIPAFALGRAQELLLILDEYWSNHPELHKIPIYYASPLAKNVRAVYQTYINSMNERIRNQFAQSNPFHFKHIDPLNSIDNFHDVGPSVVMASPGSLQSGLSRQLFDKWCTDKKNTCVIPGYAVEGSLAKTIINEPREVTLANGLTAPLNMQIFYISFSAHADFPQTSGFLEELRPPNIILVHGEANEMGRLKQKLITQFDGTNTKIVSPKNCQSVEMYFSSEKMAKTIGRLAEKVPEVGETVSGLLVKKGFTYQIMAPEDLRVYTQLSTANITQRLAVPYSGSFEVIKYRLRQIYESVESSTDESDVPTLIVHERVTIRLDSESYVTLQWSSDPISDMVSDSVVAMILNIGREGPKAVPMEEETEMVAQKVVYALMVSVFGDVQVVQEGMLVITVDGDVAYLDGRSGDVECANAALKERIQTAFRRIQGAVRPIPLSAS

SEQ ID NO: 114822 - protein, 139 aa, Triticum aestivum
  unsure (1)..(139): unsure at all Xaa locations
  Clone ID: PAT_TA_9240.pep
RRPAYWSCFCSPSPRGAGSRSPPARAAPWAASSASSSPRPAASSRRRAAREQTAGTPPRPRRWTPRRRRGTAXPAGPRKRLKKSSVXTASRPTCAGRRRCCAASGATRRRTLPAPASTTSPPTGASSGARSACPPARSI

SEQ ID NO: 114823 - protein, 204 aa, Triticum aestivum
  Clone ID: PAT_TA_9241.pep
RCSAELVDRHGGQHEGVLLPGGASARRGHGEQALARRPRGQHPGRAHRQGRQLPHVGGPRGGGRLAVRRRRGGGRLGEEGARPSGGGEEAAEEVFRELHPRRHVPEEEGAVRQAVLQDVARRRRRRPQPRPPHPVRRQVQEVRAHLLDRSLAVPSLPSSGFRVVSCRRGRSMHVSYSTFAFPSIGFMHRLNKQASFPPSWSHAV

SEQ ID NO: 114824 - protein, 41 aa, Triticum aestivum
  Clone ID: PAT_TA_9242.pep
GGRGGGRGGFGGRGGFRGRGAPRGRGPPRGGGRGFRGRGRF

SEQ ID NO: 114825 - protein, 190 aa, Triticum aestivum
  Clone ID: PAT_TA_9243.pep
MRSPIGGGGFRGRGGDRCGRFGGGGRGGGGRGRFGGGGGGFRDEGPPSEVVEVSTFLHACEGDAVTKLTNEKVPYFNAPIYLQNKTHIGKVDEIFGPINESYFSVKMFEGVIATSYNEGDKFFIDPMKLLPLSRFLPQPKGSTPRGGGRGGRGGGRGGRGGRGGFRGRGAPRGRGPPRGGGRGFRGRGRF

SEQ ID NO: 114826 - protein, 192 aa, Triticum aestivum
  unsure (1)..(192): unsure at all Xaa locations
  Clone ID: PAT_TA_9244.pep
RPARAPARAGNRRSPRGRRGRSAGGGXRGGEQGSLRGGGGRVPGRFRGGRGRCRDEGPPGQLGEVSTFVHDCEGDPVQQLTNEQEHYFNGPXLTRIFGPINESYFSVKMFEGVIATSYNEGDKFFIDPMKLLPLSRFLPQPKGSTPRGGGRSGRGGGRGGFGGRGGFRGRGAPRGRGPPRGGGRGFRGRGRF

SEQ ID NO: 114827 - protein, 194 aa, Triticum aestivum
  Clone ID: PAT_TA_9245.pep
VRPRVRPRLRRRRRNPLRRTPPLLQPFSRRSTGTSKAVYDMASHAYPSKRPFQKKYSEHNGRAKWQKTKHAPSQQPQLTIQPGVPLIRILCPTEKCGNVIGKGGSIIAKIRQENGVKIRVDEAVPGCDERVIVITTAEKDKEASHEQGKENDGGTAVSADGEHEKEKDHSKEEKDDSDNAHGKEEQDDAERDDS

SEQ ID NO: 114828 - protein, 145 aa, Triticum aestivum
  Clone ID: PAT_TA_9246.pep
SPLRPEALVCDENEGQLIDDRNYVWTYTSPEFPVLQEDVLQSFKLPRQVLCIGGVVKVELLGRAQKQAIDGLYYVCVSHVQILGKPLSRELGVVPRGNGLVLNYYLDPRTCGVPRSESSGDDAAAGGIAWRRGSGILELREGLEG

SEQ ID NO: 114829 - protein, 137 aa, Triticum aestivum
  Clone ID: PAT_TA_9247.pep
MSSAGGGRGKGKAVSKTVSRSSKAGLQFPVGRIARYLKIGKYAQRVGAGAPVYLSAVLEYLAAEVLELAGNAARDNKKTRIVPRHIQLAVRNDEELSRLLGAVTIAAGGVLPNIHTTLLPKKVGKGKGDIGSASQEF

SEQ ID NO: 114830 - protein, 224 aa, Triticum aestivum
  Clone ID: PAT_TA_9248.pep
MDNVQGDISISGKYSFVNEGIKHADSSQAPPRTGNVILPPYSALRNFADSETKRKVIEKLPGNALRQTLTYFISDELTNTLKTEVGRRLGITKAEKLQRSLAHDVERLATQVSRTIVHDSELYRATSVQRNPTTVKFGVVHGENVVEAISTAVLQSHDLRKVLPVGVIVGVTLASLRNYFHVGVSKHDNLTKAAVKSGILDEDLIVQDADEGNRIIFPHRKRQM

SEQ ID NO: 114831 - protein, 189 aa, Triticum aestivum
  Clone ID: PAT_TA_9249.pep
ICRRFVEPKQQKPQISPLPPLLPSLNFPPKLKSSGLLPPSDLRYKYPSILPSLPQPHPINLPAWYHQPPIRRASARMSSKMAADSGDQENLPPSTTPPTATAAVVRPRHFGVKKGQMKRLGRARRRAPLKDITNHFAVETASAEVQALQQPEEGSEGGTAKEELAAQTNALASAAAVKARRNSLRKEFR

SEQ ID NO: 114832 - protein, 150 aa, Triticum aestivum
  Clone ID: PAT_TA_9250.pep
FRFLFLSYTWLGNILPRVKFDPETKGIAGRHTLAGASSSRGEERDLANARHAQPPTMMQTRGQMRSGEAKTPRAIFGISSTKQTKREKGTTTERAARPAWGRTGARPQMVEAYTRTGATLGVGSRRQTETEKPRPDESSPTALTGEGAAG

SEQ ID NO: 114833 - protein, 152 aa, Triticum aestivum
  unsure (1)..(152): unsure at all Xaa locations
  Clone ID: PAT_TA_9251.pep
WPGEGVKTLPYPMNNIHFLLGSETTXNALVVENHFKIEDIGCLVVEPVRGTFLKWLTFPRQSKAHYRWENEPNIKENDSHRCLWPRKPCTAGRICILSTSVLTIYISRQRGNGEPTLKVLLSGVRKNSGTPRVESSWHPTIWTSLYQAVGCL

SEQ ID NO: 114834 - protein, 92 aa, Triticum aestivum
  Clone ID: PAT_TA_9252.pep
NYTICCLTLFVSFIQHHHDSRFSETNGDSLLLDFRKGNDHNDLLHQVRYQARKTTFKLWRCLLWLLAAPKVTLEFGDPLHAPGLCLTQALLR

SEQ ID NO: 114835 - protein, 127 aa, Triticum aestivum
  unsure (1)..(127): unsure at all Xaa locations
  Clone ID: PAT_TA_9253.pep
PNPXTTHIFGDCILEPQTTVGKSDEAAVEPKDGASAKSYLVVKRATEAAAGPGEDFLSSCFTCTKKLEGNDIYIYRGEKAFCSAECRDQEIMIEEEAEKCMATGGSPRSSCSSLHEDIFMAGMMVAT

SEQ ID NO: 114836 - protein, 44 aa, Triticum aestivum
  Clone ID: PAT_TA_9254.pep
LVSRLRSRSLTELTRQIAPPTKNGHAPPPIESRKSSQSVNPCYV

SEQ ID NO: 114837 - protein, 538 aa, Triticum aestivum
  unsure (1)..(538): unsure at all Xaa locations
  Clone ID: PAT_TA_9255.pep
MATANADAAEVERLYELGDRLSSAKDKSQHAADYEAIIASVKGQNVKAKQLAAQLIPRYFRSFPALGTFAMEAMFDLVEMEELAIRIQAIRGFPLLGKDAEFISKIPDILGHLLTSEENVERDAVHKALMSLIRQDVKNSXAAFLKARRVSMXRRELARLYLGCSGWPFQVELLNPFAEMERFRTDLIKKSVLDVTGLEFKFFKDFLRSLSIFGDTAPRESFQELIEIIQAQADLDAQFDVSDIDHIXRWTSCIYMALPIFTRGASSSKFLNYFAKQIVPVFDKIPEEKKLDLLKTVAASSPYAVAQDSRQLLPSVVQLLKKYMPGKKVDDINHNYVECLLYTFHHLAHKTPNTTNSLCGYKIVTGQPSDRLGEDFSEHYKDFIERLTGTEDTVRAASKRLTQGMADFNKAISSAKTEEEKTKIKADQQKSTMTMRSYNNILAMSQPLHGKSPLFIGDKKITLSWMEQPKKPAASTAGGKRTQPASNGNAPLNKKGRGDGGMHNQLVNRAFEGLPRGGGRGSGRGRGRGGRGRGWGYR

SEQ ID NO: 114838 - protein, 191 aa, Triticum aestivum
  unsure (1)..(191): unsure at all Xaa locations
  Clone ID: PAT_TA_9256.pep
MSHDDPPPAPAKKKSPAEEAAEKRREKLTPGSLMKAVIRSGRGDATPADGDQVILHCTIRTMEGIVVNSTRREHGGKGIPLRFVLGKSKMILGXLLNAFPTMLKGEIALFXMEPKIHYAEDDCPVTPPDGFPKDDELQFEVGLGALKQLTIRVVRNKEGWNTKTLNAHVMQTKESHKMILLVIKRNEMTRN

SEQ ID NO: 114839 - protein, 184 aa, Triticum aestivum
  unsure (1)..(184): unsure at all Xaa locations
  Clone ID: PAT_TA_9257.pep
MLASCYLLERLDVSGNRFVGPFPAALLSLPSMEYLSIAGNRFTGRLSGNASCGENLRFVDLSSNLLTGSLPGCLAASSDSGKTVVLFSANCLSSGSGDESQSQHPSPFCRNQALAVGIVPEQSRXRKKKSGAKAGVVAVIVLVGALXVSAAVVFVVRKARLPKARPARRLVEHASGQQIRRVSA

SEQ ID NO: 114840 - protein, 372 aa, Triticum aestivum
  Clone ID: PAT_TA_9258.pep
RRVPSAPSDDASPAPPNPTQLPTVTVLQMACRGEDGGNEVFVVDLLAVRLADLWAPLRELFERPEVLKLGFRFKQDLVYLSATFTAALGGDSGFNRVEPFLDVTNVYHYLKGHDMQKRLPKETKSLASICEELLNVSLSKELQCSDWSCRPLSEGQIQYAASDAYYLLYIFDLFHQKVSIEEKCSPTAEASDEHCSQRASECSSSGNDICFDGYSTSIITKYSDRILLTESDTKARSSRRKEKQKLSSDAKCKEKFDYNTEWMGPPPWDPSVGGDGYPKFLCDVMIEGLAKHLRCVGLDAATPSCKKPQPRELLDQIYREGRILLTRDAKLIKYQYLATNQVYRVKSLLKHDQLAEVCAYFDIFRLQVDLSA

SEQ ID NO: 114841 - protein, 114 aa, Triticum aestivum
  Clone ID: PAT_TA_9259.pep
MEAGGGAARPEPPGGEGARLGQSQMQPDGPVVLNRSAELESSDAMDIDATPAQAPSQTVPPPTQSPAATLADTVVQVQKQLKRKRASNGPVIAPAEKEALADGCRLELQGLFEY

SEQ ID NO: 114842 - protein, 188 aa, Triticum aestivum
  unsure (1)..(188): unsure at all Xaa locations
  Clone ID: PAT_TA_9260.pep
MWRAYFFCFCKEDADAEHHGGHGVQPLQCQDPEGPVLHPGPRQVCHREDRVRXNRVLVSGPFDADKLTCKLWCKASNVIKNIEVVKPPVVAKPKDDPPKPKKKEEKPETKPAPCNQLVPYAYPYPLPYPSAWPCGCGTSCCEGHSKPPPPAPAPTCQCHSYPPYQQPMPMPCTPMVICEESPPACAVM

SEQ ID NO: 114843 - protein, 443 aa, Triticum aestivum
  unsure (1)..(443): unsure at all Xaa locations
  Clone ID: PAT_TA_9261.pep
MAEASRYQILVRLLDGRTHCLRFPTPTVSGAALLDAVSALSRVPAASLRLVTGRLDISPSSVLASFPDGQFPSASALLRLRGGKGGFGSLLRGAASKAGQKKTSNYRRXRDINGRRLRHVNAERRLEEWXAEAADRQLEKLAEDFLKKKAKESGRGGARAAEVDKYLEKYRRDAESCVNAVEESVRASLGKRKAVPKPRDAKKLKIWMGKKKVADDESDSDSDSDVDDNEGADAKPIALDHGNYSNESDKVRRRRVDLASVSGSHSEGESSGEKSQSSDSEKNGNALQESMEVKIRSGCDFESGGSLECEGGMANTSENGTSENGKSALSEEVLKSDDKTDVDNTGSATSSLLNDPVVPPVEESADVNNKPLLSEEPVDLATFSSAAELEALGMEKLKLELQTHGLKCGGTLKERAARLFLLKTTPLDKLPKKLLAKPNSGGK

SEQ ID NO: 114844 - protein, 102 aa, Triticum aestivum
  Clone ID: PAT_TA_9262.pep
YLCLHSPEVRGLRRRQSHCRAGRAGARGARRSSPGAAHKGRRRGSSCRHTTHRSPLVQTLSELHLSVLHLGQVEHMLDGLDDMDGVEDVRFDELIGMQGVVF

SEQ ID NO: 114845 - protein, 212 aa, Triticum aestivum
  Clone ID: PAT_TA_9263.pep
TESTFEKEVGQDRGALVEFYAPWCGHCKKLAPEYEKLAASFKKAKSVLIANLDADKYTSLAEKYGVSGFPTLKFFPKGNKAGEEYESGRELDDFVKFINEKSGTSRDSKGQLTSEAGLVASLDALVKEFHSAADDKRKEILSKIEEEAAKLSGPAVKHGKIYVNVAKKILQKGSDYTKKETERLHRLLEKSISPSKADEFAIKKNILSAFSS

SEQ ID NO: 114846 - protein, 368 aa, Triticum aestivum
  unsure (1)..(368): unsure at all Xaa locations
  Clone ID: PAT_TA_9264.pep
MATPQIYRKTLLPVLLLLAAAALYPAAADGDEVLALTESTFEKEVGQDRGALVEFYAPWCGHCKKLAPEYEKLAASFKKAKSVLIAKVDCDEHKSVCSKYGVSGYPTIQWFPKGSLEPKKYEGQRTAEALTEYVNSEAATNVKIAAVPSSVVVLTEETFDSVVLDETKDVLVEFYAPWCGHCKSLAPIYEKGGPLFSSXDEGVVIANLDADKXTSLAEKYGVSGFPTLKLIPKGNKAGEEYESGRELDDFVKFINEKSGTSRDSKGQLTSEAGLVASLDALVKEFHSAADDKRKEILSKIEEEAAKLSGPAVKHGKIYVNVAKKILQKGSDYTKKETERLHRLLEKSISPSKADEFAIKKNILSAFSS

SEQ ID NO: 114847 - protein, 108 aa, Triticum aestivum
  Clone ID: PAT_TA_9265.pep
EALVLLGGSGPGGTRRRRPRRRSDGGRRDCSTRGSGNRPRRASEEQQGPTGSSKKVQERSAARVHPFPCVMFGQIGSFMLSIIFKVCFCVEKWQKIKVQNKECHKINF

SEQ ID NO: 114848 - protein, 316 aa, Triticum aestivum
  Clone ID: PAT_TA_9266.pep
ARRGMYGSFVQIATCLGILFSLLVGTPVKDIDRWWRVCFWVSAVPAVLQAIAMEFCVESPQWLYKCGRTNEAEMQFEKLLGPLHVKSAMAELSRSERGDDGESVKFSELFYGRHFNVVFIGTTLFALQQLSGINSVFYFSSTVFRSVGVPSSLANICMGIANLLGSIIAMLLMDKLGRKMLLVGSFFFMAFSMGLQAIGANRHLGSASVYLSVGGILLFVLAFSLGAGPVPGLLLPEIFPNKIRAKAMALCMSVHWGVNFFVSLLFLRLLEQLGPQVLYTMFSSACVVGAIFVRRHVVETKGKTLQEIEVSLLQTQ

SEQ ID NO: 114849 - protein, 52 aa, Triticum aestivum
  Clone ID: PAT_TA_9267.pep
FFFCFSSPLSLLLITQRKYLYKGLTRTSQPSRPATTHGSYSYWKSESNETFT

SEQ ID NO: 114850 - protein, 81 aa, Triticum aestivum
  Clone ID: PAT_TA_9268.pep
GDVHLLVSDAPPWWLDKYRPLLRGLSHHAVIDMDRQSAEVLCYPHVVVGLSFHKEMSIDTAKTVGGHYSMADFARLARRSY

SEQ ID NO: 114851 - protein, 133 aa, Triticum aestivum
  Clone ID: PAT_TA_9269.pep
MSRTARPQAFNSIPETPQAAVDATPDVRGKFRRMEFGSSSRFSSPPTLSMRKSRNNISSPQQRLRMQSGSGNASKLCFSIQKRVALGSPAPARTTSMTSGTGIFDPALREQIMAGRFGNAQRVFNGKRRMSVL

SEQ ID NO: 114852 - protein, 251 aa, Triticum aestivum
  Clone ID: PAT_TA_9270.pep
MVRLLSLAPHKFRCRSIVAKLHYYLPLFGGSLEKLLRAINFTNLLCCKGRVEPNVAFLRECGLGDGDIAKLCSSRMVTANMERVRTMVALTEGLGVPRGSGMFRHALSAVAFLDEKKITAKVDHLKKTVGWSDAEVSIALPKAPFLLAKSNESLQHGSEFLVSEVGLEPAYIARRPVLLCYSLEGRMRPRYYVVKFLKENGLLKRDPSYYTVFKETDTYFVEKFICPHKEAAPYLAEDYAAACGGEVPASI

SEQ ID NO: 114853 - protein, 102 aa, Triticum aestivum
  Clone ID: PAT_TA_9271.pep
ALSPALTSPYILASLACLAGQVASSLTPRSLVWQERREMARPYHLPLLSVLSFLLLTGLVTADLSGGNKVGKIVTMTVQYPAAGSPPGEKTTISAHYVDEHG

SEQ ID NO: 114854 - protein, 239 aa, Triticum aestivum
  Clone ID: PAT_TA_9272.pep
MDGSTVNRLVILFLLVLVLATSNSEHGHAGAVDAGNVVVVRVRLIGRGPDDKTTVAVQRHDLSFAGFTDGSGHWHAFPGLEHLFPTSTTLPFGSSYSDLIGGLANLPGVPLGREAMLEAIRVLSAYRPGADVEPVKRALAAMKVVMCEAQRVRPIKETLNDGWDTGAHVAPEHLPYTEHWDTMSYEILRSNITGKWDGPFTNMLETEANIHSKEEALAVVGVLRSVDFEQVIEAHASPI

SEQ ID NO: 114855 - protein, 44 aa, Triticum aestivum
  Clone ID: PAT_TA_9273.pep
FFLVTYTPFLPKYKTFLQFKLNYRNIVYFGTEVVQKHKDASIYT

SEQ ID NO: 114856 - protein, 317 aa, Triticum aestivum
  unsure (1)..(317): unsure at all Xaa locations
  Clone ID: PAT_TA_9274.pep
SSADASHEERRDLAAGVAAAAPAAVSFXHVALVGTPTAGTPVGSSGLAATVRAAAVLLRLHPDWDWFLTLNAADYPLVTQDDLIHALSYVPREFNFIDHTSDIGRKESEKVQSMIVDAGIYLSGRTNFFRATQKRPSPDAFKFFTGSPWVILNRRFIEYCVLGWENLPRLLLMYFNNVMLPQEGYFHSVICNSLDFRNSTVNNDLRYKVWDDPPQTEPLFLSMAHYDKMVDSGQPFARRFQANGPLLDKIDEKLLKRPGHGPVPGAWCAGRKSWFIDPCSQWSDVNVVKPGPQALKLQQYINRTLEEADSGAKSCRL

SEQ ID NO: 114857 - protein, 178 aa, Triticum aestivum
  Clone ID: PAT_TA_9275.pep
FFFSQRLEKAAIIDTTLRPHRGDVRHGGEVVEALDDVVGLGDAVHHHAGSPAAPFGSEHGVASEIHRPRAVVVVVAVPAAAQLRRSTFARTSGHGVDQNRVRRRIPFPPRVERIFFRSDSDRSVWERPTHPIPSLSHTPVDPIDRRTPAAPLLCASLLFAPRRSHRDLIGWTRSLLFP

SEQ ID NO: 114858 - protein, 141 aa, Triticum aestivum
  Clone ID: PAT_TA_9276.pep
RGLIWYIFPGFLVGSTFMLWNKHHGNKQLIGAFEVTTPPWWRTVEHPLAQQEAILQLEAHGQAGNIFLLKLRFLVLAAFPQSTNKVAVAMLVVAATFVFMPFWSIAMVVLLEAYMRHMSLRKKSSEKLVRRFLAWMICLCL

SEQ ID NO: 114859 - protein, 510 aa, Triticum aestivum
  unsure (1)..(510): unsure at all Xaa locations
  Clone ID: PAT_TA_9277.pep
MERNIIVLLSLLLCLLSCHVSAAGATAKRRLSSPLSRPHRVITAEAAPATTVPAMVQYETRYHTQRLDHFNAAPASYRTFPQRYLVNGTYWGGKTAPVFVYAGNEGNIELFTNNTGLMWELAPRFRAMLVFIEHRYYGRSVPFGSEEAAFRNTSTAGYLTTTQAVADFATLVQSLKANLSAPTAPVVVFGGSYGGMLAAWMRMKYPHVVIGAVASSAPILAGYGPALPYPSADIISCLFXSESKNCHDVLMNSWKELDKALSNDAGRAQLNSTFKMCRGSTVEAIPDLLDTAIVYSAMTDYPTESGFLTHLPAYPVKEMCRAIDNPKSGKDTFSRINEALMVYYNYTGNAPCLGDATEHDPYGMFDGWDFQACTEMILMSYGVRNGSVLPPEPFNFTKLPDGCPASTGLPPRPYWFPTEFGGFDIANVLKRSASNIIFFNGLRDPWSSGGVLKDISRSIMALVEPKGSHHVDLRFSSKDDPDWLKQVREKETRIIGHWLNQYYKDEAIKS

SEQ ID NO: 114860 - protein, 108 aa, Triticum aestivum
  Clone ID: PAT_TA_9278.pep
AVLITCLTEVVLQFNRPFSRATLSFRAGLYHPLLPDPSPVLKLGTGLNLPWQVQRHCCCPSSGKGGTPTASTSVTARAPEEMYWRRQCCSLSNEGRDGWSLILLPCRC

SEQ ID NO: 114861 - protein, 147 aa, Triticum aestivum
  Clone ID: PAT_TA_9279.pep
RPCRSSREEAGDSSRAGHRRAPAPSSRVVAMLPSSARHRLKVTVAAADLLPIPLHHRVSIVSVSRDPTMAIALFPSFSDHLVHNGGRGADNRWKVGREGPTVVPRGMKQRRHRSFPGQFIFLSFVLPHSPPRYSLIKRYKWVASCNF

SEQ ID NO: 114862 - protein, 214 aa, Triticum aestivum
  Clone ID: PAT_TA_9280.pep
HIIAEKLQEGLPCISESSTICGGLRAMRPITEDYIATFILRWQFIQSVQSATSCVQWDPGGFDFVELAANRHRLGRYTELQDSCSPSWLADGTSHMLKLHLQDTNFEELAANWHRLEGKPVVKEEGMSATQSTAAATSTEGATMVAQTAAMAAKPTATQTGEPRQRAHQHMGRAGQVVTPRAGRLQVPSQDAANGHPGLDHERQRRLPLFPVIS

SEQ ID NO: 114863 - protein, 110 aa, Triticum aestivum
  unsure (1)..(110): unsure at all Xaa locations
  Clone ID: PAT_TA_9281.pep
NDGILSKYKCEIVQCCTSQQVLRSPTMLSSLASDPKMSISQLFPIPRCYKLNSSCCGKDFQLPPTYIVKMPISMSAVIVIIVVVAFIVLVVTMNLLXLGYALHDIIHTSA

SEQ ID NO: 114864 - protein, 202 aa, Triticum aestivum
  Clone ID: PAT_TA_9282.pep
HGADAYIDDINALIPLTDGNIRTALDTGCGVASWGAFLLKRGIITMSFAPRDSHEAQVQFALERGVPAMIGVMATDRIPYPARAFDMAHCSRCLIPWNKLDGLYLVEVDRVLRPGGYWILSGPPIRWKKHYKGWQRTEEDLKQEQDEIEDLAKRLCWKKVVEKDDLAVWQKPINHMECANNRNADEALQFCNNSDVDSAWYK

SEQ ID NO: 114865 - protein, 84 aa, Triticum aestivum
  Clone ID: PAT_TA_9283.pep
SHAPPTHRAMATPRSPTFFPARGPRPLPSSSPEPHNPPPSPWPPPPPVAALVRPDLVGTPRRAPTPTGAYPPPVARTTMAPPQI

SEQ ID NO: 114866 - protein, 212 aa, Triticum aestivum
  unsure (1)..(212): unsure at all Xaa locations
  Clone ID: PAT_TA_9284.pep
GAYXLLQLLLIRAELEIQRLPGDTVQALQSLDLIKSRMKKIFQGRIEGIHHQNTSAQELQDQHPGRGEIFTPKHPHSGRSKFGEVRYRGDWMKRPISETEVAWLARILIHISDRLNDALRLGCDGAADDSVANPTYIKFDRNDLTTIGGPKDAARMALVAICSLLAVVGQAVLRFMRAHRVKINLRVFASKKLLTGLVLLYAMVAGTKRAFY

SEQ ID NO: 114867 - protein, 156 aa, Triticum aestivum
  Clone ID: PAT_TA_9285.pep
MLPLATMSAPSSLLLRPAARQRTGGEPGRSWGEQSISGSQSRRNKLSNSICVKANITCCANQTQTAKRKSFSGPTSPPSGSVKEKVKPRLDDGGVGFPPFRFGGGGGGGGGGGSSSSGGFILFVIVLLLDYLREFERNLQNGPRRGSDYDSGLAPQ

SEQ ID NO: 114868 - protein, 286 aa, Triticum aestivum
  Clone ID: PAT_TA_9286.pep
SFGEVYQGELKSPRRRLIAVKRLINSNEYSEREFSNEVQSIGQIHHRNLVRMIGYCKEGKHRMLVLEFMPGGSLRGFLFKPERPPWSWRAEAALGIARGIEYLHDGCVSPIMHCDIKPDNILLDGAYAPKITDFGISKLLGNQQVHTTVTNIRGTRGYIAPEWFRSDARIDTKVDVYSFGVVLLEMICCRKCQDPLVDQGGDETVTLFGWAIQLVSSQRTELILPDDDDAAADMERVERFARVAFWCIEPNPSLRPTMHHVVQMLESAVGEAEVLPDPPACYMDSA

SEQ ID NO: 114869 - protein, 132 aa, Triticum aestivum
  Clone ID: PAT_TA_9287.pep
FPCLEQLYVIFHKHNEQDKKNGPRYDPLHPIECLQTHLKRVVFLRTRKREKQYEFARFFVLNAEVLNKVEFEGFGGYNSVSVAYQHRFLRVENRASQDAQFEFRRYIRTEHQLVEHIHDLSVADPFRSHRQD

SEQ ID NO: 114870 - protein, 152 aa, Triticum aestivum
  unsure (1)..(152): unsure at all Xaa locations
  Clone ID: PAT_TA_9288.pep
ILXLPWVSLDLLPLAAEPAHPQLWAPPQLEITGATTGSLAAGLAPRMPPLFPGPVNCDRCVAGPEKPLRKKGGEIVDLYIVIIVGVRAGDVGVELVSRIQHGNSLSMRILATLLSPSTQARRLIAVPTRGGRVVVILDNSSILRPTDSTHAR

SEQ ID NO: 114871 - protein, 156 aa, Triticum aestivum
  Clone ID: PAT_TA_9289.pep
TRRDDATGIFSPSSSYGISSSSPISHRTVSSSGCFSAATGIFSPSSSYGSSSSPTCRRTVSSSGCFSAAPGIFSPSSSYGSSSSPISRRTVPSSGCFSAASSLDISSGVLLAGNAASPAAAPLVTSVPPWRCSLSCTSSLQSLPHALPLWQAMLTK

SEQ ID NO: 114872 - protein, 221 aa, Triticum aestivum
  Clone ID: PAT_TA_9290.pep
MIQLLFTLLAAEAALVLVLLFRTPARRLALLAVDCSKRGRGPVMARTVAATMFVVLGSSGYSIAKIRRREGEFAQLTPTDQVLASRHLLEASLMGYSLFLGLIIDRLHHYIRQIRAMKKNMEAVTKQSRVLEETKLGDSEEIQGYQKKIGSLNEQVQVLKQQSESQTQELKTAETNNLALRKQSEGLLTEYERLIAENEELRNKLQTMELRFSRSDSKKNT

SEQ ID NO: 114873 - protein, 82 aa, Triticum aestivum
  unsure (1)..(82): unsure at all Xaa locations
  Clone ID: PAT_TA_9291.pep
MASTAARRLRELQGRPGNKTCVDCAQRNPQWASVSYGVFMCLECSGKHRGLGVHISFVRSVTMDSWTEXKLRKMEAGGNDRP

SEQ ID NO: 114874 - protein, 188 aa, Triticum aestivum
  unsure (1)..(188): unsure at all Xaa locations
  Clone ID: PAT_TA_9292.pep
MASFPLASAARSLPTIASHLPAAATTRSVSIPASPVPAAKNAASCSLSTRSRRRPAVRRNAAETYVPGSGKYIAPDYLVKKVSARELEELVRGERKVPLIVDFYATWXCGPCVLMAQDFETLAVEYQESALFLRLDTDEHYEFPGDIQLRARVRPAPYFFRPDQGKDAIRTEGLFPIQRVRNIIENEL

SEQ ID NO: 114875 - protein, 306 aa, Triticum aestivum
  unsure (1)..(306): unsure at all Xaa locations
  Clone ID: PAT_TA_9293.pep
SGDPYVTIQVSYATVARTYFSCNILNPVWAQNFHVPVGHEAAEVEFVAKDSDDFGAXLMGTVAIPAQNLLSGDRIEGVYPVLEPNGKPCAPGAVLQLSIQYIPVARLTMYHHGVIAGPDCLGVPNTYFPLRRGMRVTLYQDAHVPDGSLPDIWLDHGLRYQHGQCWRDMYDAISQARRLIYIVGWSVFHTIDLIRDGAEKAPSLGDLLKMKSQEGVRVLLLVWDDPTSRSILGFKMDGFMGTRDEETRRFFKHSSVQVLLCPRSAGKRHSWVKQQETGTIFTHHQKTVIVDADAGNYRRKIIAFVG

SEQ ID NO: 114876 - protein, 99 aa, Triticum aestivum
  Clone ID: PAT_TA_9294.pep
YPGMIWVLFIMQLASHGTRDEEGMQLVPRCDQEEVSDSQEIFSQSDTAGSSTEYLGSCEIKPLIVEDEDHNIDEEWKKPILSFKTFHNAGFALIMKVMT

SEQ ID NO: 114877 - protein, 170 aa, Triticum aestivum
  Clone ID: PAT_TA_9295.pep
GPAAPRPARDHRHRVAPPCAAATPSGPLAPSRCPLWALARASPHAQHREGAARPLGRDAAHGGRRRCWRFLSLPPPLRLPSPLFLSLPRPRTGAAHSSSAWIQTPILEPWRRNCRILPPPESFFLSFPSLCPTHVHPPVAAPLFFACSIAPLLFPSVCAFLCISTQDNGD

SEQ ID NO: 114878 - protein, 165 aa, Triticum aestivum
  Clone ID: PAT_TA_9296.pep
ISPQAGCSSLTRMGATYPLVFLILLLLHGTKAASDPPVPGWLTLSGRRPLVIARGGLSGVVPESSQLAYSMAMGSSLCEVVLFCDLQFSSDGVGFCHGSLRLDNSSNIAEKFADRGSTYQVNGREVQGWFSLDFKSEELHSVLLLQNVLSRSSTFDRTQELLSLD

SEQ ID NO: 114879 - protein, 170 aa, Triticum aestivum
  Clone ID: PAT_TA_9297.pep
SGGKIDVTSHFKSSKSSKKEKSVMKLVGETGVQQRSSLLGDLGTSKKHATGKRSSALISGMENASESGTRSRSFGHKQPIPSQLTESQGTASFPVNNSPDSLKPSLLKLKFKRPHLEQPSAQVSQPEEPATWASQQEDLNVAKGQRSKRKRPSTDKMDGSEGSTSAATTL

SEQ ID NO: 114880 - protein, 233 aa, Triticum aestivum
  Clone ID: PAT_TA_9298.pep
GGVSLVHSRRPSSFSRLHMMPMTTTFCRSRVCLLPLVAVLAVAASLEPLTPLSKVMAIDVSAVAKGASVLDEAAHSSVDKKLKHVKEGIEHGMEVFRFWDDHKDDIKKQLQLLTPGAQGSSPSGYVVDTGNLKSLVYGIDINSPVTRTGPCELGARAVSCSAPACRQLYGGQPWPNCAHGPGRTSLSLPLRRLSLPVPGQSHLVHKAHRHASTLSLPLYACSPSARGRPRLGD

SEQ ID NO: 114881 - protein, 224 aa, Triticum aestivum
  Clone ID: PAT_TA_9299.pep
FPEEKKSEMQNNAHVSLTQNCTLNSMMSVYDFFCLFLQPANQKAQTIFVLPTGAIALHLMHAPHYIEKRMLKMGGQEDVVVCRGKTGGRRRWGWSPWPPISVRRSGANCTRRFGRAARYRGQYCTPLCTSPPLLEGGRKDAAVVGWSPGGRRRGLRGAHGRGGDGRPQPHYDRKTRGDPASLGTRGAAAHSQPEIRSPQVVGEPPAIQHNRAGAARGWRAAPIS

SEQ ID NO: 114882 - protein, 188 aa, Triticum aestivum
  Clone ID: PAT_TA_9300.pep
CRDHLLVRMSISHWRQMGRRHPRASTCRRRLCHRSPPPRPASSSCDASAMTPLLALPRNATLSSATTAMAPLLPFRSRPPQAAPPPSLSRRRDGGRQGGDCRWQARGRGQVMEVPRVRARGDELHGAWACDALLTGDLVAVGPGLGRPWVAVDLDPVGDAWRREALRAQLTGLLAGGARAWQPRADRE

SEQ ID NO: 114883 - protein, 150 aa, Triticum aestivum
  Clone ID: PAT_TA_9301.pep
EKKKEEKRKKNLASQNRSVGEGHMRCEREGSSPAMHARTPFPWLTRERPREHLLFYYHGDTELLLAPSSLCTLHRATDSLSKHAGVGRLPPGGHRYVGAPCSIDGRRQGTGRPVDHCFSRSGGGGWDSTRMDQRICTSSHGHDLTSSYRM

SEQ ID NO: 114884 - protein, 104 aa, Triticum aestivum
  Clone ID: PAT_TA_9302.pep
TRLTGRALVSRVSEVTNLPLLKICRQIYFGRGEFVLPPTVYEWGMEGETEVFRTSLNQMSFSAMFDTHRVGMGSEVVVSRLIEVTNLPLFRVVEIGPMDCPCNG

SEQ ID NO: 114885 - protein, 99 aa, Triticum aestivum
  unsure (1)..(99): unsure at all Xaa locations
  Clone ID: PAT_TA_9303.pep
MADLAGGSLAIWTQHLTCSATVALLVLALDKGRRRGEGGGAPPAVCTRGHGDDAGEVDGGLPVGWXRRRRRRGLGIGWRRRRGGGGTSECGRRRRLGLR

SEQ ID NO: 114886 - protein, 450 aa, Triticum aestivum
  unsure (1)..(450): unsure at all Xaa locations
  Clone ID: PAT_TA_9304.pep
STSWTPSDASARSPAGPSRPPRPAAGPPWPCRSPGPPACRSGCSFLIFILATRFIGRKYKKLFWLSAISPLLSVILSTAAVYATKADKHGVKIIREVHAGLNPSSVKQIQLNGPYTTECAKIAVICAVIALTEAIAVGRSFATIRGYKLDGNKEMIAMGFSNVAGSLXSSCYVATGSFSRTAVNFSAGARSTVSNIVMAATVFIALEFFMKLLYYTPMAVLASIILSALPGLIDIREACNIWRVDKMDFLICLGAFLGVLFGSVEIGLGVALAISFAKIIIQSLRPQVEVLGRLQGTNTFCSVRQYPVACRTPAVQVIRIDTSFLCFINATFIKERIMEWVRAEVDTSNEKVRERVHSVVLDMSNVVNIDTSGLVGLEEIHKELASLGIQMAIASPGWQAIQKMKXLAHLVDRIGEDWIFLTVGEASGRVSNWHTRAVLPEWLSVLLVKK

SEQ ID NO: 114887 - protein, 173 aa, Triticum aestivum
  Clone ID: PAT_TA_9305.pep
RPRTRGIMEEQQRLSGVLCESGKPNALALAEEELHHDFSKTEPSTPVLTSEPSFRDKAVTASGGLEGTDELLKVLSSHDDCLSLDHELSTPDSSCVAGYLLNSPRDSKRACISNSLGHGNSEFTLPHIIPESSSGSDLQLRSSVFSYGTGRSGSSAALDASEDGFTNGSGSDV

SEQ ID NO: 114888 - protein, 163 aa, Triticum aestivum
  unsure (1)..(163): unsure at all Xaa locations
  Clone ID: PAT_TA_9306.pep
PPAPRRYHAPPLIPGAAPPCRPPSPGENRFAXPPTAPSPSPHRHPHRPSPSASAPATAPRPQPPPTSSPLVTPAAXPPPPPXSTPSRRPCPPATTPKIGSPLPRFRSSPHTWRHKAGRFSLSLSPPFLPPHSWPRPSSCVPPRLCENSNSDATYALGETLTGT

SEQ ID NO: 114889 - protein, 121 aa, Triticum aestivum
  Clone ID: PAT_TA_9307.pep
LHYTSRRRRRRCLPVRFESSPELCWVPHLNKGLFRCLFFSSQFFSTRVSFDVISLLDVWLCLLEKLGYATIWLQVNCNICCFVFQSCIKLLFWVIWMLNSSNPATVVYLVSNYRFCEQNRI

SEQ ID NO: 114890 - protein, 167 aa, Triticum aestivum
  Clone ID: PAT_TA_9308.pep
MASLAALHPNLPHAHGHPSHPNPTSGLLRLLPSCRRHRAPRRRGLGLAVSACASSAASPSAAGRGDRSEAASSLERCLAASALSAAAPAAAPPRVPPAMKGGKQYGAFGAVTLEKAKLDLSQRKKKIMPELATGGGGGDIGKRIGHGGGDGGDDDRDDDNYFDDFDD

SEQ ID NO: 114891 - protein, 154 aa, Triticum aestivum
  Clone ID: PAT_TA_9309.pep
VIISSCISCFTSFYMMRWKEYFPGKELVQSPHFQVEVFCYPEPRIVCDYLSWRQSECHNRNQYTTCFWMLVKSGEGENKAKEILKDTLPKDKNELLFQRFQMNYNNEPAMFRKGSCAYRQKVEASEDERWDVAVAHVDMGPHFWAKHSYVFDRR

SEQ ID NO: 114892 - protein, 159 aa, Triticum aestivum
  Clone ID: PAT_TA_9310.pep
MARNKEGLVLLLDVGPSMHRALQEVENVCTTLVRKKLVFHRSDEVGVVLFGTKETHNDLARELGGYKHVLVKHDIKVVDEETKDALENLPKGTAPGDFLDAIVVGLDMLIKRFGDTKAKQRLCLITDAQHLLRDPPQGTKEDQVDTIADQMKKHDIKMD

SEQ ID NO: 114893 - protein, 193 aa, Triticum aestivum
  Clone ID: PAT_TA_9311.pep
IALGCRLRLLPVANIQESFCSSLSKLLRTRRPEEAEPHAERSLDCFTHGRLTLQQLEVSRRRTRPAMERAWRSGALSETASCADTPRSAHSSCNLQHRHSQSMLRTREAAVDMSPRFSYCKPTINRDSKMLHRRHSLNLPEQSLPGRHSRKTTERTQKATSKSIADLAGEIAALRAGSHPQGTASADPLQKGI

SEQ ID NO: 114894 - protein, 186 aa, Triticum aestivum
  Clone ID: PAT_TA_9312.pep
VDGGFYTSLGKLIGGAKSSVAEIVGAAFSRKKRPNVHQYQQGRASPWPVQESYAIPRDETPPVVDTRTPTPRKNYAFMSKEPEKIHHIRQGRAPYNGWNNGESPQQQQQQQQQVHHQQYLQHNRQYSLGPQTFYEPSCEATNEIVFGAVQEVDSARRAVEIKPVNHCDAAAYEQSGLRYRSGGYMG

SEQ ID NO: 114895 - protein, 222 aa, Triticum aestivum
  Clone ID: PAT_TA_9313.pep
MAVAEVRTPRRRHGSMALADLLLREASAERADAAGGERPGVAAGQAARARPGEDYALLKQGCERHPGASFSAFAMFDGHNGAAAAVYAKERLLANVLGCVPAHLTRDEWLAALPRALVAGFVKTDKDFQTRAHSSGTTVTLVIIDGSVVTAASVGDSRCVLEAEGSIYYLSADHRFDASGEEVGRVTECGGEVGRLNIVGGAEIGPLRCWPGGLCLSRSIGD

SEQ ID NO: 114896 - protein, 228 aa, Triticum aestivum
  Clone ID: PAT_TA_9314.pep
AYCLLSLGDSITTDHISPSGVIKPGTPAAKYLLERGVKPENFTTYGSRRANDEIVVRGAFANIRIVNKLLEGEVGPKTVHVPTGEKHYVFDAAMKYKSEGHDMVILAGDEYGAGSSRDSAAKGPLLLGVKAVIAKGFERIHRSNLVGMGIIPLRFKAGEDADSLNLSGHERFTIDLPRKITEIRPGQDVTVTTQNGKSFTCTLCINTQVELEYFNHGGILPYLIRKLA

SEQ ID NO: 114897 - protein, 353 aa, Triticum aestivum
  Clone ID: PAT_TA_9315.pep
MEAVHEGNGGGSGLVVTELSHIKELVKQLDVHLGGSPDLCKLLAQQIFAVTERSIGMIRSGHFNGPKRPAAGAGLDSPPLSPTPSPLSGVSNTPFKPNKKRKTSEKGGRQIRVSSAAGGADAPADDGRSWRKYGQKDILGAQHPRAYYRCTYQKTQGCAATKQVQRADEDPALFDVIYHGEHTCVHKTAAAAVQPAGQNPGAESLLQSLSSSLTVKTEGLTAAGAQGWSATTPFSFSSPAVSGMTPPEQQHHPFSTPSTPENCFVSMPTSLEPSPATSGSNHMCMTPFHAQSELQTMVSALVEATSMPAAGTEEAAFSTCRSDGTAVDAAFDVDNFDVSALHVNNFDVSVFLA

SEQ ID NO: 114898 - protein, 80 aa, Triticum aestivum
  Clone ID: PAT_TA_9316.pep
FFLIDGVVDDELLALVLQMIVSPTLNHSVLKCRSIFKIPTAPISVRRTFLPLRSSSPRSSSSILLRNSNSKSPTSLSLSL

SEQ ID NO: 114899 - protein, 452 aa, Triticum aestivum
  Clone ID: PAT_TA_9317.pep
ARLRACGAAAPASVPALVRARLARPASASAVASSSALEELAADRKGLARVVLKKGKTQIFRDGSPMVYSGAVDRIIGRPPPKTGDVVLVADGSEKPIGWGVYNSVSMFCVRLMQLEEEAKRDPASALNMERLLEERLCSAVDLRRSLGFPSTNTNAYRLINSEGDRLSGLIVDIFADVAVIASSAAWVEKYRQQIQSLVSKVSDVKHIKWRSSTDILKEEGLDMSEQKEPAPSSYSGTVKVMENGIVYLVSMEGQKTGFYADQRESRHFISTLSKDQRVLDLCCYSGGFALSAAKGGATNVTGIDSSGSALDLANENILLNKLDAERISFLKEDATAFMKGAISRNELWDLVILDPPKLAPRKKVLQSASGMYRSLNALAMQVVKPGGLLMTCSCSGAMTQSGLFLKTIQGAASMAGRKVTVLRQAGAACDHPIDPSYPEGQYLSNYLLRVM

SEQ ID NO: 114900 - protein, 80 aa, Triticum aestivum
  Clone ID: PAT_TA_9318.pep
MFVGGVKHEPDGIALLIMKGLSKGSWTVDLGDFWASMEFLWEWSSATYLYLFLVHLPCWLLCIHVLLHPCRQVGSKVKRE

SEQ ID NO: 114901 - protein, 249 aa, Triticum aestivum
  Clone ID: PAT_TA_9319.pep
PQQKGRIGILLDFVWYEPHSDSNADQGAAQRARDFHIGWFLDPITNGRYPSSMLKIVGNRLPGFSADEARMVKGSIDYVGINQYTSYYMKDPGAWNQTPVSYQDDWHVGFVYERNGVPIGPRANSDWLYIVPWGMNKAVTYVKERYGNPTMILSENGMDQPGNVSIADGVHDTIRIRYYRDYITELKKAIDNGARVVGYFAWSLLDNFEWRLGYTARFGIVYVDFNTLKRYPKDSALWFKNMLSEETRR

SEQ ID NO: 114902 - protein, 130 aa, Triticum aestivum
  Clone ID: PAT_TA_9320.pep
TRQEAAAFAKLKTFCSNIVKRLAPPLLKEVQASALRLEPEPCTPRRTTRASKRSSTVSVTKATPAENVLLRALGLVPANLVPHEEDVQELKDLFDSPLRDQHVRIIAALFGKPVPSFEMEEETRVMVEAR

SEQ ID NO: 114903 - protein, 198 aa, Triticum aestivum
  Clone ID: PAT_TA_9321.pep
WQANIHQILSKSPVQQISQKNQHLGSEVRILEHACMPRSSMHPFYKASHWHTPEIKIGHALLLPTSSWSSRRNMNRRHHHDTSQRSPRQCPASPGHSRLNQLHVSQIFVNMKLLQSFYSNHRLSCSCQSSVQPLQTTTKHSLWSLRCIPDRHPYSLARSMPSFLVTALSLPYSPMAIFSMDIFYISVRCYIQTVLQFS

SEQ ID NO: 114904 - protein, 326 aa, Triticum aestivum
  unsure (1)..(326): unsure at all Xaa locations
  Clone ID: PAT_TA_9322.pep
MSFSVAGMEKERGAAAAVEEIRRLPAEVNWEMLDKSRFFVLGAALFSGVSAALYPAVVVKTHLQVAPPPQAAVGTVRAILGRDGLRGLYRGFGASLAGTVPARALYMXALEATKSSVGSAALRFGVSEPAASAVASAAAGVSAAVAAQVVWTPVDVISTRLAPSAASXSPPXDLLRKILATDGVRGLYRGFGLSIITYAPSNAVWWASYAMAQRFAWRVVGADRSESYPALMAVQGASAVLAGGAAALVTMPLDTVKTRLQVMETDAAVARATLGSTVRGLLKEGGWAACYRGLGPRWGSMSLSAATMVTTYELLKRMSAKEGSLG

SEQ ID NO: 114905 - protein, 173 aa, Triticum aestivum
  Clone ID: PAT_TA_9323.pep
RLYAGAQDVLKTFRRVPVHFVDITALSELRKDAHTSVHTLRQGKLLTPEQQANPKTYADCIHWCLPGLADTWNQFLYARILFQPLHPTPTVASLPSSNGAPTWLLQVSVAHKIQKSKGPLKETKDGCPPSPFLFTIFAGAANSRPVQWARDSKRTGGTEGKDNEICSGLFFFS

SEQ ID NO: 114906 - protein, 126 aa, Triticum aestivum
  Clone ID: PAT_TA_9324.pep
RLKGYRIRSPEVEEGICQVLAHLWLESEIVSGSSSSIATTSEAAAVAAEAAVAAEATATPSSPSSLVKKGEKTDFEKKLGEFFKHQIETDPSAIYGDGFRAGIRAVERYGLRGTLDHIKRSGSFPS

SEQ ID NO: 114907 - protein, 355 aa, Triticum aestivum
  unsure (1)..(355): unsure at all Xaa locations
  Clone ID: PAT_TA_9325.pep
RAALYSLMAVERDIFGISGPTYLNPVNWNCENNRRSVAACLVQGXYVLGERPATKPVNPLTPAAXPWWGVPSNFEMIRKXVDDVDLSIFGAIFEFNPPSSKEASAQDAPRFIIAFRGTITEKETISRDLSLDLQLVQNGLHKTSRFAIAMQAVQNVASAFPGSPIWLAGHSLGAGTAILTGRNMVKKGALLDSFLFNPPFVAAPIEGIRDERVKHGFRIARSVITAGLTIAMKAKTEGNNQRSVAEESFNILSSWTPYLFVNPGDHVCSEYIGYFQHRRNMEDLGAGFIEKLATQNSIGDLFYKALGWESEPLHLLPSADLIVNVSPSPDFKYAHGISQWWQPDLNLQCNKYRYS

SEQ ID NO: 114908 - protein, 189 aa, Triticum aestivum
  Clone ID: PAT_TA_9326.pep
MCQPTRALSLPTHPPRNRRNLVARLLFTPPDSLFAGPPPAPCAPARCDSFGPPTWACPLATVPPGVPIHMTVPLLAPALVLSLACQPPDRYMSCGCDSFDVGTCVWPFAPPMLPSVPFPPSFPDLPPAGIAAFCCTVPRRPPLCFAPAGWAAGAPNTGAPPVLPGGPFPPAASKLPPVGNAGFCCTEPC

SEQ ID NO: 114909 - protein, 371 aa, Triticum aestivum
  Clone ID: PAT_TA_9327.pep
VRSNTITESFEHLINLRQNRPAELIAKFLDEKLLAGNKGTSEEELEGILDKVLVLFRFIQGKDVFEAFYKKDLAKRLLLGKSASIDAEKSMITKLKTECGSQFTNKLEGMFKDIELSKEINDSFKQSSQARTKLPTGIEMSVHVLTTGYWPTYPPMDVKLPHELNVYQDIFKEFYLSKYSGRRLMWQNSLGHCVLKVEFPKGRKELAVSLFQSVVLMLFNDAQKLSFVDIRADKELRRTLQSLACGKVRVLQKTPKGRDIDDKDEFVFNEDFSAPLYRIKVNAIQMKETVEENTSTTERVFQDRQYQVDAAIVRIMKTRKTLSHTLLITELFQQLKFPIKPADMKKRIESLIDREYLERDRSNPQIYNYLA

SEQ ID NO: 114910 - protein, 76 aa, Triticum aestivum
  unsure (1)..(76): unsure at all Xaa locations
  Clone ID: PAT_TA_9328.pep
GSAADIIKVAMLNSHSVITNGSNTLDSMDGLTQNFXQIRGRCHLLQVHDEFVLEVDPSRVAEAVRNPRAIQCVPSV

SEQ ID NO: 114911 - protein, 136 aa, Triticum aestivum
  Clone ID: PAT_TA_9329.pep
VKKGAGPIGSQVTVKIVKNKHAPPFRTAQFELEFGKGICRSSELFDLGVKHKLVKKTGGAYYSFNEQQFHGKDAVKAFLTKNESVAEELEMELRRLIQTEPPRKPEAEDDLLDDSPEEIVRPETSSEEDMAAIIRA

SEQ ID NO: 114912 - protein, 345 aa, Triticum aestivum
  unsure (1)..(345): unsure at all Xaa locations
  Clone ID: PAT_TA_9330.pep
MGVDYYNXVRVDRGASDDDLKKAYRKLAMRGHPDKNPTTKKEAEAKFKQISEAYEVLSDFQKRTIYDQLGEEGLKGQPPPGAGGPGASSFYPGGGQSTSFHFNPRSADDIFAEFFGFSGPSFLGGMPGGSMRGEPRSYGGGVFSNEYLAKRFAEGSAGNMPRPSHKPAPIENQLSVTLADLYKGVAKKMKISREVIETSGRVSQVEEILTIDVKPGWKKGTKITFPEKGNESPSMMPADIVFIIEEKPHDVFTREGNDLVMTQKISLVEALTGYTVQLTTLDGRSLSRQVNSVIHPSYEEVIPGEGMPIPKEPCKKGNLRVKFSIKFPSRLTSDQKAGIKRLLGS

SEQ ID NO: 114913 - protein, 284 aa, Triticum aestivum
  Clone ID: PAT_TA_9331.pep
RVVPRVRVIEVWDYVNGMLKKDLQYQGDESFMMHEDAVLCVDFSRDSEMLASGSQDGKIKVWCIRTGQCLRRLERSHAKGVTSVTFSRDGTQILSTSFDTTARIHGLKSGKMLKEFRGHDSYVNYAIFSTDGTRVITASSDCTVKVWDVKTADCLQSFKPPPPLRGGDASVNSVHLFPKNSDHIVVCNKTSSIYIMTLQGQVVKSFSSGKREGGDFVAASVSPKGEWIYCVGEDMNMYCFSQQSGKLEHLMKVHDKDVIGITHHPHRNLVATYAEDCMMKIWKP

SEQ ID NO: 114914 - protein, 114 aa, Triticum aestivum
  Clone ID: PAT_TA_9332.pep
MATLRNLKIKTSTCKRIVKELRSYEKEVEKEAAKTADMKEKGADPYDLKQQENVLAESRMMVPDCHKRLEAALTDLKATLAELKESNEQGTEIGEAEATITEVEAVYTPTEAED

SEQ ID NO: 114915 - protein, 228 aa, Triticum aestivum
  Clone ID: PAT_TA_9333.pep
MEDWENDDFQPIAPVVKAQPLKSNWEDEDVDEDDVKESWEEEEEKPKPVEKPAPKPSAKAAVKKGKQPSTSTEVVEDDVLDDPISEKLRQQRLVEEADFKATAELFAKKDGSEKSLETFIPKSESDFAEYAELIANKIRPYEKSFHYMGLLKNVMRLSMTPLKGADAKEISSSVTAIANEKIKAEKEAAAGKKKGGAKKKQLHIEKGEEDFVAGPGASFDDPDEFDFM

SEQ ID NO: 114916 - protein, 195 aa, Triticum aestivum
  Clone ID: PAT_TA_9334.pep
MDPELPSAGNISTNGEVINPSAETIPVDAEVINPSAENISISDEVVEPSVESISVREKVINSFGNENSQIKNDAIKIPEVAPTPASAQKDVIKKTYASIVKATNESIPPAPITKPKPKPKPRPNPTVKRAENVEKSSSVPAKTMHASLTVPPNDQNISDDQGYSIFVKNLPWNATIEMVDAEFIKFGSIKPRGIQ

SEQ ID NO: 114917 - protein, 229 aa, Triticum aestivum
  unsure (1)..(229): unsure at all Xaa locations
  Clone ID: PAT_TA_9335.pep
MIKTTKEVQSYKFIPLVYQIVSRLGSTKDARHETNFQNALASLLKKMAIDHPYHTIWXLLALANGDRVKDRPRSRSSFVVDMDKKLAAENLLKELSSFHGALIRQMKQMVEIYIRLAELETRKEDTNKKISLPREFRSICQLELAKVPVVTATIPVDPNCRYEEGTFPHFSGLVDSITIMNGINAPKVIQCIGSDGNRYRQLAKSGNDDLRQECCMLFSFILLRSSTMY

SEQ ID NO: 114918 - protein, 85 aa, Triticum aestivum
  Clone ID: PAT_TA_9336.pep
MPSASSAVGRLQAAAQDAANSSSSSRSAFSNQLLVPREAGRMVSLSACAKFGAVSFVVGVVVGFTLNKRLRRWAAKLLKRIKDDN

SEQ ID NO: 114919 - protein, 128 aa, Triticum aestivum
  unsure (1)..(128): unsure at all Xaa locations
  Clone ID: PAT_TA_9337.pep
MRXEVIGMNFYSEKIGTPFLLWNEIGNILAYFKEKSDAGEVAKDSGSSFWKMDGDSTVRLNRWPVPMPCWRDPDDPSWSYPDDWITDAPRDEPNIEIPPGEEFRYGYIRGTRYRNLVKECWVPLTKKW

SEQ ID NO: 114920 - protein, 364 aa, Triticum aestivum
  Clone ID: PAT_TA_9338.pep
MRRWFCCSQFHASYREHEHEFPSSPDEKEGNGFDSKSDPTKAPPPIEIPELSLDELKEKTDNFGSKALIGEGSYGRVYYAILDSGKHLAVKKLDTSADPEPDNEFLTQLSIVSRLKHENFVEMLGYCVEGNQRLVAYEFATMGSLHDILHGRKGVPGAQPGPALDWMQRVKIAIDAAKGLAYLHEKVQPSIVHRDIRSSNVLLFEDYRAKVADFNLSNQSPDMAARLHSTRVLGTFGYHAPEYAMTGQLTQKSDVYSFGVVLLELLTGRKPVDHTMPRGQQSLVTWATPRLTEDTVKQCIDPRLKGECPPKGVAKLAAVAALCVQYESEFRPSMSIVVKALSPLLQQKPQAPPAAAPNTTTSEA

SEQ ID NO: 114921 - protein, 82 aa, Triticum aestivum
  unsure (1)..(82): unsure at all Xaa locations
  Clone ID: PAT_TA_9339.pep
SRGASEEDNQQKARREASCGDSGRMRRGVAGPGGRGQSGATCGRLRRGAVTASXKQIDQAVAGPVPGGGMYGPELDMNLRYR

SEQ ID NO: 114922 - protein, 108 aa, Triticum aestivum
  unsure (1)..(108): unsure at all Xaa locations
  Clone ID: PAT_TA_9340.pep
LVVRIRXKNRRSNISIHLCSCKTAEFISFFLKPNSYSSYYALQPKHLHIYSLFGQAREISKEMKRMLWNIRKAEQISLHLSSSSSSMSLSLTRSSMASVCVMRAEACS

SEQ ID NO: 114923 - protein, 170 aa, Triticum aestivum
  Clone ID: PAT_TA_9341.pep
VDQVTHNYTVTLAKSKQVPEDRLRRVFSVLVAGPSGTSRAPAAIPVPCARTGGRLRVLCGGLVLVGGIAKPNRPDIITGIGIWELDKTQWQEVSRMPHKFFQGFGELDDVFCSGGADDLVYIQSYGATALLGFDMKQRQWKWSAKCPVSKKFPLQLFTGFCFEPRLDITT

SEQ ID NO: 114924 - protein, 280 aa, Triticum aestivum
  unsure (1)..(280): unsure at all Xaa locations
  Clone ID: PAT_TA_9342.pep
MRASAAEIFDRPLTTCLPYEMFKNMTQQSVAVAHLIMXPRHHSXDLIEALNTYMPDQNDDRPLATFKERLQYLQRTXNTRASCGRSGVHGWGLFAVTKIQEGQMVIEYRGDQVRRSVADLREARYHKENKDCYLFKISEDVVIDATERGNIARIINHSCMPNCYARIVSVGDNKSQIILIARRDVSAGEELTYDYKFDPDESEDRKVPCLCKAXLTCRGYMNLKCSQGLTNPNYSGEAPHSQIHPDSFIILCMAVSMQPVCYFFSHRILLDSRGRASQAR

SEQ ID NO: 114925 - protein, 130 aa, Triticum aestivum
  Clone ID: PAT_TA_9343.pep
GHHASAPSRVPPEAPVQPVVQPHQQQPEVTPHRQLIPRPMPHLPIRSRRCASTAGGATPPPEALAQPMVHPDVSPWRRPTCLPICAVASPTAVSGPQSFLPPRGASIHSQGAAQPPASRGATQPSLFHLG

SEQ ID NO: 114926 - protein, 174 aa, Triticum aestivum
  Clone ID: PAT_TA_9344.pep
SRAPRRTCSRDGLRQPAVVAGVGHPRVPRPGPRGGGARGGAAGRTAGAARRGGTRGGGGRGGCGPRRPGTSGPGPGRGGGPWRGSPGGPGAGAGAGATTGRPGGPGARTGRPTPAAWGSEFRARVPRWPCNIFAAHWGDGRCRREVERRRGQMEGNGGVQLGRDGQKVAKQGRE

SEQ ID NO: 114927 - protein, 113 aa, Triticum aestivum
  Clone ID: PAT_TA_9345.pep
ITKIDKLELFNAQEFHELILDKPECILRHGEEMPFTVCVLRPNSNGHEFPATINAVIDSNEQNSWLVPKTKWLYPDDIRDADKMPLVRKRFKPDYTFPPLDGMDLHTEDSDEE

SEQ ID NO: 114928 - protein, 172 aa, Triticum aestivum
  Clone ID: PAT_TA_9346.pep
AIRKACASLEPNYQPPVTFVVVQKRHHTRLFANNHKDRSSMDKSGNILPGTVVDSKICHPTEFDFYLCSHAGIQGTSRPAHYHVLWDENNFSADEMQTLTNNLCYTYARCTRSVSVVPPAYYAHLAAFRARFYMEPELSENHTSKSSSGTNGTSVKPLPAVKEKVKRVMFYC

SEQ ID NO: 114929 - protein, 171 aa, Triticum aestivum
  Clone ID: PAT_TA_9347.pep
EFAVTERAGEDLLLESLTDQDDGACNQVPLQGNMHEESGEEDEFDCCGHRQENCCVEGNVMVSLVDNNQEATIFYTDAQDDSCTSFEAPHVCTMDGTPTDIAGDHYRDVGFGSVADHGYFGGHCDPKTWDIGFSSVWEKDEFLSTNNVIEEVFGKGSCEIGNDSSTAQGII

SEQ ID NO: 114930 - protein, 270 aa, Triticum aestivum
  Clone ID: PAT_TA_9348.pep
SGPAPAPQPRSNRRIHRPAAGSPHQWHPPPAPPCPLPWPSSMTQLQPAPSPLALSCPYPGPPCRSPSPSQRQRECLHPPQTPPPLPPPQPNCLAHRSICRRSSTRPPRASSPGTSSRLRPLCASRRTGRSSARCRSPRPTTAKVDIGWAFSPGTMVLGWISNISKKMRDLETVDLPMLAAHPNDKTAADRCLRRLNVIKDNMKKAKRAVQGRVTVPTDQLNEISRAVKRLHQKKEHNLQYLEDRLPALVRALLAVRSAVAPGTLVPGSIH

SEQ ID NO: 114931 - protein, 94 aa, Triticum aestivum
  unsure (1)..(94): unsure at all Xaa locations
  Clone ID: PAT_TA_9349.pep
VSCQRHFGFGCEIDEETSNKLXGLPGVLFVLPDSYVDAENKDYGAELFVNGEIVQRSPERQRRVEPVPQRAQDRPRYSDRTRYVKRRENQAYQR

SEQ ID NO: 114932 - protein, 236 aa, Triticum aestivum
  Clone ID: PAT_TA_9350.pep
MAAAAAAAGARRLLARRASSSPVTISALLRRGGAAAAAAPHEPLLRPAALAAVASRLGFLRGMARRPGGDGYSPARSGGGGGGGDRAPTEMAPLFPGCDYEHWLIVMDKPGGEGATKHQMIDCYIQTLAKVLGSEEEAKRKIYNVSCERYFGFGCEIDEETSNKLEGIPGVLFVLPDSYVDPEHKDYGAELFVNGEIVQRSPERQRRVEPVPQRASDRPRYNDRTRYQRRRENQQR

SEQ ID NO: 114933 - protein, 147 aa, Triticum aestivum
  unsure (1)..(147): unsure at all Xaa locations
  Clone ID: PAT_TA_9351.pep
MKASIKFRDDDRPLMRAKVPIGVLGLPFQSGLSAGGDPRELRFDLSTAFASGPALRLSYRPNDPGLPFAISIRAGVGALGSPVRGPFSLAAELNXLPAXSGSPAFFLLLKPRLRGFLTFQKLPVNQGFSAPLVGEGLTKGGTARTNF

SEQ ID NO: 114934 - protein, 142 aa, Triticum aestivum
  Clone ID: PAT_TA_9352.pep
MSIRDVAPPWRTGYILAILALGSVAGPLQGITRAVLLHGRVQVVALFLSPKKDHKLRVYWNVYHHSVGYTIIILRMVNIFKGMSILDVAQKWKTGYIIAIAILGGVSVALEVITWAIVLKRRKTEDKAYNGGASNNNGHLPM

SEQ ID NO: 114935 - protein, 175 aa, Triticum aestivum
  Clone ID: PAT_TA_9353.pep
NYNSQVQINILTYIWTDSTTSTHQKNETEHHSTGPSRGLFTNGNTGLKPLALSRPPSPPLPHAGILRGFFGRSPLRGHVVLLCPFSLQIVQNLDLASFTSYPGLSLAVVGLPLCFFLSGTNNVDNGPVDDAAPTDTEPRPHSVEMIISEHTSSCCEPFAIVAWLDWLNPQLEFGR

SEQ ID NO: 114936 - protein, 140 aa, Triticum aestivum
  unsure (1)..(140): unsure at all Xaa locations
  Clone ID: PAT_TA_9354.pep
PPPQSPPFPASISHAQRTSPPIPFWRIPPPRFSPSSQATTQFSNPQSISSSQFFGDPANLEKEGQISLQXFSGSSAISSADLFGQQANNSNADLSASDLINRISFQATQDLTSLKSMAGQTGKKLTSMASNIISDLDRIL

SEQ ID NO: 114937 - protein, 363 aa, Triticum aestivum
  unsure (1)..(363): unsure at all Xaa locations
  Clone ID: PAT_TA_9355.pep
MATDAGAADRSSVFRKLRAKSDNKMCFDCNAKNPTWASVTYGVFLCIDCSAVHRSLGVHVSFVRSTNLDSWTPEQLKMMVYGGNNRAQAFFKQHGWTDGGKIEAKYTSRAADLYRQLLLKEVSKSSTEDGNNSGLPSPVAASQTSSQAAAFPDFKLVEVPKEVVNXEPESETIRSPKAPTHSFKKPIGGKKPGSKTGGLGARKLTTKPSESLYEQKPEEPAPALPSVAESTTARSKSHTSRFEYVENVPSAGSSSAENQAFGHVAPPKSSNFFGEYGMDSGYHKKSTSGASKMQVEESSEARQKFSNAKSISSSQFFGDQANLEKEGQISLQKFSGSSAISSADLFGQQANNSNADLSASDLI

SEQ ID NO: 114938 - protein, 222 aa, Triticum aestivum
  Clone ID: PAT_TA_9356.pep
KKPLGAKKLGAKTGGLGVKKLTTKSNESLYDQKPEEPKPALPTMTTTTSAAKSGPSSHSRFQYVENETSTESKTGGGNKTGHVAAPKTSDFFHEYGMDNGFQRKTSTAASKTQIEETDEARKKFSNAKAISSSQYFGNTDREQKEAQLSLQKFSGSSSISSADLFGRDTNDSDLDASAADLINRISFQASQDLSSLKNMAGETGKKLTSFASNFITDLDRIL

SEQ ID NO: 114939 - protein, 225 aa, Triticum aestivum
  unsure (1)..(225): unsure at all Xaa locations
  Clone ID: PAT_TA_9357.pep
MQASPPLSGSLRPCPSLLLPSPPLSYFLLPSPSLLLFPLNSEAARARARSAWWLARDGDPTPGAADRSSVFPKLRAKSDNKMCFDCNAKNPTWASVTYGVFLCIXCSAVHRSLGVHVSXFVRSTNLDSWTPXNSLKMMVYXGNNRAXTFFKQHGXTDDGKIVSXQYTSERMLNYTAQDASTKEVSKSSTEXGNNSGPPSPVAASQXSSQASASPAYKLAEVPKAS

SEQ ID NO: 114940 - protein, 149 aa, Triticum aestivum
  unsure (1)..(149): unsure at all Xaa locations
  Clone ID: PAT_TA_9358.pep
AFTVQSPEKLTDKIGVLETLGWSQGDVLLAVKTMPGILTISEERLQXNVHFLTKVAGLEISYIAQRPVLLKYSLERRLFPRYCLLKLLNTKGLLDLRFDYNAASLSEKKFLGRFVHPYKERLPGLADVYASSCAGKLHMELLSENTKQN

SEQ ID NO: 114941 - protein, 252 aa, Triticum aestivum
  unsure (1)..(252): unsure at all Xaa locations
  Clone ID: PAT_TA_9359.pep
IPLGFGTQEPRGKVCRLKXSKYGLNRSHRAXWFGRLRKEIGSIGYRQSNADPTLFFKYQSGKIVTLIVYVDDNVIPGNDDDGIAFLKKMLDEEFEVKDLGFLHYFLGIEVAYGSQGIYLSQRKYVLDLLAETGMLNCRPTTTPIEQNHRIRADSGDPVDKHQYQRLVXRLIYLSHTRPNIAYAVSLGSKFMHDPEXSHLDVVHKNTKDILKGCXGKRGFYFXNQXHLKVXGFTDADWGXXCLNXRKATSGXX

SEQ ID NO: 114942 - protein, 145 aa, Triticum aestivum
  unsure (1)..(145): unsure at all Xaa locations
  Clone ID: PAT_TA_9360.pep
XDRPASRQTGRXTRAXQPREPGPPAHPTTATRAFAPPLGFHAAVTAPNGSHVQLKCACSPSAGRARGQAPPPRRHGRASRGSGARTADPELVDLLCASSSGSSRRAAPTTGSAPPPPSSGPARLRRRAPSGGSETGGGRGERWRR

SEQ ID NO: 114943 - protein, 124 aa, Triticum aestivum
  Clone ID: PAT_TA_9361.pep
ECLLCGWGTVLVALPRRDKLMGGFIYFCARPPACVSLPPAWLPSRLAKAFSSRVQLQKPVVNRCSSWHLHGLSVLQSSVLSTELIKVLRQTCPESSTPVGQLLLLVVPQVVTKIAPPLPKARLL

SEQ ID NO: 114944 - protein, 87 aa, Triticum aestivum
  Clone ID: PAT_TA_9362.pep
SEKHHIHLSPQPPGWRRRRIRRREGDHVMGKGKEPAKDAPNKTKAASTSTQLTKPPSFKKNKVQSRNNPMLTQKNRKPPPKSKRPKG

SEQ ID NO: 114945 - protein, 92 aa, Triticum aestivum
  unsure (1)..(92): unsure at all Xaa locations
  Clone ID: PAT_TA_9363.pep
TSVLDTNTLNFAMVGRHQRYVDGQLFSPFWRLHHFVFFWLQFTYLLVSQNPVILLLFLLLLFPLHLLLLLLPLPLLPLLLLLLLLXLTXFXX

SEQ ID NO: 114946 - protein, 42 aa, Triticum aestivum
  unsure (1)..(42): unsure at all Xaa locations
  Clone ID: PAT_TA_9364.pep
CRKSTSIMRNRDCCEFVDSKVXTGPELLCSYIDHRLISYXAD

SEQ ID NO: 114947 - protein, 166 aa, Triticum aestivum
  Clone ID: PAT_TA_9365.pep
VSSGHRLPVAPHASGDSSPPAAAIANYAGRFRRLSAALSTHPCSLRYAPSSPPSRFVAPLPSSVARLGFRPPHLRPPEPLPPPSPAGGRPSPPLPSSGEEMRGEERRGRSSRAGHGAGQNRAGTGLDQARVVRTPTPWSCSLGLLQVGRQVHSLSITSSAMDQLKI

SEQ ID NO: 114948 - protein, 162 aa, Triticum aestivum
  unsure (1)..(162): unsure at all Xaa locations
  Clone ID: PAT_TA_9366.pep
MTESEIKQNTAAETLNPSSALFSSVSRTLSGSPLRSHLLEPTPTLLPPPPPPPPATDSVTTAGATLSAAGLASVAAGSSAERSFAMVRADSFCGDPVGDSAMTASFCGVGGITASFWVSARASAMFSDSPGTSSASCTGLASXTPVLVEMVLLEREREREEK

SEQ ID NO: 114949 - protein, 201 aa, Triticum aestivum
  unsure (1)..(201): unsure at all Xaa locations
  Clone ID: PAT_TA_9367.pep
METREIVTSETTQCAASDEVQSTISASDAVGTLDDKVDSDGEDIIDHHVDESRITEVELWQQLENELYRKREGENNIVEEMTESNIAEEVGGRAQDVLSEPNEKEVHRFYPPGKIMHVITSTREAAIDDDTRPXEHEDEEPDLHQVDAAGESETSIGIFLTPRSLYGKLRLSKMMINDHYMPMYRRNIEQLVAELEKDLAL

SEQ ID NO: 114950 - protein, 148 aa, Triticum aestivum
  Clone ID: PAT_TA_9368.pep
NCIWGGIWRKLLDQSVRTSPLGKDRYYNRYWFFRREGRLFVESADSKEWGYYSTKEELDALIGSLNIKGIRERALKQQLDKFYNKISNAVEKRLKEVTHQLLVEEAVLRRSSRVHAHPKDSPSTSFLEYVNTWKPIQKRNRSKEDRAT

SEQ ID NO: 114951 - protein, 179 aa, Triticum aestivum
  unsure (1)..(179): unsure at all Xaa locations
  Clone ID: PAT_TA_9369.pep
RHEGHLGSNFVPELLGHFLATENFYFTSKFFGLDRSSSLSDFVVAGEQLCNKDLSTLRQTYLNHSDEDFSRYCFSSAYIVALLHDNLGVPLDDKRIEYSNQVGDTHIEWALGAFIANTKHRILGASGAAATRAPKHXQVLAVLGAFLACGVFLGLRWRKPKTKIIYDLEKGRYIMTRIS

SEQ ID NO: 114952 - protein, 99 aa, Triticum aestivum
  Clone ID: PAT_TA_9370.pep
KDDNGESSGEASTPKSSNGTGQEEKTEAGDSCKESDLSLVSRPSVQEEDLSWEEIEDVGDQDEKKAGSPRSSPSSKVEDIRKRLNSVEDDEDLSWDVDE

SEQ ID NO: 114953 - protein, 177 aa, Triticum aestivum
  Clone ID: PAT_TA_9371.pep
MGAMAMGLGRFTHWLWPGNAARVGNHELPGIALTGASFPEFPSGFREADAIAFSSAAAGRRTRPRRVKNQRRSRGEPRIDREYDMVIVPSDGGGCLSGSESDDSDWSIGWLEPQAPEMQTDGDQETSFAVLVPCYRRGRAEQPMMPQGRFLGAGPLADGGPSDGKNFVEQWLSSLQN

SEQ ID NO: 114954 - protein, 126 aa, Triticum aestivum
  Clone ID: PAT_TA_9372.pep
QVSKAELLVGSNGLQLQGQKWPTIKEAFTIVLAAGLLGVVWCGVKHEKQAGTCDDAEAPSLLSSVAPFSLVPLPDCADEQIHMVTASARMVPAQAAAAAAAYSSENATGVKEIEDCLNFLHSRVSV

SEQ ID NO: 114955 - protein, 94 aa, Triticum aestivum
  Clone ID: PAT_TA_9373.pep
CIYEQDPVYLTKVESWLEDLLWEKKSNMDIYRCKGILNIHDSNQLHTLQAVREVYEVVPAREWSETQSRMNKIVFIGRDLDISILQDSFSRCKH

SEQ ID NO: 114956 - protein, 183 aa, Triticum aestivum
  unsure (1)..(183): unsure at all Xaa locations
  Clone ID: PAT_TA_9374.pep
KSRKAAKNPKVFFDISSSTSKAGRASMELYAGKVPRTAANFRQLCTGESGLGSSGKPLQYKGSAFHRIIPGFMCQGGDFTRGNGTGGESVYGAKFADENFLLRHTGPGVLSMAHAGPGSQXGPQFFICTXQPPWLDGKHVVFGQVGAGYGVVARSGEDGSGRPAASPPRRARRHRGLGPADHS

SEQ ID NO: 114957 - protein, 54 aa, Triticum aestivum
  unsure (1)..(54): unsure at all Xaa locations
  Clone ID: PAT_TA_9375.pep
APKYNHLRHLDTMKQKHLTASKGRSLLFRMSDELITATPCPLNRLETECPSCVX

SEQ ID NO: 114958 - protein, 227 aa, Triticum aestivum
  unsure (1)..(227): unsure at all Xaa locations
  Clone ID: PAT_TA_9376.pep
XYLDFVFGWILEPLVSGDYPDVMRKNVGSRLPSFTKSQSQVVKGAVDFIGINHYYSMYVNDRPLDKGTRDYSADMSLYQRASKTIPGSSKNVPASSQSDPEGLQYVLQYLTKAYGNLPIYVQENGVASNDTLDDTERIEYLKSYMGSTLKAVRNGANVKGYFVWSFLDVFEFFAGAKSRYGLYRVDFNDEALPRQAKLSARWYSGFLKNNDTYVRNELESTGSHALQ

SEQ ID NO: 114959 - protein, 271 aa, Triticum aestivum
  Clone ID: PAT_TA_9377.pep
PTRPTVLSSRVCIITAEMWCLFKKSKYSSTKLKNLGYLPQLEYVQKFWKLCEQQLNISDDTEDEDANEEYIEDTNRDAVMIAAAKLLLADTVSKDYLGPEIVSHYVSHGASTTEIIKHLITALKKNANSDIAALFFEALRRVYERYMAYLREGENQNLIAKSYSECQDLANRLAGYYVGAVRIKNKSEILKIIQCGVQFAFVDLPKQLSFLEAALVPFVSKLPSSDIPDILTDVQKRAQDIDMNEDPSAWRPYLTFVEHLREKHARNEVFH

SEQ ID NO: 114960 - protein, 421 aa, Triticum aestivum
  unsure (1)..(421): unsure at all Xaa locations
  Clone ID: PAT_TA_9378.pep
ELSAEFWDRIELAAAAMAAMALFSLLFLSAAAPPALGFTRSDFPPEFVFGAATSAYQYEGAVAEDGRSPSVWDTFTQAGKMSDKSTGDVAADGYHKYKDDVKLMVDTNLEAYRFSISWSRLIPNGRGAVNPKGLEYYNNLINELVQHGIQVHVMLSHLDFPQVLDDEYGGWLSPKIVEDFTAFADVCFREFGDRVSYWTTIDEPNVSALGSYDNALFAPGRCSNPFGITNCTXVGNSTVEPYIAAHNMILAHASATRLYREKYQAAQKGGVGINVYSSWSYPMTNSDVDVEAAKRYLDFVFGWILEPLVSGDYPDVMKKNVGSRLPSFTKSQSQVVKGTVDFIGINHYYSMYVNDRPLDKGTRDYSADMSLYQRASKTIPGSSKNVPSSSQSDPEGLQYVLQYLTKAYGKLRTYVQENGLS

SEQ ID NO: 114961 - protein, 212 aa, Triticum aestivum
  unsure (1)..(212): unsure at all Xaa locations
  Clone ID: PAT_TA_9379.pep
LAAARRVAVALICGALAAVWCHRALAAGAAAAGAGAGASTAVEAADVVGWVALRLRGSWPTVLQVLQLLKEQGLILALLLGLSAFFSMAETSITTLWPWKVRELADKEPENGVFKMLRNDVTRFLTTILIGTTVVNIGATAIVTEAATAMFGEAGVSAATGVMTVAVLLLTEITPKNVAVHNATEVARFVVRPIAWLSIILYPVXRIGTIIS

SEQ ID NO: 114962 - protein, 133 aa, Triticum aestivum
  unsure (1)..(133): unsure at all Xaa locations
  Clone ID: PAT_TA_9380.pep
QLSAFSKVTKSCXTRSPREIQSQQSNIGRNRVKVQMHGNAVGRAVDLASLDGYEGLTSELEQMFEIKDIKQNFKVAFTDNEGDTMKVGDDPWMEFCRMVRKIVIYPIEDDKNMDPRQRSVLAAAPDPDPKANL

SEQ ID NO: 114963 - protein, 193 aa, Triticum aestivum
  Clone ID: PAT_TA_9381.pep
LLDSLSGRLARNVLQTGPVFPNGKKRRLDFGAVAYVTQENVLLGTLTVRETVTYSAQLRLPSSMSKAEVRRVVDDTLDEMGLRECAERPIGTWHLRGISGGEKKRLCIALEILTRPRLLFLDEPTSGLDSASAFSVIETLRTLAIDGGRTIVSSVHQPISEVFALFDDLCLLSSGESVYFGDAKLAPQFFAET

SEQ ID NO: 114964 - protein, 109 aa, Triticum aestivum
  Clone ID: PAT_TA_9382.pep
MQQMATTVTLLLGAASSPGPAAGDGAARDGFQCSRLLPKKKQQRPRWVLCSLKYGCLGVGEPGEAGGRSAASPVYSSLTVSPGGDAAVAVVSSEQKVYDVVVKQAALLK

SEQ ID NO: 114965 - protein, 141 aa, Triticum aestivum
  Clone ID: PAT_TA_9383.pep
RQSFAQTVENVFALSFLVKDGRVAINIDDNGHHIVYPRNAPAASAIASGEVSYSHFVFRYDYRDWKLMKEVVPEGQELMPHRTAHSLSAEEREQMEPCAQRTPIRKLCRNRGLVLQEQMVVAETPEEDRSSKRKRLFIDQE

SEQ ID NO: 114966 - protein, 90 aa, Triticum aestivum
  Clone ID: PAT_TA_9384.pep
MLELRLVQGSLLKKVLEAIKELVTDANFDCSGTGFSLQAMDSSHVALVALLLRSEGFEHYRCDRNLFMGMNLGNMAKMLRCAGNDDIITI

SEQ ID NO: 114967 - protein, 263 aa, Triticum aestivum
  unsure (1)..(263): unsure at all Xaa locations
  Clone ID: PAT_TA_9385.pep
MLELRLVQGSLLKKVLEAIKELVTDANFDCSGTGFSLQAMDSSHVALVALLLRSEGFEHYRCDRNLSMGMNLGNMAKMLRCAGNDDIITIKADDGSDTVTFMFESPNQDKIADFEMKLMDIDTARCGSPASXSEHLGIPDSEYQAIVRMPSSEFSRICKDLSSIGDTVIISVTKXEGVKFSSWLEDIGNXATLICHXNCNVPVPLAFALRCMASCPKACPLPDRVSISLSSELPVVVEYKIGXMGYIRFYLXPKIEEDEEMKA

SEQ ID NO: 114968 - protein, 82 aa, Triticum aestivum
  unsure (1)..(82): unsure at all Xaa locations
  Clone ID: PAT_TA_9386.pep
SGCLHMLSLAAKRAIRDNPFWEEDNPTRSASLRCAEPDYRAIRDGPDSIALYFSKKKKTXDKXLTDYXCXXFXFXNEXFXFC

SEQ ID NO: 114969 - protein, 99 aa, Triticum aestivum
  Clone ID: PAT_TA_9387.pep
VPGPRAVDRRPDLVVPTTGGSETNAPRSSGLGSRSRRLRKGRSGPASGDRMARIIEMGDGKEKAEDSAPPPYLFECEKLDEDSPLLDEEDGDEDMIFDF

SEQ ID NO: 114970 - protein, 127 aa, Triticum aestivum
  Clone ID: PAT_TA_9388.pep
GDRGATERRHRLKPDATSSVDAMGLTFPALSLGASRPRPDAALPPCLTLMPSCSPPSSMIGAPSASRAPKLPPSLGLVANANPPRQAPDLELKISSTAARKTDQQAGAAAGSSPSPRTPFFGTIRVT

SEQ ID NO: 114971 - protein, 318 aa, Triticum aestivum
  Clone ID: PAT_TA_9389.pep
FVALCVLLWWPSFDVILVDQVSVVIPLLKLKASSKTIFYCHFPDMLLAQHTTLLRRLYRKPIDMIEEATTGMADLILVNSKFTEATFARTFCGLHARGIEPGVLYPAVSVEQFHEPHDYKLNFLSINRFERKKNLGLAISAFALLRSVVSKQPGDALREASLTVAGGYDKRLKENVEYLEELKRLAATEGVSEHVKFVTSCSSSERNELLSNCLCVLYTPKDEHFGIVPLEAMAAYKPVIACNSGGPVETVVNEATGFLCDPSPIEFSKAMVKFVGDHDLAVRMGKQARDRVVQKFSTKTFGDLLNSYVLNVYHQRME

SEQ ID NO: 114972 - protein, 104 aa, Triticum aestivum
  Clone ID: PAT_TA_9390.pep
VAGYRLIPYFIFDPRGGGRGTLFAASDPQVPEYCETLKSEDWPVCACINYDCNPMNASEEAHNLETSQLVWEKTLEMIGLPSDALEKLIEGEPVQCRYGQQKAE

SEQ ID NO: 114973 - protein, 160 aa, Triticum aestivum
  unsure (1)..(160): unsure at all Xaa locations
  Clone ID: PAT_TA_9391.pep
FFAGDXSGGSTQMNVNYYPPCPDPSLTLGLLPHCDRHLLTVLSQGDVAGLQARHGGRWLLVRPVPGAFVVNLGHQMEIITNGLLASVEHRAVTNTDAVRLSVVTLIMPKMECRIGPAPEMVNEATGPAKFKEFEFSEFIKAYSAAAASREDVLHYFRIHR

SEQ ID NO: 114974 - protein, 64 aa, Triticum aestivum
  unsure (1)..(64): unsure at all Xaa locations
  Clone ID: PAT_TA_9392.pep
KHTFFTHLQNSNLNVXEXTCTDSSQKPANSGYTCGDGPHVFGDSCDLNCNKGYYIXGRGNATLX

SEQ ID NO: 114975 - protein, 135 aa, Triticum aestivum
  Clone ID: PAT_TA_9393.pep
CGALMVSWMTPIVQAGSLYGSTGRMMCFSLETTLGSHLSIVYGTSRYFHQRMCTSWASKEMIHVTFPKCKIIVLFLGPARIRQHMVAPLLTAAQHPRNLPSSHLRTCLLCVLRARLESSPSVTYLRPVQATDTMN

SEQ ID NO: 114976 - protein, 160 aa, Triticum aestivum
  Clone ID: PAT_TA_9394.pep
EMVSASQDIIPGTEEMVVSKLYEDGIVYTLHRDVALHISRNIEGRVKKALERASLLTKDWNEELFWVVHPGGREILDKVESSLVLRKEKMDVSRKVMAQHGNTLSSCVIVVMDEMRKRSRKRGLPTAGEGLEWGLLFSFGPGLTVETILLRALHNQEPNA

SEQ ID NO: 114977 - protein, 474 aa, Triticum aestivum
  Clone ID: PAT_TA_9395.pep
MAARRYTEHEEALEIKSLRRIIAAYINYQDAAEKDVKRYERSFKKLSPAHKELLFHLGLKYQRLRWCISMNTSFIMNMLEAFEPPFDMSQCVDGDCHDCAEHMHGHSHADTINNSELLAQHCCPEEGANTRETENKKDEEVHMVGCSQPAACNLGISQGEDKSCNDGKDASAAANCQDTDCFASSTDENITPGHRRAPSLPLDVPPVDVDKVRCIIRNIVRDWAQEGQIERDECYKPILEELNRLFPDRSRPPSCLVPGAGLGRLALEISSLGFVSQGNEFSYYMMICSSFILNHTQEANEWTIYPWIHNNCNSLSDKDQLRAVSFPDIHPSSAGITEGFSMCAGDFVEVYNEESQESAWDAVVTCFFLDTAHNIVEYIEIISKILKDGGVWVNMGPLLYHFADAYGPDDDMSIELSLEDVKRVAYHYGFVMEVEKMIDTTYTANMVSMMQNRYRAAFWTMRKDASRSKAKKRQ

SEQ ID NO: 114978 - protein, 249 aa, Triticum aestivum
  unsure (1)..(249): unsure at all Xaa locations
  Clone ID: PAT_TA_9396.pep
NESLDRHLFGKDIGKSLAWSERFKIALGTARGLAYLHHECLEWVIHCDVKPENILLTRDLDAKIADFGLAKLSGRNATGNGEVADTGVQLSHMRGTAGYMAPEWAMGLPVDAKVDVYSYGIVLLEIVIGSRISAQTTTDGGERLXTWQIAQALKQVVASGRHHVIKWDSRLNGQFNPPGRPWEWVKISLLXAGGRRDNRPTMDDISKAPKAXDDEDEHPAYLSCIGSHARSTPPTARQVARCSRYIVVA

SEQ ID NO: 114979 - protein, 127 aa, Triticum aestivum
  Clone ID: PAT_TA_9397.pep
RPRSVLFSSSSIRNFPHRRRLGHILPPPATTEHAPSAAGRPNQEQPRGLLRVRRIVCSEPAEAVGIPMGAETNLSSPQLDPTKSRESVTLLNDDQGSVYVAECDKSLEPAIGMVVDKWETGEMFYTR

SEQ ID NO: 114980 - protein, 366 aa, Triticum aestivum
  Clone ID: PAT_TA_9398.pep
FQKQHSQLPSQEHVAESASGQTLQQLDVSSSNNLVDVTPFKGLSITATSSSSQRDTIWVRYQCDWGLTFYTRIDLHGYFHTYPHVDGPFQSLEQVNNAIDRYLHDRRDPIMCEERPEFYEVGKASVERGIRDSLFWPDGSKKMYVKSEPVDESRCWMLQLVQALVDKYNEDHNLFKDLAFEVKDVVCREVIYEGNCLYYHINFTTRTKGAKTADNLFFSEVKRMPGEDKKLVVSCTCMVDPSDNGQCYGCESNMKHPNADAYAGGHSKVCNLKGECLGPNIAVAETMDDWKAEEARVRQMFKGLDDPTVVARLMEPPKLNFGATKATDEEVERFMNSIMGPCDPNLCPTYGILDASAVERFRVALM

SEQ ID NO: 114981 - protein, 149 aa, Triticum aestivum
  Clone ID: PAT_TA_9399.pep
GEQEMDQKGIFSERMAVTVCPSESLIVASNAKCGASSCGSTMLLPPHDTEKHSKYLQFVVASNSRHRMDGGMRQDQRLNSGGFSYDGGAIVPEQTDMYDLGVPKLQGGFNSSSCNFDGLLNSMIKVESDEVPFTENDLGCELFPLGACI

SEQ ID NO: 114982 - protein, 422 aa, Triticum aestivum
  unsure (1)..(422): unsure at all Xaa locations
  Clone ID: PAT_TA_9400.pep
MSWLEMWLPAAAEGAAAGLFLDAGDAAAHGALLAAMPGCSASFGVPRRRRGRAPPGFLSMTMSVKGGRGSAPAPGGLLPGGVRAGGGGPVAGGRAAGCRAPGVLVAEAHGKLTEEEAHSGAGAMNTTKHLWSGAVAAMVSRTVVAPLERLKLEYIVRGEQRNLFELIQAIATTEGLKGFWKGNLVNILRTAPFKAVNFYAYDSYRKQLLKWSGNEETTNLERFIAGASAGVTATIMCIPMDTIRTKMVARXAGGEALGGVIGVARHMIQTEGLFSLYKGLVPSLISMAPSGAVFYGVYDILKMAYLHSPEGKRRISMMKQQGQEANALDQLELGTVRTLLYGAIAGCCAEAATYPFEVVRRQLQLQVKATKMNALATCLKIVDKGGVPALYVGLIPSLLQVLPSASISYFVYELMKIVLKVE

SEQ ID NO: 114983 - protein, 204 aa, Triticum aestivum
  Clone ID: PAT_TA_9401.pep
SQNKAAGSGAAKNPDDAYTSGKLEWAREDGFKEIRRSWIDLKRESQSWFLNFLEDALASGSQNEGGGRGSARDREGGQTGGGDGRAGEGGSQEKGRRRRDEQREPQSWLLNFEEDALASGFKFESRGTSRPGAGERGASAGGGGQGGGRQPPRAGPGSWLAWLGRSTRAALLYRTLEDPEGQEQGADACLLGTDGTAAPAEQED

SEQ ID NO: 114984 - protein, 216 aa, Triticum aestivum
  unsure (1)..(216): unsure at all Xaa locations
  Clone ID: PAT_TA_9402.pep
ISAPSADAPMLTVGVNEKNYNPSMDVVSNASCTTNSLAPIAMQTTLVVTILQGLMTPMLATTATQXFMKLVSWYDLEWRNSNCVKHLXRALGSCRLTMMXLLALNGKLTGMAFQVPTPNGWVVDLTCRLEKQAAYEDVKAAIKEASEGSLKGILGYTDEDVVSNDFXGDXRSSIFDANAGMGLSSSFMKLVSWXYDNEWGYSNRVLDLIGHMSLVA

SEQ ID NO: 114985 - protein, 237 aa, Triticum aestivum
  unsure (1)..(237): unsure at all Xaa locations
  Clone ID: PAT_TA_9403.pep
FVPPCIFPQETSKCLRYGRVQVGTEHNELGGAHAAKARHRAAREHNMHAHRKAAPPGRRPQGARGARSPARMCRHLRPLTWAKKKAARVPDGDRGRVQLARNMALAAQEETLQKQMMYHKLGAKCWQGEGTGXEVSCIHRLDHLKTVYMSGFRCYRAQVELLCCILEKSPALEHVAIEPQVTLECAPVLNMGMPESEIRQWARVTSERFGKAITVPSHRPLGDCYRKRRSAAITSCL

SEQ ID NO: 114986 - protein, 230 aa, Triticum aestivum
  unsure (1)..(230): unsure at all Xaa locations
  Clone ID: PAT_TA_9404.pep
SCSTPSLGAPLPSPRRAPPPATTLTSPPPAPSRGDGAXPPVPPLPPPPLLPSPPHPTTPPTRPPFPSPPPHPLRLPRVPLPTPDLSLASSHLHLVRNRRRRAGCCSYGGHRLGEGRPVAVGSDPRRGGVSKAAEWRDSGSMDPTPDAASPCCPDLDDGEPRLPTGGGRRSRGEDGGAWSDPGGSGRDGSISGGFGLEAAGSGEIEGRWRHGPPGDPCSPRKRDRGERRSR

SEQ ID NO: 114987 - protein, 67 aa, Triticum aestivum
  Clone ID: PAT_TA_9405.pep
LPRHGSGDAQCQVLAGSAGARVRVDRGKLWRRPHGARRILQSDEEATSCSCHASHVHAANVIIREFV

SEQ ID NO: 114988 - protein, 58 aa, Triticum aestivum
  unsure (1)..(58): unsure at all Xaa locations
  Clone ID: PAT_TA_9406.pep
STCCMCFIIAIREAKAAPPLDLYILLKDRTGRSSPITRXXFLDALVGXCAXCVAAVSP

SEQ ID NO: 114989 - protein, 107 aa, Triticum aestivum
  unsure (1)..(107): unsure at all Xaa locations
  Clone ID: PAT_TA_9407.pep
PTTQXCRRILCLFSGGPPSHLRPPAWKLRHGACCHQRPKGATASTSGATAAGTPAGWPPVESRPGATSPAGWLPSRPDRGPRHPWDGFPLNHDGALCRRPYLSPVRG

SEQ ID NO: 114990 - protein, 106 aa, Triticum aestivum
  Clone ID: PAT_TA_9408.pep
QFQPHGRLSPERPELPLAVVDHILLNPNAPPARAHVSLGCPPARLLPRGPASRAGSHGELPREHPDYICEAMGVLFSCNDERNMTRQPIVPCEHNPLGQAGQDRKI

SEQ ID NO: 114991 - protein, 183 aa, Triticum aestivum
  Clone ID: PAT_TA_9409.pep
HCWWILFLSGRTGAQPHLLTSNFTRRCSCRGLSGLALCRSNLLSSSVPTPLLLVPPIFPSPSDLSLIPCHIFFLVDPFSSAVLLWPSRSLVVLEGRVSSIKRELARPDADEPGEKSVNQVTQLSSRAIAPDPGIELTMQALSISEPAIVYIQAEQRLEEGQDADFNFLMKLASTRGPIRVLSG

SEQ ID NO: 114992 - protein, 462 aa, Triticum aestivum
  unsure (1)..(462): unsure at all Xaa locations
  Clone ID: PAT_TA_9410.pep
QEGSSCRGLSELSLCRPNRRILSFVGGIDLCDGRYDTQYHSLFRTLDTVHHDDFHQPNFATASITKGGPREPWHDIHSRLEGPIAWDVLYNFEQRWRKQGGKDLLVQLRDLSDIIIPPSPVMFPEDRDTWNVQLFRSIDGGAAFGFPDTPEEAARAGLVSGKDQIIDRSIQDAYINAIRRAKDFIYIENQYFLGSSYCWKPEGIKPEEIGALHVIPKELSLKIVSKIEAGERFTVYVVVPMWPEGMPESASVQAILDWQRRTMEMMYTDITQALEAKGIEANPKEYLTFFCLGNREVKQDGEYEPQEQPEPDTDYVRAQEARRFMIYVHTKMMIVDDEYIIIGSANINQRSMDGARDSEIAMGAYQPYHLANREPARGQIHGFRMALWYEHLGMLDDVFQRPESVDCVQKVNRIADKYWDMYSSDDLEQDXPGHLLSYPIGVASDGXVVTELAGMEFFPDTR

SEQ ID NO: 114993 - protein, 794 aa, Triticum aestivum
  unsure (1)..(794): unsure at all Xaa locations
  Clone ID: PAT_TA_9411.pep
MAQILLHGNLHVTIFEASSLSHPGRASGGAPKFIRKFVEGIEETVGVGKGSSKLYATIDLEKARVGQDSMCGXLGAKPGLLAEYDTHLRQQPCPVRRTMWHADPLGATLIGRAYLPVGELLEGEEIDRWLEICDDNREXFGESKIHVKLQYFGVDKDRNWARGVRSVKFPGVPYTFFSQRQGCNVRLYQDAHVPDNFIPKIPLADGKNYEPARCWEDIFDAISNAQHLIYITGWSVHTEITLCRDTXRPKPGIDVPHGELIKLLLRDCVRVVMLVWDDRTSVGLLKRDGLMATHDEETANYFQGTDVHCVLCPRNPDDSGSIVQYLQISTMFTHHQKIVCVDDALPSQGSEQRRTLSCVGGIDLCDGRYDTQHRSLXTTLDSVHRADVHQPNFATFIPNMVIADDAYIGIGSANINQRSMDGARDSEIAMGAYQPNHLADRQRSPGPDQRPFXARVVRAPGHAGRRVPNARRASIALGTCTGKGRLMSRTIQATYRNTLRASKNFIYIEKEYFGGGFHSXQPGARILQQPGRQHVSPQSLXTEIRSHPAFPVCGLSLVVSFSDSEVVPQKTSXAVIVGVQIXTLEWAWMRITVVTEENXGTLHGFCCLYHRLIIHYGEDEPQEQAYPXSDNDRAQVVRRFMIYVHTKMMIVDDEYIIIGSANINQRSMDGARDSEIAMGAYQPYHLANREPARGQIHGFRMALWYEHLGMLDDVFQRPESVECVQKVNRIADKYWDIYSSDDLEQDLPGHLLSYPIGVASDGVVTELPGMEFFPDTRARILGAKSDYLPPILTT

SEQ ID NO: 114994 - protein, 183 aa, Triticum aestivum
  Clone ID: PAT_TA_9412.pep
MIEGAGFGGLLRLQCPTVPARLSTWLLRRFVTDSSELVTSGRGRIPVTVDSVHRVLGIPKTGRDVVYGLDDESIASVLDKHGVDRPPSMASLEKSIKLMKSADEHFLRTFVMLVLSSFLCPTSSLKVSPRCFPALVNIGSIRELNWCKFVVEQLEKCVSSLGKKNSARGCLFYLVILYLDSLD

SEQ ID NO: 114995 - protein, 393 aa, Triticum aestivum
  Clone ID: PAT_TA_9413.pep
MASDDSSSSHPTEKKEEASAAAAAGGAGFDDLEDPRFQCCVCLELLYKPVVIACGHMSCFWCVHKAMHYARESHCAICRQPYTHFPSICQLLHHLLLKLEPVEYKKREMEVLEQERSVDTFSPQIIEFLNSKNNNGENGKDWGNKLEDGKTGPPGEVSVDDSTMNEHSMKIKLDDVSCPICKELLYQPTVLNCGHVYCISCLPSVGDEALKCQVCGGLHPGDFPNVCLDLDHFLEEYFPAEYESRRKKLQLENSQCNPEGSSSSTSCKKGTFVQKTLDLSNVHIGVGCDSCGVYPIRGKRYKCKDCTEAIGFDLCGECYDNTSKLPGRFNQQHTPDHRMELDNSSLFDAFLRFQGIPAEGLQQLVQQMELIGAGGMVQIVADDEEMEDNHEDA

SEQ ID NO: 114996 - protein, 186 aa, Triticum aestivum
  Clone ID: PAT_TA_9414.pep
LPPAALQTLGPASILLFVPIYDRVLVSALQRTTGTQSGLTLLQRVGTGMALTLASMSVAALVEARRLETAREHGIVDDPEATVPMCWAWLVPQYVLIGVAGVFAEVGMQEFFYYSVIGMGNFISGTLVSLIDRITSSGGGYSWFADNLNRAHLDYFYWLLAGFSAAQLALYLRCASTYVYSHKRLR

SEQ ID NO: 114997 - protein, 277 aa, Triticum aestivum
  unsure (1)..(277): unsure at all Xaa locations
  Clone ID: PAT_TA_9415.pep
MEGLSWTRACVLVLCIMPFLHQAAAIRFVIDREECFSHNVEYEGDTVHVSFVVIKADTPWHYSEDGVDLVVKDSNGAQVRDSRDKTSDKFEFIVQKRGVHRFCFTNKSPYHETIDFDVHVGHYSYFDQHAKDEHFSPLFEQIAKLDEALYNIQFEQHWLEAQTDRQAILNENMSRRAIHKALFESXALIAASVIQVYLLRRLFGAQAGGHLGSNAPVRRRCLVAPLETVTLNCAPSLVCGFLFYICITPCDSIYEFFENDTSQFHVLTDIHIRYFAQ

SEQ ID NO: 114998 - protein, 145 aa, Triticum aestivum
  Clone ID: PAT_TA_9416.pep
PYSLSSRRPRPSTIIPDGTPQWVPDIFFDILPHLRPILKRDSVRSFLRFLNQNGRDMTLGYIIKPEALNELVIANALRCAKVVLVGKNAELHGFRADPNCMTQFGFFPLHLAAEMFSVDMIELLLHHGTSANLHTSGALIIDNLL

SEQ ID NO: 114999 - protein, 87 aa, Triticum aestivum
  Clone ID: PAT_TA_9417.pep
ELHVATEEESNTMAKCSCLLECHCLSWQEWKHSGNISKSNTCRRRAFNISDTGTTIAHGYCKRAYLDLVVVVVVGGGGHVCRALSDG

SEQ ID NO: 115000 - protein, 388 aa, Triticum aestivum
  Clone ID: PAT_TA_9418.pep
MSSSADPSVHTNYSAGSPRLKACVSDMSVGNSRFFTYQEMYQITDGFSPRNLLGEGGFGSVYKGRLPEGKDVAVKQLRDGSGQGEREFQAEVEIISRVHHRHLVSLVGYCIANSQRLLVYDFVSNDTLHYHLHGQGRPVLEWSARVKIAAGAARGIAYLHEDCHPRIIHRDIKSSNILLDNNFDALVADFGLARLALDAVTHVTTRVMGTFGYMAPEYASSGKLTEKSDVFSFGVVLLELMTGRKPVDSSRPLGDESLVEWARPLLSRALETGKLEGLVDPRLERNFNEVEMFRMIESAAACIRHSSSKRPRMSQVVRVLDSLADIDLTNGVQPGQSELFNVANTADIRMFQQMVQGNQDDSSAFSQYSWISRSRADAEATSSNSRIL

SEQ ID NO: 115001 - protein, 384 aa, Triticum aestivum
  unsure (1)..(384): unsure at all Xaa locations
  Clone ID: PAT_TA_9419.pep
FYYLRSHKRKELKQTQGKNVVNNVHKPVEHNPLGKDDTNRISKVIGKAADLAGSAKGKKSLHTVYIPTITNYTQVWWVPNVVVAHEKEGIEAIHLASGRTLCKLHLTEGGLHADINGDGVLDHVQVVGGNGAEQTVVSGSMEVMKPCWAVATSGVPVREQLFNVSICHYNHLNLFHHGDFSRSFGRSFDPSGLEVATPVLLQRDDGHKHRKXGSHGDIIFLTSRGEVTSYTPGLLGHDAMWRWQLSTGATWSNLPSPSGMMENVVVPTLKTFSLRAYDQKQVIIAGGDQEAVVISPDGSLLTSIDLPAPPTHAVILEDFSGDGLTDIILVTSGGVYGFVQTRQPGALFFSTLVGFLIVVIGVIFVSLHLNSSNGGKPRSSTSHR

SEQ ID NO: 115002 - protein, 296 aa, Triticum aestivum
  Clone ID: PAT_TA_9420.pep
FMYVRPPGYNPESAKAAEIQDEKKKLDQGDAAEDAVAANTSSMPDASAEKKKSRPKDVFGRSLPTEQEFEVLKNAPRLDTGAPARPKPFGVEVRNVRCLRCGNFGHQSGDRECPMKDIIMPNEESRLKRDDPLTAIKAQTDSSEPLKWELKQKPGMSPPRGGYNPDDPNQQIVAEEIFDEYGGFLGDIDIPALLTNFSTSKSKKRSKSKSRRRQSEPAAHVESGRHRSSHHSFSDSEPEKSNRASGSKRKKKYCSDPSSYSDSEEEAGKGKAKQKSKHRHRKKHLLESSSDSEVGS

SEQ ID NO: 115003 - protein, 126 aa, Triticum aestivum
  unsure (1)..(126): unsure at all Xaa locations
  Clone ID: PAT_TA_9421.pep
KRKGKCPWPGPSTERGTMIRVYTVAQATKLHRFQXGAYPSTIYSLAFRPCIAQPDVFAARSSSGSLHMFFLDTTRNGGLATRASRLVIYSPCATIFFTRLEDHISSVLKLYCIDLERLQSKDANLE

SEQ ID NO: 115004 - protein, 153 aa, Triticum aestivum
  Clone ID: PAT_TA_9422.pep
RKSAYTPSPRQSHGQGEESWSPSAAAPLQMFFLVKRDAVFSASGVAAATKAGRSKASFICGRGDGEAGRRAIDPHSVLVQCQPKNRRGRAAWCQLAEEDGDVAGDASGRRGRGDGFVLGVGIWGGDDKTDGGEEEGRSGSERRVRAPPSPSRT

SEQ ID NO: 115005 - protein, 241 aa, Triticum aestivum
  unsure (1)..(241): unsure at all Xaa locations
  Clone ID: PAT_TA_9423.pep
SRVGSFQKGFFRTFLSLVRWPSTASGSYYGVPRARSGREGQRRPRRDVGRAWRRGGGRGWGGASSPGADAGAGGLGGXAGQRSLPTPFLTKTYQLVEDPAVDDVISWGEDGSTFVVWRPAEFARDLLPKYFKHNNFSSFVRQLNTYGFRKIVPDRWEFANDCFRRGEKRLLCDIHRRKVVQSAGLAAAAAAAAAGAVTVATAAIPMALPVTRSGSPEPQLSFEEQVLSFNSGSVEELPLAE

SEQ ID NO: 115006 - protein, 352 aa, Triticum aestivum
  Clone ID: PAT_TA_9424.pep
PASAHASVLRTVRRDLTRYEELDKESQAQMNEELSGWKLVVGDVFREPTSSKLFCVMIGDGGQILGMAIVTIFFATFGFMSPASRGMLLTGMIFLYMLLGILAGYAAVRLWRTVKGTSEGWRSVSWSTACFFPGIVFIVLTVLNFMLWSRNSTGALPISLFFTLLSLWFCISVPLTLLGGFLGTRAEPIEFPVRTNQIPREIPSKNYSWLLIFGAGTLPFGTLFIELFFILSSIWLGRFYYVFGFLLVVLLLLVVVCAEVSVVLTYMHLCAEDWRWWWKAFFASGAVAFYVFLYSINYLVFDLRSLSGPVSATLYIGYAFIVSLAIMLATGTVGFLTSFSFVHYLFSNVKID

SEQ ID NO: 115007 - protein, 644 aa, Triticum aestivum
  unsure (1)..(644): unsure at all Xaa locations
  Clone ID: PAT_TA_9425.pep
LVLIMNSLMVILFLAGIVFVXLLRTVRRDLTRYEELDKESQAQMNEELSGWKLVVGDVFREPTSSKLFCVMIGDGVQILGMAIVTIFFATFGFMSPASRGMLLTGMIFLYMLLGILAGYAAVRLWRTVKGTSEGWRSVYWSTACFFPGIVFIGLTVLNFMLWSRNSTGALPISLFFRVAPATVPLTPTSISSHRRLNLRCQVLGRGCWELAIMAKGWIFSALLVLFLVMAPACEAFYLADSSMHSYRQGEEIGAKVKSLTCLETELPFSCCSLPHCRPKGGIKKSAGNLGEILMGEQIDNSPYRFPVNVNESLYLCTTSPLDEDDVNFLKQRSQDLYQVNMILDNLPVRGFTEQNGMTTQWTGSGVAKTPCSTTYVSIINHLKFKVLVDEYAAGKVTVVGTGEGMEVISESDTDTDAKSGYEIVGFEVAPCSGSPEPLPLAAPSGSGSGLAGAAPGASSGEENDRLRRDNARLTRELGQMKKLCNNIVSLMSKFASSQQPDGGPGSLSSVVNCSGESALAPPPPLPAGILDLMPSCSALATAAGLAVDGGPDTDARLFGVSIGLKRARDEEEDGDGEELPNGDGAGVKPEEAAERRADGGSEDRQSWPIYRPKPVYRACNGQDGAGGLPGQTRTDPTRGEWTML

SEQ ID NO: 115008 - protein, 248 aa, Triticum aestivum
  unsure (1)..(248): unsure at all Xaa locations
  Clone ID: PAT_TA_9426.pep
GACGPHASGAARVLLRRNARSRFLHFPSPTQPCTSRRRRRRRRAAVSGKMRPILMKGHERPLTFLKYNRDGDLLFSCAKDHTPTVWYADNGDRLGTYRGHNGAVWSCDVSRHSTRLITGSADQTAKLWDVKTGRELFTFRFDAPARSVDFAIGDHLAVITTDSLWGTCXTAQVKRIAEDLQDQTEESALVXPASRXRINRAVWGPGNRTIITAGEDATIRIWDSETGKLLXKESDKEAGHQKAISSLS

SEQ ID NO: 115009 - protein, 349 aa, Triticum aestivum
  unsure (1)..(349): unsure at all Xaa locations
  Clone ID: PAT_TA_9427.pep
IFPHPNPPPTLRRPGACARSGVAASRGSKGPSEFLKHNRVRELVFSCAVELSPTVWDADIGGRLRTSRGHKGAVWSCDVSRHSTRLIAGTADQTAQLWDVKRGKELFTFRFAAPARSVDLAIGDHLAXVITTDSFMXISPTAQVKRIAEDLQDQTEESSACDLRHHGGGLTGPVWGPXNRTIITAGVRMATIRIWDSETXGKLLKESDKEVGHQKAISSLSKSLDWSHFLTGSLDKSAKLWDARTLTLIKTYVTERPVNAVDISPTLDHVVIGGGQDAMNVTMTDRRAGKFEAKFFHKILEEEIGGVKGHFGPINALAFNPDGRSFSSGGEDGYVRLHHFDPEYFNIKM

SEQ ID NO: 115010 - protein, 88 aa, Triticum aestivum
  Clone ID: PAT_TA_9428.pep
RTTTWPQHAPATDPNKKLSLDFHDTTTTQAKSYRGGRETRTTGRQPGIKEKGKRNQDRAVEYLGIDMNRRNCLLCSASQTLSLSLSPR

SEQ ID NO: 115011 - protein, 400 aa, Triticum aestivum
  Clone ID: PAT_TA_9429.pep
MLLEIFGSGMRLTRNNDRVLRLLFGDRSAYASFVLASNIAVKGVNKWGRPNWLCVLPCVSNYFCTSIYATRGTIATTKGMDTSGMKGRTKQVLVGHASYPVSEADIYKKTTHRDGSIYKINYGILKLWHLTQRRPAQLEPMMFSNPTNCFPDRDRCMVHSATAMLQIFSLKLEKASTNIGLVQLYGYIAARDRYDSLLNYVFSRSRDDPIIVEQGSLIEMTGPKRGITMVAPALVEFDMRIKKGKQEDDLQLIDGAMEYHDLVTPEYPFTHRINGDCGAVDITLALVRWAFEATIDVVISKVQCGFDLSLSSCVVLRNGLHEIQLFRGSVVESCGLRRYVIAVKEDTLMHLKFKVGQNSCKNDLDHHCFFKAKKHGYDYQQIMLELASISVKVTWSNLQR

SEQ ID NO: 115012 - protein, 507 aa, Triticum aestivum
  unsure (1)..(507): unsure at all Xaa locations
  Clone ID: PAT_TA_9430.pep
SARGSLEDAKSRLEMELAKAKKEVESMNAQYTYNEKRLDSLEAAANPKDDEISRMKELDDLISTEQVALKKLEKSSSKLKDQASELQQKIENAGGQVLKDQKAKVEKIQSELDKTSSDINRHKVKITTCEKLMKKLAKGVEEAKKEMENLVAQKEKLMSVFKEIEKKAFLVQEDYKKTQEMIDTHKEELDKTKEDYNKTKKVVDELRATEVDAEYKLQDTKKLAKEWEMKVKAYKKRLADIQTNLAKHMDQLQKDAIDPEKLKETLSDEHLNEMCDLKKAMEMVALLEAQIKDSSPNLDSIAEYRTKARLYGERVDELNATTQERDDLKKLYDGLRKRRLDEFMAGFNLISLKLKEMYQMITLGGDAELELVDSLDPFSEGVVFSVRPPKKSWKNIANLSGGEKTLSSLALVFALHHYKPTPLYVMDEIDAAVVFKNLSIEGHYVKDRTKEAQFIVTSLXNNMSEXADRLVGIYETDKCNQEXTKSITINPGSFAEGTNPPTLGVRA

SEQ ID NO: 115013 - protein, 175 aa, Triticum aestivum
  Clone ID: PAT_TA_9431.pep
GSAGVVGAEAPEPTPGRRKEKQPTSGSGTAPVLEERTPSELAEAEGKLDARTRLCIRDSLLRLAQSSSQRQIAGDRTSSNKTKRDEDEVSENDASNRRKRSLVKEAETDTNPVDRIVAHLLFHRPCSTVATLAKEEIASSTLMSLEADSKMPGATPGRPSGDQQTAQEMAIQPSV

SEQ ID NO: 115014 - protein, 125 aa, Triticum aestivum
  Clone ID: PAT_TA_9432.pep
AEDIVRKWQSIKTKALGSDHSVESLQEVLATRPLKVWRDRAAEIERKGWFWDYTLSDVAIDSITVSLDGRRATVEATIEEAGQLTDAANPRNNDLYDTKYTTRYEMTFTGPGGWKITEGAVLKSS

SEQ ID NO: 115015 - protein, 578 aa, Triticum aestivum
  unsure (1)..(578): unsure at all Xaa locations
  Clone ID: PAT_TA_9433.pep
PRVRPRVRPRAPKHMTVVVMLKSMEFLVDLMRFPGQLIPFSSKAIITSHISAAGESDSADYDSCDSPLEPNSPLCSQRQEQDENNRSFKVTSLRDIMRRTSTSVHGXTSSSHSEPNVANALCGRRGRKANEHXRTASSSPDHPLSRAHGRSNLGDRQYGDGVAVSRYLSXDGASTSSARRGRPKSMSTSPEIGDDFARAVKEMSESMRKNPXSRAHNDGSPGHSNDSQRKEESVGDLNDDEVSVREPNVQEGSRRHIITQKALSLPSSPHRLGNHGSNLREPADFLTAEDLMSTWNKALQSSPFLNKPLLPFEEWHIGFSEIAVGTRVGIGFFGEVFRGIWNGTDVAIKVFLEQDLTMENMEDFCNEISILSRLRHPNVILFLGACMKPPHLSLVTEYMEMGSLYYLIHTSGQKSKISWRRRLKMLRDICRGLMCMHRLKIVHRDLKSANCLVNKHWTVKLCDFGLSRLLSNSAMSDNSSAGTPEWMAPELIRNEPFTEKCDIFSLGVIMWELCTLSRPWAGKPPVQVVYSVANEGARLEIPDGPLGSLIADCWTEPEKRPSCQEILTRLLDCEYTLC

SEQ ID NO: 115016 - protein, 202 aa, Triticum aestivum
  unsure (1)..(202): unsure at all Xaa locations
  Clone ID: PAT_TA_9434.pep
MGGRGGKSHSDGCIMGDSKRALTPGVNTPKKDGAQLLQCTNHMCPIRVHWHVKLNYKDYWRAKIAVTNFNYRMNYTQWTLVAQHPNLNNVTEVFSFQYKPLLPYGNINDTGMFYGLKLYNDLLMEAGPFGNVQSEVLMRKDDRTFTFSQGWAXPRKXYFNGAGSXMPPPDSYPYLPNSAPLVTPRSVITAASACLLVLLLVA

SEQ ID NO: 115017 - protein, 148 aa, Triticum aestivum
  Clone ID: PAT_TA_9435.pep
WLVDMPVAVASRVLVPLHHAAASLTVTATPCLSPPLRGPMPVLPVAKLPFRRWRLQLYDMFLSSDLVPTALGLFGHWPGRNPRLILAAATSAGAVPFLEALPRLILRAPLQARGNPRSSSLDRMTAAFPFMKALSCLLMPCLVLDSEC

SEQ ID NO: 115018 - protein, 192 aa, Triticum aestivum
  unsure (1)..(192): unsure at all Xaa locations
  Clone ID: PAT_TA_9436.pep
AGCVLVATEVLDDDSVFERTVILLLRLGSRGTFDGPFGVILNRPLYTKIKKXRPPEREPKDPLSAAAPPSWGAPSASVAAXGTKDSSRLKGFEEVIPGICFGFRTELEKAGVLMKSGAINTEDLRFFVGHAAWDYEQLLSEIRAGYWAVASCSTELISDAVSTDPSCLWTEILQLMGGHYSELSQKPKQDSS

SEQ ID NO: 115019 - protein, 189 aa, Triticum aestivum
  Clone ID: PAT_TA_9437.pep
DPIQREREIPNPIHRTLTLTKQAAREMLVQKMPMAAGYEGFPLIPSFQADKEQAEAVLAVRAIKAKAEEASLILKAGCGSKRKAEEDGGEVTVKAKAKAAEEEAAAFTTVKAKAEEDSDEDAEWDDDEFMARITADHAAHVEKMKALYPTIKYGDYDPKVYCHSPDPESDAWNLQKKCLGLAEIAAGLL

SEQ ID NO: 115020 - protein, 239 aa, Triticum aestivum
  Clone ID: PAT_TA_9438.pep
MRRSAMALRSTADRCFGHHSPLTNVIQSTFSANIGSRLGSLARAFSAKPLGNEVIGIDLGTTNSCVSVMEGKNAKVIENSEGTRTTPSVVAFSQKGERLVGTPAKRQAITNPQNTFFGTKRMIGRRFDDPQTQKEMKMVPYKIVKAPNGDAWVETTDGKQYSPSQIGAFVLTKMKETAESYLGKSISKAVITVPAYFNDAQRQATKDAGRIAGLDVQRIINEPTAAALSYGTNNKEGLI

SEQ ID NO: 115021 - protein, 371 aa, Triticum aestivum
  unsure (1)..(371): unsure at all Xaa locations
  Clone ID: PAT_TA_9439.pep
TKVSKQISFEKQFVSEFHQKACLSNSAFGTLGTWKVTHTSRRRGAGLRSRTHPGRAAAAARRTPSTQTGISWNSDAGTSSRDEAGAELDHPALQVRGHAGDGDPDEELLGHDAGEVGDGAVGDGAAEVLVEVDVVVAEPGVAAAGELDLVVAGGVFEGVGLDRVREEALGEAVLQEDVVRHAVQHGAAAVGACSLCDRRGCRGHGEDEEDGHWRHGRRRSGLGVCLGVFEVKATNGDTFLGGEDFDNTLLEYLVSEYKRSDNIDLSKDRLALQRLREAAEKAKIELSSTAQTEINLPFITADAAGAKHLNITLTRSKFESLVNXIARTRDHARMLKDAGITQRVDEVSVGGYKVQSEEVVRNLARPTKITR

SEQ ID NO: 115022 - protein, 537 aa, Triticum aestivum
  unsure (1)..(537): unsure at all Xaa locations
  Clone ID: PAT_TA_9440.pep
LFETLLLAMSGQHPVSLTTEYDGAIQSAVHKVLPQTRHRFCRWHILNEAQCKLSDFLNAFPSLYDDLVNCINMSDTIDEFEANWEALISKVGSGHNEWLDSMYNCRQQWVPVYLRDTFFGDEPSRQECMSRXXSFFECPITAKTDSQSFIQHYEKALDSCYEREVKEEFETKYSLPDIKTPSPIEKQGADLYTRTLFLRFQQELIGASVSTLEVAEQDGKACTYKVTTSQGSEKPRMVQFNSSECSAKCTCQMFECLGIVCRHILTVFGAQGVSALPSQYVMKRWTKNATDRSSDKKPDEVIRVKELKEEQRSTVEDGEQSQTWRYNSLCREALRYAEEGASSAEVYIVAMQALQEAANKVNMAKRGIGQVAAPLAVMPITAQLPECSGKIQDSFGQQKKRKRNSNNSXRENSTPNQFMHMQQPXNYLFVGPITSGSQRAYHYCCIPVPPCAQHANIRVHITPTRWHGLPVLFTFVPPNPNATQFFECCNFGSPINEMSQANGNKEHVIYGSHTVTSNGSACPQAKHGESNYNEHFQ

SEQ ID NO: 115023 - protein, 422 aa, Triticum aestivum
  Clone ID: PAT_TA_9441.pep
MMIHFFLLVALKLRINSCLLMAVFCPLQRRWGGSVGHAVHPARPEYFKSKQVFLEKPYLPCLDVGKPKRPNYLPIELANMISLQRYTKALSSQQRTTLVEKSRQKPQDRMRVVTDAVKSNRYDDDPIFSSCGIKIDSQLTRVEGRVLSAPMLVVGNSQDCVPFKGRWNYNNKKLFEPVRIERWAIVNFSARCDMSRISRDLVPRGRAHGCPTLGPYSLVDEDNQARRCAPIVRVERMFEKVKANLPGPPEFLLCVLPERKNCDIYGPWKKKNLHEMGIVTQCIVPSAKMNDQYFTNVLLKINAKLGGMNSKLALEHSRKIPVINKIPTIILGMDVSHGSPGRSDIPSIAAVVGSRCWPLISRYRASVRTQSPKVEMIDSLFKPLDNGKDDGIIRELLLDFYTTSQQRKPEQIIIFRDGVSES

SEQ ID NO: 115024 - protein, 99 aa, Triticum aestivum
  Clone ID: PAT_TA_9442.pep
SARGSLSSSSRARGRVRRETMHGRVSCYEKLPSSGRAPMLPEEALSCSPARASCGFFARQGLAAASPHELAPRARRYNLRSSKPTTCCGSPELLMRRGE

SEQ ID NO: 115025 - protein, 154 aa, Triticum aestivum
  unsure (1)..(154): unsure at all Xaa locations
  Clone ID: PAT_TA_9443.pep
TXRRXPXGISGRAVEPXERRRRRGXRGPDRLGWAAGGRSPPRASSGISATSSSGISLDAVAPWKQTSTALLAPVLGDGRFRARVGAGLAMVRRAAAHXDTILNSLCSIEYQFITYLGTIDEFGSSKKGDRELRARGWEGDNATGGRFRVPFFRT

SEQ ID NO: 115026 - protein, 131 aa, Triticum aestivum
  Clone ID: PAT_TA_9444.pep
QCCPEHGRLWKLKSNRFCFQAHKGHRLDQCEETRSDRCRKPRLSNGSTSTPTSTSTGRQSKQIHFTLLHADESDQVYFKFASACLLLAGLHFSNFQSFESLPTNCVCDSSSFNYPVPYVNYILKYRLTTTY

SEQ ID NO: 115027 - protein, 82 aa, Triticum aestivum
  Clone ID: PAT_TA_9445.pep
GAPKKKFKRSGLASSKPWVLVRQSSPLFLYFFYFFFFSLFFFFFFFFFFFFFFFFFFFFFYTESYSNALHKFRPTIFHSYIY

SEQ ID NO: 115028 - protein, 126 aa, Triticum aestivum
  Clone ID: PAT_TA_9446.pep
LQICRSTAAAPVKAVSRHVASKACSFVGSTPLPVTAAAPGVKKMTPAVSTLPARRGIGGAQLQDSEAKPVASSVTVASAPRKQPIPLLGSGGITPLLVFYLLPKPFTHEFHLIFASLGSALNHQDF

SEQ ID NO: 115029 - protein, 156 aa, Triticum aestivum
  unsure (1)..(156): unsure at all Xaa locations
  Clone ID: PAT_TA_9447.pep
XAQLGQMXPVAPNGAGHWRWTIISVAGPRGWGGARQAGEGPWGRPTARGATEWRESEGRATPALPPLPAQAIQGQEMDNPGGLGHMLGKGCGMFFAPCLGPCPHILAVQNTGVYRAALQEIQRGNGWLTAESCLFSPITEAQLRLVWMFQCWQDLS

SEQ ID NO: 115030 - protein, 545 aa, Triticum aestivum
  Clone ID: PAT_TA_9448.pep
MEIGGQHPASSCSKEHQKIYRDWFALADSDGDGRITGPDAIKFFAMSSLPRADLKQVWAIADSKRLGYLGFGEFITAMQLVSLAQAGNEISQDSLQREDLISFNPPVMEGLDAQLAKSKHLAKRVDQDMDGFPQAQGPSTNHWFNSKSSKKIPLTAVTSVIDGLKRLYIEKLKPLEVTYKFNDFVSPLLTNSDCDAKPLVMLLGEYSTGKTTFIKHLLKTSYPGAHIGPEPTTDRFVVVMSGPDERTIPGNTLAVQADMPFSGLTTFGTSFLSKFECSQMPHPLLEHITFVDTPGVLSGEKQRTQRSYEFTGVTSWFAAKCDLILLLCDPHKLDISDEFKRVIGSLRGHDDQIRVVLNPAGRPGTQQLMRVYGALMWSLGKVLNTPEVSRVYIGSFNDKPVKESAVGPIGKELFEKEQDDLLSDLKDIPKKACDRRINEFVKRARAAKIHAYIIGHLKNQMPTMMGKAKAQQKLIDNLEGEFAKVQREHHLPAGDFPYVEHFREALGGYSIDRFEKVKPKMIQAVDDMLGYDIPELLKNFRNPYE

SEQ ID NO: 115031 - protein, 220 aa, Triticum aestivum
  unsure (1)..(220): unsure at all Xaa locations
  Clone ID: PAT_TA_9449.pep
DHHAPEDVPEALNESLNDLQLEYLDLYLIHWPVRVKKGTNHSPENFVTXEKLHDAGKALAIGVSNFSSKKLGDLLDVARVPPAVNQVECHPCWQQTKLHNFCQSTGVHLSAYSPLGSPGTTWMNGNVLEEPIIISIAEKLRKTPGQGALLWNIQMGHGVLPKSTNPERIKQNLDVYDWTIPADMLAKFSEIKQARLLRGNMMINPQSVYKTYEELWDGEI

SEQ ID NO: 115032 - protein, 192 aa, Triticum aestivum
  Clone ID: PAT_TA_9450.pep
RPPTRPVGFILPNLEVKFVDPDTGRSLAKNTPGELCVRSQCVMQGYYRKKEETERTIDAKGWLHTGDIGYIDDDGDVFIVRRIVRLIKYKGFQVAPAELEAILLSHPSVEDAAVFGLPDEEAGEIPVSCVVRRSGAAESEADIMAYVASRVASYKKLRMLHLVDAIPKSVSGKILRRQLRDEFINMIKPAAA

SEQ ID NO: 115033 - protein, 534 aa, Triticum aestivum
  unsure (1)..(534): unsure at all Xaa locations
  Clone ID: PAT_TA_9451.pep
MGDAAIAVMEEEGEQEHIFRSRFPPVAVPDGVTVPDFVLAGAEAYADKVALVEAAPGGRSYTYGEVARDVARFARALRSVGIRKGHVVVVALPNLAVYPVXVSLGVMAAGAIFSGVNPRSLAAEIRKQVEDSEARLVVANEVAYDKVKDVGVPVIGIGEQGLMAGAISWDELLAAADRTGPPVVPLEPVQQSDLCALPYSSGTTGVSKGVMLSHRNLVSNLCSSMFAVGTELLGQVVTLGLMPFFHIYGITGICCATLRHKGTVVVMDRFDLRTFLGALVAHRVMFAPVVPPVMLAMVKNPIADEFDLSGLALKSVMTAAAPLAPDLLAAFQRKFPGVQVEEAYGLTEHSCITLTHAGDDPEKGHIAKRNSVGFILPNLEVKFVDPDTGRSLAKNTPGELCVRSQCVMQGYYRKKEETERTIDAKGWLHTGDIGYIDDDGDVFIVDRIKELIKYKGFQVAPAELEAILLSHPSVEDAAVFGLPDEEAGEIPVXCVVRRSGAAESEADIMAYVASRVASYKKLRMLHLAGTSSST

SEQ ID NO: 115034 - protein, 245 aa, Triticum aestivum
  unsure (1)..(245): unsure at all Xaa locations
  Clone ID: PAT_TA_9452.pep
KCRIGVDDRAPYEEXCTXVDKXVCKSPSRHFIIHARKALXXGLSPAENRKVPPLKYEYYYALLRDFPEVHXTLNGGLTTIEQVSASIRQGAHQVMVGRAAXYNNPWNMLGHVDSEIYGMPTRCSSRRQILESYQVYGDSIIGQYGISRPNVRQLVKPLLHLFHSEPGNSLWKRKADSTLRHCKTLVQFLEETLDAIPDSVLDAPVLMEPSREQDYFAHVDSLLPPRYTKLANGSYESPALVTASS

SEQ ID NO: 115035 - protein, 239 aa, Triticum aestivum
  Clone ID: PAT_TA_9453.pep
GRPGRSGMVSVGTLLAFTIVAVSILILRYVPPEEVPLSSSRRESMGLNQEYDEEKGRDPLGDDICDTSQIKDLIATEAMKDPLLEKQHKGKMDEMKRRKIAAFSIGSVCLGVLVLTASASATWLPFLPLCIGCIVGGVLLIPGLVVPRRRARDDGRHSFGHSGGFMCPFVPFLPVVCILINTYLLINLGGDAWLRVGPWAVIGVFIYIFYGRTRSSLVDVVYVPVAKADVRRSSSGFMS

SEQ ID NO: 115036 - protein, 155 aa, Triticum aestivum
  Clone ID: PAT_TA_9454.pep
QHAALNFGQYPLGGYVPNRPPLMRRLLPDPERDAAEYAMFLADPHRFFLNAMPGVLEATKFMAVVDTLSTHSPDEEYLGESLDEGAAPWTGDEEALAAHGMFAADVRRAEETIERRNADHGRRNRCGAGVLPYELLAPSSPPGVTCRGVPNSISI

SEQ ID NO: 115037 - protein, 100 aa, Triticum aestivum
  Clone ID: PAT_TA_9455.pep
CLILVKTYTKEHIFMYISSSICQKYQQAKPVWFDLKFRHPINCGCLWSASHPCSRNIFVYVNLLVSIICVKKRVNMNWLYVFIPAYRPMTRFAYRPFLMS

SEQ ID NO: 115038 - protein, 95 aa, Triticum aestivum
  Clone ID: PAT_TA_9456.pep
SSAAKERLTKTVSRVQKLTVRKASGLRPKPRDPAIPKPSVPTGARRNTSTQGIPPARATSSAKRGTIDQVSYCTILAKPFSTCLKYLLEALECKV

SEQ ID NO: 115039 - protein, 163 aa, Triticum aestivum
  unsure (1)..(163): unsure at all Xaa locations
  Clone ID: PAT_TA_9457.pep
ASGVVKPNVTFLHEFGLAACDRGGLWIPTPSLLSISPERIRTAVAXRLSLLGVPRGSPMFKHALQAVAFLNKDKITAKVEHLKKTFSWSDAEVGIAVSKGPAVLSRTKESLQRRSEFLISELGLEPAYIAYRPALLTYSLEGRLRPRYYIVKFLKENGLLKCD

SEQ ID NO: 115040 - protein, 232 aa, Triticum aestivum
  Clone ID: PAT_TA_9458.pep
SADAWGRTSPLWHLSFTPKFTDGKLLSASSKPKVAIIREEGSNSDREMSAAFHAAGFEPWDITMSDLLNQKADLMEFRGIAFVGGFSYADVLDSAKGWAASIRFNQPLIQQFQEFYNRAGSTLGIWSAHGEGRALFPDKNVLSGVVNSNLAPLRYCDDTNNATEDYPFNPNGSPLGIAALCSPNGRHLAMMPHPERSFMMWQYPWYPKEWQVEKGGPSPWLRMFQNAREWCS

SEQ ID NO: 115041 - protein, 345 aa, Triticum aestivum
  unsure (1)..(345): unsure at all Xaa locations
  Clone ID: PAT_TA_9459.pep
MAAGSAAPLLAAVACTVLVLLAPAVSGDAATLESVPDLVKAMYVNIESFPCVSRRVRSGEIGCSNPGHGLVIAPIVRFKNSDDQLAQPSAVLLPLDQMPAFFLRVSNEPELYHKVAGVLVESNGDKLLELSPDRKFPQEDFAPYSNVSHDWNPAGSGIMWNRYDFPVFLLSEESTQTLRKIADKNEKSNNGYQANVAEFDLVMQTTKAETNGSXSCLKEQSCLPLGGQSVWASLPPMSNASAEHQKPIIMVVASQDSASFFRDRSLGAASPISGLIALLTAVDALSHLHDLGKLKKQLVFAAFDGEAWGYLGSRKFLQELDEGDDSVNGINSSMIEQVLEIGSVG

SEQ ID NO: 115042 - protein, 222 aa, Triticum aestivum
  Clone ID: PAT_TA_9460.pep
MPKGAKKRAKLKKKQQGGQPAGSNGGATTTTNDNGSNNSSHGDAASDGNHLPIKLNIPPVDASEDSMESSEEMVTPRAEAAEEEEKKGATSEVPVERAVEVADEGATGEAGAGGQRVKVDVDAEAHAVVQVPELQVQDIVVPHPAHRPNPKAEEVVVRDADTAAVVQEPEAKGEVSRSRGPPAAAQTAVVRRGPAVAAAAAGHRAKWWNCGGLEDLLVVQGR

SEQ ID NO: 115043 - protein, 146 aa, Triticum aestivum
  Clone ID: PAT_TA_9461.pep
HESSVSFIHSLFSVHFSSITNHGTVQRVHVKHHLLASLVEVRVGRVQSRSNSNRSSRVLSAACPSSKPAHSLTTASTVTKLAAYPCCTSPSCCTPTTRPFAITGPPEHPLIDLQSCLILSFQSISFVSLIFGPTSASRTCSGFIWE

SEQ ID NO: 115044 - protein, 53 aa, Triticum aestivum
  Clone ID: PAT_TA_9462.pep
MGTMENVIVLVNRIQRACTVLGDHGGDGAAASLPALWEALPSAAVVGGHEIGE

SEQ ID NO: 115045 - protein, 248 aa, Triticum aestivum
  unsure (1)..(248): unsure at all Xaa locations
  Clone ID: PAT_TA_9463.pep
NAPNLTTFYFEGFIGQISLGGSLQVKTLRMICFRQTNIVCYARHNLLSIAPNVETLTISSPNEMVNTPMLSSKFLHLKLLQISLVGMALSGAYDYLSLVSFVDASPCLENFVLAISQHRMXHASILGEPSHDLRQIPQQRHAKLKSVTITGFCSAKSLVELTCHILENTTSLDCLTLDTTCHPSCAVTKFRAAARAGDGDSLVEAQKALLAIRRYVLGKVPSTVKLNILEPCSRCHAVESLVSTAKLS

SEQ ID NO: 115046 - protein, 160 aa, Triticum aestivum
  Clone ID: PAT_TA_9464.pep
PQDRHCRLLQSYVPGPYKFFGFGQWTAGTLCCYIPCQSRSWGNTCTNSGSSKVCKRSTIIVRELDEPCIGHISGGINGVVFRSYTQHIPWHRVYHYHPHGSAKFAWVCDILHGAGAIVSLMSQSTWAFSVKLVEFLVRGYYCILILSTDSTKISLAGLVW

SEQ ID NO: 115047 - protein, 76 aa, Triticum aestivum
  Clone ID: PAT_TA_9465.pep
HVQIYFQKSEGSKACTELVMDRHESLAGEVEPGNIYTWRWSDGYWLWSEVSPPLILIMEMARQGTAATLEAGRASS

SEQ ID NO: 115048 - protein, 294 aa, Triticum aestivum
  Clone ID: PAT_TA_9466.pep
GASAGEGLGNAFLSHIRAVDGIFHVLRAFEDTEITHIDDTVDPVRDLETISQELRLKDIEFVQAKIDDLEKSMKRSNDKQLKIDHELCQRVMTHLQDRKDVRIGEWKAAEIEILNAFQLLTAKPVVYLVNMSEKDYLRKKNKFLPKIHAWVKEHGGETIIPFSCAFEQKLVDMPEDEAAKYCTENQTTSLIPKIIKTGFAAIHLIYFFTAGHGEVKCWQIRRQSKAPQAAGAIHTDFERGFICAEVMKFEDLKELGSESAVKAAGKYRQEGKTYVVQDGDIIFFKFNVSGGGKK

SEQ ID NO: 115049 - protein, 398 aa, Triticum aestivum
  unsure (1)..(398): unsure at all Xaa locations
  Clone ID: PAT_TA_9467.pep
MPPKASKKDAEPAERPILGRFSSHLKIGIVGLPNVGKSTFFNIVTKLSIPAENFPFCTIEPNEARVHVPDERFDYLCQLFKPKSEVAAYLEXINDIAGLVRGASAGEGLGNAFLSHIRAVDGIFHVLRAFEDTEITHIDDTVDPVRDLETISQELRLKDIEFVQAKIDDLEKSMKRSNDKQLKIDHELCQRVMTHLQDGKDVRLGEWKAAEIEILNXFQLLTAIPVVYLVKMTEKEXEQVTNKDTCLREGGGKVKLCFTSAVSTNGFEQKLVDMPEDEAAKYCAENQTASLIPKIIKTGFAAIHLIXYFFTAWSRRXVKCWQIRRQSKAPQAAGAIDTDFERGFXICAEVMKFEDLKELGSESAVKAAGKYRQEGKTYVVQDGDIIFFKFNVSGGGKK

SEQ ID NO: 115050 - protein, 69 aa, Triticum aestivum
  Clone ID: PAT_TA_9468.pep
ERSNLLSGALPRPPPPPPPPPRHSHSTPPPPPPGPPQVPVVGDRLGLHPLVIARANGSSMNELIIKQCN

SEQ ID NO: 115051 - protein, 191 aa, Triticum aestivum
  unsure (1)..(191): unsure at all Xaa locations
  Clone ID: PAT_TA_9469.pep
MALTTRGGGGADQAQPPPAPDASLGFLTKRDTEVKLPRATRVKNKTPAGVQITAEQILREARERQEPEIRPPKQKITDVHELADYRLRERKRFEDLIRRVRWSVSAWVKYAKWEEGQMDFARARSVYERALDVAHRDHTLWFKYAEFEMRNRYVNHARNVWDRAVSLXPRIDQLWYNYIHMEELLGAVANA

SEQ ID NO: 115052 - protein, 159 aa, Triticum aestivum
  unsure (1)..(159): unsure at all Xaa locations
  Clone ID: PAT_TA_9470.pep
GTYSLILSLMQLXFENVIKKHTYTAVLNMQIYTALVATIASMVGLFTSGEWRMMTEEMDTFRSGQFSYFMTLVWTAVSWQITSVGVVGLVFEVSSLFSNVISTVSLPIVPLFAVLIFHDTMDGIKIISMLIAAWGFVSYLMQHFIDDKKARKAAAGWLV

SEQ ID NO: 115053 - protein, 209 aa, Triticum aestivum
  Clone ID: PAT_TA_9471.pep
MSRQHAAGCARRLPKRIILVRHGESQGNLDMSAYSTTPDYRIPLTPRGVEQARAAGRGILDVVSSGGPDANWKVYFYVSPYERTRATLRGIGAAFPRDRVIGAREECRVREQDFGNFQVEERMRAIKETRERFGRFFFRFPEGESAADVFDRVASFLESLWRDIDNGRLDPSTTCETNLVIVSHGLTSRVFMMKWFKWTVEQVERLNNF

SEQ ID NO: 115054 - protein, 106 aa, Triticum aestivum
  Clone ID: PAT_TA_9472.pep
GRFCVDTLGGDGNVWLVFWEILCAIHLLGNTYPSLLYRGLYGPISVTHRPKALGLPYWVRRYIFYAVLSLVLPCLAGLLPFASLSDWREHAVDYMRSRFTGNDIET

SEQ ID NO: 115055 - protein, 161 aa, Triticum aestivum
  Clone ID: PAT_TA_9473.pep
LCEGSWKHLLQMAQQADGIYDVPDGPVRGRVGLKLSSENSFSEMHRSYASQMERLRKHLKKKFKTLVKGKRKFHLTPDGLAVFTVAFTDGERTVRAIIEGRHMWVRGFETTDGQVYEFKEKNQGHETKKYIKGSILLSHGGGFPTLLREGPPLENFEVGYT

SEQ ID NO: 115056 - protein, 152 aa, Triticum aestivum
  Clone ID: PAT_TA_9474.pep
FVPNAAGGAADDMAAATVEPLERSFLAMDPAVALGVARMIFLGDQRPALDAVPAQCTIVGVRHDFAAPPVVAEYMERRMTKAGTDVAVEIVESVGHFPQLVAATGVAGILDGVLLRLRHQGLSIGHDGTEEGETTVPVATEVEIDGGIDVTT

SEQ ID NO: 115057 - protein, 89 aa, Triticum aestivum
  Clone ID: PAT_TA_9475.pep
LFLELCGWIELMVAIHTSDSCISNHNHDSDHHAASPKLIWGLINCKRFFGGTINLYNNFVARSVALCKNRNLQFYPRTLVERKFFYEFW

SEQ ID NO: 115058 - protein, 169 aa, Triticum aestivum
  unsure (1)..(169): unsure at all Xaa locations
  Clone ID: PAT_TA_9476.pep
VLRRGRDGADIHCIAFSPDLKWLAVSSDKATVHVFSVNVDLPSLTPEDSNGPGGLQAAPAPSSPAVATANKRSSLSFAGGFLPGYFSSEWSSTQIRVPEXTKYLVAFSNQANTFXILGINGRFYRCRFDPEKGGVVDVRHKGTPCGSVGQDVECINFMNPSKKTSNSKP

SEQ ID NO: 115059 - protein, 204 aa, Triticum aestivum
  unsure (1)..(204): unsure at all Xaa locations
  Clone ID: PAT_TA_9477.pep
SRAGRWCPRRCRGPGSTQRPRPPPSSPTSLRVVRCMAKERRVRMVAKQIQRELADMLTRDPVMQRAVLPEAALGADRYXSSLTTIADVELSNDLQVCKVYVSVFGDERGKKVAMAGLKDKTKYVRSQIGKRMKLRLTPEIRFIEDESMERGSRILTILDKLKEEREQREGNAEDEDGEVSDIAEEEDGDWEGDEPDEEDIIYVK

SEQ ID NO: 115060 - protein, 203 aa, Triticum aestivum
  Clone ID: PAT_TA_9478.pep
FGSTEQLKVIEEDITKFHVHSHFLPILEEKSRGTKKYAKVVSNLPFNVSTEVVKQILPMGDVFSVMVLMLQDEAALRLANASIQTPEYRPINVFVNFYSEPEYKFKVERANFFPQPTVDGGVIRFKIKDVREYPLVSSNKSFFSMVNSAFNGKRKMLRKSLQHLYSSADIEAALTNIGLPPTARPSELGMDDFVRVHNHLGKV

SEQ ID NO: 115061 - protein, 97 aa, Triticum aestivum
  Clone ID: PAT_TA_9479.pep
LHSWGMWQESVIAWTSEAICDAEDLVEDFSGLRWLIKIFWMEEEKVNSNLLEEKWVKLDEDWRWRVTYLHMDGMLVILHVEKLSGVCMYVVVVVCNA

SEQ ID NO: 115062 - protein, 132 aa, Triticum aestivum
  Clone ID: PAT_TA_9480.pep
DKAGQVEKTTPGKGKERAKEATRDSYKAELARQILLSFIVKSVHDSLGSTRPQPDRKPSGSDEASSEQSSNVTKTAVSPKEFDKQPKAAEVPKSEKDTEGFTVVSKRRKSKQHFVNPINGLYSQQSICTSVS

SEQ ID NO: 115063 - protein, 104 aa, Triticum aestivum
  Clone ID: PAT_TA_9481.pep
MLRVAGRRLSSSLSWRPAATVGARGPLAGAGGPGRDDDDGSAYQRRFAIESPFFTAARGFSSAETLVPRNQDAGLAELPATGAALKNPNSKILYDQYNHERYSS

SEQ ID NO: 115064 - protein, 142 aa, Triticum aestivum
  Clone ID: PAT_TA_9482.pep
MLRVAGRRLSSSLSWRPVATVGARGPLAGAGGPGRDDDDGSAYQRRFAIESPFFTAARGFSSAETLVPRNQDAGLAELPATVAALKNPNSKILYDQYNHERYPPGDPSKRAFAYFVLSGGRFVYASLLRLLVLKFVLSMSAK

SEQ ID NO: 115065 - protein, 150 aa, Triticum aestivum
  Clone ID: PAT_TA_9483.pep
FGAELGTNGGKAMPRPYAVAVVALVCLFVAGFGISWGPLKWIIPSEIFPLEVRSAGQSMSESISLTLTFVQTQSFLAMLCSFKYGSFAYNAAWVVVMTAFIIAFLPETKGVPIEAMGAVWARHWYWKRFVKPAPEPTPTPDKHADGSLEM

SEQ ID NO: 115066 - protein, 106 aa, Triticum aestivum
  Clone ID: PAT_TA_9484.pep
HVSSIISCSVMLLKGLTELLSMPLCLGVEKALTGRQGKGEPVDAMNMQNMVKLNNTSMVKFSAPRTSAVQGASGTTRTDPPRMPAAPSMTCILLRLFNIRGLCLFL

SEQ ID NO: 115067 - protein, 154 aa, Triticum aestivum
  Clone ID: PAT_TA_9485.pep
LPFLNSLGEGRVRGRVVPMIVYRKTKDEVMDMGVVLYNMLLSMCADIGYVDEAEEIFRDMKSSMDTKCKPDSWTYSSMVTLYSCTGNVPGAEAILKEMAEAGFKPNIFILTSLIRCYGKAGCTDDVVRSFGMLEDLKITPDDRFCGCLLTVAAD

SEQ ID NO: 115068 - protein, 458 aa, Triticum aestivum
  Clone ID: PAT_TA_9486.pep
GDQEFDLPVNQRTDICTIMYTSGTTGDPKGVLISNASIICLIAGVPTDRLLNSVNERLEETDVYMSYLPLAHIFDRVVEELFMFHGASIGFWRGDVKLLVEDIGTLKPTILCAVPRVLDRIFSGLQAKISAGGFIKSTMFNLAYKFKQFRMMRGAKHNEAAAICDKVVFSKVKEGLGGNVRVILSGAAPLATHVEEYLRVVTCAHVLQGYGLTETCAGSFVSLPNQMSMIGTVGPPVPNIDARLESVPDMNYDALASTPRGEICIKGETLFSGYYRREDLTEEVLVDGWFHTGDIGEWQPDGSMKIIDRKKNIFKLSQGEYVAVENLENIYGVVSAIDSIWVYGNSFESFLVAVVNPNKEALESWAEANGISGDFEALCENPKAKEYILGELSKTGKEKKLKGFEFIRAVHLDPVPFDMERDLITPTYKRKRPQLLKYRDGAHGIWFHRACAPRPGPV

SEQ ID NO: 115069 - protein, 393 aa, Triticum aestivum
  unsure (1)..(393): unsure at all Xaa locations
  Clone ID: PAT_TA_9487.pep
MGTSGSKGLDGVGGLGAAALAGGSGGGMGGDEGDGDGAVTGSWHGGAQLYVSLKMENARIIGDLVPHVYGSEPIIGSWEPARALAMERELASMWELSFVVPPDHETLDFKFLLKPKDAETPCIIEEGPTRLLTGGMLEGDVRLANFRLNGDDELLEFRVFNKADIVSPLDLAASWRVYKENFQPSKVRGIPDISINEAPTHATEDGSGSSLELDLEHYVVPTPTAPPTEYAANLAATPASLDQPETPWTNDMLLSDGIQSPRSAAADFKDDSYHNKDTEASIADSSNSKKLQXVSGMVESKSVGTLIQLQKKDMPQGLYVDRGVVSPKLGKSFSACSLASGLNFGSTKAMPEAAGAVAAAAVADRLHGSKEDRKLAIVLVGLPARGKTFTAVK

SEQ ID NO: 115070 - protein, 145 aa, Triticum aestivum
  Clone ID: PAT_TA_9488.pep
CRRLRTGPPLILVLRPVRTHKIDVILQVQLNQLQIASTYQILNIKCHTLPNFTEIFRESEREREQQQVERSSSSMGFRVRRGRRSSRGVERKQQQALREKRKSSKERRGFSRGSSKDVGEREIAAGEGRGKGGVVAEFGEEEAAG

SEQ ID NO: 115071 - protein, 162 aa, Triticum aestivum
  unsure (1)..(162): unsure at all Xaa locations
  Clone ID: PAT_TA_9489.pep
KRGPTPTPRSTDPPRAPPGREARAPSGGGAGPRPEGXRTQGQLTAGGAGAAGGKVDGRDGAARGASRARRRGAAGGNQAGSGHGGPRGAVSATHPQPRCVARHGRSEHGEEEHAQRRRQRRRAPRRARPAEQWRCGTRMPSTAGLQAAAAGAAWMRCIVGGG

SEQ ID NO: 115072 - protein, 185 aa, Triticum aestivum
  Clone ID: PAT_TA_9490.pep
MCVPNSRLLTSSPKTVMSILERADKLGVPRGSLMFRQAVTTTTGLGAETMAAKLKLFEEILGWSEAEVTNVVRINPTVLRISGEKLRRAKEFLTKVVGVDTRYILARPSIVMYSLKCRLVPRHYVMKALQEKGLIQKDQSFYTMITPSEKTFQRRHIDAHRHVLPGLAEAYAAACQGKLPTDVAV

SEQ ID NO: 115073 - protein, 187 aa, Triticum aestivum
  unsure (1)..(187): unsure at all Xaa locations
  Clone ID: PAT_TA_9491.pep
XTHASNGHAHGSAALVVAVGGSHDDKXTIRQRVISQVLELGIVVHSVIIGISLGACPDPDTIKPLVIALSFHQMFEGIGLGGCIVQAKFKATSLITMILFFCFTTPVSIGIGAAISSVYNENSPNALIMEGLLNSVAAGILVYMALVDLLAEELTNPKVQGRWKLQLGIYIFMLIGAGLMSMLAKWA

SEQ ID NO: 115074 - protein, 108 aa, Triticum aestivum
  unsure (1)..(108): unsure at all Xaa locations
  Clone ID: PAT_TA_9492.pep
MVKICCIGAGYVGGPTMAVIAVKCPAIEVVVVDISKPRIDAWNSDKLPIYEPGLDEVVKACRGRNLFFSTDVEKHVAEADIIFVSVNTXTKTCGLGSRQAADLTYWES

SEQ ID NO: 115075 - protein, 143 aa, Triticum aestivum
  unsure (1)..(143): unsure at all Xaa locations
  Clone ID: PAT_TA_9493.pep
TGDTRETPAIDVCKGLVGDKAQVSIYDPQVTEEQIQRDLAMNKFDWDHPMHLQPTSPTXVKQVSVVWDAYEAAKGAHGVCILTEWDEFKKLDYQKIFDNMQKPAFVFDGRNVVDAEKLREIGFIVYSIGKPLDGWLKDMPAVA

SEQ ID NO: 115076 - protein, 313 aa, Triticum aestivum
  unsure (1)..(313): unsure at all Xaa locations
  Clone ID: PAT_TA_9494.pep
MVKICCIGAGYVGGPTMAVIAIKCPAIEVVVVDISKPRIDAWNSDTLPIYEPGLDDVVKACRGKNLFFSTDVEKHVAEADIIFVSVNTPTXKTRGLGAGKAADLTYWESAARMIADVSKSDKIVVEKSTVPVKTAEAIEKILTHNSKGINYQILSNPEFLAEGTAIEDLFKPDRVLIGGRETPGGQKAVQALKEVYAHWVPEANIITTNLWSAELSKLAANAFLAQRISSVNAMSALCEATGANVSEVSYAIGKDSRIGPKFLNASVGFGGSCFQKDILNLVYICECNGLPXEVANYWKQVIKINDYQKSRFV

SEQ ID NO: 115077 - protein, 181 aa, Triticum aestivum
  unsure (1)..(181): unsure at all Xaa locations
  Clone ID: PAT_TA_9495.pep
ADVPPQPNSPPDNVFRPAPLLADDLHMKLSYLENXVAFARLFFPAEAKVAMQIAQADVTPEVGGFSAASTSGKLREVDLNETPVTKNKRLRSRVDALAKTVELGRRYFPNCSQVLDKFLEVGLPDGLDAFQQQSGTPDEQQVKKMGFCEVKEDVRKAYSKDTADKSMFSALSSNSSSSAMK

SEQ ID NO: 115078 - protein, 515 aa, Triticum aestivum
  unsure (1)..(515): unsure at all Xaa locations
  Clone ID: PAT_TA_9496.pep
MVKICCTGAVYGRGPTMAVISIKRPAIEEVVVDISKPPVDAWNSDTLPIHVPGLXVGMSKAGRGKKLSFRDDVEKHVAGGPTSPTSRGTAPTTRPRARGLGERLPDRTPPAASVPDDRRLDKVTDDDKTVVDKSSQPTQNTYANNKTLINNRIIFNNQSPPERLSEADAIEDLFRVNSGVIGSRGGQTAEQAHQGLARQVCDRHGPPSPPTSSPTELSTEAAKGFPAQXFSAGNATSALGEAAXANVPEVSYAIGXNTRGKGPKFRTASLGFGGSLVPSCTYLNPGVXICEWNGLXRSVANYWKQVMKINDYQKSRFVTRVVWSLFNTVPCKKIAVLGLASTXEKHAGHARETPARRVQKGLVGDKAQVSIHDPXVTEEKMQRXLATSKFGTNHPMHLPPTRPTAGAXRGAWCGARYEAGKGAHGVCILTECDEIKKARLTEDPTTNMQTSSLPVFVRARRQADDAEALGKIRLHLSTSSLASRPVGRGKRTCRPVALTSTSSGRPGPEEEAKSG

SEQ ID NO: 115079 - protein, 66 aa, Triticum aestivum
  Clone ID: PAT_TA_9497.pep
GTREFTNMEGFLKSTSAPEAAAVAALQFFFFPDARQPEHARAVARAGRAVQHQQSALSAAELLGRL

SEQ ID NO: 115080 - protein, 205 aa, Triticum aestivum
  Clone ID: PAT_TA_9498.pep
AVPEAARPVHDGLYYAVDAYKKEPPDASEAATQKDRGPLGVEEQAPDAREQGAGTSSVPAPTDGGEHACAKPVQEQSEHCERRIPRHPNKLDKQVTSLSARGEGEDRHVELRGGRSSFKDQVVGRNSFKDQVVGRNSFKDQLGGLLLQSRSRRIFDKLWSSKGHGENGKGSETSGSSQSPPSTAKPTEVKPSPLPPLRNRRYSVS

SEQ ID NO: 115081 - protein, 77 aa, Triticum aestivum
  Clone ID: PAT_TA_9499.pep
MAAVDLSKLVKEKRFWAASFLIAWAAALQGHMMWLKRQDAFKDKFGDPEAPNKVTEQGHQQPPAGEQGELTADAEIR

SEQ ID NO: 115082 - protein, 502 aa, Triticum aestivum
  unsure (1)..(502): unsure at all Xaa locations
  Clone ID: PAT_TA_9500.pep
MLRSPAXALLRRLAPRLTGCSGGAGPSTRRTLPPYISSSSSFLARFSSTPTSPPLPSSVXAHDDEAEDGHEQGSSSDSGARLSISVDRAGLYSPPEHSHEPSSDSNLVKHLKSIIKFRSGPISIAEYMEEVLTNPQSGYYMNRDVFGESGDFITSPEVSQMFGELIGVWAMCLWEQMGQPEKVNLIELGPGRGTLLADLLRGSAKFGNFTKALNINLVECSPTLQKVQYNTLKCEDESVGDEKRTVSKLCGAPVYWHASLEQVPSGFPTIIVAHEFFDALPIHQFQKGSRGWCEKMVDLAGDSSFRFVLSPQPTASLIFLSKRCEWASPEELEKVEQIEVCPKAMEISEQIADRISSDGGGALIIDYGKNGIVSDSLQAIQQXTKFVHILDXPGSADLSAYVDFAAIKHSAKDASDDISVHGPMTQSQVLGSLGINFRVEALMQNCDEKQAESLRTGRRRLVGDGGAPDRDGPDDETANGMGSRYEALGRGNKAHGTRGRSA

SEQ ID NO: 115083 - protein, 207 aa, Triticum aestivum
  Clone ID: PAT_TA_9501.pep
MSKKRGLSLEEKREQMLQIFYESQDFYLLKELEKMGPKKGVISQSVKDVVQSLVDDDLVLRDKIGTSVYFWSLPSCAGNQLRTTYNKLESDLSNSKKRYMELLEQRDDLKRGREDTDEREDALEELKAVELRHKKLKEELAAYADSDPSALEAMKDATEVAHSAANRWTDNIFTLQQWCSTTFPQAKEQLEHMYREVGITEDFEYLQ

SEQ ID NO: 115084 - protein, 87 aa, Triticum aestivum
  Clone ID: PAT_TA_9502.pep
SDNQVSKFMSDYKRRGFSIFLMAHVGRSAGGAFEDLLVRSVPSSFQEPTFLHVYICCTAYAGLPAIIIIKREYAAAEFSRRSFLSCA

SEQ ID NO: 115085 - protein, 241 aa, Triticum aestivum
  Clone ID: PAT_TA_9503.pep
VISVRPSMISVRRAAAGALKASPLRAVPPSFHACIVPRTATCGAPSAGGPARIRANDYIYARTVASVPHSSSPLLPRERLIAPVRRLSSKLGEVASQLKRSAVWGGARGRRSRPDATPTRQVFLGLVLAETLLAVICREGLPDLKFYDSKRFFLDENDSYHLMRFSNTSISSNFICRSAGGAFENLISYLSFIVSEVSTGLPRSVLNCFIDDNLEKAPLTLTKDVFLCWKDEDTLEIDMGW

SEQ ID NO: 115086 - protein, 201 aa, Triticum aestivum
  unsure (1)..(201): unsure at all Xaa locations
  Clone ID: PAT_TA_9504.pep
MPGPGDGLDHRGATNASSPSPPPKWRVRLQISPPPLHYSSTLAPSPSPTPFPLKTLTLAAPLAMAADYRTPDRLLPAAAAEGPAQDPPKPALAVAGPAAAATHDGLRFWQYMLAGSVAGVVEHTAMFPVDTLKTHMQAASPPCRPTLSLGAALRAAVTGEGGALALYRGLPAMXLGAGPAHAVYFSVYEFAKSXLSDRFGP

SEQ ID NO: 115087 - protein, 278 aa, Triticum aestivum
  Clone ID: PAT_TA_9505.pep
SQVLSASLTNAAKELEAEINEGGNAPNQDAAVPWIGLRKRFLAPVRKQGARRTCVFEASMVTTETHYKVNYNAKSPPEEFNYCLSLSDFKVYTSHTGKVLGANGSGGSLENCMEVLKEVGVRGVDMASEKKSEERFKIHAYRKFRRKDIHEVMLLLDQGKALAASFPISDNWKSMNGVGVYEFQEERALPHLHRKGKFRGHSVMIVGYFPDSLEEDLAALKSKDDIEEQAQLLLKLAEVVLAFQNSYGELWGELGGFGSIKAKSIGWYYLPIVCVGAA

SEQ ID NO: 115088 - protein, 166 aa, Triticum aestivum
  unsure (1)..(166): unsure at all Xaa locations
  Clone ID: PAT_TA_9506.pep
LGVVPQDTVLFTSAHAPNHASGRLSATDEEVYDAARRASIHDTIMNFPDKYDTVVGERGLKLSGGEKQRVSIARVFLKEPSILLCDEATSALDSTTEASILNSLMSLSVDRTSIFIAHRLTTAMLCDEIIVLENGTLVEQGPHDLLLSKXGRYAELWSQQNTTEAS

SEQ ID NO: 115089 - protein, 805 aa, Triticum aestivum
  unsure (1)..(805): unsure at all Xaa locations
  Clone ID: PAT_TA_9507.pep
LPGVGAPASAAPSASGAASVPHPCLVLAGGKEGGFLELEEIDGADFGIFGSFVEDVGASEKKAWNDQKKKKKIKKRKRGDAKRLDGDVGGDGDGDGDCAGDSVAESEEGGEKGEKKRKRKKRNKRKGRGRANESDCMVDVALDEVAGVLVGLVVSGLGFVEVRLLRQQAPSAPRVLSWLPPLAEALLRLGVCGPSPLQEACLPPGAPRGAVVVGAAETGSGKTLAFGLPILQRLLEEREKTTRLHVEDEKAAEGSSTGGPLRALILTPTRELAKQVCDHLKEAAQFLGIHVVPIVGGLSMEKQERLLKKKPEIVVGTPGRLWELMSSGNQHLVELHSLSFFVLDEADRMIERGHFKEVQSIIEMLPLSNSSDEQTVKATSSCETVANLQIKKRQTFVFSATLALSANFRKKLKRGLSTSKTATADDLSSIEALSKQAGMKPNAEIVDLTNASILPEKLEESFIECSDDDKDANLYYILSVHGQGRTIVFCTSISALRHISSLLRTLGINVLTNHAQMQQRARMKAVDRFREGENSVLVATDGFARGMDFDNVRTVIHYQLPHSSDVYIHRSGRTARKSLTGCSIALISPADKAKFYSLCKSFSKENLQQFPVDXAYMPAIMNRLXLLRQIDKISSKSSKENANKSWLQKXAESMGLILEASDSEEERVRGHKQRKATSAQLQKLQQDLNELLQHPLQPKTFSRRYLAGAGISPLLQKQLEELSKRNVNSNSSNDNNKGSRFVIIGQDRVEPLQALQDSGQEICVNMDKQKEKRRLAENWRRKKHEEKKSTREQKRKDRRSAKERD

SEQ ID NO: 115090 - protein, 156 aa, Triticum aestivum
  Clone ID: PAT_TA_9508.pep
SNDVPPRPRANRSESLRQQLQMPDPRGIASMVRRLIENQDIVRGQAAPPAGGVEVTVLPAARARARARGQQRHSLVSPSPIMLRASNAAPESGNQVRLPSSNSVNAAPAVTQQSSSMEQASTSSTLAVIVGQAAQSRRSRPSESTTTRRTRRRQQQ

SEQ ID NO: 115091 - protein, 134 aa, Triticum aestivum
  Clone ID: PAT_TA_9509.pep
PYGWGMCSDVLNYTDKDGNINILPLLRRIVEHKIPLWIFSGDQDSVVPLLGSRTLVRELAHDMGLPVTVPYSTWFRKGQVGGWTTEYGNLLTFATVRGASHMVPFAQPDRALGLFRSFVLGQRLPNTTYPPIGD

SEQ ID NO: 115092 - protein, 136 aa, Triticum aestivum
  Clone ID: PAT_TA_9510.pep
FFFFFFHQEIHLRLTGSDELHLPSTLRFKMILKSTRYTATSLGYYKNNLHAGHAQLISHVHIAFITSNVSSGSSYPVNTLATIQLSLRPHHAPSVILPIFLDWDTRRTWAIPKAPPSLPVSLAILIYPSSPIICPA

SEQ ID NO: 115093 - protein, 99 aa, Triticum aestivum
  Clone ID: PAT_TA_9511.pep
FISEKKKKKKKKGGTCSLLGGPKCPVTGKKIQGIPHLRPTEYKRSRLSRNRRTVNRPYGGVLSGQAVRERIIRAFLVEEQKIVKKVLKIQKTKEKQPSK

SEQ ID NO: 115094 - protein, 119 aa, Triticum aestivum
  Clone ID: PAT_TA_9512.pep
MVQRLTYRKRHSYATKSNQTRVVKTPGGRLVYQYTKKRASGPKCPVTGKKIQGIPHLRPTEYKRSRLSRNRRTVNRPYGGVLSGQAVRERIIRAFLVEEQKIVKKVLKIQKTKEKQPSK

SEQ ID NO: 115095 - protein, 404 aa, Triticum aestivum
  Clone ID: PAT_TA_9513.pep
MDRIVGRKFKLGRKIGSGSFGVIYLATDMDTYEIVAVKIESSNSKHPQLFYEAKIYNALQGGSGIANVKWCGVDGEENVLIIDLLGPSLEDLFVYCGRKFTLKTVLMLADQMLTRIEFMHSKGYLHRDIKPDNFLMGLGRKANQVYVIDFGLAKRYRDSTTNRHIPYREHKNLTGTARYASSNTHLGIEQSRRDDLESLGYVRLYFLRGSLPWQGLKAATKKQKYEKICEKKIPTPIEVLCKSCPVEFASYFHYCMSLTFDQRPDYGFVKRLFRDSFDATGYDFDYVFDWTVLKYKQGQKTQHVPGATITRAIPTHLDKRAGVNGDVHPNEAHEQMESSHMTGSAAQLQRQNMAASARNENPKNDGNSRHIVRIDAFHQNQGFDSNTGSPSACFPTLPHNAPAR

SEQ ID NO: 115096 - protein, 110 aa, Triticum aestivum
  Clone ID: PAT_TA_9514.pep
MLERPARGAAAASGAWRSRLPVLIVMAICTNCLLLVCLYDEEGKWRIEPGLAAILIMEHALLLVKFGFSHFVPEEPAWVRANRVKYVAQAQTVCSQQLLRSISKLDRKWE

SEQ ID NO: 115097 - protein, 211 aa, Triticum aestivum
  Clone ID: PAT_TA_9515.pep
MESSSTTAAAALHAGGVAEREYEEVLGRLSSLITQKVRADTGNRGNQWDLMGRYLQILELEEPIARMKVIHVAGTKGKGRPCTFTESILRSCGFRTGLFTSPHLMDVRERFRLDGVDISEEKFLKYFWCCWNKLKEKTDDDIPMPAYFRFMALLAFKIFSAEQVDVALLEVGLGGKFDATNVGKSPVVWGISSLGFDHIGILGNTLGEIAG

SEQ ID NO: 115098 - protein, 114 aa, Triticum aestivum
  Clone ID: PAT_TA_9516.pep
GPLPARPWEHIDHVIMNLPASALQFLDCFDGLVQKRYWKGSLPWIHCYCFIRSSESEELILCEAQNKLNAKIAEPIFHRVRDVAPNKAMFCLSFRLPVECLKEETEDHILSVDG

SEQ ID NO: 115099 - protein, 360 aa, Triticum aestivum
  Clone ID: PAT_TA_9517.pep
MGSVDASETTVTGWAARDATGHLSPYTYTLRKTGPEDVVLKVKYCGICHTDIHQVKNDLGASKYPMVPGHEVVGEVVEVGPEVSKFRAGDVVGVGVIVGCCRDCRPCKANVEQYCNKKIWSYNDVYTDGKPTQGGFASAMVVDQKFVVKIPAGLAPEQAAPLLCAGVTVYSPLKHFGLMTPGLRGGILGLGGVGHMGVKVAKSMGHHVTVISSSNKKRAEAMDDLGADAYLVSSDADQMAAAADSLDYIIDTVPAKHPLEPYLALLKMDGKLVLMGVIAEPLSFVSPMVMLGRKTITGSFIGSMDETEEVLQFCVDKGLTSQIEVVKMDYVNQAFERLERNDVRYRFVFDVGWSNIEDAA

SEQ ID NO: 115100 - protein, 164 aa, Triticum aestivum
  Clone ID: PAT_TA_9518.pep
EEQKSDDDTCTEPGYYSSRTASQLNEDEKQEIMERASIRPGNPAFVVVLLMTHLQRKNNFLTIPSKFAADHLQSKPREVLLLRLSREDKWHVRCYYSSRTRCFNCQRWVKFVRDNGLREGDVCVFELIKGARKMTTMTVHVARRKKDGRFVAGQWAARGRRLRL

SEQ ID NO: 115101 - protein, 257 aa, Triticum aestivum
  unsure (1)..(257): unsure at all Xaa locations
  Clone ID: PAT_TA_9519.pep
RESTLNIQDDKDSKSNDDMADIVNLDPSDCFMCDLKHDNIEDCMIHMHKKHGFFIPDSEYLKDPNGLLIYVGLKVKRDFMCLYCNDRCQPFQSLEAVRKHMDAKGHCKLRYGDGXXEDEDADLEDFYDYSSSYVDVEGKQLVAAGDMDNSIELGGGGSELVITSKSEKGRRVTTLGSREFIRYYRQKPRPSVAADRALALSLASSYKSMGLVTVQSKEQMVRLKVLRAMNKSGVETMRTKIGMKSNVIRNLPKNVPY

SEQ ID NO: 115102 - protein, 182 aa, Triticum aestivum
  Clone ID: PAT_TA_9520.pep
EFNSSRSYPEADPLFVSPLLENFKEDGVVKSYTEVLLVPLTTPERGRGRGVITFTCTVLALYFGSLLNALRRRIGEEERGLKKADKRRGLIPLLIAKLRGQKVDPSESESTSPASLPRSKLLLKVVFVAVVAIVFHYLSNRERTSIGENFDQIHGGRSYPSSFVACMYYLHVQVLASGPSFL

SEQ ID NO: 115103 - protein, 109 aa, Triticum aestivum
  Clone ID: PAT_TA_9521.pep
TAPPRSSPRHLHRCLPLWLGPCHQPGSPGVRALHSACMPLWRGAGRPPPAAGSPRAAPCTFATSSVQYNTPPILNIEDRNINEISVGVKHLKVLLLSLLIYEYQYQQWT

SEQ ID NO: 115104 - protein, 99 aa, Triticum aestivum
  Clone ID: PAT_TA_9522.pep
AAETAATPHLAVRPATQCRDTSTKPSEHRAASLLQSSLVEVHCHFILQYKHIPNQRQLFVRFSWTLWLMKQQYIRCPRCWLRSPRRKLGASSLISLTIF

SEQ ID NO: 115105 - protein, 136 aa, Triticum aestivum
  Clone ID: PAT_TA_9523.pep
MRLWSLLLLLVCLPTLILSEDYSDVTVIVRGSKTIAATSDEFICATLDWWPPEKCNYDQCPWGKASILNMDLTNPLLAKVIQAFSPLRIRVGGSLQDQVVYETPNLGSPCRPFTKASSGLFGFSKGCITMERMGCM

SEQ ID NO: 115106 - protein, 537 aa, Triticum aestivum
  unsure (1)..(537): unsure at all Xaa locations
  Clone ID: PAT_TA_9524.pep
MRLWSLLLLLVCLPTLILSEDYSDVTVIVRGSKTIAATSDEFIWATLDWWPPEKCNYDQCPWGKASILNMDLTNPLLAKAIQAFRPLRIRAGDSLQDQVVYETPRLXHPCKPFATALCGFFEFSKLCITMERWDAMNDLFLNTGAVITFGLNALRGRKQIRKGVWGGAWNSSNAQEFMEYTVSMNYPIDSWEFGNELSGSGIGASVGAEQCGKDLVELQKIVNQLYENSSKPLVLAPGGFYDKQWFAKLLDVSGPNVVRGMTHHIYNLGAGNDPHVANRILDPQHLSRVSDTFRDLQLTIQRHGPWSAPWVGEAGGAYNSGSRTVSNTFLDSFWYLDQLGQSAKYDTKVYCRQTLIGGNYGLLDTDTYVPNPDYYSALLWHRLMGNGVLSIDFGGTSYLRAYAHCGKQKGGIALLLINLSQNMGSMVTVRNDLNVGLAQGQGITRDSSFVHGLKRTVSWVGSKASDGLEKREEYHLTAQDGNRFARTMLLNGVPLELTEDGDIPPMYPVQVSASSPIYVAPLSIAFVVFPDFEADAC

SEQ ID NO: 115107 - protein, 121 aa, Triticum aestivum
  Clone ID: PAT_TA_9525.pep
MDEVRGKSLGRPSPLLTGLLPGSRSGASPHLLLDLEREGRTPARPASPSHTEVVEIIDRYDHACVPPNMTDNKLAYIQNEAISRECTRTLTVTKDTKQPIYAYYQLDNFYQNHRSSCPGQI

SEQ ID NO: 115108 - protein, 507 aa, Triticum aestivum
  unsure (1)..(507): unsure at all Xaa locations
  Clone ID: PAT_TA_9526.pep
TTTLKAGTGVLVQRTRPKDSPPPPPSRLRASARXDRSATKSALDELRAKRMRQQDPEAYRSRFKDLVPKSGSSPNRRRAGTPPSDGSNDGGHRGRMNNHVGIAEDNRDDDFGESPSRLDPLKFDDVKSITLRRSKLVKWFMEPFFEDLVSGCFVRLGIGKTKSGTPKYRLCIVRNVDANDPDRQYKLESYETCKYLNVVWDNEANAARWQMTQVSDSPVLEEEFKEWLQEAEKNGVRIPTRQEVLEKKEAIIEAYNFVYSAATVQRMLKEKSAVRRPMNVAAEKDRLRDQLEMALVRRDDAEAERIRARLNHLQKIAQPMSTNEKAAKLEEMNRKNRAENFKNASEMKAVNTSLKAGEAGYDPFSRRWTRSRNYYAAKPEGEAENAEAANGNSDNVIAVTEAVKGGVRVGTAVTASALVAAAEAGKLVDTNAPLDLGTETNPLHNFELPISLAVLEQYGGPKGQFEAYMARKQKIEATMGYKIPDNDGRRHALTLSVSDYKRRRGLL

SEQ ID NO: 115109 - protein, 162 aa, Triticum aestivum
  Clone ID: PAT_TA_9527.pep
IPPLAKGRYRNVMDMDAGMGGFAAALMEYPLWVMNVVPSGSAPDALGVIYERGFIGTFHDWCEAFSTYPRTYDLIHANKVFSFYHDRCDITYILLEMDRILRPEGTVIFRDTVEMLVKIQAITNGMRWKSQIMDHESGPFNPEKILVAVKTYWTAEPAQKQQ

SEQ ID NO: 115110 - protein, 149 aa, Triticum aestivum
  unsure (1)..(149): unsure at all Xaa locations
  Clone ID: PAT_TA_9528.pep
RVFHKKKADTXYAMDGEQVIIGGMTRNATAVGGSAAAGSGSCHDPDQYHHSPPAALFPSLGAGGHPYQLTSCDHHHTHGAAGVSLTDVDPFAGMPPLLSYDSIVDFSQQLQGGGAAAGLRDGAGDQCGGELMDLGLQVQEEHYNYNSLM

SEQ ID NO: 115111 - protein, 335 aa, Triticum aestivum
  Clone ID: PAT_TA_9529.pep
MPLSNNQVPPPAFSQPVVQPVVLDPLQASPGREEGEVPESELDPDTRRRLLILQHGQDTRDPTPPLPAVPPAQVSVPPVQSHGNWFPIEDGIGMNSNNLNMGSAGFPSESDTMHYDKKQPPQPSYFHGGDNNPVSSGRFSYQSQRFPSQVTHTEDHRMLQNHAPPRYRSFPGQRNNLIESGQSYARNVGSVGILEEIALKSGSKVEYRSTLCDTAELQFSIEIWIVGEKVGEGIGSSRKEAQRQAAEISLRNLANKYLLSDPNKMTDVNEDGFGSNPNFFGYSENTRNDILAVPSTSEESRFTKTGENNSKITGGSIAALKQLCTVEGYNLVFQA

SEQ ID NO: 115112 - protein, 71 aa, Triticum aestivum
  unsure (1)..(71): unsure at all Xaa locations
  Clone ID: PAT_TA_9530.pep
SAERCCSSACISSPFFMGDYGEIQQEIQLXRHEHLLACLICLLVDQLSFHAWRPIIIKKHCRELSAAAXHT

SEQ ID NO: 115113 - protein, 229 aa, Triticum aestivum
  unsure (1)..(229): unsure at all Xaa locations
  Clone ID: PAT_TA_9531.pep
DYLWVAEDGMKMQGYNGSQLWDTAFAVQAIAATDLIEEFAPTLKLAHDYIKNSQVVDDCPGDLSYWYRHISKGAWPFSTADHGWPISDCTAEGLKASLLLSKISPEIVGEPVEVNRLYDAVNCLMSWMNENGGFATYELQRSYAWLELINPAETFGDIVIDYPYVGCTSAAIQALTSFKKLYPGHRRKDVDNCINKAANYIEXIQRSDGSGYGPGAVCFTYGTWFGVKG

SEQ ID NO: 115114 - protein, 235 aa, Triticum aestivum
  unsure (1)..(235): unsure at all Xaa locations
  Clone ID: PAT_TA_9532.pep
MHKLGRGSRDKVQQFMAITGASEKVALQALKASDWHLEGSFDYFYSQPQISVTNSRHLEDLYSRYKERDADMIMVEGTSQLCNDLLVDPHDVVMLVISWHMKAATMCEFTRQEFIDGLQSIGVDSIEKLREKLPSLRAEIKDDNKFHKLYNFASAWARQKSLPPETPMAMIGLWFAVRHWTLIDHRCQFLQFRQIKAIYTITWQLSKYDVEAVXPYLIDEFVEDLTENGCVQRNK

SEQ ID NO: 115115 - protein, 115 aa, Triticum aestivum
  Clone ID: PAT_TA_9533.pep
QARLLCFVVTAIAKLATCHNELLPRARVSLAKVARSRTSDRRVWQRACDYLGLMNEPGPRGPVLGPSTAQGNGPGIVNWSEGGTKMVAHIPFYLLAEQKGPPSHDFSYADLLPAE

SEQ ID NO: 115116 - protein, 201 aa, Triticum aestivum
  unsure (1)..(201): unsure at all Xaa locations
  Clone ID: PAT_TA_9534.pep
EXIDNFKWLNSSYCLVMRQLDSARLKEFYFKAHDPSSLSDGTENLKYRNPKYLSMLNHLRFYMPEIHPKLDKILFLDDDVVVQKDLTPLWDVDLKGMVNGAVETCKESFHRFDTYLNFSHPKISENFDPRACGWAFGMNMFDLKEWRKRNITGIYHYWQNLVSNGAKKYCYIVELHLSHRVCYVYVVLLQQSLVSTPSDPK

SEQ ID NO: 115117 - protein, 95 aa, Triticum aestivum
  unsure (1)..(95): unsure at all Xaa locations
  Clone ID: PAT_TA_9535.pep
KRPGNGGACSDISVSDLDRXMYTAGCPXPDIVIRTSGETRLSNFLLWQRTFSPSAGTPDPLWPEFSXRHLVWAILQYQRAYPYIEQNKDLAKKQL

SEQ ID NO: 115118 - protein, 87 aa, Triticum aestivum
  Clone ID: PAT_TA_9536.pep
NLVPSRQQTLKAELQRPGGFLQLERQFRRCTEGISKEVKLPDWRVQELIAQEINYKRALPKTYAHYARKKLQIAEVLGMIPKAEIPA

SEQ ID NO: 115119 - protein, 294 aa, Triticum aestivum
  Clone ID: PAT_TA_9537.pep
EVRELHVKYVGYRIKAYLLLKGKHIDELDEATSECKYPLELALENTCFSPYLEDGVFGWYFDSDLCLLKSLSDYQRLVLPNCAWSEYESLSQYILFYNTHEADRDYVLYWEKMVKEIKWLENHVLKEDTPEGDQMRCKGLYQSVKIASGFTNIDLDLACHGFEEYVWRTRLYRLFVEGLDRAFLEIWKRVNEDQTSFRDALQEVYNDNPVPSRRHTLKAELERPGGFLQLERQFRRCTEGISKEVNLPDERVQELIAQEINYKRALPKTYAQYARQKLQVAEVLGIIPRAEIPA

SEQ ID NO: 115120 - protein, 206 aa, Triticum aestivum
  unsure (1)..(206): unsure at all Xaa locations
  Clone ID: PAT_TA_9538.pep
MVKEMKWLENHVLXRFSGVGGQCAVKGLYQSIKIANGFSNIHLGLACHGFEEYVLRTRLYRLFVEGLDRAFFEIWKRVNEGQTSLSLHENPVPLRNILXGELECPGGFFRDALQEVCTENLVPSRQKTLKAELQRPGGFLQLERQFRRCTEGISKEVKLPDWRVQELIAQEINYKRALPKTYAHYARKKLQIAEVLGMIPKAEIPA

SEQ ID NO: 115121 - protein, 177 aa, Triticum aestivum
  Clone ID: PAT_TA_9539.pep
RQESRSISCRGRDGRPRGGATALVVWARLLALGSGAAIAFRCFGHSLQGPVAYSSIMHKGLACIVTGFLYCSGCPTSLCGGMFLLSCFFFLLHLHCLAFIPDGFVRVLLAKTEIPDGCVGLFQGVVGAVRDCALFFGHLCCCSISASLKLVLAGGKRTIIGLGVVLFWGGSCRVVFV

SEQ ID NO: 115122 - protein, 217 aa, Triticum aestivum
  Clone ID: PAT_TA_9540.pep
MAGNNPPPKPWERVGTLSGPAPFKPPSGGSTSDLVRPCGRFGGGYGIGALQGNNNLYSSYGGGSGGSYGGSGMYGGSMYNNGMGNPYGGMGMSPYNQGPHSFGPPAPPPGFWVSFLRVMHGIVNFSGRVAFLISQNTQAFHMFITALLQLCDKSGMLYGELARFTFRLLGIKTKPNKGRIQGAQAPSLDGPGQQFVEAPKANKNSWENVWNGDAKGM

SEQ ID NO: 115123 - protein, 92 aa, Triticum aestivum
  unsure (1)..(92): unsure at all Xaa locations
  Clone ID: PAT_TA_9541.pep
SARGNLVRRTMNSMTPKXQVFDSRLDLNSKRVVEEMTLVMKIALFCTSESPLDRPSMREVISMLIDARASSCDSFSSPASESPIKDDSSFRL

SEQ ID NO: 115124 - protein, 76 aa, Triticum aestivum
  Clone ID: PAT_TA_9542.pep
KITRGIRKRLTAASLKHRRHKGGSLIPVGHVSLTMRTRQEGAAAARPRRRRPAAARRQSPQKSQGRREPRPSPGAL

SEQ ID NO: 115125 - protein, 146 aa, Triticum aestivum
  Clone ID: PAT_TA_9543.pep
WLAVISRLHRSRSLDRTSRQRTSSSRAPSLPARRQRLRCNGHRSYDAAGVDARSSESLLEVRSGGPRRLSELQCSSHDIARAAMQWSESTPRELPCNGHRRHQSFNAAATTSLSCDAAAVGVDAAGKCCTVAPGAAGDASLQHRAS

SEQ ID NO: 115126 - protein, 249 aa, Triticum aestivum
  unsure (1)..(249): unsure at all Xaa locations
  Clone ID: PAT_TA_9544.pep
IFVKTLTGKTITLEVESSDTIDNVKXRSRTRRTSPXDQQRLIFAGKQLEDGCTFADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTIMLEVESLDTIDNVKAKIQDKEGIPLDHQHLIFAGKQPEDGRTLADYNIQKESTLHLVLELIAGKYNTCSCNGSVPLFRFFTSQYHV

SEQ ID NO: 115127 - protein, 42 aa, Triticum aestivum
  unsure (1)..(42): unsure at all Xaa locations
  Clone ID: PAT_TA_9545.pep
WRKKVGTADWKRRCIEVVFYSLEKPPSXVGLFHSAGLNFMGV

SEQ ID NO: 115128 - protein, 156 aa, Triticum aestivum
  unsure (1)..(156): unsure at all Xaa locations
  Clone ID: PAT_TA_9546.pep
SNPLFPNRYYVPIASLLVGNQPLPIPRGALDIQQYGRGGVYLSTPMPVGMYLNGEVYDLLKAALQAPGATANGLCYSADAKVPLPHHHSSEFAGDAVMALRXGSSVWKTRADGARCLSVLPSSTGETILGTRAQMGRLMTYELATGNAFGFGTVTF

SEQ ID NO: 115129 - protein, 182 aa, Triticum aestivum
  Clone ID: PAT_TA_9547.pep
MSSVQLSGAGVAAVAFSNNGLRLSQTSALRVCSSRRSSRSLVVKAATVVTPKYTSLKPLGDRVLVKLSAAEEKTIGGILLPSSAQSKPQGGEIVAVGGGRTIGDKKVEVSIPTGSQVVYSKYAGTEVEYNNSKHLIMKEDDIIGILESDDVKDMKPLNDRILIKVAEASDKTEAGLILTETT

SEQ ID NO: 115130 - protein, 247 aa, Triticum aestivum
  Clone ID: PAT_TA_9548.pep
MSSVQLSGAGVAAVAFSNNGLRLSQTSALRVCSSRRSSRSLVVKAATVVTPKYTSLKPLGDRVLVKLSAAEEKTIGGILLPSSAQSKPQGGEIVAVGGGRTIGDKKVEVSIPTGSQVVYSKYAGTEVEYNNSKHLIMKEDDIIGILESDDVKDMKPLNDRILIKVAEASDKTEAGLILTETTKEKPSIGTVVAVGPGSLDEEGKRQPLSVSPGSTVLYSKYAGGEFKGADGTNYIVLRVSDVMAELS

SEQ ID NO: 115131 - protein, 115 aa, Triticum aestivum
  Clone ID: PAT_TA_9549.pep
VILNLDEVKAHEASLKWTGFPSKTCGWLQDRTEAALVHHPKQQPNGEAIPLETTSVAGWVHGLLFDGGMAIVGQLICVVVYLRRVTCACNSEGSAGGRVQWATRWHVTTLCLRVS

SEQ ID NO: 115132 - protein, 125 aa, Triticum aestivum
  unsure (1)..(125): unsure at all Xaa locations
  Clone ID: PAT_TA_9550.pep
LWHARPRTSTMGKPCFNHLTSSPHLNHVLRPLFLRHRLWMPVPHLRSCLARLTSADRPWHGEYPVPWPPAPSAERSPRSRPCSDGSHAWRPSHSMSGNCFTMKHKVVVIEFLRWWSSPPXARAVP

SEQ ID NO: 115133 - protein, 273 aa, Triticum aestivum
  Clone ID: PAT_TA_9551.pep
MEKSKHGKRNHREDGSTGRGHGKGRPSGSSMKMNPGGMKNENALQPPNASTSAMNVIRKKVDPETAKYFLEISNLFDNKEIDLEDRSTICANALEETKGKELELVTDGVISHTLQILVQGCELEQLCMFLRSCIQSFAVIAMDKFGSHVAEAALKALATHLEDDTSRVIVEEILNRICKVIAADATNVMCSCYGSHVLRTLLCLCKGVPFDSLQDFHMTKRSAVLAERLSGGSSRPGDQNLTSFEHGFPDMFKTFVRQMLQNAKNDISSRRGR

SEQ ID NO: 115134 - protein, 90 aa, Triticum aestivum
  Clone ID: PAT_TA_9552.pep
ILWAARFFFFFFFFFFFFFFFFFFFFFFFFFFFGHNKMTRNQQLQKKKVILHLQLDPEPLVNYTCNVSHLALHPVDPLRRTTGGVKQNSR

SEQ ID NO: 115135 - protein, 211 aa, Triticum aestivum
  unsure (1)..(211): unsure at all Xaa locations
  Clone ID: PAT_TA_9553.pep
MATAPTSHQLAAGAPWSSLPRGGFRALTDSAPASVRFSVGRRRAARLEVKAAGNIFGDYFQVATYGESHGGGVGCVISGCPPRIPLTEEDMQGDLDRRRPGQSRITTPRKETDTCKILSGTYEGMTTGTPIHVLVPNTDQRGGDYTEMAKAYRPSHADLTYDLKYGVRSVQGGGRSSARETIGRVAAGAVAKKXLKLKCGVEILAFCFQGH

SEQ ID NO: 115136 - protein, 144 aa, Triticum aestivum
  Clone ID: PAT_TA_9554.pep
KQGVEIGSGFAGTDLTGSEHNDEFYMDEAGNVRTRTNRSGGVQGGISNGETIYFKVAFKPTATIGKKQNTVTRDHEDIELLTRGRHDPCVVPRAVPMVETMAALVLMDQLMAHVAQCEMFPLNLALQEPIGSTNSTPALAPDLA

SEQ ID NO: 115137 - protein, 329 aa, Triticum aestivum
  Clone ID: PAT_TA_9555.pep
MATAPTSHQLAAGAPWSSLPRGGFRALTDSAPASVRFSVGRRRAARLEVKAAGNIFGDYFQVATYGESHAIGRVAAGAVAKKILKLKCGVEILAFVSKVHQVVLPEDAVDYETLTLDQIESNICRCPDPEYAQKMIDAIDKVRVNGNSIGGVVTCIARNVPRGLGSPVFDKLEALLAKAMLSLPASKGFEIGSGFAGTDLTGSEHNDEFYMDEAGNVRTRTNRSGGVQGGISNGETIYFKVAFKPTATIGKKQNTVTRDHEDIELLTRGRHDPCVVPRAVPMVETMAALVLMDQLMAHVAQCEMFPLNLALQEPIGSANSTPALAPDLA

SEQ ID NO: 115138 - protein, 146 aa, Triticum aestivum
  unsure (1)..(146): unsure at all Xaa locations
  Clone ID: PAT_TA_9556.pep
IFSSHMIFTLVFVRTYHKYGSKRFIKLLXWVMAIVQSLLIIAARKHYTVDVVVAWYAVNLVVFFVDTKLPEMPDRTNGSPLIPLSNKDKDGRPKDEKDVRLKDEFHKLLNGNHGDPTDRRQRVQMNGRHPEEDMSMLSDATPNGGT

SEQ ID NO: 115139 - protein, 94 aa, Triticum aestivum
  Clone ID: PAT_TA_9557.pep
ILLFLGEGKLTTLKLGRSNIMVAHLVCPCHQSQALGVEVLRQPEVCVHADRSQALAVEVLCQSVHTCHRLLQSEGVMIVIWSVLDVLLCWIKSN

SEQ ID NO: 115140 - protein, 85 aa, Triticum aestivum
  Clone ID: PAT_TA_9558.pep
RTNFQWPSHGLVLQKKVSLFFLLKMRGQSLSFLKRTIFFYEQQECCFHILRGEILCRNENDKKVEKVSPTRHSSPPTPVTFFFFF

SEQ ID NO: 115141 - protein, 114 aa, Triticum aestivum
  unsure (1)..(114): unsure at all Xaa locations
  Clone ID: PAT_TA_9559.pep
QQNGQQEQQGNIFVAGGGSAGAGAGSATGASSGLGASIAAFGDSIAAFGDSIAAFGDSIAAFGDSXLLIMRLWLWCMTQLRRALLGKIWLVVLRAPPGFLITCQYRECKVGRAX

SEQ ID NO: 115142 - protein, 233 aa, Triticum aestivum
  unsure (1)..(233): unsure at all Xaa locations
  Clone ID: PAT_TA_9560.pep
MGQQSLIYAFVARGTVVLAEYTEFTGNFTTIASQCILCGCCXNQWGNRCQLLSWFGLRMISARDMLAGKLLLLHPSSSTESLDQNLKRIAFLVRVKDDFCKRYAGGKAATAAPSSLNREFGSKLKEHMQYCVDHPEEINKLAKVQAQVSEVKNVMMENIEKVLDRGEKIELLVDKTENLRLQAQDFRQQGTQARRKMWLQNMKTKLIVLGIIVALILIIIXLPVCHGFNCGKK

SEQ ID NO: 115143 - protein, 147 aa, Triticum aestivum
  Clone ID: PAT_TA_9561.pep
MGQQSLIYAFVARGTVVLAEYTEFTGNFTTIASQCLVKLPASNNKFTYNCDGHTFNYLVEDGFTYCVVAVESVGQQMPIAFLVRVKDDFSKRYAGGKAATAAPSSLNREFGSKLKEHMQYCVDHPEEINKLAKVQAQVSEVKNVMME

SEQ ID NO: 115144 - protein, 137 aa, Triticum aestivum
  Clone ID: PAT_TA_9562.pep
MGQQSLIYAFVARGTVVLAEYTEFTGNFTTIASQCLVKLPASNNKFTYNCDGHTFNYLVEDGFTYCVVAVESVGQQMPIAFLVRVKDDFSKRYAGGKAATAAPSSLNREFGSKLKEHMQYCVDHPEEINKLAKVQAQ

SEQ ID NO: 115145 - protein, 224 aa, Triticum aestivum
  unsure (1)..(224): unsure at all Xaa locations
  Clone ID: PAT_TA_9563.pep
MGQQSLIYAFVARGTVVLAEYTEFTGNFTTIASQCLVKLPASNNKFTYNCDGHTFNYLVEDGFTYCVVAVESVGQQMPIAFLVRVKDDFSKRYAGGKAATAAPSSLNREFGSKLKEHMQYCVDHPEEINKLAKVQAQISXEVKNVMMENIEMVLDRGEKIELLVDKTENLRSQAQDFRQQGTQVRRKMWLQNMKIKLIVLGIIVALILIIILSVCHGFNCGKCE

SEQ ID NO: 115146 - protein, 139 aa, Triticum aestivum
  Clone ID: PAT_TA_9564.pep
MSAVAPPLCTWIVAACLSATCVADDEGKQRNYVGGGLFGTRRHLAARRGGGSRSGVPIAVSFHPERGGVENNRSETKERRVVVTGMGVVTPLGHEPDEFYNNLLQGVSGISEIEAFDCSSYPTRIAGEIKSFSTDGWVA

SEQ ID NO: 115147 - protein, 222 aa, Triticum aestivum
  unsure (1)..(222): unsure at all Xaa locations
  Clone ID: PAT_TA_9565.pep
MARGGSAVAVLSFLLGLPLLSVLVAGEDPYRFFTWNVSYGDIYPLGXVKQQGILINGQXFPGPQVEAVTNDNLVVNVFNKLNEPFLXSWSGVQQRRNSFEDGVAGTTCPIPPGANFTYILPARVQTGSGFLLPSPASPRAAGGGGAGRGRSRPSLPPPRPPPPARFTPPLPVWYKTNHTDLRYMLDSGKALGFPDGLLINGRGWNGYTFTVQPGMTYRFRIT

SEQ ID NO: 115148 - protein, 96 aa, Triticum aestivum
  Clone ID: PAT_TA_9566.pep
NEIFCRYATLFIGFHHIHSTRGQRHFYVQRYNQSPKKFYPQVFRQVPPKTAPHVLSLVPIPAAAEDQPRQRHHDKHSVSQTHLKQHLVAHIAPHPL

SEQ ID NO: 115149 - protein, 100 aa, Triticum aestivum
  Clone ID: PAT_TA_9567.pep
IMSLRSCCFGVVCHNTSSKFVNLLCNVQVPARKFVCRYPEPPLHTLTQGCHVKKKDMWELLNGQRLQQGREDSCISLLAIPVTIFVITCRVYPQKKTCRV

SEQ ID NO: 115150 - protein, 132 aa, Triticum aestivum
  unsure (1)..(132): unsure at all Xaa locations
  Clone ID: PAT_TA_9568.pep
RLRLDQTSKADXLALLKEITQNGISQDVCVNDLEPPAFEVLRSLKKLKKRFIASNRGDYSAVFMSGSGSTIVGIGSPDPPAFVYDDDDYKDVFVSEARFLTREENEWYREPMSSNATFSKEDSLSEAAPVVD

SEQ ID NO: 115151 - protein, 193 aa, Triticum aestivum
  Clone ID: PAT_TA_9569.pep
IPGLQERICTSDTSTEAGGQLKLLSSYCAEIGRHDAYIQLLDLYLDPKNGREPMFTAAVRLLHNHGKSLDPIQVLERLSSDMPLQLASDTILRMLRARVHHHRQGQIVHNLSRATNVDARLTRLEERSRHVQLTDESICDSCRARLGTKLFVMYPDDSVVCYRCYRNQGDSVSARGRNFRKDAIFKQSWLVSR

SEQ ID NO: 115152 - protein, 74 aa, Triticum aestivum
  Clone ID: PAT_TA_9570.pep
FFFLLIINFKIYISLIYETQLQQAYLSSIPKCTSPIYTTPQRSRTLPRGITCVDTKQGKPKTSSTLHNNITLII

SEQ ID NO: 115153 - protein, 195 aa, Triticum aestivum
  unsure (1)..(195): unsure at all Xaa locations
  Clone ID: PAT_TA_9571.pep
QRWXLRLAAASRKIGRPDYVLLCTYGCSDAVDINKTTACVSLSKMGCIKVTISKQDLPSISYFHVTCPDLTENPFTQSPEILWSSENFILFRVHLVGPGPPEFFLYMVEGPEFKRPMLSLLPDFGSYCVREMLDPYLVGVVPDDDGKSHSVTAFKRKESADCELHIYRLEGSTGTWSKEHIFPDFPSWARSGVFP

SEQ ID NO: 115154 - protein, 88 aa, Triticum aestivum
  Clone ID: PAT_TA_9572.pep
VSIDGEEVAGVRRVGWGFRGNRAVLLADGEVVDVMWDVHDWWFGRRGGGAGAQFMVRSRAEEGRLWMADQPSAAPPGGVFLHVQCYRR

SEQ ID NO: 115155 - protein, 272 aa, Triticum aestivum
  unsure (1)..(272): unsure at all Xaa locations
  Clone ID: PAT_TA_9573.pep
PARQSAAHAPFSLLSIPQNPRESTSPFLQLPAPCRVSPPTNPYPPGYCSCSQPWRPRPSPPRPPSSSTTAPGAPPSTSERPRWCTAVVGGRWRPLRVACEKVVGIDLGTTNSAVAAMEGGKPTIVTNAEGARXTTPSVVAYTKXGDRLVGPRSPRQARRVVKARRNTLLLSPRRFXGRKGNAKGRRKESNARFPTRXVRDDNGXVQAPTCPAIGKQFAPEEISAQXVLRKLVDDASXKFLNDKQRGKPGLFMDGGKAAIKALDPGKKWFLRF

SEQ ID NO: 115156 - protein, 116 aa, Triticum aestivum
  Clone ID: PAT_TA_9574.pep
RFRRIRRHQGNRAHSKAQQKAGKGHQGSTKTAGSPTLQQSGQKRRRTGDDGEPRAEGMADKLLEILERNSQLVAAQLEAQNLNSERDREERREQANSLAVVLGRLADALGRIADKL

SEQ ID NO: 115157 - protein, 63 aa, Triticum aestivum
  unsure (1)..(63): unsure at all Xaa locations
  Clone ID: PAT_TA_9575.pep
DLIKQVQFSPKNFQRAGTRARSRLASSGLASRPRADPLFPARRXCCHVCGTRTSTSALLGEGE

SEQ ID NO: 115158 - protein, 221 aa, Triticum aestivum
  unsure (1)..(221): unsure at all Xaa locations
  Clone ID: PAT_TA_9576.pep
IRHERRMAMCNVNDFFREYIVSRRMEENHVFALEGRCSQTTRRTGRHLVIDKSWDGDESVFNRIEFSRLRSVTVFGPWKPFLASDKMRVLRVLDLEGTEGLTDNDIKNIVKRLPRLKFLSLRGCKHIFRLPKSLGRLRQLQDPXDVRHTAVAGLPATVVKLQKLQYVRAGNTPEEYAVSDSTESSTSVPICFSCGPVGNHIVRVEVPRGVENLTNLHTLGV

SEQ ID NO: 115159 - protein, 97 aa, Triticum aestivum
  Clone ID: PAT_TA_9577.pep
ESSGEAKPELRRSKVHLRCAPGQSISAIKFASFGTPSGTCGSFEQGECHSTKSQTVLEKCIGKQRCAVAISPDNFGGDPCPNVMKRVAVEAVCSPGT

SEQ ID NO: 115160 - protein, 135 aa, Triticum aestivum
  unsure (1)..(135): unsure at all Xaa locations
  Clone ID: PAT_TA_9578.pep
PPPPPLSVLNLEPCIFWRGEPSHTSAPAPTAGPPPEDDGGAKGPHIPTGRQIPRPRSPPFAAKDEALDSVAEELAVEVEEEIAVVWRRSXEYMEPSEEAKVXVCNLPYDVSSERLAQLFDQAGVVEVAEVSISSS

SEQ ID NO: 115161 - protein, 203 aa, Triticum aestivum
  unsure (1)..(203): unsure at all Xaa locations
  Clone ID: PAT_TA_9579.pep
MSDGGDSVSSDDCIDDCLEACCCDCFWDPICFRILCALVILAVLATVVTLLVIAFVPRPVGVSVEDAALTRLDLAVKNATSTALSYDVSIAVAVHNGNLFMPAEHTAGDRRGRGPTXRRKVYHATAAADSVSVALGSADVADFHRESAAGLFQLEVKIVGEVMYRPHHKKHRLDAICRLELALSTATSPAMFKKVKCDVQKEH

SEQ ID NO: 115162 - protein, 273 aa, Triticum aestivum
  unsure (1)..(273): unsure at all Xaa locations
  Clone ID: PAT_TA_9580.pep
RPNLPVDLLPPPHLTTVAPIPSRALPPWXFPCTLVLHXSRAPLVTSSPRAPPSMAEVDPLLPSLAGPGPPLPQKPATTSHPTTAPPPPTPRPXPSPPTTSHPTAAHPLPTTSQAPTPWPLRLPFLVAPDPSTXPPADSTPPPPHPTQLPRPSAGPATXPVLPWRAPPPPIAVAISTAPETFGSWQPRPSLPRPPQPDLAPPSPLLHLLAIEGSPGLKEKGSLSATGDASVVFALEVLCSLPAHSLDACEGSQTGAPMHRGRAVVALCNSEQWF

SEQ ID NO: 115163 - protein, 283 aa, Triticum aestivum
  unsure (1)..(283): unsure at all Xaa locations
  Clone ID: PAT_TA_9581.pep
EGPRRRGWPLRSGDYAELCDRCYGSFEHGTFCETFHSEVAGWRKCEACGKRLHCGCIVSVHSDXLXQPRGVDCIXCARKSYAAMAPSQMWSTPTVHMPQNVADRKDSYVKSWRPPTGQISSQWRQNHHLWNMSTIQPDLQQRRAYEFDRPSGSEKLPPGRTFIHAXQKKSDDMHDRPTTPAGMGLIIRDRYPNGLGQQTSMDPTHSSTPYQREGPIPNSLQDPSHHVGESDPLSSRKGIISDGGSTVSTGFKLDSHHPSILKDDAATLPTMGGYTITNYPPVP

SEQ ID NO: 115164 - protein, 196 aa, Triticum aestivum
  Clone ID: PAT_TA_9582.pep
WCYVGLLLWPLYQIRPLSQPASPSSSVHRLIPTPSPSSIQIQHTHTHTKRKWISLWATPPMATPPPAGHHLAPRPRVTLVPPRSTRPLCARSALTGGEGAVATAKSGKEGAAGKCQPTRSLASRWFPASPSSGEATHPASPRVHLLPQRWRVEQPTQGRGGARSSREENRGREEAAAAAAAAREKVACDVKFWRKG

SEQ ID NO: 115165 - protein, 106 aa, Triticum aestivum
  Clone ID: PAT_TA_9583.pep
ALSPPPQKFPKSSPEPSLLESSKKYRNIVRLHQHTNSCTHGDRDIQVQVLCDAEQAGSQAQLVPKKAGASDRRGQRLRQTIVLTRATAATNTRQGNGRTESGVPSC

SEQ ID NO: 115166 - protein, 276 aa, Triticum aestivum
  unsure (1)..(276): unsure at all Xaa locations
  Clone ID: PAT_TA_9584.pep
LCGAXLSPCGXHXVAXTSTFGSLSSTTKLLLVLGLLALSIIFAVAAVLKARSLKRSAEARAWRITAFXRLDFAVDDVLDCLKDENVIGKGGSGIVYKGAMPGGAVVAVKRLSAIGRSGSAHDDYGFSAEIQTLGRIRHRHIVRLLGFAANRETNLLVYEYMPNGSLGEVLHGKKGGHLQWATRYKIAVEAAKGLCYLHHDCSPPILHRDVKSNNILLDTDFEAHXADFXLAXFLNXNAGGXXCMSXIAXSYGXIAPEYPTSQGGKTTVNFGVCAGL

SEQ ID NO: 115167 - protein, 119 aa, Triticum aestivum
  unsure (1)..(119): unsure at all Xaa locations
  Clone ID: PAT_TA_9585.pep
FVXCLSFDXSLPPLDEEGDTSXPLCAEPLSSXGLTSWIDTESRCMSRVISTTPSSSSLNLVVFVALWLEPSKFPLFGIDVAVLAGGLLELSESVTTVPASISGISIFIYLSGQFLLVSA

SEQ ID NO: 115168 - protein, 47 aa, Triticum aestivum
  Clone ID: PAT_TA_9586.pep
ITYKRLREENEFAQKIEEEKAPVHEIDDLSLQLLHFFFLTTDKLELI

SEQ ID NO: 115169 - protein, 140 aa, Triticum aestivum
  Clone ID: PAT_TA_9587.pep
SRSTLHRWKLTAPAMRKPIARLNLQTLGPYCSTSTTTEKMVIQPDNKSLIPGTMSRRVELTTSYLSDSPVACLTRSESARSAGAGRRRVELTTSYLSDSPVACLTRSESARCDLAGRRLKIRGLKARPLPGQSRARGAPP

SEQ ID NO: 115170 - protein, 136 aa, Triticum aestivum; identical to SEQ ID NO: 106789
  Clone ID: PAT_TA_9588.pep

SEQ ID NO: 115171 - protein, 302 aa, Triticum aestivum
  Clone ID: PAT_TA_9589.pep
MEAMRGYAEMKQLGEKGLEMIGSCRKYPELKGCWDDIAKSLPHRPYLAIYRRAHTLLHRSTGCKWTDEEKEQIRRFVEKNGTDWKTLAQELGKSEIHVKHAWRRIKPKKKKGADDEEDVSGGESELVHGHRFTTEEDAILMEAMRDYAELKQLGEKGLEMIGSCSKYPELKGCWDDIAKSLPHRPHEAIYHRARILLYRSAERKWTDDEKEQIRRFVESNGTDWKTLARELGKSEIHVKDTWRRMKPKNLKKGRWTQDEHQNLFDLVNLDLRLKAHQIKNPDHRLLCDFPSWVGFCVLVTLS

SEQ ID NO: 115172 - protein, 145 aa, Triticum aestivum
  Clone ID: PAT_TA_9590.pep
MYLDAGGNHETFSGGTVPESFSVRSRNSSNSSGAGAAFCRLLSLQILDLSNNQLTGELPDCWWNLQALQFMDLSNNSFSGQIPAAKASHNCSLESLHLAGNDFTGTFPRVLEGCDSLANLDIGSNKFFGAIPPGIGNRVPVVENP

SEQ ID NO: 115173 - protein, 150 aa, Triticum aestivum
  Clone ID: PAT_TA_9591.pep
RSEKKARMAASQVNGPVLVEDTCLCFNALKGLPGPYIKWFLEKIGHEGLNNLLKAYEDKSAFAMCIFSLALGPEEEPITFVGKTAGKIVPARGPADFGWDPVFQPDGFEQTYAEMPKPEKNQISHRGRALALVKEHFASANYEVQGDGLA

SEQ ID NO: 115174 - protein, 210 aa, Triticum aestivum
  Clone ID: PAT_TA_9592.pep
MSGAAAAVARVLPKAVTFVTGNAKKLEEVRAILGSSIPFQSLKLDLPELQGEPEDISKEKARMAASQMNGPVLVEDTCLCFNALKGLPGPYIKWFLEKIGHEGLNNLLTAYEDKSAFAKCIFSLALGRKEYPITFVVKMAGKIVPTRGPADFGWDPVFQPDGFEQTYAEMPKSEKNEISHRARALALVKEHFASANYEVQSGLNSFSSTK

SEQ ID NO: 115175 - protein, 91 aa, Triticum aestivum
  Clone ID: PAT_TA_9593.pep
KSKLYTNVFDQIHQIDRVFKYYYSSSLMLLRNDLSSLAFLSCSSSSGHTTLLSASLMSIASLPWLPFLLLSTTGEGEDKSMAPASDSANET

SEQ ID NO: 115176 - protein, 68 aa, Triticum aestivum
  Clone ID: PAT_TA_9594.pep
SSASNTSNSYNEEKPITGLSLPKVGAGDDDDALLILDMPGDRSSEQLPLTWKSSGLKFDVQENQIHRK

SEQ ID NO: 115177 - protein, 80 aa, Triticum aestivum
  Clone ID: PAT_TA_9595.pep
FYPSFPFSTPCPSSLFNIYTSLPDCLSWMVSLQTWPNMNPPSFHLHMLIPSHARSNRSFLKVHKSFLNTLQVLEHIVHLQ

SEQ ID NO: 115178 - protein, 194 aa, Triticum aestivum
  Clone ID: PAT_TA_9596.pep
MVRKEKTTTGMRLPPQHQGLEVKIPSFFRCPISLDVMRSPVSLCTGVTYDRASIQRWLDSGNTTCPATMLPLPSTDLTPNLTLRSLISHWSASAASCSPIAGSAAFFAGPSPAGLVRQVASSGADPSAALRELAAYLSDDDLDEFEKNALVGAGSAAETVASVLRRKGEHISVAVAEAGVRLGAIGALDIEDAN

SEQ ID NO: 115179 - protein, 80 aa, Triticum aestivum
  Clone ID: PAT_TA_9597.pep
YQKYQVLQKERKERKGKKRVRHTNGKPAVPRQLRDKLRDENPLVPYNTQHHKSSRSSYSTGAARCQLLFGDSEDSDIDGM

SEQ ID NO: 115180 - protein, 200 aa, Triticum aestivum
  Clone ID: PAT_TA_9598.pep
TRQRCIGRPAASASEDDALAEGSVNTTSYRPSVLFQEDLHFYPVKKHGSNMLMVFNTTAESFRWMSAPATPESATLFEMDGKLVLYYIDEDITMIDICVLQDYDNEVWEFKYKIKLPVADLRLSARSRGYISPVLYEKGGVLISMHSRLVQVDTLGSVRSDIIWSGSNLSITPYKLKQSLVRHTFFPSQPGGASSGGPFI

SEQ ID NO: 115181 - protein, 53 aa, Triticum aestivum
  Clone ID: PAT_TA_9599.pep
VDCMLLTSRLISLNYVNSFYIQWDLCPAALPSAEQKKLAEELPLRGGFGTSIN

SEQ ID NO: 115182 - protein, 239 aa, Triticum aestivum
  Clone ID: PAT_TA_9600.pep
AVQDALDIPASIEGPSASCESTTTSNHSGVASSSDNKQQQAQATEISSQSLVLESVKHYSQQQMIVPEAGSSIARSTSEEVVFEPLEPISDLPDVDADGFDIEELMRMMEDDPIEVEPVTGANTGVELGQQEPLYLDTMDQGMLENMLQSDCPYPMSGSEGRAMHNPAFHDAEKEKRYNAASDLDAPSLQGHDHLFKQPFDPFEAAWKAEEALEKEKRDNLHAGPLGGHNNFFSPASVY

SEQ ID NO: 115183 - protein, 232 aa, Triticum aestivum
  Clone ID: PAT_TA_9601.pep
RHEADLGVVSLLKHILVGDDYEKLAAIEAYDASRIREVQDKNVSASDDSSTAATTDPRSVRVPPAAHIRRHAGRLLTILSLLPNSKKEIVSDDVWCKWLEECATGRIPCNDIKLKSYCRLTLLNVFCSESQNTRSVSGECPDSECEYKRKCPQFGDALFLLNPELPLEVHLGNSGCGTSRDTCKDDGCIEHSGSKTRSVEGQVLHQDVSPLKLMPVCPWPSGWAIQLNGGNL

SEQ ID NO: 115184 - protein, 185 aa, Triticum aestivum
  unsure (1)..(185): unsure at all Xaa locations
  Clone ID: PAT_TA_9602.pep
MPQPSGILASASSDHTIXFGYAMSGSLEPHCSGFQDSQVNRLEITPDKRFLPAAGNSHIRLFDVNSXSPQPVISYDSHTSNVRAVGFHCDGNWMYSGSEDGPVRIWDLRTATCQREYESRPAVNTVVRLPALHLLVARVRCGPVRVGGAAPLSRSSVLLPEVATALCSLTGLSDLKNYGKFSIQP

SEQ ID NO: 115185 - protein, 109 aa, Triticum aestivum
  unsure (1)..(109): unsure at all Xaa locations
  Clone ID: PAT_TA_9603.pep
YTRLLRATPSNLYTFFSNTHQTFGRHISSIEQIDAGLPXQQFPSCKYSVPDMRAMSFTAHDWGPLHIGRSEAPTSWSKEAGRTPPLLATNVWKPVTPTTPTQGRQPLSR

SEQ ID NO: 115186 - protein, 116 aa, Triticum aestivum
  Clone ID: PAT_TA_9604.pep
MYQGGLEYPVELAHPGHRGCTGGVLDIAKLSLAKQFHPTTPTYLFCSRTGLHRPNRALVVGTQRSFKLTGEARTSSNLSFSRASPSVSRGALCSAWSGQATGQNELSRRGIMLNFK

SEQ ID NO: 115187 - protein, 218 aa, Triticum aestivum
  Clone ID: PAT_TA_9605.pep
MELFAHAKAVRLKSRHDKFLYADEDELHVTQDRNGSSPSARWTVEPVPHAPGAVRLRSRYGRYLAASTEPFLLGMTGRKVLQAAAAPGGRPDASVEWEPVRDGFQVRLKSRAGGVRGGGDKYLRANGGVPPWRNSVTHDVPHRTATQEWVLWDVEIVQVLTPGPATPAPEKAASAPPAALAPDSPPAPKLRPAPTPYEAHHRPTKSQTSPSPPPYAPA

SEQ ID NO: 115188 - protein, 168 aa, Triticum aestivum
  Clone ID: PAT_TA_9606.pep
VRHAKMKISRNIVKSNGQLGTESEILTIDIKPGWKKGTKITFPDKGNEQPNQLAADLVFVIDEKPHDEYTREGNDLLIYQKIDLVDALAGTTVNLKTLDGRDLVIKLTDVVTPGYELAIAKEGMPIVKENGRRGNLRIRFDVDFPKRLSSEQRQNIRKVLGGGGQPQQ

SEQ ID NO: 115189 - protein, 164 aa, Triticum aestivum
  Clone ID: PAT_TA_9607.pep
MAIGQTMPKGSLATSLSFPSSGSTRILGRKRVAVSPAPSPSGPHSPVRTLRKQRSIRFHMDDTICLLESLPQDVLVKVLCKVNHSDLRQLLLVSKPVSEATVVAKELHFAFATPSKASADAEEEDDGPGAPKQHRVARSRCRGMNLASVAVNLSESFSSLMSEV

SEQ ID NO: 115190 - protein, 152 aa, Triticum aestivum
  unsure (1)..(152): unsure at all Xaa locations
  Clone ID: PAT_TA_9608.pep
NIFFQKTISRVYDLKGSVRSRYNSDTSSHNKVLLDSNLIEELHTKPIFLGRKAKRTLERAVWNDTSILASLDVMDYSLLVGIDEENNELVIGIIDFLRQYTWDKQLETWVKASGILGGPKNETPTVISPVQYKKRFRKXMSRYFIASPTMAS

SEQ ID NO: 115191 - protein, 100 aa, Triticum aestivum
  Clone ID: PAT_TA_9609.pep
PPSQVRFPRSHLSPPLLRLTALGSGQSGPPAQLCARRSRGLASWCLPGGFCPVLPIASRWFVFSAPVGWGLLRAEAVGGSVSESLMVGNTESLETAVFNC

SEQ ID NO: 115192 - protein, 136 aa, Triticum aestivum
  unsure (1)..(136): unsure at all Xaa locations
  Clone ID: PAT_TA_9610.pep
FISTTNSYIDTARTIAATTTTENRPLFALQAQNKKASPQHSNQFLLSYPYCEQMIFSSQAGLLHGQRLIDLVGAAFEHHNPLLKRAPCCREPLVRGSRDLQGITTVVLNSTMSCHGVPHVWVLELVLSLVPNXLQX

SEQ ID NO: 115193 - protein, 212 aa, Triticum aestivum
  Clone ID: PAT_TA_9611.pep
ASIGKLTKLRRLLINRSTEVPDKIIGKLEALEELVGIDISKSPNILQEIGTMPELRVLSIALWSWDEHHTTLLSQIICKLAMKKLRHLSICSCCLLDLKPDLKPDLQPVLQLEKLEIQGSIFEKLPTWINGLTHLRSLSIEIYSLENNALEVLGELELLFLSLVAKRTAGEKLVIVTNTFCTLQTFLLFSRATAIEFEQRAMEKLQRLKLTL

SEQ ID NO: 115194 - protein, 114 aa, Triticum aestivum
  Clone ID: PAT_TA_9612.pep
SSTPFILCAELTLVCQDFFFICYPSFGCSLSSYRNQSWCSSYLHLIMFLKFPSTTIYNNVGMCFLLSVSIVHLHDVELCATEYTLADLNCCFPSPNQMPFVFAVCIPRSSLRSW

SEQ ID NO: 115195 - protein, 164 aa, Triticum aestivum
  unsure (1)..(164): unsure at all Xaa locations
  Clone ID: PAT_TA_9613.pep
ASLXRMTLXNPTKEWAFPDLYANPNNNSDKQSTACCLSDVAHESSTGEGVSAASGKEHKINTYRDRAAERRKLHRGLGIGPGQKQSNGMSSDEYEEATEDMDSLGAGPVDMNLCSSGLKSAKRIMENMGWKEGEALGKSRQGIVEPIQPTFNKHGAGLGWSQTR

SEQ ID NO: 115196 - protein, 357 aa, Triticum aestivum
  Clone ID: PAT_TA_9614.pep
HPALGGYIRFLNIYTGIFIRVHIPCFEDHSMLDCPDGLLLLQRKKDVVICLLHPFTGDVAEFPPLASLCMYMSKFGIFLNGPYDLLLRMVHTAVSVHAGGSITIMLALSHAERMAYVSTGDKHWTHTSWIMSGMRTALPFLGSLYMVRSSKNKPSQIMRVDPPDSSSSSSWSSTPPQMIATCPANQMVKPYLVECNSELLLVVYTDRKSRLVVIRLADLLLGVPATPLTSIGDHALFIGTWSMAVNSTNLPSVQGNSITVLIPRKSGRLRQYDLRTGTWSLLCDGYFLNANGPIPRPYSLVHHIVSCCQRLYWLSGHIWTLYHRSQPCWTIVALAHRNVCAVCSDQLKAIHLSNIYV

SEQ ID NO: 115197 - protein, 92 aa, Triticum aestivum
  Clone ID: PAT_TA_9615.pep
SPTIPPRQLDGSVDLRLGALNDWRLDGFFLLLPTAPFCASGGRRPLVRWPRRTTKRRLGLGTRGQIREGLRQRFVEVASLNQVSGFDAWCSE

SEQ ID NO: 115198 - protein, 81 aa, Triticum aestivum
  Clone ID: PAT_TA_9616.pep
QQWRSNCSKGTLSHNRYKLAGSISKDNNLNHVLSQVTYAADRLSDTTTQSEYDLQQINHYYWGLDDDIEGISALSNAGHEE

SEQ ID NO: 115199 - protein, 100 aa, Triticum aestivum
  Clone ID: PAT_TA_9617.pep
MRKMFTRRASSYAPGKSLTLGSRHTGSDSVLAQSTALHPPIHLQLQNHLLPRKSCRVDYHAWAPDSAEVALVGFANPTTSASAAERADQHGLRCCSDGHG

SEQ ID NO: 115200 - protein, 117 aa, Triticum aestivum
  Clone ID: PAT_TA_9618.pep
MAAMSYSSSSSAAAAGGGGAAAATAAGLKTYFKTPEGRYKLQYEKAHSTAVLHYNHGGKTVSQVPVDALAVRAPARGISVGTPSSSCGMRSEYFWLLGSGVGSRVLFAWYLNGIWMR

SEQ ID NO: 115201 - protein, 144 aa, Triticum aestivum
  unsure (1)..(144): unsure at all Xaa locations
  Clone ID: PAT_TA_9619.pep
CSHPLPDPPPPHTTPPXDPPPAPPTPLPPSGSPXPPPPPHSLPLDLNAPPPRPAPHRVPHQAPHRPPRPAAPTHAPLELPPRWRPPRLRTQPPRPGXGLPLPLPHTAATPSSPSPLLPPTIDPTGAPPPTATTARIRAERRWRW

SEQ ID NO: 115202 - protein, 174 aa, Triticum aestivum
  Clone ID: PAT_TA_9620.pep
MARPSKGKVCVTGASGFVASWLVKRLLESGYHVLGTVRDPGNQKKVAHLWNLAGAKEGLELVRADLLEEGSFDDAVMACEGVFHTASPIITNADSKEEMLDSAINGTLNVLRSCKKNPFLKRVVLTSSSSTVRLRDEAEFPPNVLLDETSWSSREFCESIQIWDAVAKILAEKS

SEQ ID NO: 115203 - protein, 338 aa, Triticum aestivum
  Clone ID: PAT_TA_9621.pep
VRPRVRRRGRANTSKGKVCVTGASGFVASWLVKRLLESGYHVLGTVRDPGNQKKVAHLWNLAGAKEGLELVRADLLEEGSFDDAVMACEGVFHTASPIITNADSKEEMLDSAINGTLNVLRSCKKNPFLKRVVLTSSSSTVRLRDEAEFPPNVLLDETSWSSVEFCESIQIWYAVAKILAEKSAWEFAKENNIDLVAVLPTFVIGPNLSPVLGPTASDVLGLFKGETEKFTIFGRMGYVHIDDVASCHILVYETADAKGRYISTPRVRAGTGRAPLPAKRFPSFPIPKSLPNIYGEQTYGYNTSKIRKLGLEFRGVEEMLNDSVESPKAHGYLREAAA

SEQ ID NO: 115204 - protein, 212 aa, Triticum aestivum
  unsure (1)..(212): unsure at all Xaa locations
  Clone ID: PAT_TA_9622.pep
EGXLAPQVLELMMMLFNVETYRAAMMEFEINMAEMPLGKLSKENIQKGFEALTEIQNLLDDTGNQELALRPRRLVAASNRFFTLIPSVHPHIIRDKDDLTMKAKMLEALQDIEIASKLVGFDGDNDESLDDKYKKLHCDITPLAHDSEDYKLVEKYLLNTHAXPTHKDWSLELEEVYVLDRDGEGSKYSRYKNNLHNKMLLWHGSRLVDAAA

SEQ ID NO: 115205 - protein, 144 aa, Triticum aestivum
  unsure (1)..(144): unsure at all Xaa locations
  Clone ID: PAT_TA_9623.pep
XNEKSDIYSFGVVILEAITGRDPVDYGRPANEVNLVDWLKMMVASRRSEEVVDPXXETRPSTRVLKRALLTALRCVDPDSEKRPKMGQVVRMLESDDPIPRVDRRSRHNRGGSTEMDSQRENSDTDKSDNPDSKPSRSRASSSK

SEQ ID NO: 115206 - protein, 125 aa, Triticum aestivum
  unsure (1)..(125): unsure at all Xaa locations
  Clone ID: PAT_TA_9624.pep
TIIKGSISILSDAGLGMAMFSLGLFMALQPKIISGGKSVATFAMAVRFLTGPAVIAATSIAVGXRGVLLHVAIVQAALPQGIVPFVFAKEYNCHPQILSTAVIFGMLVALPITILYYVLPWDIEP

SEQ ID NO: 115207 - protein, 196 aa, Triticum aestivum
  Clone ID: PAT_TA_9625.pep
AHIYNALIKGFCQASKFSDAVRIYGEMANNGCSPTVITYNTLIDGLCKAEKYQDASSFTKEMLEKGCKLDVNTYASLIRGLCRDKKVDAALALWNQILDKGLQADVMMHNILIHGLCSAGKVDEASRLLSEMKEKNNCRPNLVTYNTLMDGFYEMGCFDKAASLWTAILENGLVPDIISYNTRIKGLCSCQRTPEG

SEQ ID NO: 115208 - protein, 343 aa, Triticum aestivum
  Clone ID: PAT_TA_9626.pep
NDSRLNVGLACTSAVVGAAVLNYAEVVSLIKDESPARPIGARIRDTLSGKEFDAFAKVVVNASGAFCDSVRKMANNDVVPMIAPSSGVHIVLPDYYSPEGMGLIVPKTKDGRVVFMLPWLGRTVAGTTDSSTAITMLPEPHEDEIQFILDAICDYLNVQVRRSDVLSAWSGIRPLAMDPSAKNTESISRDHVVFEDYPGLITITGGKWTTYRSMADAALLAALWARMLKPAKRGVAALLLFAGGYGWAPAALSVLPLHCMPWMMTYGGTVGPGPLGGAVSWHLPLAPGTLAVCVAARAPRDGLALRRPPGSPVGDAELAGGPQHQHMFWVPLLYPKFMTGYPQ

SEQ ID NO: 115209 - protein, 245 aa, Triticum aestivum
  Clone ID: PAT_TA_9627.pep
WGGAKHEPGDADDNGRRMHPRSSFRAFLEVVKWRSVPWEDVEMDAIHSLQLILRGSLQDEDATDNNAGSIVEAPSDDIKKIQGLLELRIVTNEMVRLIETATAPILAVDIVGNINGWNNKVAEITGLPTTEAIGMLLVDLVEGDSVEVVKQMLNSALQGTEEQNLEIKLKTMHQQESKGPVVLMVNACCSRDLSDKVVGVCFVAQDLTGHKMVMDKYTRIQADYVAIVKNPNELIPPIFMINDLG

SEQ ID NO: 115210 - protein, 346 aa, Triticum aestivum
  Clone ID: PAT_TA_9628.pep
PTRPYICYIKHYRGRWLKLDDCKGMAGDAARGHAQGAYMLLYSRRTARPVPLLPVKEPIKHEKQCKVPPLNGQNHLIPEDMSLKCESFSKSSEDLREDSESSNDSLHRMDTVNQVSDLDLHMNIERDKFVANGSIHQPISSALHVLEEDTRDSGSLLEGNNTMRADQFGNSACESSSVNSSEEECKEPAPGIDSVDYMDIDVEAGTEVETQNVQQQPILGDSVGVIRNKTSVPTFENCMAGKPKPLFSIGFLDKPSRKKSDSREECQNGGSMAVSSQKIDGHCNEHLIRPEQGLIANSLGGSPSSANGSVHCNGDVFVTPSNGVLVNGDTQSDNYSLDAAKRDVPS

SEQ ID NO: 115211 - protein, 78 aa, Triticum aestivum
  Clone ID: PAT_TA_9629.pep
TVARKNLLGGKAMKAVTNWPFAHFNQVCNLQKEIGIVNMSLCAWLHDYYQICKLISGSNCLDPLSVIKFSLLDSFFCL

SEQ ID NO: 115212 - protein, 230 aa, Triticum aestivum
  Clone ID: PAT_TA_9630.pep
MVRPRHVFAYADGTPQLELLCAATTGDLAHREPARGKLDGGRGRLAEAVEAVKDHGAGALHLAASGQNLEVCEYLVEDVGVNVDAVDEAGRTPLVWAIIVKGGQVDIVKYLLDHGANPDNADRTGITPLHEAVERGHCEVVELLLSRGAYVDPFSTIDGTPLHVAAEHKQEWAMKILLDHHADCNKILRGFLTPLNIAIESRSVKCVKLLVKAGADVKGPRNATPLQGAA

SEQ ID NO: 115213 - protein, 104 aa, Triticum aestivum
  Clone ID: PAT_TA_9631.pep
APHILFHLKQSTQSSGVVVDGRELKSRHHLVLGFVYIFRSPVTITIICLSSGDYSQGLLYQITLPRYHCVPGWLFMCSTAVCGLLCSVKCQYCSVKCQYLLCDP

SEQ ID NO: 115214 - protein, 205 aa, Triticum aestivum
  unsure (1)..(205): unsure at all Xaa locations
  Clone ID: PAT_TA_9632.pep
PPPSGASPTPPPPPPPPPPPSCLPPFPPPPRPCDAMRPGSEESNVAALPCFFQVPKQQAPQPAANRGVASTSREAQGPPPPVSAXPGRGRKHACAPGTLATSAPPPGPPRRPARPAPGAHAPPGSPPSSRXTALPPPPKLGVVPAPASSSCPPGPDPPSALPRGXAPLAALPHAGPSMQGVQLILNSSSSAGNPEAPFAVTRRLI

SEQ ID NO: 115215 - protein, 140 aa, Triticum aestivum
  Clone ID: PAT_TA_9633.pep
GVPALLSNDSVNGLEMFGFISPPLIEVIEALDPDHKCLDYWLSKHTPPLRRLLSESLMTTTVDGTNNSSIRLLGVDIASNESERSSFHNNSCAGETKLSRLLKKAKWPEEQELIVMNKAISGRMDNSAGLQDEMKNYVDK

SEQ ID NO: 115216 - protein, 176 aa, Triticum aestivum
  Clone ID: PAT_TA_9634.pep
LVDAHQLISQFYNTREISDDAASVLQYWKQRKYLRKNIWLETWLRREIQALTQDENIEAIVYHIDGMIESFMKAQEKLHASKQTSPEHTREEFRSLLSDAARPFLLGRTARFVTEVELFLISQRNIDAYSRVRLQRFKESASHVAREQDTLPQDRPLEDHYLYLLNEETDCVGGVI

SEQ ID NO: 115217 - protein, 221 aa, Triticum aestivum
  unsure (1)..(221): unsure at all Xaa locations
  Clone ID: PAT_TA_9635.pep
MDGRRRGEREVNRWHTGPEEARERDSGSSSPAAILLFALIGATVTTAAVGQLRRTFGWFYTQLSRSEPYVYWEDIPRGPNRCGDAWRYYRRTRETNEDQRKRVRFLXERIMHMQDMFKKERSKCRDYRTRNGHNPTYNQHSRREDWYEDAETFYANQRTNFRSRPXXMQYSMSHHYSSWPKQSRQNISDAEIRCLRETMDTSDKPKTVLGNQEQDLQHKWI

SEQ ID NO: 115218 - protein, 119 aa, Triticum aestivum
  unsure (1)..(119): unsure at all Xaa locations
  Clone ID: PAT_TA_9636.pep
MAPHPPVLLLLLLAPLLLCSLLPDAARAAGAEDTGVTIVRKDGTTCTLCASCGNPCNPNPGYNYPSPPPPAPVTPAAPVYPPPTSYPSSXGGGGGGGXYFYPPPTGGWGTGGGGAGPLG

SEQ ID NO: 115219 - protein, 151 aa, Triticum aestivum
  Clone ID: PAT_TA_9637.pep
KVASSSLVQQCAGEDEETTPLSGDQSFFTAIMCKTHVQKPYLLIIPTHFQRRLPARRAAVVLRCRGSSWIMSYCGDTKLKRLDQGWEHFAVHNRLQVGDACVFELVSGYAGDGGKREVVLEVQVLRRGGLPEPEDLATKGDTADEAIIILD

SEQ ID NO: 115220 - protein, 236 aa, Triticum aestivum
  Clone ID: PAT_TA_9638.pep
VRPRVRPRAFPKSPPPRTPSTAAASGDLPRRRVPAPLRLASLLKTPCRREILRADTLLPNLPRRRRRRDLVGAPASSSRSSASNGKGLGRTVEAGLPLRSRRHSPLNPAPKPSKSRVGQEFVRSVTCRFPNQPEAAAVGMSDEDGDPDWLTAFKAPSTAPVMLSSDSDRSRGNSPTRTAPSNQEEKAPRKKLMLSSDSEASPGNSPSRAGDADEEEDSLANTRKKDDQQSKGKKTK

SEQ ID NO: 115221 - protein, 103 aa, Triticum aestivum
  Clone ID: PAT_TA_9639.pep
GRGLGRLSRGKAGPVDPEHAEGRHRGESPGSTHHGGDSKAPLADGEPRVTGLVLVLDGLVVGGKGGARRAGVEARDAPVDGDQHQERDTSRLEVVETQPEELE

SEQ ID NO: 115222 - protein, 169 aa, Triticum aestivum
  Clone ID: PAT_TA_9640.pep
RKPHLKHGGRMQFGLFLKGAGLKLEDALTFWRSEFSQKVGSERFDKEYAYTIRHNYGKEGKRTDYTSYSCQKIISATPGVGDHHGCPYRHFGEENLRAALNNMGVGGNALEGILDKVKNRHYQLACTMTFEATHGVSCDTGINHPNQYFSESQKVLQAKNQTVQSQLST

SEQ ID NO: 115223 - protein, 182 aa, Triticum aestivum
  Clone ID: PAT_TA_9641.pep
LPSFSTVILSLQPVTNAGVRSIVNYVSLAFSLALRFHLVLLMYSKGKPPRGLGEREQGATVALQKRWVSGRHAWGPWKAWVRRATEDRAGFFVMGRLLVVLSLRCGICHDWRGERAPRQALEGQGRPRPSAGSDRRCSSRRTAVSALPLAIKENRVERGPREELGGWERHRLAREGLGLWAS

SEQ ID NO: 115224 - protein, 278 aa, Triticum aestivum
  Clone ID: PAT_TA_9642.pep
KGVKLCLPTSHAHPEGAALTSPVCVDWYPDVTISVGAVGHDVVAVATSNPCCLYILRVRPLSSLQYELYETQHVQLQYEVSCISIPEEDSRLRTSSSAFGGDFRKRKGNNSAAEVDVRMFAVIGTHKPSVEVISLEPDEAFRLLSIGSISVNNALGAPVSGCIPENVRFVASERFYILAGLRNGMLLRFESGTSKDQYLPASFYKESFAPSLNALLQLVAIRHIGITPVGLVPARVAAYSHILGLSDGAGLSYASPHALAHASSPFLPPSHVTPVSSV

SEQ ID NO: 115225 - protein, 88 aa, Triticum aestivum
  Clone ID: PAT_TA_9643.pep
RKATVKHGSPLNTVEQAFIAARMTRNKFGQSTNMAVGLLLGSSQIIVYMLARSLFIRRPRYYGFCVAWLVDVPMEALLACLCLSFVCC

SEQ ID NO: 115226 - protein, 49 aa, Triticum aestivum
  Clone ID: PAT_TA_9644.pep
FFLNSNKSLTRNGGLDSNSFCTWYKRCLPVPKIGQLIQAKLTKNSRLVP

SEQ ID NO: 115227 - protein, 102 aa, Triticum aestivum
  Clone ID: PAT_TA_9645.pep
RVFAKVDGPHHVRFGAFSSGFDHEIVLFDDTFFGTKMQFQHVVVVKAEEKLDVCLKFGESLFRWTFQHGHVGPVRIPDDSMSKYGQFDVRVFFAPKNSRPQK

SEQ ID NO: 115228 - protein, 151 aa, Triticum aestivum
  Clone ID: PAT_TA_9646.pep
LPDWVSSRSLPHLSRLEIDVEELQGDDIQIIGMLPALRFLRLRASRVMGRLVVRADAFPSARCCIFWEFLTPPCLFPPGAMPGVRHLEFQVSARSIASGEVDCGLGHLPSLEHLQVSLWRENSSDEEMETAEAWLRRAAEAHPKRPTMKIY

SEQ ID NO: 115229 - protein, 39 aa, Triticum aestivum
  Clone ID: PAT_TA_9647.pep
LACFPNLCRRGSHCCVAINTLWTSNPSNEGRPDISLKKK

SEQ ID NO: 115230 - protein, 193 aa, Triticum aestivum
  Clone ID: PAT_TA_9648.pep
VYVGLIGMDTLWKGEYSDLQMAEAYCVGQFVRLRTNTSSPRFEWQRKRGGVFATGRISQILSNGCLVVTFPGKLSLGEVLGEVCSCLADPSEVEVVSFDKCDGVVKKYEHLEDFHWVVRPLFIAIGFFTAMKLGIFVGKSITRPRSRKVASVSDQGGDPQKVQQQEVHSSVGTAWLPPPVANMLFRDGPAPSG

SEQ ID NO: 115231 - protein, 78 aa, Triticum aestivum
  Clone ID: PAT_TA_9649.pep
MNAGSSSSSTTPISGHGDLGSPALVAQMLLLLLLQVDVTASYKGQGRIVQHGFINPWWVDGELLVLNGKVINMNLLFD

SEQ ID NO: 115232 - protein, 145 aa, Triticum aestivum
  Clone ID: PAT_TA_9650.pep
APGYTVQLYPWAVAPHELEVPLQTFKTWRSWANGPFVFNTRPLVSTDTPCYRPAMFFLSRVRNETSRGTVSEYSRHAAKSEKECDQASFRAASTVHTVKVFAPKMNLNEWKRAPRRHCCKTTRTRWGTVLEVRIRYCSRGELTTP

SEQ ID NO: 115233 - protein, 287 aa, Triticum aestivum
  Clone ID: PAT_TA_9651.pep
AARASRSHSSGAARPRRTYSTRAAASACSAVPVPGLALCCRGSSALAPAPPFSGSGVPAFLRRTPPTGLPPPRLRPSPPGLPILQGEVQALHPGDTRVRLSAGSLSAHASRGASSRHWGASPRHGPLAPARRGRVVLASPSAWVLVGRSPETPAKLPDLVEHNPLIAVDVLSKLINCPDMDSYFNVLVHMEMSLHSMEVVNRLTTAVDLPPGFIHDYISNCIRSCQNIKDKYMQNRLVRLVCVFLQSLIRNKIINVEDLFIEVQAFCIAFSRIREAAGLFRLLKSLE

SEQ ID NO: 115234 - protein, 132 aa, Triticum aestivum
  Clone ID: PAT_TA_9652.pep
VKLEYKSRSGEDENTYSNHRQQETLKTRIKLERKGIRKRKTGEAEGEVMGMRCRVSSCRARIEAALIGLSSYCRGRIEADGRRQSTGRPHLGQNATQTSRGWLLPLHSSSCRGRALVMSRGQPLPAGRGRRW

SEQ ID NO: 115235 - protein, 163 aa, Triticum aestivum
  Clone ID: PAT_TA_9653.pep
MYGESSKHENLECILQDQSANPSVVSLNFLKEITNNFSDERVLGKGGSSVVYKGVLQSGEIIAVKRLEPSMAGSQSLFQNEVDHLMRLQHPNIVRFRGYCHETVWLYTEFEGQKVFAEISEMLLCFEYLPKGSLDVHLSGGSSEFDWHTRYKIIEGICNGLHY

SEQ ID NO: 115236 - protein, 125 aa, Triticum aestivum
  Clone ID: PAT_TA_9654.pep
KHQAQQLPILIPQSGKQLENGPPNGLARHESFERHSKVPTKQLSRAVSNVTCMDEHIEKTAIQKGRFKVTTEETEASTHREKELLERIACLERMLQVTQDEVVRLKEKEAKGAVPCVQQNKVHGL

SEQ ID NO: 115237 - protein, 155 aa, Triticum aestivum
  unsure (1)..(155): unsure at all Xaa locations
  Clone ID: PAT_TA_9655.pep
PPWXASGTGAVPKAKKYVVGRKLGGGPRKKAVARSVKAGLQFHVGRIGRFLKKGRYAQRVGMGAPVYLASVLEYLATELLELAGNAAKDNKKARIIPRHLLLAIRNDQELGKLLACITIAHGGVLPNINPLLLPKKTAEKEPKSPKKAAKSPKKA

SEQ ID NO: 115238 - protein, 140 aa, Triticum aestivum
  Clone ID: PAT_TA_9656.pep
MVRATRITVVILELIRATNPPPPRSSSISISVSSKEAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 115239 - protein, 209 aa, Triticum aestivum
  unsure (1)..(209): unsure at all Xaa locations
  Clone ID: PAT_TA_9657.pep
RTPCSWTSPAPLLCAGITVYSPMKQHGMLHAGRRLGVVGLGGLGHVAVKFGKAFGLKVTVISTSPAKEREARESLKADDFVLSTDERQMQGMARSLDYVIDTVSAQHSLGPILELLKVNGKLVLVAAPDKPVELPSFPLIFGKRTVSGSMTGGMKEXTQEMMDLCGEHGITADIELVSTDGINDALARLARNDVRYRFVVDVAGTGSRL

SEQ ID NO: 115240 - protein, 48 aa, Triticum aestivum
  unsure (1)..(48): unsure at all Xaa locations
  Clone ID: PAT_TA_9658.pep
MIQQYGDLTHFTAQKALVLTSKALARLQGGNIPQIIAIYKRFPAPFPX

SEQ ID NO: 115241 - protein, 207 aa, Triticum aestivum
  Clone ID: PAT_TA_9659.pep
MAGAAGSARKVSAVLYHYPCPDGAFAALAAHLYFSAAALPVRFFPNTVYDPIRSDGLPFDEIEDVYLLDFVGPPGFVADIAPKVQSVTILDHHKTAMESLCGSATLGENVNKVIDMQRSGATIAFDYFRNKLLTEASTSRNHGSGNSVTEMKYLPENKLEMVHKLFKFIEDGDLWRWTKQNSKAFISGPKDVNIEFNGSLNGKVFDQ

SEQ ID NO: 115242 - protein, 80 aa, Triticum aestivum
  unsure (1)..(80): unsure at all Xaa locations
  Clone ID: PAT_TA_9660.pep
XLMIFCXVYXHCIAIYFVSDMQGYLNLLAYFFCVRLFIWKIAYLVNFGLALYVVCLLNIDLSVTMPASETLALKYMLCYS

SEQ ID NO: 115243 - protein, 90 aa, Triticum aestivum
  Clone ID: PAT_TA_9661.pep
LTKHKHSTSACIYTPHTPPIYPGLSHTTAMPNNDTHTDGLCKHTQTLSLTCQITGHTDMGFVPLRAKGQFANLHVEKMDQDISACTNAHM

SEQ ID NO: 115244 - protein, 140 aa, Triticum aestivum
  Clone ID: PAT_TA_9662.pep
QQGGLLRVPDAPVCERGTGYGCLGRRAAAAACCSCCRGALPRRCAASTVLRLRCSPPPDPRAPGPPAPWCLFQGRSLSWTLLPLDALPPGRFAAGTVPVREDMSFLNHTVFFYVIVLCCRCCCGLVLLYQLHTRCRLPLS

SEQ ID NO: 115245 - protein, 175 aa, Triticum aestivum
  unsure (1)..(175): unsure at all Xaa locations
  Clone ID: PAT_TA_9663.pep
RVGAAAASLSAHSSSRAGHWTRHSQIRFSPKPSGLHVPPCRHDGCRGGEEGDGIKVLTEALAQGGELQSEANQLVKGVNLLVATPGRLLDHLKSTGGLNYKGLKCLIIDEVDHILEQNFKEDMKQIFKRLPQNRXLFSFLPQTQKVEDIANFTFGKKKGGHRKLVYVGVDDLTLN

SEQ ID NO: 115246 - protein, 136 aa, Triticum aestivum
  Clone ID: PAT_TA_9664.pep
ASRSHSMGGLLVRCFMSMNHDICSKYVNKWACMWAPFQAAPWGINDSLLTGLQFVYGFESFFFVSRWAMHQLLVECPSIYEMLPNPNFEWKEKPFVQVWRKNPEKDGTVELVLYEATDCVSLFEEALQNNEYHAHG

SEQ ID NO: 115247 - protein, 108 aa, Triticum aestivum
  Clone ID: PAT_TA_9665.pep
KRCKSMALPRPYSSTTRPPPVVVCSYPPENVSSKIVKGSVMNLGYTSTLPLTASRYLSPASNTLPPSSPAAPTGAAPDAALIALAPHHTKEPLVEIVLLLFPVKPAFS

SEQ ID NO: 115248 - protein, 86 aa, Triticum aestivum
  Clone ID: PAT_TA_9666.pep
IRHEADLVLFFDCPEDEMVKRLLSRNQGRVDDNIETIKKRLKVFESLNLPVVEYYSSRGKAHKINATGTEDEIFEAVRKLFSSLRL

SEQ ID NO: 115249 - protein, 374 aa, Triticum aestivum
  unsure (1)..(374): unsure at all Xaa locations
  Clone ID: PAT_TA_9667.pep
GTRLSTVETLASTAICGXTAILGGQPLLIVGVAEPTIIMYTYLYKFAKKQPDLGEQLYLAWAGWVCIWTAIMLFLLAMFNASNVISRFTRVAGELFGMLITVLFLQQAIKGIVSEFSMPKDDEISDPSSPIYQFQWIYVNGLLGVIFSIGLLYTALKTRRACASRAGAGWLRSFIADYGVPLMVIVWTAFSFTLPSKVPSGVPRRLFSPLPWESISLRHWTVAKDLFSVPPTYIFAAIVPALMVAGLYFFDHSVASQLAQQKEFNLKKPSAYHYDILVLGFMVLLCGLLGIPPSNGVLPQSPMHTRSLAVLKGQLLRKKMLQTAKEGMSNRASSLEIYGKMQEVFIQMDSNLNANSVDKDLKSLKDAVLREGDE

SEQ ID NO: 115250 - protein, 173 aa, Triticum aestivum
  Clone ID: PAT_TA_9668.pep
MSGDRRGGGPPGNGDNPGGGWETIEKKKKPGQTSGRGQWAPWGSSSNAPPTTARQAWNGNGSSRPSGNNWAQPSDRRSAARGNPRASSQTKSTEPELQAPNPVVTPPLANGWQWASRPCPSGPESSKDDVASSGLDPEANNPEVEDSSDDDNDDDMSDDYDSDASEKSLRHEK

SEQ ID NO: 115251 - protein, 178 aa, Triticum aestivum
  Clone ID: PAT_TA_9669.pep
HLCEEQGVKTEQRSKVVQGTLDVVTQKLRETEEENIFVRRKAKEKHSEYEEEMKSQEKFFHDQIENIHKALEDKEREFERLLQEERAKARQCDVDSGTTENRRLRKEHVQRFMDCQVKDVQEFEAEADQLIKAHEEKKVQLKKEYAAKEVELEKEFDAAFTSLMEKHKPDTFRASNIS

SEQ ID NO: 115252 - protein, 311 aa, Triticum aestivum
  unsure (1)..(311): unsure at all Xaa locations
  Clone ID: PAT_TA_9670.pep
LYCQRLVMDNQELLGYFSEXAATKARHAYGPGGHRGMSVLIFESSAVGYMEAERLHKHFIDQRTDRDTWQNRRVPFLPGGKRQLYGFLARKEDMETFNRHCQGKSRLKYEMRSHNEMVVAQMKQMSEDNQQLNYLKNKVVKTEQRSKVVEETLGVITQKLRETMEENIFVRSKAKEKHSEYEEEMKSQEKFFHDQIENIHKATEDKESEFERLLQEERAKARQCDVDSGTTENRRLRKEQVQRFIECQVKDVQEFEAERDELIKAHEEKKVQLKKEYMAKEVELEKEFDAALTGLMEKHRPGTFQASSSRP

SEQ ID NO: 115253 - protein, 148 aa, Triticum aestivum
  Clone ID: PAT_TA_9671.pep
PSSRSLLRLLFARVPLETHTHSSSTSVCSAVMLPTVVCTVAMLPRRRLPRRPEGPYASGRLGWRDDGQPLVARRGGQPWDWTPVDLHMLDENKGTEDHGQSREAVTPCLSHLFRWLSTAPALGAQHGGTRHGSSIVWSLDATAHCPAS

SEQ ID NO: 115254 - protein, 223 aa, Triticum aestivum
  Clone ID: PAT_TA_9672.pep
KKLGEIYDTHGSREAVLNVLFPGETGYEAFKKLSADSSEPYSDVYGSLYHYIAEAEDTSPSDKYTGFVLKKEGGEFVEQSANLFKYDLLYNPLRFESWQRLSSLYDEEVDLLLNDGSKHISILDWRTNTPLIQRVEAGRRHSRRSLMMSLILARTIPDQVEMHELLALVYYDSVQNVVPFYDQRATLPVKDATWDINCRNSLKQFEKAFELMSQWLHAFYLGK

SEQ ID NO: 115255 - protein, 138 aa, Triticum aestivum
  unsure (1)..(138): unsure at all Xaa locations
  Clone ID: PAT_TA_9673.pep
FDGAXKGNPGKSGAGVVVRRSDGSVIAQLREGLGIATNNAAEYRALLLGLRYAAKKGFKYVRAQGDSKLVCNQVQDLWRVRNDNMADLCKKVKELKGNFLQFQINHVLREFNAVADAPPGFAVELPVGEIQEQSNFTC

SEQ ID NO: 115256 - protein, 164 aa, Triticum aestivum
  Clone ID: PAT_TA_9674.pep
KIKNVAQEKNLWAETGRPNCTGEGGQLLTTGPSPSRWRGERPAGFSWALRRCKRRPTHGQCERSGSAARCRKVLAHLQRRGSRGAAAGSRTPTSGAKGRRDEGLGDSGGLQVRRPGAAPIQSSQRALERRGSMQRRRALCSTGSDGGSETGSGLDVRGTGQHGG

SEQ ID NO: 115257 - protein, 50 aa, Triticum aestivum
  unsure (1)..(50): unsure at all Xaa locations
  Clone ID: PAT_TA_9675.pep
IQIVVPSIHSRIEYYIQLHEXDEKMYKTYCLSIFYGQKLRHRIESNVVKS

SEQ ID NO: 115258 - protein, 165 aa, Triticum aestivum
  Clone ID: PAT_TA_9676.pep
SPSSGSIPIHPIPPSIQPANHSPPATTPKAAPSSHRSGADALSAPELLPIPMDAFPCPSSSTASLPLASRLQPPEPLSRSSLGIRALPSGHRFELPATRPSHSPSSPSPRPPSPCSFSCLSPCSRAQEKWSVAPPSAVVAVRRCSSPDTASPATGPVLLRPPVKP

SEQ ID NO: 115259 - protein, 77 aa, Triticum aestivum
  Clone ID: PAT_TA_9677.pep
VAALDIMQSYYPERLGRVFLIHVPYMFMAAWKMVYPFIDEKTKKKFVFVADRDLDATLRDAIDESQLPEEYGSKLKL

SEQ ID NO: 115260 - protein, 68 aa, Triticum aestivum
  Clone ID: PAT_TA_9678.pep
LTIISKCFSYTKCSSCIKYPLHPTIKTILQVNIAFKNVLYYGTEGVHFIVSRMFTSLFKFKFTTIQKK

SEQ ID NO: 115261 - protein, 148 aa, Triticum aestivum
  Clone ID: PAT_TA_9679.pep
KTSQAYNLISYSTSWPLHCKYYESQSARCLIREDRCRQLASSLVEVEDLINVPLDIDHPQCQYSALFCTKKHVTICSLLQINLHAGLVCVTACRRTNQGFASSLGGPACPRVFGFTFTLSSKEPQGKCFQSFCSRRSVPGSMPPRLHL

SEQ ID NO: 115262 - protein, 193 aa, Triticum aestivum
  Clone ID: PAT_TA_9680.pep
MILVDWFFDALAYLGLWQKDAKILFLGLDNAGKTTLLQMLKDERLAQHQPTQHPTSEELSIGKIRFKAFDLGGHAFARRVWKDYFAKVDAVVYLVDAADRERFNETKQELDALLSAEALFNVPFLVLGNKIDIASALSEHELRYYLGLEYHTTGKGNVDLSHNGRRPLEVFMCSVVRKMGYGDGFRWMSQYIK

SEQ ID NO: 115263 - protein, 170 aa, Triticum aestivum
  unsure (1)..(170): unsure at all Xaa locations
  Clone ID: PAT_TA_9681.pep
MTPADSIFNESDECLESVLTEIRLNTRTGXSTRRPILALSEQVNLEVGMVNSNLLGRKTRYAYLAVAXPWPKVSGFAKVDLATGELTKFEYGEGRFGGEPCFVPMDPAASRGEDDGYILTFVHDEAAGTSELLVVNAADMRLEATIQLPSRVPYGFHGTFVTGKELESQA

SEQ ID NO: 115264 - protein, 128 aa, Triticum aestivum
  Clone ID: PAT_TA_9682.pep
KVGLSEKIVVSYEVKDIVKDDNIDLDDLFRTPDVAFGGFSVLHDPSVSEPDSASLLRVGIGARKLGSGSLFLYGLIMRKNVTELAAMEGDEQRLSTLYRDFGTKLVGLDGLGDAGESLISRIKASSKK

SEQ ID NO: 115265 - protein, 359 aa, Triticum aestivum
  unsure (1)..(359): unsure at all Xaa locations
  Clone ID: PAT_TA_9683.pep
MHKASSLSELGFDSGGASSGFFRPVADGCPSGTPTSSVAPHRASTKVSVIGAGNVGMAIAHTILTQNLADEIALVDALPDKLRGEALDLMDVTESEAAQLRRSAKTLWENCHAPRPLTRLAVKPCSIYTNLNLFMRNGCCSRHKCLCVFEHSPVRHVCVVLTPXVNLHTNGAWRFSGFPASRVIGSGTNLDSSRFRFLIAEHLDVNAQDVQAYMVGEHGDSSVAIWSSISVGGMPAFKSLRDSHRNFDEAALEGIRRAVVGGAYEVIGLKGYTSWAIGYSVASLAASLLRDQRRVHPVSVLASGFHGISDGHEVFLSLPARLGRGGILGVAEMDLTEAEAAQLRRSAKTLWENCQLLDL

SEQ ID NO: 115266 - protein, 178 aa, Triticum aestivum
  Clone ID: PAT_TA_9684.pep
RFYRKRLSPHFIYKATINSTRYKRTPSQHTHTPKAGYIGAERSNTNPSTPRRGEAAYDEPWAPRRRLQERNDTGAPPPPDPRIRVSPGATRRAIRAATTPSRRERVPLAPVRPKIEQVFTPATTHRHRTPHPGYHAAHTVVATGQHQATGSAHEHRGTITRAATLASKTLTPPHPRST

SEQ ID NO: 115267 - protein, 201 aa, Triticum aestivum
  Clone ID: PAT_TA_9685.pep
MKRFLYVRCYNSSELIAALKSLKSQSEARNEIFDIGVYFLMLDSIGAFYWIDRALQPTRESKGKTLSFQSITETVVQEIHKFLQLQPILVLVTKAPIYGEGITTSNDFQRGSPKYMSEDSTPLGYPKREEERNGSCREYMPSAWQTFVTHRIKLQDLAQEPGFFSEQENAILSVHTCEWVQPSLNSKEKFYIKDDGVGLIQ

SEQ ID NO: 115268 - protein, 200 aa, Triticum aestivum
  Clone ID: PAT_TA_9686.pep
MRELAVQRAKQLQAEEEERTKRQKAKALAKLEELNKRSSVHQKNSSDPPPENDDVHNKPKAGVDGSTEPASSTAESHDVPVLDNVSILQPPNEPKDTAVPAQPMSTLLQAEGTGKDLSGHNTSTSGMNTQSNMMEHIAHKSISQSHDLSVTKPRQGYRKRHAVSEDKILGENSSVAVNTENVKKAVEVSLDTSTGCCYIT

SEQ ID NO: 115269 - protein, 144 aa, Triticum aestivum
  Clone ID: PAT_TA_9687.pep
PSTQPGADPPSSGPIKGSRLASVGAGVVLEVWNSDGTERQWWRYSNMTEGAALSYKTGGAPPHPDVCVVLFFTCACRRQLPPPPLLTSVPQPPPVRAALLVELTCAAMDLVGVGGLFCNVGLPKVLLVTWTLAGAAPVPHAGVI

SEQ ID NO: 115270 - protein, 202 aa, Triticum aestivum
  unsure (1)..(202): unsure at all Xaa locations
  Clone ID: PAT_TA_9688.pep
MARAASLAALCLLLLAAAAAAGARMDPIYSGQLVPDWSREPKIKPQNFSLNREDNLQLLSRSRDVTRKKLGERTGVIKMETVQQDDEALVKLENAGFERSKAVDSAVLGKYSLWRRENENEKADANVRLMRDQMIMARIYSVLAKSRDKLDLYRELLARIKESQRSLGEATADADLPKXASERAKAMGQVLSKARDQLFDCK

SEQ ID NO: 115271 - protein, 99 aa, Triticum aestivum
  Clone ID: PAT_TA_9689.pep
PSRSSPCLRVPLLLLLPRTGPRRPPRAVAACGSTDGPPGGTACASSLRVDVSVVGLPSVHPLAACARLGRCTAIRSGTGCPGPICVGHSHPLGHGRDLS

SEQ ID NO: 115272 - protein, 45 aa, Triticum aestivum
  Clone ID: PAT_TA_9690.pep
EFGTRYTSKTRDPIHSKVCCSSYPLLYHAKKKINTSPELLTAVLS

SEQ ID NO: 115273 - protein, 248 aa, Triticum aestivum
  unsure (1)..(248): unsure at all Xaa locations
  Clone ID: PAT_TA_9691.pep
AWKLAKLDGNEAMKAAARARASSSVLRPVGARGPGSTGNSHPQSIASQDDYETGTQSASSLSSPVHIHKLAPRTQMNVPPPRPPERPGVPTTQATNPIMXPASNILRSARTERASVVWDQDAGRYVSVASAPARPGGVAAGSSTRAPXSLENPSGGRNLARMSASSLALPSGQPSERLAYSGQSIFLGGPVLGAAAESRTNEANTRARPDDSGELNADQHHARGTGERGPTAESFPPGTFQKKPPFNR

SEQ ID NO: 115274 - protein, 293 aa, Triticum aestivum
  unsure (1)..(293): unsure at all Xaa locations
  Clone ID: PAT_TA_9692.pep
PATNHGKSPASRVTRSLSQVACVSQPRHDDSTISRRLKNLGNGVKVRDVVLGPDDSAAAERSGLLGLLLHRDEGERRRLLLVVRPLPLHGEKARAGGRGGSGVGRPRGGEGRAPAVVLLRLAAVEARRRRHPLVGPLXGLRASSCRPTGRAARAPGPSHGWICCRSRVRSSTFGPTWRLEAGPVVAGGEKCGEGKGESSGSRRRRDRVWTRKRVTEPQLYCSGRAVCGLRQKNLRAAANFFAGRASMRALFWPKNWAEPTYSPEFLRAGCFAESARVALTYKDVNKCFQFQGC

SEQ ID NO: 115275 - protein, 54 aa, Triticum aestivum
  Clone ID: PAT_TA_9693.pep
NDSSFQFSVLTTVEHLVSFDSVCSCCGANYTHLFSSPADVVEHLFPPPPPSCQF

SEQ ID NO: 115276 - protein, 69 aa, Triticum aestivum
  Clone ID: PAT_TA_9694.pep
MKLQTEAAAAAGGEGRLMIRQVWANNVESEFQAIRQVAERFPYVSMDTEFPGVIHCPSKHHSTLTPSER

SEQ ID NO: 115277 - protein, 324 aa, Triticum aestivum
  Clone ID: PAT_TA_9695.pep
MKLQTEAAAAAGGEGRLMIRQVWANNVESEFQAIRQVAERFPYVSMDTEFPGVIHCPSKHHATLTPSERYAALKANVDALHLIQVGLAFAASPDAAPAVAFEINLREFDPRVHRHNPSSVALLAGHGLDFAKQRRQGVDARVFAALLMSSGLVCSGASAPTWVTFHSAYDFGYLVKLLMGRKLPRTLPEFLGLVRVFFGDQVYDARHVMDSCAGLYGGLDALAAQLGVKRAAGMSHQAGSDAALTWDVFRRIREVYFAGDSRQGQGQGVGSFAGVLYGLDLELHLAAPRPTTAAATATGTTTRTSAAAATAPAGGATTGGPWRR

SEQ ID NO: 115278 - protein, 137 aa, Triticum aestivum
  Clone ID: PAT_TA_9696.pep
MEQSLALKMQIQAFRPICFSEALLQQLQIARFVSDKKKCCEQTNSEDTYGNVVTAIEWQLRPTMFPPTEESQHTGKMMFQWAETKTYRYWTKCISQRCFGSQAISFTASVPETSVSSTNGMVFHTFNPTGAGLSSGP

SEQ ID NO: 115279 - protein, 199 aa, Triticum aestivum
  unsure (1)..(199): unsure at all Xaa locations
  Clone ID: PAT_TA_9697.pep
KKAFPLSSSWDPHPHPPSYLLPPPTPPRPPSRPWHPEPRHRSPVPTRPPSWPDPVXSKPPCPAPVRPPLHRAAEPLPSCPKICVAIPGSTLSWWLRRIQPREARASGHLPRPPSWMTTLATSRDAALRRGCEADRRGAGAPATGTMRNCGDLDVAEAGRIIRRWRRTHLFAVDLPERRGGWGLQELQEAGARGSLVPNS

SEQ ID NO: 115280 - protein, 241 aa, Triticum aestivum
  Clone ID: PAT_TA_9698.pep
KRKLAIVGKGLTFDSGGYNIKVGAVCSIELMKWDMGGSAAVFGAAKALGQIKPPGVQVHFIVAACENMISGTGMRPGDIVTASNGKTIEVDNTDAEGRLTLADSLVYACKQGVDKIIDLATLTGFCRVALGPSIAGILTPSDELHEEVAAASEVSGEKLWRLPLEESYWETMKSGVADMLNTGAIPQGGVITAALFLKQFVHEKVQWMHIDIAGPVWSHKNRSATGFGVSTMVEWVLRNSS

SEQ ID NO: 115281 - protein, 177 aa, Triticum aestivum
  Clone ID: PAT_TA_9699.pep
ARGDAVIFDDKEPFSAKVASQKDASQMRTVWNPGSEFSLCGCSWSMQGNLCKHIIKVNMMCAPRKDFQPSLSFQSFQRVLLDLWQKPLDDSFSLDLSVAWVMQMQERIQKVAELAASDGIAQVAGKLPIQWANKRGRRTAIRRTSPMCILPHSNGSVQRDLTLKRNRKRRRLSNFSG

SEQ ID NO: 115282 - protein, 281 aa, Triticum aestivum
  unsure (1)..(281): unsure at all Xaa locations
  Clone ID: PAT_TA_9700.pep
AEQSGELVSRSMAGXMMPRENFGYADAHTVPCRTAAAATGPADWREALDIVALGLPEQSVEGMKVICHELTQAVDPESSALDDLIKEADRLVSCLSVMVPKTFNFSLSGASSRSCKYVLNTLMQTFQIKRLAHAVKEGTLDNLITELLLWLLDERVPLMDDGSQLLKALNVLMLKILDNAERTSSFVVLINLLRPLDPSRWPSPTPSESLAVKNQKFSDLVVKCLIKLTKVLQSTIYEVDLDRILQSVHIYLQELGMEEIRRRAGADDKPLRMVKTVLHEL

SEQ ID NO: 115283 - protein, 114 aa, Triticum aestivum
  Clone ID: PAT_TA_9701.pep
KRGRTLASVFILGWHHEKFGRIRLLIEEPIDRSHRPVREHLEAAPQEIVHGWGSNWHATRKKFAVGARVGELGKINGQKSAMAGAGWEEDMRERASERGERRAEAGGGARAEFL

SEQ ID NO: 115284 - protein, 147 aa, Triticum aestivum
  Clone ID: PAT_TA_9702.pep
MRHLEFQRMRVTLAIGVVGLCATAYILGAWQGTSSAIKDAPRPVYAKTQCDEAASRAPSNASGAPSVASVASSGARLDFQAHHRVAFNESSLATEMIPPCQLKYSEYTPCHDPRTARKFPKAMMQYRERHCPTKDKLFRCLIPAPPN

SEQ ID NO: 115285 - protein, 302 aa, Triticum aestivum
  Clone ID: PAT_TA_9703.pep
GIRHEAGILFPHVRTKNKTECIARLIQLPFGEHMLGNINNGKSDSRFHTNQTTDGKTNHFIVKEASSQSADMVDGMQIDGEEDGADKLVEDHPSKRRRLCSSIDVTSSLMEQLALLTTAVSPDVVAAAAAASIKALGNENPQAKKAFHLSEKEYQVKSFSSNHVQESDCNVGNKEAEMHGQTVPDKKTEKNFISTAYQVRAAVGTAVGAAAARAKMLVDQEEREMELLMASIIETQLRKIQYKIKHFEELELIMEQEYTTIQQIKESLMKEWQTVLERAFQTGAPLQRDEVLTRLFLDRSTP

SEQ ID NO: 115286 - protein, 104 aa, Triticum aestivum
  Clone ID: PAT_TA_9704.pep
NTAATYIKAHIFSSQQSLLFSALQPCHSYLKIQMLVASVFLFSEIQLCSDQGGRQGPHRRDASTQLVVASHRQTGREARSPGTVRMAPGVVEEPPRWSSCADRA

SEQ ID NO: 115287 - protein, 259 aa, Triticum aestivum
  Clone ID: PAT_TA_9705.pep
MAPSSPAAAAVAEGDEQQQQQIVAAAAAAKKGGGKRGRREMRRIEDATSRQVTFSKRRSGLLKKAFELGVLCDAEVALIVFSPRGRLYEYASAPDLQKTIDRYLNHTKGTSANEKTVEQPAAGVQMCRSEATALKHKIDAIEAYQRKLSGEGLGSCSAHELQELELQLEKSLSCIRQKKQQKMLDKILELKEKERKLLTENVVLREEYKALPLLELATAAAAERSPDGAGAEEAEEDERRLHYMEVETELVIGRPGSSS

SEQ ID NO: 115288 - protein, 236 aa, Triticum aestivum
  unsure (1)..(236): unsure at all Xaa locations
  Clone ID: PAT_TA_9706.pep
WSSVLLCLYEAGRHGKVQLLDIFCEAINPDLHTQNDSNNELLMSKLTSGNLSSGKSGAGRRCIAQALDTARYMPMETLFRVLEVWSTHLEGMNEINAKVKELQSTTTSEDCVTITKDKWPRRSANIXNWTVPLNDKAAMLLDDITRNLWAVECXFHETLLKNVGVLQSALLGNPRRMVQLDLLXSTQLMPLLLRHXNGIAVSASLHDTSVMCNLAQEYGDVINLHDWYLSFDGIIN

SEQ ID NO: 115289 - protein, 70 aa, Triticum aestivum
  Clone ID: PAT_TA_9707.pep
PLQNFLLVTHNHNQKFRIAVCVVAFHSSRTGTGSLKLLELHWNCNHFLCRRTSTGATGLLIISNLQLTHV

SEQ ID NO: 115290 - protein, 78 aa, Triticum aestivum
  unsure (1)..(78): unsure at all Xaa locations
  Clone ID: PAT_TA_9708.pep
HAPVAPGPPPSSSPCAAATPPXPPCPPCSSRTHRAPPPHPPXTAVAPXAPSQADTRPGAPRSRRRTPPLPARLRHGPR

SEQ ID NO: 115291 - protein, 181 aa, Triticum aestivum
  Clone ID: PAT_TA_9709.pep
ERDVRRAARRRNPRTPPPMRGQWHRLICTCLGAGEEEVDVKCTRRGGGPAEGDTERKMGFPPPPPLWPLHEEPRCPSSSSAAPPPLFLYGAKCRSAAALLPFSLLSLSLRRRAEGTGWKASPSLDPDGTGHRVTNSRCSSWDGWRAQAAMIFLRERRDRERGGLGRDGGVRRVCARVAAVF

SEQ ID NO: 115292 - protein, 229 aa, Triticum aestivum
  unsure (1)..(229): unsure at all Xaa locations
  Clone ID: PAT_TA_9710.pep
RQAEENRMRLLHADMQRRAALKERTERSLVQKATSGSKFAARVRSAILAKRAAAEXKKRLALLEAEKRKARARLMHIRQAAMTVSSQREAERIKLKEHLDSKLQRAKRKRAEYLKQRGSPCSSAHADYIKHADFLSRKLARCWRSFVKSRKTTLALAQAYDALGINEKSVKSMPFEELAMLMGSPTALEATKALLDRFERRLTLCQSANSSSADNAVPRPRGPCGAALP

SEQ ID NO: 115293 - protein, 148 aa, Triticum aestivum
  Clone ID: PAT_TA_9711.pep
GAAACSRGVRRREQQQLWFREEEEEIAAGGQGEKEDAVGVWREEQHHELGEVEQQNGGALTRMTRRLCSHLSGWSREVWRWLEMVEGWHSEGGDGSMMVDAVDGAVARLRWMDGVGGGEWWRAVVPAVMVMWWERDGTGGGAAGLWSR

SEQ ID NO: 115294 - protein, 187 aa, Triticum aestivum
  unsure (1)..(187): unsure at all Xaa locations
  Clone ID: PAT_TA_9712.pep
RHEGRXAAPRVPLVPRPRQAPLVPPLLQAPLVPPPVQGPLVPPPAQVARRAITHADVVDAFEVVKCDWAPVRAGVPEIENTFYEFDKRGDDTKNRGGNLIKRHLFNRRNHVGNKRREICHYLPAYKKYAILLKKLSNDLQGLEHRLDKKLLDYNQYMPEAPLTNPDHFSRYPELLKPATKGKKATKK

SEQ ID NO: 115295 - protein, 198 aa, Triticum aestivum
  unsure (1)..(198): unsure at all Xaa locations
  Clone ID: PAT_TA_9713.pep
MMGAADKAELGFEEEDDMAAGTPPPARKMQSLDFEHIGSLAAVAESLSPRSKWRMTLRSIRIVIFQAKINVLLPFGPLAITLHYLSGNHQGWVFLFSLVGITPLAERLGYATEQLACYTGPTIGGLLNATFGNATEMIISIYALKNGMIRVVQQSLLGSILSNMLLVLGCAFFAGGLAHPNRDQVFNKASAVXNSGLL

SEQ ID NO: 115296 - protein, 81 aa, Triticum aestivum
  Clone ID: PAT_TA_9714.pep
HQVRVPTSLGTQGWPQRAHGRRQQRESNRESKPQVFYKILLCFSSDVSPTQYFPAVHSSSLGSPLIATFIVRRISQDHSTV

SEQ ID NO: 115297 - protein, 98 aa, Triticum aestivum
  Clone ID: PAT_TA_9715.pep
MSKPSRCRALRTQVALLLVLLVAASLLPAGDAASGFCAGKCAVRCGRSRAKRGACMKYCGLCCEECACVPTGRSGSRDECPCYRDMLTAGPRKRPKCP

SEQ ID NO: 115298 - protein, 83 aa, Triticum aestivum
  Clone ID: PAT_TA_9716.pep
TRVINGAVIPANNKQYVTYTRKHGPRIPQYFLHIIFVDAPVLSCVPFAGSPSCGSLNRAWSWSQLGISRFGVHTAFVCLNKTS

SEQ ID NO: 115299 - protein, 221 aa, Triticum aestivum
  unsure (1)..(221): unsure at all Xaa locations
  Clone ID: PAT_TA_9717.pep
MVQEGALTALASAADSSQEHFQKYYDAVMPYLKAILMNATDKSSRMLRAKSMECISLVGMAVGKQKFRDDAKQVMEVLMSLQGSHMEADDPITSYMLQAWARLCKCLGQEFLPYMSVVMPPLLQSAQLKPDVSITSAGEDGESDDDGVETITLGDKRIGIRTSLLEEKATACSMLCCYADELKXEGFFPWIDQVATTXLVPLLKFYFHDEVRKAAVSAMPE

SEQ ID NO: 115300 - protein, 141 aa, Triticum aestivum
  Clone ID: PAT_TA_9718.pep
SARGPGDAPVVQTVSPGCHVLSNAAIDSPWPKVLRLGQSFNGFLAAHDDAEVSLKQMVEELMTDTVKADRSVVPDTGVDPDWEYELSSIFIDTKKGQARYGTRSMAAIGVKLDGEVTFYEKSLASSLWNENVVQFEMEMAQ

SEQ ID NO: 115301 - protein, 259 aa, Triticum aestivum
  Clone ID: PAT_TA_9719.pep
PASAPRPPTRPPTRPVPPSKGRRDGFPRPAAAPPTEPERWRDLDMLLSRPGNLVHSTFDPSPGLRDLIGSVVEVLVVGAGGLGCELLKDLALSGFKNLHVIDMDTIDVSNLNRQFLFRIQDVGKPKAEVAAKRVMERVSGVNIVPHFCRIEDKELEFYNQFQIIVLGLDSIEARSYINSVACGFLEYDSDDRPVQETVKPMVDGGTEGFKGHARVIIPGMTPCFECNIWLFPPQVKFPLCTLAETPRTAAHCIEYAHLI

SEQ ID NO: 115302 - protein, 457 aa, Triticum aestivum
  unsure (1)..(457): unsure at all Xaa locations
  Clone ID: PAT_TA_9720.pep
MASPAAAPPPTEPERWRDLDMLLSRPGNLVHSTFDPSPVLRDLIGSYVEVLVVGAGGLGCELLKDLALSGFKNLHVIDMDTIDVSNLNRHFLFRIQDVGKPKAEVAAKRVMERVSGVNIVPHFCRIEDKELEFYNQFQIIVLGLDSIEARSYINSVACGFLEYDSDDRPVQETVKPMVDGGTEGFKGHARVIIPGTTPCFECNIWLFPPQVKFPLCTLAETPRTAAHCIEXYAHLIKWDEVHSGKPFDAXIIRNIWQWIXYSEALKRAELFGISGVTYSLTQGVVKNIIPAIASTNAIISAACALEALKLVSGCSKSVSNYLTYNGLVGTHIKVTEFVRDTDCLVCGPGTLIELDTSSTLSEFIKMLEEHPKLLMSKASVTHGGNNLYMQSPEVLEQMTRPNLSIPMFELLKGTPFATVHVSGMAESNGKKVSSLRKLRVAFKGVEEASKMDTTESS

SEQ ID NO: 115303 - protein, 206 aa, Triticum aestivum
  Clone ID: PAT_TA_9721.pep
ANSARGENESQNADPACFTPVKDVLPPEAMDMMAEVSELPEKSKEVKKARREVNGEENGDPSCSTPLPENQEMQRPVNAVENVVSADLDENHPVVEESENGLAVGKPNTTLSVEIPDIEEQESLEPSTPEPLREGASEKFGVATPAQNEKRQVTRKRRRGLYNKRKVWVLWDENVVLDNDTMREIVDGVGVEDLVVKRRKAPHTSP

SEQ ID NO: 115304 - protein, 163 aa, Triticum aestivum
  unsure (1)..(163): unsure at all Xaa locations
  Clone ID: PAT_TA_9722.pep
FGTRRTRDGANPXXWQLPFLALRGRRRGAMARNSPSVGGIKRSSSASRTSSSSAMSAQRRPRCTQAGGAEDREAGSLLCPATTESMALAEADGTIRSPCIRLGYVHSGFQVWWFGMCFSALADSAAVAWAVECMREPTAAYVLHRHCKSTSSSRNQGWKGRIQ

SEQ ID NO: 115305 - protein, 58 aa, Triticum aestivum
  Clone ID: PAT_TA_9723.pep
TQELFRSTQSIALDFVGLRWILKAKSKETDFCILHWRHLGGGCDVGDNKITLVLLQKK

SEQ ID NO: 115306 - protein, 53 aa, Triticum aestivum
  Clone ID: PAT_TA_9724.pep
SILKSLNRLILLFRTEEVYTYLQICLLLTLLSYTDKPHGLLRMCCWTINHQLM

SEQ ID NO: 115307 - protein, 283 aa, Triticum aestivum
  Clone ID: PAT_TA_9725.pep
TRPGRDSDDEDFRDRDYDVAALASNLSQAFKYGIYPSEDVDEAQASQERDDEDVYFDDEAAEVVINSLRLGDDPDSGSLFTNSTWFAFDEDTALNDGPEASLSANLESPSPNVDDDDMDEVVLGDPIDDTKGSDSLLATSDRDLNEGSGQTVLSNGPVDKLENDIRPSTPDVKESPAECVEWTEEDAEPGEVSENTAVPCSEIGSEKVMDATDGVMPGTGQVGEEQGSENLVESLAPDTTVEKTLPHSPAVNSTGHSEPADGSANVESPLGEQKQEKEESQEK

SEQ ID NO: 115308 - protein, 138 aa, Triticum aestivum
  Clone ID: PAT_TA_9726.pep
RHQGCLDPAQYTFMEKYLGRPPGAWLFGRIGLTVPPTCVDRPLSRAVSSAIEGLSPFPEASISSRTDWICRHRSVCLSHFAPLPGDRRQCFGLNPQRLAFSTIIPGMNGPPKHPTRRCSDNCWPPSKPSYDDDTSRRT

SEQ ID NO: 115309 - protein, 87 aa, Triticum aestivum
  Clone ID: PAT_TA_9727.pep
MAARAMRIIVLQPPRPLTNTPTCSSAHSPPPSGAHHAQVVRRCPRPSLYYAAPRRSPPSDSATGATTPPRPRSLPPLGSTCSCIPVA

SEQ ID NO: 115310 - protein, 57 aa, Triticum aestivum
  Clone ID: PAT_TA_9728.pep
MAVRGRVGESFVVDVPDGNTKDETCYFVEAVIKCNLTSLAEVSERLAVQSPTSPLEQ

SEQ ID NO: 115311 - protein, 204 aa, Triticum aestivum
  Clone ID: PAT_TA_9729.pep
MVGLVGGGARAWRLSDEAANGAGGGGAATEADYMRRLHGHAPGENQCTSALVKHIKAPVHLVWSLVRSFDQPQRYKPFVSRCVVRGGDLEIGSVREVNVKTGLPATTSTERLEQLDDDEHILSVKFVGGDHRLRNYSSIITVHPQSIDGRPGTLVIESFVVDVPDGKHEYERSFKGLAGNFYLLQTGRFSIFFHIYMSLVRISM

SEQ ID NO: 115312 - protein, 135 aa, Triticum aestivum
  Clone ID: PAT_TA_9730.pep
MELNITSKSNPFGDTTAENDKKMLSNAFIETADFRTLIETDDRTIVVGRRGTGKSALFIQLNEHWKKDKKILILSFSPDDSQIIGFRSMLKPFTGSFNLARAATRLLWRYAMLMEIASYISSHYKLSSQISSETL

SEQ ID NO: 115313 - protein, 103 aa, Triticum aestivum
  Clone ID: PAT_TA_9731.pep
GSWEELPSLVWTHSWSCCRCPSGASALCFVGVLRSALSLYSLLASRCSALCLAAVLGSSLSVYFVVPSRCTSFCFVGVHRSAFRCYSVQIFWVGSGFLAVFTV

SEQ ID NO: 115314 - protein, 288 aa, Triticum aestivum
  Clone ID: PAT_TA_9732.pep
RTSSAASVEEPVVHQSDTSTEKPSESQGDAAAGESSGPPSEPQNDASAGEPSEPKVDAITEERSESQIGAGPHDLTEQPLEPQKDGRIEKPLETETNVVTDNPSESSLATETLPESTPKISTTTEEPAQREISDETLPQSIALDTTPESTTSVEEPTDVGEAIVEISEDSSAPEKPSEDAVTPEKPSDEGEAAVEPAGDNAALEKPSEEVEVGADPSNNLVDLEKPSEKEDDSVKPVEDSVALEKPTTDKPWEEDKVSAEPSNDRVDLDKPSEKEADTVKPSEDSMAL

SEQ ID NO: 115315 - protein, 150 aa, Triticum aestivum
  Clone ID: PAT_TA_9733.pep
AQSSLTQLTQLSLLELSTPLPTPPSLVRSSEPDKTSGPISPILRCRPRRTAVRGRMRQQPASSSMEMGRGSWRRGRRIGRGRCASGQVSNAPSHMGTKLEELVASLANLKVGGGSGARMRGVQDEQAHLASQLGMASRLLIQRRRAVTVR

SEQ ID NO: 115316 - protein, 72 aa, Triticum aestivum
  Clone ID: PAT_TA_9734.pep
FIDGKLEIISFFWLCTLRDARKLIVVTRAHFCDKGLFRFICCTSMSFSGGARSWKLVMSKLYAYPYMLIIFC

SEQ ID NO: 115317 - protein, 168 aa, Triticum aestivum
  unsure (1)..(168): unsure at all Xaa locations
  Clone ID: PAT_TA_9735.pep
WGAARRDKPSVLVKSLRVENFYAXGEGTDGTGVPTKFVTMNCSLEIDVHNPSTMFGIHVSSTSIQLYYSQIPIASGQLDKFYQPKKSRHVASVTLHGEKTPLYGAGATFVLTDTDGVPLTVDLAVRTRGYVIGRLVRVTHAKRVRCPVLVSSLTDKPIMITQTACSYS

SEQ ID NO: 115318 - protein, 167 aa, Triticum aestivum
  unsure (1)..(167): unsure at all Xaa locations
  Clone ID: PAT_TA_9736.pep
QQVLQAFTPRRCTPHQEEERSMSMQLAVDGRSGAFPAKVLGYGPRSEGSGVGSVVEEVHREAVGDELLGRQAATLPVLPSHGSGRGIWDDDGGSGGGELNNRGGVDEARSGQIRQHRRPARPDPNSTDDQRGQIRQWLRCFHRTGGQRRKRGRGGAAQGGGAQXGQD

SEQ ID NO: 115319 - protein, 212 aa, Triticum aestivum
  unsure (1)..(212): unsure at all Xaa locations
  Clone ID: PAT_TA_9737.pep
AYLIPWLRYAASSSIHSLYDDSYCFGLKEKSLLSISAPPPQHIYFWNSQHILNTKSLSLVHRFSNLLLDHVSLNSTSESHPCIHFGEHLIKCFRTPSKCTKARCEILLNXSSDGHVLGNNSSIAFDITSSPRLQESATLALPSQTHMCTALIHVTSKNMFGKLKTVSDHSVQSPWQHGGTVSVLVISFGSGGALLEPHLPEXLHLRTSAEFL

SEQ ID NO: 115320 - protein, 276 aa, Triticum aestivum
  unsure (1)..(276): unsure at all Xaa locations
  Clone ID: PAT_TA_9738.pep
SNGKVGGEKRSFEVDAIVGADGANSRVAKDMGAGDYEYAIAFQERVKIPDDKMRYYEERAEMYVGDDVSPDFYGWVFPKCDHVAVGTGTVTHKADIKKFQAATRXRAKDKIEGGKIIRVEAHPIPEHPRPKRVSGRVTLVGDAAGYVTKCSGEGIYFAAKSGRMCAEAIVAGSANGTRLVDESDLRKYLAEFDRLYWPTYKVLDILQKVFYRSNAAREAFVEMCADDYVQRMTFDSYLYKRVVPGNPIEDIKLAVNTIGSLVRATALRREMGKLTL

SEQ ID NO: 115321 - protein, 319 aa, Triticum aestivum
  unsure (1)..(319): unsure at all Xaa locations
  Clone ID: PAT_TA_9739.pep
SRPVIVRRNVAADEDSPLGRHEVLGDVRRDGLQQRRGHRLQGLGVRHVAPRHRRGRHPEPYAHDHRSNGKVGAEKRSFEVGAIEGADGANSRVGADMAEGGVEXPSRLEEPVKIPDDRMRDKEDRAEKYVRRGALPGVRREDVSPELYGWGFPQSDHAAFGTAILARRTSCWTSRTRSSTGPTRRVEGRSISRVPTPTSPARPATMVVYARVTLVNDSGGDVTIAVKRGRLRAGEVLAGSAGGRGWLDGGRLPDWWARATRLSSRRNSAGSTGQTLYCRGNAARGALAEICADDGVHADDVPQATSTGSPCRATPTRDF

SEQ ID NO: 115322 - protein, 330 aa, Triticum aestivum
  unsure (1)..(330): unsure at all Xaa locations
  Clone ID: PAT_TA_9740.pep
EEFXRGWCPMAARTVGFLGGMQFNFDLEDLLRASAEVLGKGSYGTAYKALLEDGTIVVVKRLKDVVAGKKEFEQQMELIGRVGKHANLVPLRAYYYSKDEKLVVYEFVTTGSFSAMLHGIKGLVEKTPLDWNTRMKIILGTAQGIAHIHAEGGPKLAHGNIKSTNVLLDQDHNPHVSDYGMSTLMSLPINTSRVVVGYRAPETYESRKFTHKSDVYSFGVLLMEMLTGKAPLQSQGQEDVIDLPRWVHSVVREEWTAEVFDVALMKYHNIXEDELVQMLQLAMACTSRSPDRRPTMAEVIRMIEDLRQFTASESRASSNENPRDSNPPSA

SEQ ID NO: 115323 - protein, 249 aa, Triticum aestivum
  unsure (1)..(249): unsure at all Xaa locations
  Clone ID: PAT_TA_9741.pep
MIMQYLMIQVLILLDQHKADFRFSWIKRSLHFSGNAWVLIVALIGIIPLATRQLQLKGYRLSLLGTTCTTGYAIFALYGLPRVGNTQAVQAWCHHVTSSKDFIPFMYCLMFVTSKLHLKLVLVPVICWALEHVARFLRRHFTNSSLYRAYLEPLCAGVPPSTSAGNPLWALAEIFPAFLMILSLFSKQRNAMQTFMYWQLLKLMYHSPFTAGYHRAIWLKIGRTANPYISXYPPFLHDPINAGMRWWFR

SEQ ID NO: 115324 - protein, 59 aa, Triticum aestivum
  Clone ID: PAT_TA_9742.pep
TGITSTGINITFDFLSFFLLCLPNIFFYSVNQFIYTAVTFFFPWPIDFLSSLYTPSVPK

SEQ ID NO: 115325 - protein, 483 aa, Triticum aestivum
  unsure (1)..(483): unsure at all Xaa locations
  Clone ID: PAT_TA_9743.pep
SGGIDDKYALDRELGRGEFGVTYLCMDRGSKELLACKSISKRKLRTPVDVEDVRREVAIMRHLPXSASIVTLRXEACEDDGAVHLVMELCEGGRRFDRIVARGPSAERAAAAVTRTIVEVVQLCHHHGVIHRDLKPENFLFANKKENSPLKAIDFGLSIFFKPGEKFSEIVGSPYYMAPEVLKRNYGPEIDIWSAGVILYILLCGVPPFWAETEQGVAQAILRGNIDFKREPWPHVSDNAKDLVRQMLQPDPKIRLTAKQVLEHTWLQNAKKAPNVPLGDIVKSRLKQFSRMNRFKRRALRVIADHLSAEEVEDIKEMFKVMDTDNDGIVSYEELKSGIAKFGSHLAESEVQMLIEAVDTNGRGALDYGEFLAVSLHLQRMANDEHLRRAFLFFDKDGDGFIEPEELQEALAEDGAVDITEVVKDILQEVDTDKDGKISFEEFVAMMKTGTDWRKASRHYSRGRFNSLSIRLIKDGSVKMGNE

SEQ ID NO: 115326 - protein, 142 aa, Triticum aestivum
  Clone ID: PAT_TA_9744.pep
TGLSLCHRLIGSRSLDHELVSIMCRRYTQSDMEANRECPYLNWRHNMEPEFATIVLSDHDYVNNISIQKQLVGKDIPYDITSSQMFFLPVPLEAGWVILMWDMMSRKTHFWTRISKGMALMNSRRISMNLLHGSFTMRYSIA

SEQ ID NO: 115327 - protein, 115 aa, Triticum aestivum
  unsure (1)..(115): unsure at all Xaa locations
  Clone ID: PAT_TA_9745.pep
MKKVFDLTVRDLKRGVNKKVLKVPGTEQKILDATSNEPWGPHGSLLAEIAQATHNYHEYQMIMNIVWKRVSDTGKNWRHVYKGLIVLDYLVAHGTERVIDDIREHSYQISXLADX

SEQ ID NO: 115328 - protein, 67 aa, Triticum aestivum
  Clone ID: PAT_TA_9746.pep
MAKGGKGLNATGEFFRRRDEWRRHPMVGNQLRHATPGLGIAIVAFGIYLVGEAAYNRLYRPAGDNHH

SEQ ID NO: 115329 - protein, 120 aa, Triticum aestivum
  Clone ID: PAT_TA_9747.pep
RLVGKEEREREGGNSGGGDGEGREGADRRRGGSVAGRGRRGVTAPWRGDEWRQGPQAAAPAPSGVGHPHRRHSSSTWSARPPRTAPTATPATPNVGGPHDVNAPRRKTSWCDLWLNAIML

SEQ ID NO: 115330 - protein, 162 aa, Triticum aestivum
  unsure (1)..(162): unsure at all Xaa locations
  Clone ID: PAT_TA_9748.pep
MELLPLLTVLLLAHAAAYLAWQALARRRRARCYLLDFACHKPSDDRKVTTEMAGAVIERNKRLGMPDYRFLLKVIVNSGIGEHTYCPRNVLDGREECATHYDALEEMDAFFDDAVRGVFEKNGVSXRDVDLVVLNGGSFSPAPSLAARVVARFGMREDVQAY

SEQ ID NO: 115331 - protein, 138 aa, Triticum aestivum
  unsure (1)..(138): unsure at all Xaa locations
  Clone ID: PAT_TA_9749.pep
MAAMWSLIIALLLLLLPLVPSSSSXITLPLHGNVYPVGHYYVTMKIGNPPMPYFLDIDTGCNLTWLECKHPQLGRQHCTQHPKHPHYSPQLINLKVECNNKYCDALRRDLAGGNPICQHKKPHQCHYNIQYVDGTSDG

SEQ ID NO: 115332 - protein, 221 aa, Triticum aestivum
  Clone ID: PAT_TA_9750.pep
GKANEMDEDPVENAGSQQDGPESWEILFKEQMQHIIQLWDLCHVSIIHRTQFYLLFRGDMADQIYIEVEVRRLTWLQQHFAEVGDASPAALGDDPAVSLASSMKALRNEREFLARRMGSRLTEEERERLFIKWQVPLEAKQRKLQLVNKLWADPNDKAHIEESADIVARLVGFCEGGNISKEMFELNFALPASRKPWLMGWQPISNMIKEKTRQLVSTPLQ

SEQ ID NO: 115333 - protein, 265 aa, Triticum aestivum
  unsure (1)..(265): unsure at all Xaa locations
  Clone ID: PAT_TA_9751.pep
EDILLRGLKWSKLLDPEKKGQWWLSGDVSSTAGNVEDVAAVISKEVVEAQKLVQLAAAQRMNTDIRRAIFCIIMSAEDYVDAFXKILRLDLSGKQDREIMRVIVDCCLQEKTFNKYYTVLASKLCSHDKNHKFSLQYCIWDRFKELDEMELSRSMNLAKLVAEMLANFSLSLATLKVVNLANPVEMTPKKTMHFRMMFETLMQKEDSLMWNVFTRIAGNPELELLRDGIVMFVRQHVIAKDAGKELAGKFKIAKKALDNSAGVLM

SEQ ID NO: 115334 - protein, 198 aa, Triticum aestivum
  Clone ID: PAT_TA_9752.pep
RPPTRPPTRPDLAFLLDRCPVLEKLMIARGRWPVCLRIHSRSLRSVQVCMAIVPEINVVRATRLERLFLWEAWGWGDRDLTNMSSKVKIGHAPKLRFLGFLGALECTNFRLGTHHPWLTPRQFQHHCPKLSNAGIQKLGPLLNQDAPPPNASESLFNPKMMTQVRGPKRWTKHHLNFEGSGLYHQGNNLSLFREKQIP

SEQ ID NO: 115335 - protein, 125 aa, Triticum aestivum
  Clone ID: PAT_TA_9753.pep
RNSDEAVMDSSAIITRLPPTAYRALRLAFRNAMRAYRTRAPTGNLDTCFDFVGVTSVTVPAVSLVFDGGAVIELDLLAVLLDGCLAFAPVAADFALGFIGNVQQQTHEVLYDVAGGAVGFRRGAC

SEQ ID NO: 115336 - protein, 162 aa, Triticum aestivum
  Clone ID: PAT_TA_9754.pep
CRVTLAWTESKHQRTSGLWFRYLTSKIPEPGLSCLEFLQFLALLIAKTSPVGRSKGKNVMCPGGTDGTSSQADCLVPLPGNVGKLMDADGEQIWGADTFFQSSCSGTSQQTYVSDPYLIAIPDKHEKFWEVDFEALDDGDLHLDKCVIGDPALEQHRGNMKP

SEQ ID NO: 115337 - protein, 126 aa, Triticum aestivum
  Clone ID: PAT_TA_9755.pep
RGRTRLSWGCFCSHQLLSSHGSPSSPSSRRGCGSTRRSVEVCRFPGFLAVRRRRGPLAPKTKELFGNPPSLKSQNLWSSFFPAPSFLATAPGRTWGAESLRTGPNLACLPNCLTFSRSSASAIKNI

SEQ ID NO: 115338 - protein, 116 aa, Triticum aestivum
  unsure (1)..(116): unsure at all Xaa locations
  Clone ID: PAT_TA_9756.pep
MGVKTVYVPIVWKLHVPPKIHVFLWLISHNKIMXDNLRKRHIIKPLDCVFCSETESFHHLFFDCVVARYVWAIFREHFNINLGSDYMSIAKFWLSNNKKSALNVACATVVWCLWKI

SEQ ID NO: 115339 - protein, 177 aa, Triticum aestivum
  Clone ID: PAT_TA_9757.pep
ARGSRLSESYKSSKSVRIYPMVFRRIYMYFSKYTCNSAVAVGELLKDTLFVVICEASRFGFVQRLTFQGMHAFEVPVGLTDLMDNIIHDYKDLSLGALLIYLYDLEEKLSVAERSRYQTEDQLAAALVGFNSYALHVNLRGSDGLYAPMFDSEVVRLIHMRLRNFDKNIRKLTDVSY

SEQ ID NO: 115340 - protein, 186 aa, Triticum aestivum
  Clone ID: PAT_TA_9758.pep
AWSRPRYSKKHMNDFPELIEMKRRANTRSLKEMALLLRGGSHIIWIAPSGGRDRPDPLTGEWHPAPFDASAVDNMRRLLEHSGVPGHIYPLSLLCYEIMPPPQQIEKEIGEQRVISFHGVGLSVAEEIKYGDVTAQSRNADEARGTFSEALYNSVVDQYNVLKSAIFRDRGAVSSNPAISLSQPWR

SEQ ID NO: 115341 - protein, 166 aa, Triticum aestivum
  Clone ID: PAT_TA_9759.pep
IFVIHGILNAKIFRGRDARLLFRRFARLGPRVSVANPACGRAPRIVAFAGSAFYSPPEGFKEKDLYHLLEKVGTPSGADDLDCRSGWLEGPNKVYIPFLACGDLSGYDSDRSYPLPSTEGGTYQSLDPVQPPIAPPYKTALEMKKASSHGAGTDTSKLSLDPQTTL

SEQ ID NO: 115342 - protein, 74 aa, Triticum aestivum
  Clone ID: PAT_TA_9760.pep
VETSKEVKRNQKYKLGPADKEYNRRMKLSSQFACFNCSDAMGNSPRRQQGDGSGQRPQKTERAHHQGTAFKLVQ

SEQ ID NO: 115343 - protein, 149 aa, Triticum aestivum
  Clone ID: PAT_TA_9761.pep
VPRAILVCTSHNSTPRIIHTSIQKQEARRVHADTEFAALHRRRSRGRWRGAWRSCCSLNEDPPLLCFDDAVDDPRRPTRSPAPASAAPGASSRTPCSSRSPAQHGVGAPPCRSRATRSAGVRCRRRQAEEIRHRRRAGQGCPPAPPRPW

SEQ ID NO: 115344 - protein, 332 aa, Triticum aestivum
  unsure (1)..(332): unsure at all Xaa locations
  Clone ID: PAT_TA_9762.pep
HRCFTHSLQVATCLHIILTTAEIVYPVLVILMCDSAVVSGFLLMFIACIVWLKLVSFAHTNHDIRQLTISGKKVDNAPSTADMDNLQAPTLGSLIYFMMAPTLCYQPSYPRTENVRKGWLIRQIILHLIFTGIQGFIIEXQYINPIVVNSXQHPLKGGLLNAVETVLRLSLPNVYLWLCMFYCFFHLWLNILAEILRFGDREFYKDWWNAKTIDEYWRKWNMPVHKWIVRHIYFPCMRSGISKEVAVFVSFFVSAVLHELVVAVPCRILKFWAFLGIMLQIPLITLTSCLKSKFRDTMAGNMIFWFFFCIYGQPMCVLLYYHDVMNRIGKTE

SEQ ID NO: 115345 - protein, 345 aa, Triticum aestivum
  Clone ID: PAT_TA_9763.pep
MPIGTAATTMPTVASWILLHVHATVRQPPKNASAVAHSSNNEKIYASLLRQRPPVPSNLYVYCADGTFGETPRVLSMVDDIILFHAYIGPAFPSPKPWKGDFFIYRSDSNRRSLERLPHPQGMIGRDDPFGIFPREGDSYTIAALLPSISSMYDFELHLFDSETRIWSRKNLTVGSRQERFKVDIPINISQILHHNTSTVITLGGSMCWVDLWRGILFCDMLSEKHALTGVPLPLPLIYYSGDRSKILGPAKCHRSIAFLDGCTRLVEVNSDVSIAEGTEFGCGRTEDWTITTWYNNNVHNNSYDDWHPDITLKASNIILGNHSVKLPLGLQYLFVSDPTILHEQ

SEQ ID NO: 115346 - protein, 259 aa, Triticum aestivum
  Clone ID: PAT_TA_9764.pep
AGAGVKEIIMLSASANKLARLKEQAEEYAALIMEELDPEGLGYIELWQLETLLLQKDTYVNYSQALSYTSQALSQNLAGLRHKSPIRKMSSKLSYYLEDNWKRLWVLALWIGIMAGLFIWKFIQYRNRYVFSVMGYCVTIAKGAAETLKLNMALILLPVCRNTITWLRNTRAARALPFDDNINFHKTIAAAIVVGVILHAGNHLACDFPRLIDSSDEKYDPLRMYFGETKPTYLALVRGVEGVTGVIMVVCMLIAFTLA

SEQ ID NO: 115347 - protein, 105 aa, Triticum aestivum
  Clone ID: PAT_TA_9765.pep
DVLCFIHKIRMTVRYDSFFLHVWRVARPRINREGDCCNLEHPLSQSPWLLLGTKDLRSLHQHHSPQITVLSLLKDSDLIVLLLNITTKVYASLLRSDEEPPWRPR

SEQ ID NO: 115348 - protein, 100 aa, Triticum aestivum
  Clone ID: PAT_TA_9766.pep
AQIQIRKKLQHILMATLGKSTSVVCLIALVLMATVLSSRAIDHGCDIGPFPGDKCPELCEKACGKPGACSSDGPVSYCCCEPVRQDGSIRPQEVAEMIQT

SEQ ID NO: 115349 - protein, 116 aa, Triticum aestivum
  Clone ID: PAT_TA_9767.pep
NDITHHYLYTIYTTLDIHKRNALKAKIQPVSIASTLYPKGPSITPSEVPLHSSTKDKTFAILCDPAYRDIQHGVSLKLIRSALDISQDEIMQVITEQIYLGMIYTTLDDNHFKSSI

SEQ ID NO: 115350 - protein, 186 aa, Triticum aestivum
  unsure (1)..(186): unsure at all Xaa locations
  Clone ID: PAT_TA_9768.pep
MYEEEAMRTTRVEMGMRGELWDDSALVDCLDHAVPPTRHAAGTLAPFGPLARSSLLPAGGGGGLSWTLAFVRAWARHLLFGKAHVLCALCFLAPGLSWKDTGVSYVKDKQLQLNMKINKLXETVKLQMVAKTAGIDHEEWLANADRWVANFLEKFAEHCLVMVSAFLGRLPGAKCRGVPLVVVVVV

SEQ ID NO: 115351 - protein, 84 aa, Triticum aestivum
  unsure (1)..(84): unsure at all Xaa locations
  Clone ID: PAT_TA_9769.pep
PGSGYDFFSRFXFCPKFGIDEDPVCGSAHCVLAPYWGEKLGKQKLIAFQASPRSGTLYLELDVANKRVLIQGEAVTIMSGTLFA

SEQ ID NO: 115352 - protein, 165 aa, Triticum aestivum
  unsure (1)..(165): unsure at all Xaa locations
  Clone ID: PAT_TA_9770.pep
MAAGAATGCLRWTSSLASLAPPSTRSFSRSSRPPARPRLPPRTTAPPPNLSVSGLSKRTTTDGLREAFAKFGEVEHARVVTDRVVCLTRGVFVRYVSVXEDAAKGIEGMDGKFXDGWVIFAEYARARPPPQHGRGNSAATTIMGHSWFLGLTVDEGTIILSGVCD

SEQ ID NO: 115353 - protein, 314 aa, Triticum aestivum
  unsure (1)..(314): unsure at all Xaa locations
  Clone ID: PAT_TA_9771.pep
GRPRGCGRPCKACRRPASCRARQCPDISTPFRSPSLCASYVLDRGLHPLANSARPVPPATAVTLIKQGXDLIIGNLGDSRAILATKDEDNHLFALQLTVDLKPSIPSEAARIRERKGRVFSLPNEPDVTRVWLPKSNSPGLAMARAFGDFCLKSYGVISVPDVSYHHITEKDEFVVLATDGVWDVLSNDDVVKIVSESTSEASAARLLVQTAHRTWRTRFPTAKVDDCAAVCLFLKTDLTNKSSDSGTKDFATNVELDGGKHFSTVKSSTVVPTDLATAFVTGNEWPVLSGDPMPATPTNLLTPTSAANQSMKG

SEQ ID NO: 115354 - protein, 114 aa, Triticum aestivum
  Clone ID: PAT_TA_9772.pep
MAAPPMPEPALPPELGRIGVKRGRRDMPMEIIEVNQAELVKNRPREDKSKLTGMAFGPSYQAAPSGKGKPSKLQKRKHQIGSLFYDLKQKEMELTERRAKGFLTKAETQAKYGW

SEQ ID NO: 115355 - protein, 117 aa, Triticum aestivum
  Clone ID: PAT_TA_9773.pep
GGGAGATGYDRGAPQGAGEQAKKLRSGRAGETRTPNDKQGQEQDYGQRVQRADSRKKTIVTASEDVPHSGRADGLERAEGNEKKGVVLAAERYSKMEDQESLKIIRLLRVTLPWTLK

SEQ ID NO: 115356 - protein, 100 aa, Triticum aestivum
  Clone ID: PAT_TA_9774.pep
SQSEEEEKKSAYTIYRKAGKSWHVIKNKKELSTPASMHPHCMASDFCLLLILLCTSFSSSSVPPTSSSSCSCKTINHERSTDPDFQANPAMDQQHGTQSG

SEQ ID NO: 115357 - protein, 73 aa, Triticum aestivum
  Clone ID: PAT_TA_9775.pep
FFLKKRSKYELTGQSKDEGYFYKNKPGVKSPTSEHFTSNRGPIPTCTFHCYQTYLLWYKYSISSLQQTKLATN

SEQ ID NO: 115358 - protein, 499 aa, Triticum aestivum
  unsure (1)..(499): unsure at all Xaa locations
  Clone ID: PAT_TA_9776.pep
MVLAQLGGSISRALAQMSNATVIDEKVLGECLNEISRALLQSDVQFKMVRDMQTNIRKIVNLETLAAGTNKRRIIQQAVFTELCNMLDPGKPAFTPKKGKPSVVMFVGLQGSGKTTTCTKXAYYHQXRKGFKPSLVCADTFRAGAFXESSGSLRGSGRQIRDVMDMLEEYKRLAKMWSKMKGLKMPKNGKMSDLSQNLNIQQMTKALPPQVLKQMGGMGGLQALMNQMGGMCMSKMLGGMGLGGXLAWSNDGMVIPRDVGGVAALLWHNVXYIFIGTGDPTXEFEIFDVKPFVSRLLGMGDLSGLMDKIQDVMPADQQPELLAKLAEGTFTLRLLYDQFQNLLKMGPIGQVFSMLPGFSSELMPKGHEKEGQAKIKRYMTIMDSMTAAELDSTNPKLMTESRIIRIARGSGRQIRDVMDMLEEYKRLAKMWSKMKGLKMPKNGKMSDLSQNLNIQQMTKALPPQVLKQMGGMGGLQALMKQMGGKDMSKMLGGMGLGGD

SEQ ID NO: 115359 - protein, 97 aa, Triticum aestivum
  Clone ID: PAT_TA_9777.pep
FFLDGILGKFKHMSEHDTYYLDNNAVRGSKSKHTVTEGTAAKIASDNSTSEDQDEGEMQSRQSRPWIRHHGLELEEAPLLQPHLLVEPLDEPLGACS

SEQ ID NO: 115360 - protein, 140 aa, Triticum aestivum
  Clone ID: PAT_TA_9778.pep
MVAGPEVMHQVVPMLEAQFRRCPVRGAEEVVVGVGVGVSSPPPPVDSQAQVDLEVPDLVKTPLETLQFVPKIRSGSFADIGPRRYMEDEHIRIDHLSGHLGSLLLCPSPNAFYGVFDGHGGSDAAAYMKRHAMRLFFEDS

SEQ ID NO: 115361 - protein, 173 aa, Triticum aestivum
  Clone ID: PAT_TA_9779.pep
GKKLTRNPSAGTNRRLSVGGGPVRTPKSVTPQSRSVRSAKKTEDSGTLSPGSRGKGTASPPIKKLSFKASTLGETETPRKPFTQSAPGNSNPATPVRSASNGTEGENRTPKILAAPTPKTPMMVTSPMQMTTTPALTAAPVCVSNDKPELCLLESTEYSFEERRLAYLAAHAA

SEQ ID NO: 115362 - protein, 159 aa, Triticum aestivum
  Clone ID: PAT_TA_9780.pep
MAAPPPTLPGPVPAPPERRARRGPRRCGLAGPSGAPGLAPAAPLTASPDLAVFHGCTSKAIDRASENPGLVQGIGVPIARAPWFDASVVFGHRRRAVSCTFALGGPEGSGLCPFEAVRNGEDGVCSFLPHRDWARMAIGACRSTAGGSCSVTISGEQSC

SEQ ID NO: 115363 - protein, 84 aa, Triticum aestivum
  Clone ID: PAT_TA_9781.pep
DTELKHFEVWINVRHCPPDSSNDIPSTKTKNVSNIFSILFLKDQWKKTRNACVFQCFAHRYIRALLQSYMSYDLAEPKLWRSEG

SEQ ID NO: 115364 - protein, 76 aa, Triticum aestivum
  unsure (1)..(76): unsure at all Xaa locations
  Clone ID: PAT_TA_9782.pep
EFGRLYWXSEKLAVAFALLVXESSMTIRIVKNLRMCLDCHNAIKLITKLHMREIVVRDRTRFHHFRHGLCSCKDYW

SEQ ID NO: 115365 - protein, 390 aa, Triticum aestivum
  unsure (1)..(390): unsure at all Xaa locations
  Clone ID: PAT_TA_9783.pep
MAAAAEEEGRAPTKYVLITGGVVSGLGKGVTASSVGVVLKSCGLRVTCIKIDPYLNTDAGTMSPFEHGEVFVLDDGGEVDLDLGNYERFLDVTLTRENNITTGKIYQSVIEKERKGDYLGKTVQVVPHVTDEIKQWIQSVSSVPVDGQTRPADVCVIELGGTVGDIESMPFIEALRQLSFSLGKDNFCLIHVSLVPVLGVVGEQKTKPTQHSVRELRALGLTPDLLACRSAQPLIGSAKEKLSQFCHVPVENILNIHDVPNIWHVPLILRNQKAHEAIIKQLNLSRSAAPPELRDWTLMAESYDNLSTSVKIALVGKYTNLSDSYLSVXVKALLHASVACSQKXFXQWVSASDLEDAAAASAPXVXAKXGXLLXGPGFTWRIGDGWRDWV

SEQ ID NO: 115366 - protein, 283 aa, Triticum aestivum
  unsure (1)..(283): unsure at all Xaa locations
  Clone ID: PAT_TA_9784.pep
MNESIPTDSVYMSDSNTNVKDAPAFHENPYCKALNNAKDIQFDHADVEGNAQNGPVVRLSFASLFDALGTCLKDESSVLLLYSLVHGNCDFQEYVLVRTDLHTLLMPMLEMLYNASRKTSNQIYMLLIILLILSLDSTFNASVHKLVLPSVPWYQERLMHQTSLGSLMVVVLIRTIKYNLSKLRDVYLHTNCLAILANMGPHAHRLSAYASQRLVSLFDMLSRKYAKLAELKNDKALKVTPDQMEADIISDDTSTELHIYTDFLRIVLEIINAXILTYALPRN

SEQ ID NO: 115367 - protein, 204 aa, Triticum aestivum
  Clone ID: PAT_TA_9785.pep
MRRGGSCISYSSAWTTPGRKLVETPHPAKSDKGYGFYVENTIGSTPQINTWTADWIEFYSKHRLGYQLKLISQRFGDSAIYEKGQRLIEKMHPLFDGAVIEPCLLHGDLWSGNISADTNGDPVILDPACYYGHNEAEFGMSWCAGFGGEFYRSYFEVMPKQPGFEKRRDLYLLYHYLNHYNLFGSGYRSSAMSIIDDYLRMLKA

SEQ ID NO: 115368 - protein, 121 aa, Triticum aestivum
  Clone ID: PAT_TA_9786.pep
HQPKERALLVEPRPHPSLLLPRRRPPPDLASVDPPPGRSDLLFLLQIPHLSSSSKSVGGLHGGREGLARERERRATRRRRRVGREAPASLLFLQIRGGLHGGGERGQRERERGGRPSCRIP

SEQ ID NO: 115369 - protein, 238 aa, Triticum aestivum
  unsure (1)..(238): unsure at all Xaa locations
  Clone ID: PAT_TA_9787.pep
EQKRMHTNPCQILVATPGRLKDHMENTPGLPAGLMGVKFLILDEADRLLDMGFRTDIERIVAALPKQRQTLLFSATVPDEVRQVCHVRLPRDLEFVNTVQEGSEETHSQVKQMHLVAPLDKQFSILYGLLTDHISENVDYKVIVFCTTAKVTSLVAELLSELKLNVREIHSRKPQSYRTRISKEFKELKGLILVSSDVSARGVDYPNVTLVLQLGVPSDREQYIHRLGRTGRKXNXXS

SEQ ID NO: 115370 - protein, 61 aa, Triticum aestivum
  Clone ID: PAT_TA_9788.pep
CCLDLFATTQLRPVCIWVKVVLHAWNGIFSSPKLLLLYCIAHCSCFYGTFCCYFGYSIPVF

SEQ ID NO: 115371 - protein, 85 aa, Triticum aestivum
  Clone ID: PAT_TA_9789.pep
ASSSGFCYVGLPTELTFPGLTAAGPYAPEADPLTSSRDVTKPERRLFVVFITSLAASWSSSGPALIDRHFRCLPCSWSCAQQRLL

SEQ ID NO: 115372 - protein, 164 aa, Triticum aestivum
  Clone ID: PAT_TA_9790.pep
GREEPAVFLCSFSSITPEMGRKRKSTMGGKTPPSKGRPCCKSVAVPSLVAVEAPEPVAASNAMVPHHQPKGGPGLLKQACSAVAVSAAKEKVVKLDLDVPMRVLNCDVCYGLLKAPIFQCSLLRHVACRSCSEFHGGKCRPCADLAASAVYVQSSYLDTLFGYI

SEQ ID NO: 115373 - protein, 121 aa, Triticum aestivum
  Clone ID: PAT_TA_9791.pep
GAAAAASEQQLRTSNSEQQSSRSRERRRRRRSSSVKIIDSCRKEHTYTAPESDSFSFIVHMRTQNRCIAASSNRACFFSLVSRHCSVFTKGYTYVHIPLVAHDGPRFMYKPGGSPRLSVYI

SEQ ID NO: 115374 - protein, 234 aa, Triticum aestivum
  unsure (1)..(234): unsure at all Xaa locations
  Clone ID: PAT_TA_9792.pep
MDLEVLQRILDRREKPTNLSFELLKNITENFSDDREIGHGGFATVYKGGVLPNGNVAVKRIRNSHSINEALFYREVDSLLNIEHKNTVRFLGFXRLLCFEYISNGSLQKYITDELRGLEWSTRYGIIRGICEGLYHLHKEKQIYHMDIKPDNILLDNDMAQKITDFGLSRLDEKTKTMSKYRPGSLRYCAPEYLHQGKMSFKSDMYSLGVIITELVTGEKRSRIIITTSKRVLS

SEQ ID NO: 115375 - protein, 95 aa, Triticum aestivum
  Clone ID: PAT_TA_9793.pep
ARELIQTPPLAVPLPKRCQCAVNATVVPHDLIASFSSCACGALLFHRRPLPLHLLQLPIAASICTQDLVHLVHLFFISHAPPPCFNFQQCLYPIE

SEQ ID NO: 115376 - protein, 185 aa, Triticum aestivum
  unsure (1)..(185): unsure at all Xaa locations
  Clone ID: PAT_TA_9794.pep
PPTASAKQEERRSGTMLGHLAGLVKVRVTRGVNLAIRDLRSSDPYVVVRMGKQKLKTRVVRKSINPEWNDELTLSVEDPTIPVKLXVFDKDTFFDDPMGNAELDIGPLVEAATMRIQLQGVADGTVVKKLVPNRQNCLAEESALYLSEGTVKHDVVLRLRNVECGEVELQLQWIDIPGSKGASGF

SEQ ID NO: 115377 - protein, 327 aa, Triticum aestivum
  unsure (1)..(327): unsure at all Xaa locations
  Clone ID: PAT_TA_9795.pep
MGNNLTRRPERIFDDGRGEGIGTVLINSGCKPSLICHCKLSRNDILKPIIWQHMDDNDSHPQPTRPEVFSDPSGGSPRKLNRSRQIASKDPFGILPEELLCTILSKLDLKEAAKTSILSSTWRHTWKHYPKLTFDILTMCGGKYKTREQRHIQTPECVDRVHYVQQFVNIVNTILYQHQGKTIERFELRLTVDVLAQLFDQLDDWVRYAVSSRTKNLILHVSLTPLDVFHYKRYVFPVQLLDAGSCLQHIQLAHVLLKVPSQFVGFPNLRRLGLYSTRVSASDMQCMVSNCPNIEWLDLFMVHLNDELKVDRPLXCLLYLXXSDCRV

SEQ ID NO: 115378 - protein, 289 aa, Triticum aestivum
  Clone ID: PAT_TA_9796.pep
RLGGGRPWPARLASALSTSMLHPIDTMKTRVQASTLSFPELIAKLPQIGIQGLYRGSIPAILGQFSSHGLRTGIFEASKLILVRVAPTLPEIQVQSLASFCSTILGTAVRIPCEVLKQRLQAGIFDNVGEAIVGTMQKDGLKGFFRGTGATLCREVPFYVAGMCLYGEAKKAAQHVLSRELEPWETIAVGALSGGLAAVVTTPFDVMKTRMMTAPPGTPVSMQLIVFSILRNEGPLGLFKGAIPRFFWIAPLGAMNFAGYELAKKAMIEAEKETADSLQEKKNMVGSRG

SEQ ID NO: 115379 - protein, 191 aa, Triticum aestivum
  Clone ID: PAT_TA_9797.pep
HWTGLSTPAAAVHTQTLAVASAASTGVDDPAAAATAAATEVGAPASPPPPAAEEADASAEAEAVPEAKRWPGWPGDNVFRMVVPVLKVGSIIGRKGELIKRLVEETKARVRVLEGPVGATERIVLVSAKEDPGLELPPAVDALIRVFKRVNGITDGAAEGTQTAAAPGVCAARLVVPGAQAINLIGKQGAS

SEQ ID NO: 115380 - protein, 348 aa, Triticum aestivum
  Clone ID: PAT_TA_9798.pep
PRPAAPSSPSTSAFNSTESSHEPGSSAYPRIESSSRVADMLQQLIAMQKDMQKQLGTIVIAPIAKEGKRIETSLGRTMEKSIKASIDALWARFLEENTKREKAERERMQQMTTLITSSINKDLPAMLDKLVKKEVSSLGPVVARAMTPIIEKFLTSIVADAVQKAVGDKMVNQLDKSVTAKRKATLARQIHLQLHTGPIKGPPEVEAPLDPMKELGRLLAEHKFDEAFTVALQRSDVSIVSWLCSQVDLRGLCTMAPVPLNQGVLLALLQQLAVDIGTETSRKIQWMTDVAMAINPTDQVIAIHVRPIFEQVYAKLAHHRSLPTTSPLDNSNLRLLMHVINSVLLSYK

SEQ ID NO: 115381 - protein, 280 aa, Triticum aestivum
  Clone ID: PAT_TA_9799.pep
MASLLYTYRSCVKALPQLPDSMKHSQADLYLETYQVLDLEMSRLREIQRWQASAASKLAADMQRFSRPERLVSAPAGALLGPRPALLVVLLQPGPRTIACACPPLVFSCCKRSFALVSSRWLLTLPMSVDLLHLLFLLGACCAFVLDWHAALVPTNTVEDILQVLIVFCVESLELDFALLFPERHTLLRVLPVLVVLATSSEKESESLYKRVKINRLLNIFKNDPVIPAFPDLHLSPAAMLKELSSYFQNFSSQIRLLTLPAPHEIPPRELQEYPFCKVF

SEQ ID NO: 115382 - protein, 409 aa, Triticum aestivum
  unsure (1)..(409): unsure at all Xaa locations
  Clone ID: PAT_TA_9800.pep
XECPTELKPHPRXIVSKCKGLPLAIVSVGSLLRVREKTVEEWRRINDQLSWEIINNSRLDHIRNVLHLSFIYLPTYLKSCFLYCSLFPEDYHFRRKQLVRLWTADGLIGERGESTLEEVAEDCLKELVDRNMLQLVERNSFGRMKTFRIRGLVRELAVDLCQKNCFGASYEDQCGGSLEMDGRRLVLHKLKKDIQQPFSNMHQLRTVITLGGSKSSCTLLPLLCTESRYMTVLELSGLPMEKIPDAIGDLFNLRHLGLRGSKVKMLPKTIENLSNLLTLDLYESDIHELPSGIVKLKKLRHLFALIAIHPRWRELASCSGVRIPNGLGNLTNLQTLQALEAQDESLRHLGELRQLRSLRVWNVKGIYCGRISESLVQMQYLSNLYVNASDENEVLLLNVCLPSLQKLLL

SEQ ID NO: 115383 - protein, 90 aa, Triticum aestivum
  unsure (1)..(90): unsure at all Xaa locations
  Clone ID: PAT_TA_9801.pep
RHERDHLEASVRRQTGEDLPSGATAXELRSLEHKLECALGKVRETKDKLMEKQLDESHHRVHILEEQNSFLGHMILKVLKHNLCTQPAKC

SEQ ID NO: 115384 - protein, 281 aa, Triticum aestivum
  Clone ID: PAT_TA_9802.pep
MQICYFFYKNVTFGVTIFLYEAFASFSGKPAYNDWFLSLYNVFFTSLPVIALGVFDQDVSSRLCLQYPELYQEGVQNVLFSWRRILGWMFNGVVNAILIFFFCTTALKDQAFRQDGQAAGLDALGATMYTCVVWVVNCQMALSVNYFTIIQHIFIWGSITVWYIFLMVYGAIDPKYSKTAYMVFIEQLAPALSYWLVTLFVVTATLVPYFCYAAIQIRFFPMFHNKIQWKRYLGKAEDPEVARQLSSRHRTSSHQRMVGISARRDGKAMQVKKGTDVEVEG

SEQ ID NO: 115385 - protein, 139 aa, Triticum aestivum
  Clone ID: PAT_TA_9803.pep
PYLLCHSQIRINGDCGAVDITLARIYNAVEATIDVLILKVQNGFNLSLSSFVLVGGSDQEIPLFRGTTAESCGLRRYVIAVKMDTWMQLKFKVSQNGSKNDHLERSCYFKANIHGCACQQIVLQHAALSVKVTWSTVPA

SEQ ID NO: 115386 - protein, 121 aa, Triticum aestivum
  Clone ID: PAT_TA_9804.pep
AHSFSDASRKRDRCVADCTFPISSEVSVADMRMSTATSATVDLCRLWILLRVGDRSQVVVAHGKSLASRFGCHAVLGHGCTMPGDSDGRAATGVDCFSCLDASLQRCSGYMMHISSVIFCV

SEQ ID NO: 115387 - protein, 418 aa, Triticum aestivum
  unsure (1)..(418): unsure at all Xaa locations
  Clone ID: PAT_TA_9805.pep
RPRDATLQAPPQPYLPPGQRRPGGEERGEKGFPAQRXVLAMELKLNTSXEEADDSGGGXTFACDVVRLAVLLFASVCSFETLEEKMRAMANLRYRVLPPQLLLKWPKEASFCQLMMHPVPDTRPKMSEVLQSEFLNQSRNSLEEREAALRLREEIEEQELLLDFLLQLQKRKQDIADNLQDTVAFLSSDINEVLHRQSALGQCGNSRTELGKEVSSGTVEDQSDCGSRKRFRPELHAVDMEEHSRSLEECSRTVPSSVVIQESVLSKSSRLMKNFKKLETAYFLARSKLARQVGNPLRSCDQVVKRTTGSAVGTEGSSIDDFALEGHSGRRQGGWMNSFLEGLCXFDRDNEFFATAGVNKKIKVFEYNMIVNEHRDIHYPVVEMSNKSKLSCISWNSYMKSHIASSDFDGLVQVWDVT

SEQ ID NO: 115388 - protein, 294 aa, Triticum aestivum
  unsure (1)..(294): unsure at all Xaa locations
  Clone ID: PAT_TA_9806.pep
RGRVDIGWPERKPYLNSIGQYNFHRWLDAGSDQPRSYGRRAMTTVIKSLVSLVGVKEDKMLFWMSRLLDTEHVEADKDTMECRLEGITDFDAEXSTXDPRHWPKLGGIVQELQDIREDFGGKVALVHFITEAHLRKYPLHPPSDMETDTGTSCIVLVEVCRKLSNYMAYLLVTHPXSMLPLNDSALYTLEKMAHLFPHLIDEQQDSEGFFNIEPSMETLQELVDIWTKLLIYAATKSRPELHAAHLARGGELITFAWLFLSHNFLGDSEVIKVQLTNANQRGTIAYVFGNPAPR

SEQ ID NO: 115389 - protein, 144 aa, Triticum aestivum
  Clone ID: PAT_TA_9807.pep
STAHRNSYLELAFTARISPPEPEGQGTQRKSKTIKFVTNSMEQKATCKATLAKTDKLAASIFELLPVRDDMDFITPLSILHQVAQRSTATMLSISTGFSPGWMVRNHRTDQPGSSFIGDLGFLGINPLNKASFSSDVLLSDATP

SEQ ID NO: 115390 - protein, 107 aa, Triticum aestivum
  Clone ID: PAT_TA_9808.pep
FFFEQTRAPSQNFIGWGGQKRMPDTKPLYISSSRPPYFAGRQANRRNPAKMSPTPRQGFRGPIPIPLSPKKKETKKNHRRVMAPTYTSGAACLMLALLYRERMRAGG

SEQ ID NO: 115391 - protein, 174 aa, Triticum aestivum
  Clone ID: PAT_TA_9809.pep
PPPIYGTITFCGNAVKIQWPSSLKPGRSTGSYKFGSTFYFPFGLCMLSRDDFISRTSDQTRVTEALEGLGRTRRSGAEEMRHHHPRAAMQSKLQRPLPPSQACRSGSHRTGGATCQPPGARAQCRAGQSTHGSQQEVIPDATVGQERTRRSRDGPAALPHHWLPMFYFLHQVLS

SEQ ID NO: 115392 - protein, 158 aa, Triticum aestivum
  Clone ID: PAT_TA_9810.pep
SLNCTVDGLELNGFKVVANSAQYSAELIALQTLSLVSTYFRHQNHFTHGTFPADARTTKQSTMHQHLSMARTDCPAKMARTDCRVATLFRHSVRLRRLSPLTITAYTVFPSSLFGCHPDLQAGLGRCSRRAKFWCISTRAPQRESVLPSSFQTSMHVE

SEQ ID NO: 115393 - protein, 202 aa, Triticum aestivum
  unsure (1)..(202): unsure at all Xaa locations
  Clone ID: PAT_TA_9811.pep
AARVERRTAEDGFIWRKYGQKEIHNNKHPRLYFRCTYKHDIGCPATRQVQQAXTTPSLYVITYFGDHTCCQGDAAGAVLEAEDVKMQPFVINFGSATASSGSPWLSSPSDTDDGRRTDSGASHSSQAVCSSEEFEVKEAKVESTSEDSQTVDPAAADLSSSADFSCASPAWDPLSGCLDWDHFGDSPFDCEFMDFDAIPLFQ

SEQ ID NO: 115394 - protein, 185 aa, Triticum aestivum
  Clone ID: PAT_TA_9812.pep
SARGPTLVPDPVALPRVACPDCGRIVVTFVARRGQFAGEHFYKCRNHNPGRDGCDFHRWQEAYAEHLASLGPAAPPLAQINADENEIGGANQGGHLQAADGEAGNQGGGSDGSQMSAAGGAGGSVLDAAASGAGGYVLGAAVVGPASGYCRTGPRIYQSGCFCGKHGHLHRHPCTGCSFKHDACV

SEQ ID NO: 115395 - protein, 127 aa, Triticum aestivum
  Clone ID: PAT_TA_9813.pep
RVTTSHRQFETQHILKDKWRNLLRACGVMCASKRKVILIMLYSLRSYSMTNSKYIALSIYHTCIDFVFAKKKHALNLMQEKAQKTMFLPLDTNLIEQIQGLAIDSAFASKMKKCHGKGTIRLEMITK

SEQ ID NO: 115396 - protein, 215 aa, Triticum aestivum
  unsure (1)..(215): unsure at all Xaa locations
  Clone ID: PAT_TA_9814.pep
DIASSDTVESFRARVQERVGCPPVQQRLIHAGKQLKDGHTLAETXDYGVRNDSTLNFICRPANRRTRTVELYIEVTNTVGRXIKERLQEAEGVPTECQRFYLHGKELDDDLALAEYNGALERKNHVVVDCQRCWPESDRTMNQSRPSNLSIWSMGQMLSILCPLFCIMMMAVTLDMRARRQHLDGDGWLAMSGVGSSSSSSELERRGEEVFIHHA

SEQ ID NO: 115397 - protein, 136 aa, Triticum aestivum
  Clone ID: PAT_TA_9815.pep
RPGVRLQDLHQTANSEVDTMMLTDAPLLYTPGQLALAALYKSNSALSVLDFERYLESVFSRQHFDCPVEQFIQIISSINHLVSQLQLPGTKEMRHADRKLKHCLDPSSSSHDDHKKKEKKSKHKSKRTASDAQLNS

SEQ ID NO: 115398 - protein, 327 aa, Triticum aestivum
  Clone ID: PAT_TA_9816.pep
AQASDVCDGDEARGSSLLCEHVPVMEKKLASAAPRELMASSAVGNEIRKESTTALVEQIERQMSCTQIGRNTDMEVDVSLQNPAVSQVQDGPDKEESEGVRLGSKTSKLLLVHADQQPGMEDRLVVSSKPRKGDVSSSCPKTGSMSAESDVSQDSNREQDKMVARKHAEDKPGAGGHTAPSHNDVATTDYEKHCVFASEVKDKLSDIQKCWLQSTVNHEVPEIPLYVCKMKQGLLSQMYFSVPYTRDHFSKHIRGSSGEMKISATNGGNSARMKFNISVSKSHRRLTFGEKEWKVFVSANRMEEGALCAFSFKVESGKPSVSVSYHE

SEQ ID NO: 115399 - protein, 291 aa, Triticum aestivum
  unsure (1)..(291): unsure at all Xaa locations
  Clone ID: PAT_TA_9817.pep
IEQVDNHRRGQHAGIVQVILGHPSCKPQLGSPASADNPLXFSNVDTRLPMLVYMSREKRPGYNHQKKAGAMNVMLRVSALLSNAPFVVHFDGHHYINNSQALHAPMCFMLDPRAGQNTAFVQFPQRFDDVHPTDRYAYHNRVFFDGTMLSLNGLRGPSYLGTGTMFRRVALYGMEPPRYRAENIKLAGKVNEFGSSTSFINSMPDGAIQERSITPVLVDEALSNDLATLMTCAYEDGSSWGRDVGWVYNIATEDVVTGFRMHRQGWRSMYCSMEPAAFRGTAPINLTERLY

SEQ ID NO: 115400 - protein, 64 aa, Triticum aestivum
  Clone ID: PAT_TA_9818.pep
YPVTLIMDIVEPLNYGLCLFLSWRIYYMCCNSCIWTSCFVMPIMFESGIFNNMGWELLLISSQE

SEQ ID NO: 115401 - protein, 192 aa, Triticum aestivum
  unsure (1)..(192): unsure at all Xaa locations
  Clone ID: PAT_TA_9819.pep
IIGQGXLKHLKVGKSGVASCEVRDTSKYNLRHVVKTDQSECTCLEWQQTGKPCEHALAFLLDRRNPRWEDYVHDYFSLEKFRAAYAGEVEPLTDRSQWPHVQFPFDMEAPLDKKRGVGRPRKNRYKSFLEGGDGGPKKKKEPKQLGSKNRCKRCHILGHRQSTCPLNGPKPRKIKKRAPRYPADDDAVGTGT

SEQ ID NO: 115402 - protein, 275 aa, Triticum aestivum
  unsure (1)..(275): unsure at all Xaa locations
  Clone ID: PAT_TA_9820.pep
MVSHWEVLGCQGQKNTPLPPMPGPTKAGFGVVVLDGKLIVIAGYAADHGKECVSDEVYQYDCFLSRWTALSKMNVARCDFACAEVNGVIYVAGGFGPSGDSLSSVEVYDPEQNKWTLIGGLRRPRWGCFGCSFEGKMYVMGGRSSFTIGNSRFIDVYDTNSHAWGEFRNGCVMVTAHAVLGEKLFCIEWKXNQRSLAIFDPADNSWQKVPVPLTGSSSTRFSLGTHDGKLLLFSLEEEPGYQTLMYDPAAPKGSEWCTSKLRPSGLCLCTVTIKA

SEQ ID NO: 115403 - protein, 205 aa, Triticum aestivum
  unsure (1)..(205): unsure at all Xaa locations
  Clone ID: PAT_TA_9821.pep
RSPWXRLSAKLRDSLLSEVDILRRITHPNIIALHDSIRDGGRIYLILEYCRGGDLYAYLLRHKRVPESVAKHFIRQLACGLVRLRESNVVHRDLKPQNILLVSNNGTSILKIADFGFAKFLQPSGLAETLCGSPLYMAPEVMQAQKYDAKADLWSVGIILYQLVTGSPPFNGDSQIQLMKNILKSGQLRFPSDCELSHDCIDLCR

SEQ ID NO: 115404 - protein, 111 aa, Triticum aestivum
  Clone ID: PAT_TA_9822.pep
SMHHRLELPTGRGWRLEKEGRERRPADLRSTGSGFNGTSEHITDRDGDPRRHTSSRGWSGQVEEWMRHRQSRSMRRLPSRGAAVEKEATSSTFSPPAPSPSSRAWCWILEN

SEQ ID NO: 115405 - protein, 155 aa, Triticum aestivum
  unsure (1)..(155): unsure at all Xaa locations
  Clone ID: PAT_TA_9823.pep
QWGIVRTSDKPXLTQSINFFKLASKLCLVDLPGYGFAYAKDEVKESWQELVKEYVLNRVGLDRVCLLVHTKRGMKPLDYELIDLMERYKTPYQIVLTKTDLVFPIDVARRAMEIQESLKKNKSVVKPVMMVSSKTGAGIRNLRGVLGKLARFIKP

SEQ ID NO: 115406 - protein, 185 aa, Triticum aestivum
  unsure (1)..(185): unsure at all Xaa locations
  Clone ID: PAT_TA_9824.pep
RHXGLXLGSTCEVLLQDGKSERLTVRAGPNTTSVQDALTEYRVIESCPRGFTWLELFPLTGRKHQLRVHCAEVLGTPIVGDYKYGRQAHQDWTPLPVPQTVDEELLRKQRLPFGLVLGGGSVAEEQPQLHLHCKQMMLPDISAAVQGLQSEDAERDFSGLEKLSFVAPLPLHMRLSWEVLKSVDK

SEQ ID NO: 115407 - protein, 167 aa, Triticum aestivum
  unsure (1)..(167): unsure at all Xaa locations
  Clone ID: PAT_TA_9825.pep
LLSSFHSPPLLHLHLSPYPRCQKQSTRYLSSLLALYVPAPSEQQALPPMHLKSLPLLHPQQPPHSSPSLLVQPPPPPQEQPSLHEPLXPFPGPFWTLALEAAAEEQPPLQPPSLHGMSPPQPPPPSPHLPSPVQRTQPSSSSSRVLPPRPSPLSVHLQSPVQGTPQN

SEQ ID NO: 115408 - protein, 104 aa, Triticum aestivum
  Clone ID: PAT_TA_9826.pep
PLRGVPGLPPPGASSDVAPLFPPLRGFPDLPRVHVPPRRSGDKAYALCFVEFSDAKCAGTAMEALQEYRFDERKLDGPFLKIQFARFPFRPPPAHEDRKRLSAR

SEQ ID NO: 115409 - protein, 76 aa, Triticum aestivum
  Clone ID: PAT_TA_9827.pep
DSYYNKVCLHTINPFIGAIYHIQYHLGWFMSKMLFLINLRVVLGCFLVACPYADCKKPKYSSYFKSFMSISSDANV

SEQ ID NO: 115410 - protein, 124 aa, Triticum aestivum
  Clone ID: PAT_TA_9828.pep
VVKTSPWSRYRRRTRWRCWRVCPCGTPRAGGSHRRPQARSRTRAAVARTGASAPATAAACYPPQLCGALRRTRRTVGARSTYHPLAQPTRKKNPLSSVASNRRRGGRSQRLGSAQGGAEARGRE

SEQ ID NO: 115411 - protein, 157 aa, Triticum aestivum
  Clone ID: PAT_TA_9829.pep
MACSDGEAEHQWIQNVKSGGAVPCLPPENCPNGWATPPGDTFMVRGPEYFATKAKIPGGEYLLKPLGVDWIKGPVKICEVLKNRNHRVRKAIDEEVSHGNKPFVWAFNLQLPSKENYSAIFYFVSLEPAPEGSLMDQFLKGDDALRKSRLKLIANIV

SEQ ID NO: 115412 - protein, 138 aa, Triticum aestivum
  Clone ID: PAT_TA_9830.pep
RPRTRGRTRGVAAHLALDPRSGRHRRRPRARSKVRPPSPPASRSTPSSSRRPGGRTPPPPSSTPHPPILALYPLSPRSSRGPCTPQSDGRPRVLLTSSRRPRESPSLLPPGLHRRAPAAAGSAAIGAPLPASRCCRTC

SEQ ID NO: 115413 - protein, 106 aa, Triticum aestivum
  Clone ID: PAT_TA_9831.pep
APARGTSAPSAAATRPAASTASTSTTTTATLPPRLTTPLTPPPPPPPTAPAATVAIGRPINRSSRSISRATAYWVSIYACELRCGSASYYWQYVLSVYLKLAGRRI

SEQ ID NO: 115414 - protein, 233 aa, Triticum aestivum
  unsure (1)..(233): unsure at all Xaa locations
  Clone ID: PAT_TA_9832.pep
ANSARGGVTKXCQXXKWEMFAEQAENDCKVGSSFSSAKHCRMETIMQECACTVDSAAQQWKKSHAAVNDLCTKQVAEVEVLVRGAIENNEQHEAEIASSRALAEEQASNSSKEILQDIDNLLEEARNSTSRVVSTVEAHSVEIQHLQENHSGQTSGVNTHAEKAFQSSYRDYEPTGETPMRSEPEVPSKGTIESLRAMPIESLMDEFRENHPYESSKEPKPSLIPRSPLATLN

SEQ ID NO: 115415 - protein, 183 aa, Triticum aestivum
  unsure (1)..(183): unsure at all Xaa locations
  Clone ID: PAT_TA_9833.pep
XEQTTXXYWGFXYXXIXXWLVIDXPEXAAVAXXEPERRPGRRRDRQPGPRTTARGRGEKRRPRGRGEAARGKGRPEVRASCRSCRLVLLLVATPCGLPLYTNNTLRCRCSPCPSSAPRTVVSSHHLKCPLLLVPSLWQSTESSDMAARRGALLSPLLAGHDSTLPGPPLLRCSLWRRXGCCCS

SEQ ID NO: 115416 - protein, 100 aa, Triticum aestivum
  Clone ID: PAT_TA_9834.pep
TLMCLLLLYTSLHVHGEVDTSIRTSSILVQPARRVLQATYVPQTTITRQCNICHCSDDGDITWYVTTCCSEAICNDPAEPSGTCTSRRISCGGCDEKTYK

SEQ ID NO: 115417 - protein, 266 aa, Triticum aestivum
  Clone ID: PAT_TA_9835.pep
SAHASVGYMLSDMLKENNGNKEGLLFDTHARTALAFVTLRSDGEREFMFYRNPSADMLLEEKELDLDLIRKAKIFHHGSINLITEPCKTAHIAASKAAKDAGVLISYDPNLRLPLWTSADDARDGILSIWDTADLIKVSAEEISFLTNGEDPYDDSVVKKLIHPNTKLLLVTEGPDGCRYYSKEFSGKVGGLKVTAVDTTGAGDAFVAGILSQLAADFSLLQDEARLREALKFANICGALTVTERGAIPALPTRQQVADALTNVVA

SEQ ID NO: 115418 - protein, 441 aa, Triticum aestivum
  Clone ID: PAT_TA_9836.pep
SARGTVVKFIELVVAQGDKRGNPKRIKRSENLNRDNHFEEYFGEHPVSSILTSLLDIIFLMKNVNERLCLLQPLCQILSKLLSDQWISGIVCQYNKGSSETLDVPSFVKETQQLVLLTLKDIIGTLQSGHQDNLLNNGNVNLLINFIRSTEDVGTRNHGLSLIASLAKAFPQLVSENIIDLFVAIGDAVKQEDSHSQHVMEDLLSVLVPCWLSKTTSIEKLLQIFIKSLTDVAEHRRVTLMMYLLRTLGENSLSTVIMYLLYTLIERGSHSLSKHKKSHCVLSLSAMSQEWEYGLAVNMTGQYSYKLWFPCLCKLLQEIKVHQKQVLLPMLHLALQFILLKLQDTELRFELEAEEAANSIQNSLGTLMEEVVLCTVSVKDKKGDISGDILKEVRNNSNTVLKIITGWMHASTYFKGITQLLEHPEGLVKRKTLGILKLQGR

SEQ ID NO: 115419 - protein, 232 aa, Triticum aestivum
  unsure (1)..(232): unsure at all Xaa locations
  Clone ID: PAT_TA_9837.pep
MYHQQCELLMPHEGLDMDAGQSHHLAAASAVPAELNFHLLSYVDAAVSPQQPTVEYFFGGADQPHAQFEQLAANHQAMTVLRDYYGQYPATADAYLPGGGPRTGSSSLVFGAAEEESAYMVGGFQCSPKPRASGSRKRGPGXAGSSFHGFPGNGGVEKKGXQRRPSTTRTFSALMRLIPTRPKGVRAPVIYDAIEYIQELGRTVEELTLLVEKKRGRREHQGDVVDPAPLVV

SEQ ID NO: 115420 - protein, 89 aa, Triticum aestivum
  Clone ID: PAT_TA_9838.pep
MESSGTTARRRAAHLKILLLHGDADPEVPYETSIWYAEFLRTSGFSVDFRTFNGLQHFWTCREMDYVEQWLRPRIARPRIAVPRRHGRL

SEQ ID NO: 115421 - protein, 90 aa, Triticum aestivum
  Clone ID: PAT_TA_9839.pep
VRTLASPMVKEGVWADVDDYLLVEALQKVDAVCIEDVDWDSLLDHRSGEVCRQRWNQMVRAIGGHREKPFIEQVEVLSRRYCPEMIEYRK

SEQ ID NO: 115422 - protein, 92 aa, Triticum aestivum
  Clone ID: PAT_TA_9840.pep
GAVSQGSKQLPASAAAVAEKQRAEKAEEGLRTVNVPQAAGGQISSCKLGTAGCSLVLARRVSVCCNNHGLKSVWLPVESPVAKYHHNDDDEK

SEQ ID NO: 115423 - protein, 68 aa, Triticum aestivum
  Clone ID: PAT_TA_9841.pep
FFFVQLKTILLLIFLTRFITFTVHVTCGRMHKLLARQTMKSRIIPIWQYLTVLLPVPKKHTQKKASCR

SEQ ID NO: 115424 - protein, 74 aa, Triticum aestivum
  unsure (1)..(74): unsure at all Xaa locations
  Clone ID: PAT_TA_9842.pep
MGTYLSTPKTEKQTADGDGARVRYGLAFMQGWRTTMEDAHTCVPQLDERTSFFARFDGHGGKAVXKFCANITHA

SEQ ID NO: 115425 - protein, 171 aa, Triticum aestivum
  unsure (1)..(171): unsure at all Xaa locations
  Clone ID: PAT_TA_9843.pep
RSSSLPGGLCCAHWSCAPVVVSPSKALRKLXAVQHLSAQLAARLRNEDDEFDILNALHPSPAVCGXCPLKEARQFIRDYEIFDRGMYAGPVGWFGGAESEFAVGIRSALLGKLSCPGIXTLVYAGAGIVEGTNPSFEWDELDLKASQFAKLLQYQEHHICYQEAGNMGTLI

SEQ ID NO: 115426 - protein, 219 aa, Triticum aestivum
  unsure (1)..(219): unsure at all Xaa locations
  Clone ID: PAT_TA_9844.pep
RHEAHAPPSAAAFLESTPGAYTTARASSTGLIFWWPRHLLRLTDSARLLAQSHPHLLGLPAPPPGTLSTAPIEPLVNQSVRVGVHEMRSRMLALGECCSGEDMALTALVRAGGAADGLEVCVHLGVYVPPVFGDAGARLVVAGXGREAAAAKYAPWARMRKSMEKMRPPGATELLLTNDGDHPLEGSVTTPRAAGRDILLSRKEFDKSKFLNFQHWSFD

SEQ ID NO: 115427 - protein, 197 aa, Triticum aestivum
  Clone ID: PAT_TA_9845.pep
PALSPVGPAAHSALPLPKKLAQLAKKCQRMLVARAGARRRHHASDTADDECCITTSSVVADEGHCVVYAADGARFEVPLVYLGTTVFAELLRMSEEEFGFASGSDGGRITLPCDATVGEGVRRLPWREAALGGGWAGLRALAGRALPHRPCWVAPAIGRALPPLCALCAAPRVSRVFFCLCLEISVQSDVRSYYHEK

SEQ ID NO: 115428 - protein, 75 aa, Triticum aestivum
  Clone ID: PAT_TA_9846.pep
TSASYRTILRATGRVGKYINYNCWNPEGSSIEVCEYICKPLSTYEYYYRDSLNHVVGLLQCSIGLPLLGSILVCL

SEQ ID NO: 115429 - protein, 253 aa, Triticum aestivum
  unsure (1)..(253): unsure at all Xaa locations
  Clone ID: PAT_TA_9847.pep
SFHLEFVHGGFFIGHRCNKSFXNGEKVYYDFCECSTTCMEMLDDLIEDLGYEHKVKIKTYLLLLGSQTNEDELRLISKNSDTSCICAMQNGMMFFKNPATHLRYYQSYLVQKRGEAGQWCRYEHWARSEHWGMLFCRWPNRGRAIVEVVQDDLEEGTDDDSSDSDYEPEIVDSDYDLKEGDDDLVNDNCQTDEENKREGKWKQLEKDDNYEVDGLELPDSDDEDMKFNSRYFTDADMNEPILHVALAFSSIDP

SEQ ID NO: 115430 - protein, 157 aa, Triticum aestivum
  Clone ID: PAT_TA_9848.pep
RSTTRTRTPHSHPPLFRPSTRSSWIWPRRLLKILDVVLGVRARLLLALLLQIIVRLRLASFGVEGIHDDSAKGMVLVILNVADVGVAGEHAAQLRRLLVGARLNLDGLAGPLLGQMLLRPAVQPPGLLLARVLHADPGAPFPWIRGCCGAGAGGEAS

SEQ ID NO: 115431 - protein, 87 aa, Triticum aestivum
  Clone ID: PAT_TA_9849.pep
GQMQLSCNPITVHMSYICKSFLERNRTIQGELASNNVTSSHNEIFEYYYYHKGSGPVHVAPACIGSGKGSTALGRTMQSFPTFLQEA

SEQ ID NO: 115432 - protein, 333 aa, Triticum aestivum
  unsure (1)..(333): unsure at all Xaa locations
  Clone ID: PAT_TA_9850.pep
MASMSSSLSLPCLALQCDLGRSTSTVLLSVPEKKVVATAADVDALIAPALANKSVLPTARGYVLARDPASLATFLYSPQSRRKIDLPPLAIDQDLLRHGAHCLLSHEPTDPSCVVLLVEPNTTFIWHLRLAGDQTQWQRHEYDIGSQVYDDDEDDEKHPAWVGKTVIRQIGACRGKFYFNPPSPELGVLDFPASPAGPPAFGSIPAGCHDEGEYAVVGRVFLVESEGELYMVKLLMDEANLNKYTGLSVYVMDFERTRWRRVGDLGGRTFVMAPVYXGASCDAGRLRADCVYVACPMSRELQVFDVKDGSIETQRLDEAPFSNKAFWVLPTGC

SEQ ID NO: 115433 - protein, 102 aa, Triticum aestivum
  unsure (1)..(102): unsure at all Xaa locations
  Clone ID: PAT_TA_9851.pep
LEMYHECKDCFHIISXTGRSDCXEMYRREILVCGYPSWGKTXXRQILILACPLCGTNQERRAAMEAEGFKILGNSGDQWSDLIGLPMATRSFKLPNPMYFIS

SEQ ID NO: 115434 - protein, 137 aa, Triticum aestivum
  Clone ID: PAT_TA_9852.pep
ASVSRSLTLTLIFYACTMCEILEHICRCHLALHMPKCKADTLLSRTNTGYATSSALAISSTISSYLLYAKRGRRHSLCNRIAVRHPPTIFAMAPQETDNVHVTCFPSRWACPAGRTRRKASGERDMVPARTATRLAW

SEQ ID NO: 115435 - protein, 231 aa, Triticum aestivum
  Clone ID: PAT_TA_9853.pep
FGSNRTSSFSEASGGRFRRRAAGSCCWTRMRVALVVPRLPEAAPRRAAGAARGFTAGGGLFGGDSVATRLHPPLPSLPVAMDEDHGPTSFSITRTRAPLFLPLDSSPRRRRPLPPLHAPLLFVAHGGRRRGSDGSKACDPSVTTAPEPGQSRGRLCELSSELTIALLHLRCKVAAATQVPWPLSHSCHPSRPQGTVVVGIMFDAGCIYSHDNGQQLGVHHRSSSVSPPLRH

SEQ ID NO: 115436 - protein, 112 aa, Triticum aestivum
  Clone ID: PAT_TA_9854.pep
CRFGTRNGSVYGDRRDVQVGCFLHRRPPSGGGGGGGWKKLGVNENGEEVVFAGRVAVGSSVQGGAALEEELVAIQVDRLAEGVWERYFGGSSGWNYVTAESEEIDRSIEQLA

SEQ ID NO: 115437 - protein, 141 aa, Triticum aestivum
  unsure (1)..(141): unsure at all Xaa locations
  Clone ID: PAT_TA_9855.pep
EPTRPPPTRPPVADCASPATRPLAGSSEPRRGGGQKEGDEGRGAARPLGQRRGGXGQVVSAIGPGLLVLVGVHEADTSSDADYICRKVLNTRLFTNEKTGKAWDQSVMQQNFVVLLXGNKPYFHVAMPPAKAKTFLLFFEL

SEQ ID NO: 115438 - protein, 195 aa, Triticum aestivum
  unsure (1)..(195): unsure at all Xaa locations
  Clone ID: PAT_TA_9856.pep
XXCPKILGLPFSNHIVSPDWFPKLQELEVHDCPKFLPVIPISWIESKRSVTVKCVKMLKEFAYSKSSTGAQLKIIGESDLLSIDQVLVFDKETGLETLTLSKCTPLELKHLLMLTSLRTLIVKDSVGLVGPLGRGQSDVEWQLPVECIKIDGLTGNTGEELTELLPHLPKLSKLEIQDCKNIKNLVVGVDVQQTA

SEQ ID NO: 115439 - protein, 52 aa, Triticum aestivum
  Clone ID: PAT_TA_9857.pep
NDQCRMLTTSKLKVGINFQDGNWLVVVLLSMSLYLHKRYRYTSYEVYLYRRS

SEQ ID NO: 115440 - protein, 181 aa, Triticum aestivum
  Clone ID: PAT_TA_9858.pep
FFPPLPPSSFPPAACVQSARLVPDFQSILLTTAAASSPLCARGSSIRLLSQMETPTGPAQAGGRFPVPHRSLSLDIKGNKTDIVISRYEDNFLVIVTQIGCMGTILAAKKDESVFSDPTYDVSVLFGKRDEPLLLACARQLIEHISGSGSARPLVISLGLKDHSQGTLKDVVSAIVDNRLW

SEQ ID NO: 115441 - protein, 69 aa, Triticum aestivum
  Clone ID: PAT_TA_9859.pep
GNLFMVLPVAAEPSVSDVLLISRMVCMPELTCSTDVAVCSLRDLLHACLVSSPASHVVFISLLLPPFGV

SEQ ID NO: 115442 - protein, 576 aa, Triticum aestivum
  Clone ID: PAT_TA_9860.pep
MSMAECSASLATTARTFVDVRSEAESKEEVVVEVEVSFLFASPPDVSGFVVHVGDYGLSYGASVVSTDGNAVLLAITMAMFNLQRYLVYRVDQGNPSLEVLPDRPMLKFHPTKVVGILSHGKGYVVAALTRKLKIDYLAYELFLYTSQTKAWSSKVIPLECTRDADLIHVLNHHTTKVITVGVDSLGWVDLWRGILFCNVLDENPVVRFLSFPCPMPSNACNLGTSCPRPFRDVICIGNTLKFVEVEYNQGEDDTDYGSNTDHGWKATTQKRNLGSEWTECFSVDTSDILLTDESWDLLSHRLRDDDARQLSLSKLECLAPTLGIDDDYLYMMTRPLGSNEKPLGLFASLDIKNKDMRLVSFSTERMSYIDPNYRPCTVSRYFNNTSVAGKPLKSKNKKAAPRFIIGENLRWIGLVKLAVLRNILVAIQRLTSLDAILMKPERPDETQLDQTWLKNCSASVEMLGQMAHGISSYTDHLPATSIQYHVDALKEGFSILGGKTFPFMDNDEYASFVDITHFKILDVVKVALSSLVKELLPKRLDDPHYSLRSVERTLMYGELPLTPYLRRLDLSEGCA

SEQ ID NO: 115443 - protein, 286 aa, Triticum aestivum
  Clone ID: PAT_TA_9861.pep
VRLAEATLALLRQESCCQQVESDGEDDGDIDHDEVLMDAVSDLLPAFAKVMRSYFDPIFAKLFDPLMKFAKSPHPPQDKTMVAATLAEVAQEMGAPISAYVDKIMPLALKELASSEATNRRNAAFCVGELCKNSGAAALKYYPDILQGLHRLFANSEQDLAVRDNAAGAIARMIMVQPQSIPLNQVLPVFIKALPLKEDHEESMAVYSCLCNLLLSSHPQILTLVPDVIHVFAQVVVSPDESDEVKTTIGKAVSHLISVYGQQMQPILSALPPAHANALAAFASRR

SEQ ID NO: 115444 - protein, 281 aa, Triticum aestivum
  unsure (1)..(281): unsure at all Xaa locations
  Clone ID: PAT_TA_9862.pep
FRGMAALRHAYLNDNAFDALPKDFFDGLDSLEEICLDNNPLNKTAGGWEIPPALAASSPQLQSLRLTNCSLVGGIPAFLGGMTGLQMLTLSYNSLTGPIPATFAGSGLQKLWLNNQLGEAKLSGTLDVLAGMADLQQAWLHGNQFTGPIPDAISNCKQLVDLKLNNNDLVGLVPPGLTALPLLRDVXLDNNNLXGPAPALKSGNLTSSHNGFCAVKPDDKCAPEVMALLQFQAEAGYPVKLTGSWSGNDPCKAWLGVTCSQGKVSVLNLPSSGLNGTISKS

SEQ ID NO: 115445 - protein, 97 aa, Triticum aestivum
  Clone ID: PAT_TA_9863.pep
MQASRARLFKEYKEVQREKSADPDIQLICDDSNIFKWTAVIKGPSETPFEGGVFQLAFSIPEQYPLLPPQVRFITKIFHPNVHFKTGEICLDISKNA

SEQ ID NO: 115446 - protein, 167 aa, Triticum aestivum
  Clone ID: PAT_TA_9864.pep
MQASRARLFKEYKEVQREKSADPDIQLIYSADPETQLICDDSIIFKWTAVIKGPSETPFEGGVFQLAFSIPEQYPLLPPQVRFITKIFHPNVHFKTGEICLDILKNAWSPAWTLQSVCRAIIALMAHPEADSPLNCDSGNLLRSGDIRGYQSMARMYTRLAAMPKKE

SEQ ID NO: 115447 - protein, 133 aa, Triticum aestivum
  Clone ID: PAT_TA_9865.pep
ATRSLFLAPPRAGFSVFVCEAWTAAVAAAGWGPAWGWSCSCTCRRRWGWTWTATTTAGRRPRAPPYRQTAGPSSTLPIVTWARTRCLIYGMVADKPYPTCCNCTQLLLVDLLDDGGAGGGRSGRHDKKRAKLK

SEQ ID NO: 115448 - protein, 201 aa, Triticum aestivum
  Clone ID: PAT_TA_9866.pep
MAEDGLNDYERLRQENIRRNQEKLAPIRRKADELSAPIRLAKPKRPYQVRPKAPTGPVRSSGRARGIAPDNLPPDLSLTPSLASSILGGGAGTNVRAADDFNAGRGMVLMRAHVRNVVPCSIESMRVLPLADQTVVAAGDKRGNIGYWDVDGVSEDADGVDGVVFSYWPHKCPVSAIVAHQVAPHKVTFLRLFFHFLGTPR

SEQ ID NO: 115449 - protein, 201 aa, Triticum aestivum
  Clone ID: PAT_TA_9867.pep
AEQIGMKMYSWNDFLKMGKDKPVQPRPPQPNDTCTIMYTSGTSGQPKGVMLSHESHGMYVKGVDLFMDQFDRGRAAEDVFLSFLPLAHILDRMIEEYFFHKGASVGYYHGDLNALGDDLMELKPTLLVGVPRVYEKIYEGILKALADLRPLRRVIFNALYNRKLAGMKAGYTQKTASPFADMLAFRKVKARLGGRLRSTRP

SEQ ID NO: 115450 - protein, 134 aa, Triticum aestivum
  Clone ID: PAT_TA_9868.pep
TNPRKPRRDHTTKQASAAPPGASTGTPPRSTAAQPLPPMEVVHEDLKWRPLQALACGTGRRLQTISFSRQVMYQIDLCAKSVLCSPPSGSKCWSHPWFNLVPSLLHCCPTDSAIGGGSVSSEEATITASGNRHM

SEQ ID NO: 115451 - protein, 250 aa, Triticum aestivum
  unsure (1)..(250): unsure at all Xaa locations
  Clone ID: PAT_TA_9869.pep
MGISSKWIKSLVGIKKHGKAQNGESSRERSSAAQVLHKRKHSVDTEGSLAVAEHTVQIEPLASDTNTQTISSETELNTKEHQAATVIQSAFRAFLARRALRALKGLVRLQALVRGHAVRKQAAETLQCMQSLVKAQARVRARQGSICFEGVRCPRKKLPNQNASEDQARKNGGTLVVVVIGFGXCGASGSAEEMQAKVLKKQEAAAKRXRAMAYALTHPGFQGTTKGWAPAGPGPEADDNQWGRNWVERW

SEQ ID NO: 115452 - protein, 159 aa, Triticum aestivum
  Clone ID: PAT_TA_9870.pep
GQFANLEEDGGKGGAPERKHVSLPRTTTVHSTPVPTTNGPAYQAPQRIPTARPGRVIASATPTKNAAFADRQTGRRMARDPAAPPAAAAAGYHQRPDCSDRQQEVEKDRAHYRPAHHFRDARVAPEAEARPSAYHIPPFNGIAAVAGGYSKVGVAGRMY

SEQ ID NO: 115453 - protein, 391 aa, Triticum aestivum
  Clone ID: PAT_TA_9871.pep
RVDIICNAALYGFGIEHKIQGYIRDAAFDPRRWLAPGQLSIHPVPCNCLVNSEVGTGDINVKVGQLCDKGHRWMCSKTISDCVEAIIGAYYVEGGLRAAMAVLKWLGINVEVEEELIGQFLSASVQTYLPKNDVIEKVEAKLGYVFLMKGLLLEALTHPSLQESAEGYSYERLEFLGDAVLDILLTRHLFYSHKDTDEGELTDLRSASVNNENFAQLAVKHKLYQFLQHSSGKLPENITEYVDSLENPSMDKVNLLSDAALRGPKVLGDVVESIAGAILIDRKLDLEVVWGIFKPLLSPIVTPEKLELPPFRELLEWCNKSGYFLGIKCTDGIKRTDGDKIEATLDVQLKETLLVRQGCGKSKKDAKAHAASMLLKDLEVEGLIVPKNASN

SEQ ID NO: 115454 - protein, 86 aa, Triticum aestivum
  Clone ID: PAT_TA_9872.pep
ELKISLELLCTTSVPKYKTFLYFNLNCKNVLYFDMEVVHDRAPVNNQIIYSNCQYQLIITDDSIRHPCQCQVGFLLQHSLCFAELL

SEQ ID NO: 115455 - protein, 223 aa, Triticum aestivum
  Clone ID: PAT_TA_9873.pep
LFSLSLVDENKVTIGASGAIPALVLLLGNGSQRGKKDAATALFNLCIYQGNKGKAVRAGLVPILLELLTETESGMVDEALAILAILSSHPEGKAAISAAAAIPILVGVIRNGSSRNKENAAAVLVHLCNGEQQQQHLAEAQEQGIVTLLEELAESGTDRGKRKAIQLLERMNRFLKQQSQAQGDAMAQAHAQSQTLSQALVQVQADTQLEESLPPTSSHLPER

SEQ ID NO: 115456 - protein, 207 aa, Triticum aestivum
  unsure (1)..(207): unsure at all Xaa locations
  Clone ID: PAT_TA_9874.pep
IFTXHSRLRIIHRDLKASNILLDQDMNPKISDFGLAKIFSSNDTQGSTKRVVGTYGYMSPEYASEGIYSIKTDVFSFGVLLLEILSGKRNSRFHQREDFLNLLGYSWHLWEGGSWLELLDVSIVTEVHTTEARRYINIALMCVQESADDRPTMSDVVAMLNSESVIIPEPNPPAYVNVRVSKVHQSASVVVPCSNNDVTITEEPDGR

SEQ ID NO: 115457 - protein, 425 aa, Triticum aestivum
  unsure (1)..(425): unsure at all Xaa locations
  Clone ID: PAT_TA_9875.pep
MAQIPNLDNAALNLTALREQSQKELLSIIKSIRGKKCLVIDPKLAGTLSLILQTSVLKEYGTELRILSADPLQTECPKVVYLVRSQLNFMKFVANQIKNDESKGLQREYHLYFVPRRIVACEKILEEEKVHQKLTIGEYPLYLVPLDEDVLSLELDYSLQECLIEGDTSSVWHVAKAIHKLEFAFGVIPNIRAKGVASTKAAELLNHMQLEDPVSMDNMGIPEIDTVILLDREVDMVTPGPSQRSYEGLLDEMLEIHNGSVEVDASIMGAQQDGKKVKVPLNSSDKLYKEIRDLNLHVVVQVVRQKATSIQQDYAEVKSTNTQSVSELKDFVKRLHSLPEIARHVNLAQHLQSFAAKPAFHARVEIEQIILEAQXYETCYEYIEEDLQKXXPIGNXXSLPRXFPXKRGGFXKKILAPGGKKLQPW

SEQ ID NO: 115458 - protein, 58 aa, Triticum aestivum
  Clone ID: PAT_TA_9876.pep
ISGSGLFLFYLLLFTSEKGDLDLVLFVCTMRTKVWRINNTVLLPPFLNISAFRDLKKK

SEQ ID NO: 115459 - protein, 206 aa, Triticum aestivum
  Clone ID: PAT_TA_9877.pep
MALPLVLLVLLAAVTAAREAHGYVAYNTSAGTVAGLLNVHLVPHSHDDVGWLKTVDQYYVGSNNSIQGACVMNTLDSVVDALARDPGRKFVVAEQAFFQRWWVEKSPQIQAIVHKLVDSGQLEFINGGWCMHDEAATHYIDMIDQTTLGHRVIKKQFNKTPRAGWQIDPFGHSAVQAYLLGTELGFDSVHFARIDYPDRAKRKDHK

SEQ ID NO: 115460 - protein, 170 aa, Triticum aestivum
  unsure (1)..(170): unsure at all Xaa locations
  Clone ID: PAT_TA_9878.pep
TVANVVTSLPFIFLGLQTPSSXRKTLNTTLYANSLIGVGVASSLYHTSRGEIRKYMRWADYTMIATTTLCLTRALRDEHPRLLMAASTLLLPFQPLMVTALHTGMMEVSFAKRASTEPELKTAHNLHRMSSLLGGALFIADDVFPQTPYIHAAWHLAAALGVCTCNKLLE

SEQ ID NO: 115461 - protein, 196 aa, Triticum aestivum
  Clone ID: PAT_TA_9879.pep
GTRPAAAALPVAKTAPDPPEIDLISSLPGEILSIIISLLPVGSAVRTTSLSRRWRPLWRSSPLNLDVSHIDGRGRDRAAAVSKILSDHPGPARRFLTACLQITDPDGWLGSPALRDLQEIDFWLPRYEIPMPLSILRFAATLRVARFGNCRFFEYDAPPSFNFPCLEKLTMRFIFVREDTLHCLLDGCPVLESLLL

SEQ ID NO: 115462 - protein, 325 aa, Triticum aestivum
  Clone ID: PAT_TA_9880.pep
MSKVEGLTSVSSLERRSAPKYYIFLFFNVFLASIIAGSALEQLQTYLHQSANQIPRTIGVAIPMKATFFITYVMVDGWAGVAGEILRLKPLVIFHLKNFFLVKTEKDRDEAMDPGSIGFDSNEPQIQLYFLLGLVYAVVTPFLLPFILVFYVLAYVVYRHQIINVYNQEYESAAAFWPSVHGRIITALIVSQLLFLGLLSTKGAGQSTPVLLVLPVVTFYFHKYCKNRYEPAFVEYPLQEAMRKDTLERAREPGFDLKTYLASAYIHPVFKGDDDDEKFSMMDEAEADQVLVATKRQSRRNTPVPSRHNGSEAPSLPEIVNDQRL

SEQ ID NO: 115463 - protein, 205 aa, Triticum aestivum
  Clone ID: PAT_TA_9881.pep
MGRRGGQRCRRSSRANLTSTSTSTSTSTGQRGGKRRRPPPPANSFVSIAADLGNHGLIMVLFETPSGFAIFYFDGISLYEPDAMENIWAHFVTEYRARHVIWRKDFQVFKDKSDAINHDSGLNNQLTNMLLKWYQPGQKLAVGKIEYKIVIEANLGISCLFDEPVMELMRGLNYLMHSVVPEEKSKLAEEHCLQTSQGLKMLLHY

SEQ ID NO: 115464 - protein, 148 aa, Triticum aestivum
  Clone ID: PAT_TA_9882.pep
PAISRGGDEFVLEPRVAGTRLFFCWIHPLFLLQPLSFLLPSPFDLMNSFRFCWNRCLDLREAFGGRAARLTARRRKLHPVARRAASNVVQTPGVATMYAGATTGDQGCCKREWPFLLMRLFLVNQIFVFAGTDEFLCWNRYNFLLQKK

SEQ ID NO: 115465 - protein, 79 aa, Triticum aestivum
  Clone ID: PAT_TA_9883.pep
IPTTLKAESTVGRLGMLGGEAQQTKSSVVAALLSNKILDPKKIKNNYNTISKINGFNDYRIKRLKGYSTMERKFHLSFT

SEQ ID NO: 115466 - protein, 106 aa, Triticum aestivum
  Clone ID: PAT_TA_9884.pep
FFFWCYKYILSPMIFYVTQSQVFGSIDLSVSHVDTFGSIKLFHESALQLTCQFHRSSPSVQLNSFTSQLYIRYFLLSVSIYDIFNMSMNTGTIFCGQTSPHQCFQA

SEQ ID NO: 115467 - protein, 152 aa, Triticum aestivum
  Clone ID: PAT_TA_9885.pep
SFSLPTRSAAGSRVDDDRRCRSPQLGFTTSQPRGCIPSSARQTALREAVEQPPGRCRGQPFGRTFETRTVTRTALREDLRNSDGHTDSPSGGTHELRPKLRSLYRVAHIRCHLSGRASPSRTSSCRNPDSLTALRNSFRGRERRSQIIAWHV

SEQ ID NO: 115468 - protein, 94 aa, Triticum aestivum
  Clone ID: PAT_TA_9886.pep
NHEFKGCVPQSITQWISRELCAMVVRKRIHPEFTGCFCIIIGTPKPNQHMNWARKKRSKPRIGDLTGKSRANTAAETDAPQSWKTEPELDQQIK

SEQ ID NO: 115469 - protein, 89 aa, Triticum aestivum
  Clone ID: PAT_TA_9887.pep
FCKFVEHASFLQVKEGIEHWRKRQQDGFSKLSQMFEQLEDSYNHFSLALLHLDVNRLWKVLCAPFKVYRIFTILWPWQLIPAPPRAPSR

SEQ ID NO: 115470 - protein, 227 aa, Triticum aestivum
  Clone ID: PAT_TA_9888.pep
ATTPSPLLLSRRPAPVRTLSTHPHPIPGLPVLLAPIRPERPRDGPPLPKSGASSLAARHRAGDSWRGAFACLARYLECELAHLERQISALSPGKGSVPFFADSGKYFQGESLEKLFRPVLSPNWKMLSWNEICGGFSIALVGTGGCLLRTPSPPAGTRRAGSLAPRPKRRVRLLRGRRRHRVRVLGGRGGQARRAARAEGHRHQRLAALPRGGPPAEPRSPAAAAGR

SEQ ID NO: 115471 - protein, 180 aa, Triticum aestivum
  Clone ID: PAT_TA_9889.pep
SEALALCPMKSKKERVVLHSNRAQCYLLLQQPLAAISDATRALCLHSPLNRHAKSLWRRAQAYDMLGLAKESLLDAILFINECSQSSDPDLSLRQNKVPDYAERLVKKQMRAAWLFRESSLKHGGIHCEGDASDAFGQEADDSEWETVSESDGEDDERREADDETEWKSGGHREDAYEKS

SEQ ID NO: 115472 - protein, 94 aa, Triticum aestivum
  Clone ID: PAT_TA_9890.pep
LASRPTIFLAAPKLHRLHDSSWRGAWTRAFPAPPHLRPVYPCSCSVKRRGGFGVRRLFFVCLGEAGWQRPFTLWSEFVPACCGSRPSTGAMIRF

SEQ ID NO: 115473 - protein, 49 aa, Triticum aestivum
  Clone ID: PAT_TA_9891.pep
VSASHLLRFNYWFTLKLWQVSNECIVCNLSSNLGAHKYQAICFLISKLY

SEQ ID NO: 115474 - protein, 111 aa, Triticum aestivum
  unsure (1)..(111): unsure at all Xaa locations
  Clone ID: PAT_TA_9892.pep
TASIHRSHEAFLQHAQLTGANTVAHMSAERSPYPGTKFLLQFTSKAKGGKPRKKMASAESGTDDRNMRGGTVVGLTGSGRRRPASRSGSGGARSRRGDGAAATAGLVPNXL

SEQ ID NO: 115475 - protein, 206 aa, Triticum aestivum
  unsure (1)..(206): unsure at all Xaa locations
  Clone ID: PAT_TA_9893.pep
PPRPLPPPPCRPAAAGRPPARPPSPRSPPPXPSPSVRRAPRPPRPPPPPPPPPPSAPRRPXPARPPPSPPPRPRPPPLAPPPRPPAPPSPALRRRRRRAPPSLPPRRALPPPARPPPPPSCPPLPRPGGPPPPPPRCSPLQATAPPPSAASAPLPGPRPCPSPSPSPVHGHQGNLYQSIRGVLTASESLYLLHTVAFTLARFFLRL

SEQ ID NO: 115476 - protein, 207 aa, Triticum aestivum
  Clone ID: PAT_TA_9894.pep
GRFMVSNSARYQQLMLLFVQRLDIAVCSTTLMLLLPNQARCCVYLCRKQGPCALRHGRARARSSCSSPAWESTTATATAVVGSWAPRLVEEEGEHESGACVLGGRGSRGAPAFAAPALDLNGGCRVRCPVPGSGGILRCGSRDWLPWTRARVLGARRGCFRGWTRRLGEKERVEGTGGGWRRGGSRRLVGWNRGRRKKIDGRVQGLF

SEQ ID NO: 115477 - protein, 125 aa, Triticum aestivum
  Clone ID: PAT_TA_9895.pep
TNQPLPDGQAEARKLQFATASQHHGKHIAVEIGILIDFLDLLLQHCMLTSHPCKLLGSWGVMVSWPVQRWSWGRTSSRSCRCRRCRPSRPAITGSCWAAPTPVAFPPRSQSPCSLSLWRQGEAAV

SEQ ID NO: 115478 - protein, 156 aa, Triticum aestivum
  Clone ID: PAT_TA_9896.pep
EEFGTRLSAMELLRSTGCYMPLQMPMQMPGEYGAAGFSLGEFRAPAPPQSQSLLGFSLDAHGSVGGASMAGYGSGAGMQGMQDRSGRLLFAFEDLKPTANSGAGGGESGGGSGAGVDGGDHQFEQGNKEQQGNGTPVGQPDTPGFWNGMIGGGGTW

SEQ ID NO: 115479 - protein, 120 aa, Triticum aestivum
  unsure (1)..(120): unsure at all Xaa locations
  Clone ID: PAT_TA_9897.pep
MSLQVEDPRSAETPAPLKRHDSLFGDAEKVSDSKHHGSQVSWMRTLSLAFQXSVGIIYGDIGTSPLYVYSXSTFPDGIKDRDDLLGXVLSLILYNLIIXIPMLKVTSFIRGSTPNDRRME

SEQ ID NO: 115480 - protein, 313 aa, Triticum aestivum
  Clone ID: PAT_TA_9898.pep
MRAGTRGPTAAGCCLDPTLARSAMPQAATQEGEASGSGPTRALPRSQRSTAAARPTATTRSMALVRARQSPGSQSPLEPTVRSNTRKRKRDPAANRKSKKRKRTGEEEEVSSADSSPVRQPHIPDRMYRLHDLNTSKAIQKAREDVSAKRARHMGLATLNVHMCRASMCVLDDPNLVPDRESARTAVLNAGRSVLGLSSSVGGKPLARCCGFWVDWDEKNKIGTALTTSRLICTKSASLDSWSGQEEYDTNAEVLVHMQGGTTEKATLQYHQKHYDLAFFSVRMDRPVHILSFNDGVKRSDHVFELGRDESSF

SEQ ID NO: 115481 - protein, 189 aa, Triticum aestivum
  unsure (1)..(189): unsure at all Xaa locations
  Clone ID: PAT_TA_9899.pep
MELVVGASNATMRSLLGKLGGLLAQEYALVRGVRRDVQYINDELTSMQAFLRDLSTALDDHDNRXKDWMKQIRDMGYDIEDCIDDFAHRIPRDPSSDVNAFSVRTRSRDRPPGWPRRDIASHIAALKVRAQPIGGPRRRYGVHNPRNRKNGSGVSAATYEVAEHQLTERQLIGTKEPVGMTADMKKLED

SEQ ID NO: 115482 - protein, 358 aa, Triticum aestivum
  Clone ID: PAT_TA_9900.pep
MPVEIGTAPSAEQVQQFAALVSDGTKKPIYLHSKEGINRTSAMVSRWKQYATRAERLATKKHSPIVNGKALKNDPTNGPGSSSNGSENGAVVKSDRTVDAGEAHDIDIEITRINLEVTNSLPNGQSTEQDEMHDSRTELLSDFKLETSPLKAQFPTCNVFSRKEMTKFFRSKRVYPKSVLNSRRRSSSLMISRRKQNLRAEDNEAIDCEAADMMVLKNANGTLLDNDYILSVSSGITNGKPSNNGTSTSFEEKVSEASLLTIDPKTSNASNPNGNAQLGSQKPSEKNGGPYLERYSSDTIDGSICATTGVVRVQSRRKAEMFLVRTDGFSCTREKVTESSLAFTHPSTQQQMLMWKSP

SEQ ID NO: 115483 - protein, 358 aa, Triticum aestivum
  Clone ID: PAT_TA_9901.pep
MEREIGAEYELNEIDGGTLHGSVGSRLSLFAREFKWRSSSSALRLPNNCYGSSFVIDPNGRWYRMWSNMMFLWSIYSVFYTPFAFCFFRGIPEHLLDLECVQLIFLADVAVHFFLAYRDPHTHRVVYDQQRIALRYIKGSFALDMLGCFPWDAVYKFTGRMEVVRYLVWLRLYRARKIQGFFKKMEKDIRISYLFTRIAKLATVELYCTHTAACVFYYLATTLPPAREGGTWIGSLTMGDQSYINFRKVDLLTRYITSLYLAIVTMATVGYGDVHAVNPREMVFIVGYVSFSMLLGAYLIGNMTALIVKGSRTERFRDKMTELIRYMNRNRLSSDIRSQVKAHLLLQYESSYKRDRRR

SEQ ID NO: 115484 - protein, 92 aa, Triticum aestivum
  Clone ID: PAT_TA_9902.pep
EDPNNNNRMIHIEIRFPSQVGRDRCGCRPARPEEGCLGCTPGTAASIPAPSGFLLKGIKPWIFFHHIHGFIVPLRHLAQRVIRHDHNIIYIE

SEQ ID NO: 115485 - protein, 102 aa, Triticum aestivum
  unsure (1)..(102): unsure at all Xaa locations
  Clone ID: PAT_TA_9903.pep
AVNGGVSHRSAPYLPPVRPPCLPPARPPCSPPARPLSPACPPCSPPARPPXPACPPCSLSARPPCFSPTSTPCSLPALPPAPCPRCIPAPHPRRPWMCCGRV

SEQ ID NO: 115486 - protein, 146 aa, Triticum aestivum
  Clone ID: PAT_TA_9904.pep
MEALWKQASRLKEQVARQGVFKQFGAGGYGNSDNAFTDESEVKLHQRLEKLYLSTRAAKHFQRDVVRGVEGYIVTGSKQVEIGNKLSDDSQKYGIENTCTSGNTLSRAATYYGKARSLIEKERGNMLKAFGTRGTTPPPAPGGRSR

SEQ ID NO: 115487 - protein, 280 aa, Triticum aestivum
  Clone ID: PAT_TA_9905.pep
METYTTDDALTAMGFGKLQGLVLVYAGMGWVAEAMEVMLLSFVGPLIREEWKISAQDESLRSSVVFLGMLIGACGWGYVSDKYGRRTGLLLSTLFTTGMGFLSALSPNYLCLMALRFLVGVGLGGSHVYSSWFLEFVPAQNRGFWMIIFSFFWTIGTVLEASLAWIVVSTLTWRWLLALTAIPCFLLLPFFGITPESPRYLCAQNRISDATLVLERIAETNQATLPPGVLVYPRDGEVDHSTLTSEADHLLPLREKDCTDDDVISPKSGSAAALRSLLSR

SEQ ID NO: 115488 - protein, 87 aa, Triticum aestivum
  unsure (1)..(87): unsure at all Xaa locations
  Clone ID: PAT_TA_9906.pep
SDSKFSASAEISTSPPPPPYQKPHFPCFRLPFQVETFTPCLQLRLPVGPELTLLXPPGLXDQEXIHTRPILLLLXIPHARLLXXNFT

SEQ ID NO: 115489 - protein, 237 aa, Triticum aestivum
  Clone ID: PAT_TA_9907.pep
VCEEWRTTKTKLLCSTLYDYIFVCTDETLLAESSHYKFLKSKDLFDSLGRRKHNWVSTCQARALLQNAILFVVDDFDSEARDARRTDGQVLMVSDARFSMLKVVFGSYTTTTKPLKEKLKSKEDAEIVRFEMRGDIWARRRMCLRDNPDFHLLQWRKTSGLKRAQVRQQEEASSQDSNSNRLLEQVQLTVKNLVEELKINTRAVTESSQAIAKSCQDVVEACKLTVASTSTGAGVVN

SEQ ID NO: 115490 - protein, 157 aa, Triticum aestivum
  Clone ID: PAT_TA_9908.pep
MATASAARIVPVLLALAALICAAAEASPAKVPAMYVFGDSTADVGSNNYLPGSAVPRANFPHNGVDFPTSRPTGRFSNGFNGIDFLALNMGFKRSPPPFLSVANRTNRQIARGLLGANFASAGSGVLDTTGDSIVSMSKQVEQFATLRCNISARIGE

SEQ ID NO: 115491 - protein, 206 aa, Triticum aestivum
  Clone ID: PAT_TA_9909.pep
DVRRRKEDGAEPEADPERDQRTVFAFQLSLKADERDVYEFFSRAGKVRDVRLIMDRNSRRSKGVGYIEFYDAMSVPMAIALRGQPLLGQPVDVKPSEAEKNLVQSNASSSVAASGGARKLYVGNLHSNITEEQLRLVFEPFGLVELVQLPVDPLTGLCKGFGFVQFARLEDAKAAQRLNGQLDIAGKVIKASAVTEQPGVQASGAT

SEQ ID NO: 115492 - protein, 114 aa, Triticum aestivum
  Clone ID: PAT_TA_9910.pep
QLKLFLYEVKQQQLLSGIRSYLKLYSAITITKLAQYMEMDEATLRSILMTYKHKMHAVDSNGKIVSSADFDFYINEDVIHVVESKSTKRHGDYFLRQILKFEETIAELDKVQLD

SEQ ID NO: 115493 - protein, 83 aa, Triticum aestivum
  unsure (1)..(83): unsure at all Xaa locations
  Clone ID: PAT_TA_9911.pep
LKNMFDPAVETDPDFDXDIRDDVREECSKFGQVRHIFVDKNTAGFVYLRFDSITAAMGAQKALQGRWFAEKMITATFMSTHPA

SEQ ID NO: 115494 - protein, 539 aa, Triticum aestivum
  unsure (1)..(539): unsure at all Xaa locations
  Clone ID: PAT_TA_9912.pep
MASAYDREDGLAPPQPHGGGPADAYDPNYVPDSVKTFVVHLYRHIRDKNVYEIHQMYEGGFQRLSDRLFRDTPWPSAEAVAPYCDGDHVFLLLYRELWYRHAYARLSPLTASHRSESWNNYCDLFSVVLHGVVNMQLPNQWLWDMVDEFVYQFQSFCQYRAKLKNKTEDELQQLKQFDKAWNVYGVLNYLQALVEKSMIAQILEREKEGLESFTATDGYDYQGGSNVLKVLGYYSMIGLLRIHCLLGDYHTGLKCLAPINLNQQGVYTIVIGSHISTIYHSAFANLMMRRYVDATRGSNKLLLGVTSRQPFLLKSPPLXTDTHDNATEEFTTILLSILMSTQYHQKSPXVAPGCEENSXMYALLAVCRSLCPQNKLIDENVSXQLDSTLPSTKWQRLQRFDDEAYAAFEWAMFRIHAPQLLTPSPPVLEPXTNKLITTAAYRLQWEAVPLRLGRTFRRTSGIRSYLKLYSAITISKLAQYMEMDEATLRSVLVTXRHGVYSLRRNGKIVSTADFEFYIHLDCARLRESKTAKRHGDYFL

SEQ ID NO: 115495 - protein, 91 aa, Triticum aestivum
  Clone ID: PAT_TA_9913.pep
SPGLQVGVLHLIMILDMLALMTAFAVGSCRKLRTSVYVYALVGGVVVILLLLIIVTSAIAKYRKPREGNGINSPRHPEPVSGANTPARPEV

SEQ ID NO: 115496 - protein, 87 aa, Triticum aestivum
  Clone ID: PAT_TA_9914.pep
SAVHLYSVKICPCCQWLSAFLLFWVHMHALDSLFLDTFQVRCVRECESVCHGVVLDLHTSKYFFFMCPCVVTCMHSSHSHMRRGSSR

SEQ ID NO: 115497 - protein, 102 aa, Triticum aestivum
  Clone ID: PAT_TA_9915.pep
VRQTSLPETHSGSGNYASAVGGAAHAHLLLPIWSIYACLVRLAGHSYVHAVEVACVHSSVRPSLVCHGVGSTTSPSSPSSSTSSSPAWWLPIRLEGRRSARR

SEQ ID NO: 115498 - protein, 105 aa, Triticum aestivum
  Clone ID: PAT_TA_9916.pep
SLPMARLYHLTLLSVSFFLLLTGLVAADLSGGKKVGKKVIMTVRCPAADSGEKITISAHLVGEGGVGDSHFHLDSDDYEPIVFAVKNLVSALEKVGDPQASLSKM

SEQ ID NO: 115499 - protein, 130 aa, Triticum aestivum
  Clone ID: PAT_TA_9917.pep
RGLRISYLLQGRRDKDFHGENDGLVVVAVEMEVAVADPALADEVRRDRDLLPRVFSRVPHGHGHLLPDLLPSGQISSHEAGEEQEEEDPEEGEVVEPCHGQTSGGVHKTYCLLLQPAGRPRKEEKHIWTG

SEQ ID NO: 115500 - protein, 179 aa, Triticum aestivum
  Clone ID: PAT_TA_9918.pep
LGCSDEILTIIAMIQTGNIFYRPREKQAQADQKRAKFFQPEGDHLTLLAVYEAWKAKNFSGPWCFENFVQSRSLRRAQDVRKQLLTIMDRYKLDVVAAGKNFMKIRKAITAGFFFHAARKDPQEGYRTLVENQPVYIHPISALIQRQPDWVIYHELVMTTKEYMREVTVVDPKWLVELA

SEQ ID NO: 115501 - protein, 226 aa, Triticum aestivum
  Clone ID: PAT_TA_9919.pep
HAPELTVLGYLETANHVLQIGNTIIKAGVTKVAPNAVVPSVKVLALKVDFGVAEEVKTLLSFLRCFPQVETLHVMSSSNKNEEEEEEEEEEQDGKDAGDGSGEQLISPKFWKEAGPIGCVESQVKKVVLDKFTVGANELGFLKFVMARAQVLKRVVLVLDPGMSPTAAKEALSKLASQVPSAKCASENVEFMGLPRPMAAWSYQIASDLSLSDPFPAEGGILVERP

SEQ ID NO: 115502 - protein, 328 aa, Triticum aestivum
  Clone ID: PAT_TA_9920.pep
APVEKREGRKPEELRNINGLHGLLNIKCLENVSGYEEARKAELNKKLYLNSLNLERSSASRNSSPPADEEVLEGLRPHHVIKVLHIRRYCGAEAPSWLQSLQQLRSLHLINCRSLCILPPLGNLGSLRYLHMKELCAVDQIGHEFYGTGDVAFPSLSVLEFDDFPKLRQWAGIEDKNSFPCLERVSLMDCPELIQIPLLPQATREVTIERTRLIPYMRLAPLSSNSEMLQLDVCASSVVLDRLLYRHNIESIAVLNISGAEQLVASGQLGSLVSLQRLELSQCGLTDQALRSFLQDLPCLSSLEIIDLPNITSRSWYREQSSSAQMLH

SEQ ID NO: 115503 - protein, 297 aa, Triticum aestivum
  unsure (1)..(297): unsure at all Xaa locations
  Clone ID: PAT_TA_9921.pep
MLNFGVSTQVPDSPVGEQESPMLPTQKTSTTVKGKSTKGKNWSIEEDNLLVAAWVHTNLDALIETDQTSNSYWGRIYDYYSTRKKVSWPVRVQNALNCRWTTINEQVSKFCGYYQQILNRNQSGVTIAQQQAQALVLYQSKDPKKRPFTLMHCWLVLEKHPKWENRVISKGPQKKQKKTSDASPGTTSNDEDFERCTDALETETRPDGNKREKTHLQKAKASASDAFSPKLSLENVWAQKLKKAEVKVTKRXEMSYKQFELEEKIMSMDTTVMIGAQQEYYMNKQNEIAARRFNTSG

SEQ ID NO: 115504 - protein, 103 aa, Triticum aestivum
  Clone ID: PAT_TA_9922.pep
IAVIIAHAYTFKWIARLNGIAFKDLSFLNGLIIIQFTKLLNYFFGSEFAELSNGIRIIQFNKLLNCFFGSEFAELSNGLRIIQFTKLLNCFFRSEFSKLLLCL

SEQ ID NO: 115505 - protein, 266 aa, Triticum aestivum
  unsure (1)..(266): unsure at all Xaa locations
  Clone ID: PAT_TA_9923.pep
GRKAPHTRHQIWREPRFRSLQDTFMEPILPCDNIEPIMQYSTTVRLNSTTADASCGESVKAKKCLSYEPAESSNPHKEAANEETECVPNELTXGIQTPVGCYNQSQQSQDVCECNADTPYEKNSTLVNGEESGLPEERLYESTSHSALRNESLTADIDADIPMDEEHAARDEDFPLSTRTRAVAKCLHQLFLDQKSQQQSNVPVTLGQALEGSKRKTTARFFYETLILKSRGLIDVNQEKPYENITISATPQLDAVLQNPVPPSTS

SEQ ID NO: 115506 - protein, 199 aa, Triticum aestivum
  Clone ID: PAT_TA_9924.pep
MGCSSSVPARSTGGLNNINGSSSAADSNDLRAKLVLLGDSGVGKSCIVLRFVRGQFDPTSKVTVGASFLSQTLALEDSTIVKFEIWDTAGQERYAALAPLYYRGAAAAVVVYDITSPESFKKAQYWVKELQKHGSPGIVMVLVGNKADLHESRSVPSQEAQEYAEKNSMLFMETSAKTSDNINQVFEEIAKRLPKPTAS

SEQ ID NO: 115507 - protein, 97 aa, Triticum aestivum
  Clone ID: PAT_TA_9925.pep
WNAASEDDHEPAHLPGSNVDGLDTLVANDIVAARSKEGGRTTVSHVRSAARGGVDAAPHGHGTHKGPGTSRYRGVAHVGELSIARANLDTHFSGSSG

SEQ ID NO: 115508 - protein, 163 aa, Triticum aestivum
  Clone ID: PAT_TA_9926.pep
ITQPLKAADPLHWKDRDLDPEIMYSSSGGMPHGRLAIGDGAIKKAVVVAKARENDTRPSNSISYHCLLKENALRSARCLAVCLRCAHVQGFYGKLGWEVPEDLLAYQDELMDGGDLMNETPQAQEDGGTPMTDSSHDERHVDAGTQMDDHGSAPTHENHLGMP

SEQ ID NO: 115509 - protein, 188 aa, Triticum aestivum
  Clone ID: PAT_TA_9927.pep
VVNDLETSVWSGCTRPIISCGNLFRPSKCGGCSAIWSSQVRPRPGAPPGGPPAAVPDRATPTPWPPAGGPPPPPPPGTRPPRAARAAPAAAAGRRAPRAAAHPGWLSRDRKPHHILGSSVPTIVIGHRLSKKNNDCRDTSQMLCALPWPPHTKPRSKSEWCVLSESVHRTPVYMCYLDAVLWGGACVP

SEQ ID NO: 115510 - protein, 175 aa, Triticum aestivum
  unsure (1)..(175): unsure at all Xaa locations
  Clone ID: PAT_TA_9928.pep
WNLLDADKSKXLXITNKVKESWSDVPLPGNNNEWFMNQGNMVKKAVDSFPVHHQANYRRSIGEDKIIHCSSEIFYIPRRYXGDFSYLVKVIGNLDIHHTIGVPMLFLAMDVPSNFEPKALGKLAYRTNLPSDTTFSAIYTPEAHAVYPMKVENEIDFVKLIRVMASGDPFLLELV

SEQ ID NO: 115511 - protein, 233 aa, Triticum aestivum
  unsure (1)..(233): unsure at all Xaa locations
  Clone ID: PAT_TA_9929.pep
PRVRXGAIYDVARHIWRPAFKRDGDASDEDDINPAEAAAVAAAAAAAAATEPPAAVEEGGGGGASAHTPRGRGSRRGRXXTAPEIEAPIFPATPAPMLTDAAXXPAITAFESSVPVIAQPPSAPAAPLPPYPLTASCPTEADVRSILSPLLKELISSVAVPGQTGLGLGLGMGFGGADILGVGLGVAGLSPRVPGDEKWRQQQILELEVYLKRLELVREQVMTVLQELRSSES

SEQ ID NO: 115512 - protein, 70 aa, Triticum aestivum
  Clone ID: PAT_TA_9930.pep
LFEDHGSDILLFVYLLYDFCAGLPNVFCLFSVHFAVCMKTIRGSLCILFNICNGFECCLAQHIAPGALFF

SEQ ID NO: 115513 - protein, 73 aa, Triticum aestivum
  Clone ID: PAT_TA_9931.pep
AEQRSMMIDFVKCCLAFRSRSLLKIAYNFLSVKLDSLSCKNSCHTFCAFCACLVVIFSAEPVSMACVIQQHAI

SEQ ID NO: 115514 - protein, 160 aa, Triticum aestivum
  Clone ID: PAT_TA_9932.pep
QPNKNVDQYHYHILDCCPSPTTTTSPTDSRCPPPRVICQFRHVSSEYCLEGGQTWSRSPARWGWRGGGLYAGGSLAGGARASGSHLGRRRSAIGRPWPSLCAPNDEARLGWPGTGRSEAGQLDPVVVVEEPVAGDVLRPRRRGSEAMACSPTRPPTRPRT

SEQ ID NO: 115515 - protein, 172 aa, Triticum aestivum
  Clone ID: PAT_TA_9933.pep
MDSGSRSSGGAGFDDDDGLAARREVSSSLQELAVRVDAKGGSCSGSGTDQLPNTPKSKHSATEQRRRSKINDRFQILRDLLPHTDQKRDKATFLLEVIEYIRFLQEKAQKYEASFPEWNQENAKLLPWSNMYFRSSWKNAQSKGQIAEDASPHPSQFIKKWGLPWIQYHRQA

SEQ ID NO: 115516 - protein, 55 aa, Triticum aestivum
  Clone ID: PAT_TA_9934.pep
QHVAASFSFYIDGLPYEISDSLTIYSLPLWNITNEDQFRPWSDDFQLYKIIPSME

SEQ ID NO: 115517 - protein, 333 aa, Triticum aestivum
  unsure (1)..(333): unsure at all Xaa locations
  Clone ID: PAT_TA_9935.pep
PPGPPHSLHPGQGEGPAQRGVGDGGSDRRHGLGGAGAGPQAHLPRRLLPGPVRRPRYRVGAPASAPRPGRGYHRGRRRGRRRPRRERHRLGLGLRPLALVGLLWKRPGHALPRVRGGRSHVGVGAAGAGRWGLALPNLLGCVHQPWRCLPHRPFPRRRLSLFPKSGMLFLEVSLIAFLLQXGNEAISADVLLKTIYVFGFGVPLFIDADQGTGGKWGLWILHKLVLTGVYGLIVFMHHSRWKDRLPAKPAYYQYVCAMLALNGLSLFGCFLIACGAGFGLWLYNFTTVCYHALYLPLLYVTFLADFFQEEDMLLENVYYSEMKDAGFFDADWD

SEQ ID NO: 115518 - protein, 172 aa, Triticum aestivum
  Clone ID: PAT_TA_9936.pep
MSWPPPVGTHDASDPSSIYFWSASEIKEAEQATLLFAADVIYSDDLTDLFFDTVRQLMSRGAKKVLYLTLEKRYNFSLDELDVVANGYKHFRSFFTVQDVSPGCGGQDNATLKPGLVGEQIDLARVPQYIREYDRGKDPGDVEAHVLSRLKIASSVYIDCLCSCCVEIMCSP

SEQ ID NO: 115519 - protein, 166 aa, Triticum aestivum
  unsure (1)..(166): unsure at all Xaa locations
  Clone ID: PAT_TA_9937.pep
TSAAIQFRVQPCSGPDSPSPPSRTSFPHQALPRGRSSPSAWNRCTAAVPPRPRPPCLAAPSAHSXSSPPRPCRAGSAAHCRESVPDDLASHPVAVPSPSSPARRPASPTALPGPPSPLAARRGPRACRPSCALSRSSPSPSRPKCRREQLSSTQCSPSCFFSCCSE

SEQ ID NO: 115520 - protein, 88 aa, Triticum aestivum
  Clone ID: PAT_TA_9938.pep
FVFVYFFIKQFHKTILYLILLVHSKINLIIDNYIYIYNINIYNGEFIYKCKLCYMETYIYLKTNIHLIIIHTYKSNQLCIRKSSCIQE

SEQ ID NO: 115521 - protein, 224 aa, Triticum aestivum
  unsure (1)..(224): unsure at all Xaa locations
  Clone ID: PAT_TA_9939.pep
MAATANASCLPASPRLPASGAGVRNRGRLPMAAVGCTAGRGGVHLRSARPLLCTSSSAAAGARGSGKMEDYNTAMKRMMRNPYEYHHDLGMNYAVISDSLIVGSQPQKPDDIDHLKNEENVAYILCLQQDKDIEYWGIDFEAVVTRCKELGIQHMRRPSXDFDPDSLRKQLPKAVSALEWAISQGKXGRVXIHCTVDFGKAPAVAILNVLREYGPNTAFNKLPS

SEQ ID NO: 115522 - protein, 243 aa, Triticum aestivum
  unsure (1)..(243): unsure at all Xaa locations
  Clone ID: PAT_TA_9940.pep
MLPSARPLLAAAAVLCFWLLVAVAEAKVHHYTWDISYQLKSPDCFEKLAVTVNGEAPGPTIRAXRGDTIVVAVHNKLETENTAIHWHGIRQIDTPWADGVAGVTQCPILPGETFTXYHAHYGMQRVAGLNGMIVVTVPDGFVEPFSYDEEHTVLLGDWWHKSVYEQATGLSSNPFVFVTEPQSLLINGRGMFNCSLAPSGTCNASRPDCALPTLFTAVPGKTYLLRIGSLTSLSSLYSRRATR

SEQ ID NO: 115523 - protein, 73 aa, Triticum aestivum
  Clone ID: PAT_TA_9941.pep
SCESVYWFDRLYCHIHPFFGNKEELVSFRFECQAKIKWEKRPVSPDSNCYLVLRFIWLRHNFNWAPSDVIYCL

SEQ ID NO: 115524 - protein, 42 aa, Triticum aestivum
  Clone ID: PAT_TA_9942.pep
CFYHQVVESFRKNLIEPMFHDPLFVWVALLHWVYIIIFVTMI

SEQ ID NO: 115525 - protein, 318 aa, Triticum aestivum
  unsure (1)..(318): unsure at all Xaa locations
  Clone ID: PAT_TA_9943.pep
MDGYNFLVLREPSFKTLLANLNNLRELYLDGVDISSSGEEWSSDLAKAVPRLHVFSMAYCKLNGPIHSSLSSLRSLTVVNLKLNGGISGAVPEFFTDFLNLSVLQLSYNNFSGWFPWKIFQLKNIRVLDVSHNERLSGRLPEFPSRASLETLILQYTNFSGVRLSSFNNLLSLRELGFSGRSISLEPTDLLFNKINSLQILLLLNFQESXAPFFSWIRSLKNLTSLHLSDCYSSKLTPPMIGNLXSLTSLEITYCGFVGQIPSSIGNLNKLTSLRISDCAFSGTIPSSIGNLKKLRRLEISYTELSCPITTDLDISTN

SEQ ID NO: 115526 - protein, 92 aa, Triticum aestivum
  Clone ID: PAT_TA_9944.pep
PRRQLSLRARRDASEPSRPWSCGSGAVEAVELRSRRRQRPRAAEATKPTPSRLLRAICSAACIWSCCTKFFRVKTEKLCMTELVFYSVVVLL

SEQ ID NO: 115527 - protein, 85 aa, Triticum aestivum
  Clone ID: PAT_TA_9945.pep
TWAALAARRACAQASGGGDKRRSIDRSSEILWFICMLCCSFIVFCKVVGVCWASMVMVSLVMLGVATSPFLAFPQVMGLVNSKSQ

SEQ ID NO: 115528 - protein, 339 aa, Triticum aestivum
  unsure (1)..(339): unsure at all Xaa locations
  Clone ID: PAT_TA_9946.pep
MVKETAYYETLGXSVDASPSDIKKAYYVQARLVHPDKNPGNPDAARKFQDLGEAYQVLSDPAKKEAYDKHGKEGLSQDNMVDPAAVFGMLFGSDYFEDYVGQLALASKASVEVDEGLSSQDARAKVQEKIXNLQTEREKKLTQSLKDRLQPYVDGRKDDFVHWANAEAKRLSEAAFGEAMLHTVGYIYVRQAARELGKSKLYMGVPFIAEWVRDKGHTIKSQVHAASGAIALMQLQEGMKKVEEGADKEEQLMKSFEEKKEAMLNSLWKINVVDIESTLSRVCQAVLKDSTVSKDVLKLRGKALKKLGTIFQGAESLYHRENSLRVESPMKEDGTTASH

SEQ ID NO: 115529 - protein, 143 aa, Triticum aestivum
  Clone ID: PAT_TA_9947.pep
SSSRSRKILTGSPAPSLLLTAYPDISLCTRFPTSERRHSPLSSTPPTCASHSAPTTGLSLTFSLYCQIFIAESGFFTAKFSDHWSKKQRASLYDCDDVEIDKSASSSARHVADADLRFFRRCSRAAPEGDFRVKNPLLRPNLF

SEQ ID NO: 115530 - protein, 206 aa, Triticum aestivum
  Clone ID: PAT_TA_9948.pep
QHAREFDKVSEELKEKDEQLEAMESANQALIIVERRTNDELEQAKKELIQGLQQIQVTRSTIGVKRMGVLDEKAFVAACKKKEGNGVSKKNAKYDVEATLVLSKWEDEIKQPDWHPFKVIDVDGQTKEIVREDDEKLQALKEELGQEAHDVVVKALLEMNEYNPSGRYPVPVLWNFKENRRAPLDEAVAYILKQWKASKNKRTYFS

SEQ ID NO: 115531 - protein, 162 aa, Triticum aestivum
  Clone ID: PAT_TA_9949.pep
DEEEHDKLLCYRNECRLQAFIQYKTKDTLNLRPQSKTLLAGDTIKRRPRALVTGIVEKSSLVDTGAYTIKKRRCVNNINRSFHVIVLGQGQGTLNPRNLLDEDLAWEGKECIKPQSHPWQAHLPPISCYLHGKDLLLFSSALAIDAPSAVSKQEGLGADDVL

SEQ ID NO: 115532 - protein, 87 aa, Triticum aestivum
  Clone ID: PAT_TA_9950.pep
STVRLKRPIPLSRTIFFVFFKTSSEITVTSFMSMFAISFKGKITNNVIAIVENCHCPSCRLTIPHGVNDIQIVIVNKLIVTRPVGKG

SEQ ID NO: 115533 - protein, 180 aa, Triticum aestivum
  unsure (1)..(180): unsure at all Xaa locations
  Clone ID: PAT_TA_9951.pep
FQVQLSSEGIDLLQRLTLVGLANTERLATAVSDLRRISRPSLRASTSSNLPNHEPPVDGIHAAAAPSADQTSNSSTMAVIQEDAAFTESVGEPSNAGSSRTLRRKGKKPRLXGSLDVDGGETHRNKRRRLNLKLRKAEPGFAEGFSVAPVFNGSLFSMGPFYPFGHTVLSLIKSLPLPLV

SEQ ID NO: 115534 - protein, 135 aa, Triticum aestivum
  unsure (1)..(135): unsure at all Xaa locations
  Clone ID: PAT_TA_9952.pep
MALRRKISAVRNKLEDLIRTAKCSMEGVEFLHTSLCKAELGLRQLVPVVPCDTQENEESFIGSIIPKDVTILTPIDINARGTCSRIKGHRDGVRGGSGDXKRRPGIHQKVARKCSICKKVVFHDARTCSMKNITQ

SEQ ID NO: 115535 - protein, 348 aa, Triticum aestivum
  Clone ID: PAT_TA_9953.pep
MRHLLLSRLLRRASSPSPPLRNLQLIRALSSSSPLPASDTDLRKYAVRALLVLGCGAATYYSFPFPPDALHKKAVPFKYAPLPDDLHTVSNWSGTHEVHTRVLLQPDSIPALEDALATAHRERRRLRPLGSGLSPNGLGLSRAGMVNLALMDKVLDVDVKKKTVTVQAGIRVAELVDALREHGLTLQNFASIREQQVGGIIQVGAHGTGARLPPIDEQVISMKLVTPAKGTIELSTEKDPDLFYLARCGLGGLGVVAEVTLQCVERHQLVEHTFVSNADEIKKNHQKWLSENKHIKYLWIPYTDTVVVVQCNPPSRWKTPKLASKYVKDEALQHVRDLYRESLKKYRT

SEQ ID NO: 115536 - protein, 482 aa, Triticum aestivum
  unsure (1)..(482): unsure at all Xaa locations
  Clone ID: PAT_TA_9954.pep
PPPVEADGAPDALRAAVCDNLQLYMEKYEEEFRAYLKEFVEAVWGLLMAPTVSPSRGQLAVTAIRFLTTVAESVHHALFGTPDAMKQICDSVVVPNLRLRDEDEELFEGNWVEYVRRDAEGSDTDTLRRAACRLLRGLAANYREQVAVLVSAQVQQMLAAYTADRANNWQEKDAAIYLVIALMQKPGATGGGTLVVDMETFSASVIVPNLQAPDWESEPMLKATVLRFLKEFKDQIPKATALRPLPSVTRFLTHESNVAHSYAAIFIENLLITKDVVQVPGVNVVTRASRYVAADINSFAQQIIQSLSKALGYPDSYENPYLMKCLMRVLGIATIAGQVVHEITARLVGILMEVCNNPKNPDFNHYLFEALAAVIGKAGEQDPALVPLFEASLFPVLQRILVEDISXEFWPYSFQDIXAQLVNLSPPPLSXKNYMQLFGCLAPAMLLWDXPPCVPCLGSALLRHXFRKFPNDFXQEXSCPIP

SEQ ID NO: 115537 - protein, 138 aa, Triticum aestivum
  Clone ID: PAT_TA_9955.pep
SGDEGGGAKGPAVSSSGAAGSDRAEIAGGAQGDASGGAGEFPHSQRVGRHPPSGDQACDLCGERALHRRRGSGRGGAPILGYPGGQIGDPRASGPVGVLPDSKSIAAQHQAAAGGSAFQHPAGGAAAGGAASCSSVTR

SEQ ID NO: 115538 - protein, 195 aa, Triticum aestivum
  unsure (1)..(195): unsure at all Xaa locations
  Clone ID: PAT_TA_9956.pep
GGSTAPTPATSSSPPPPPTPIRWRPRSRPSPAAAPGGGARRGGPXRGRPRAARGGPGGPARPGPPXRGVRVARAQVGEGGDGGVGRDGGGDXRGRGGGGTGAGAAGGAGGSGCGGPGRGRRGRAPAAGRTGRTRGRAGRGRAPSPPPAPPPPRCVTPGAEFLQPGGSTSSRAAATAVELQLLFPLVRVNFELGTI

SEQ ID NO: 115539 - protein, 100 aa, Triticum aestivum
  Clone ID: PAT_TA_9957.pep
KRWPPEATLLIAFLLVSTSMLVSVVASREVPSTDPINPANSLLGGTGRKFTMTRVEKTREVVPGGTGEGVRAISQEKIIFGAPNNFVWSTRLPPCRARAC

SEQ ID NO: 115540 - protein, 73 aa, Triticum aestivum
  unsure (1)..(73): unsure at all Xaa locations
  Clone ID: PAT_TA_9958.pep
FFFQRLQNLWRNINLKLPFVHYKTGNRLTDTKIYIRLICQTHTCGKPTTSNYAKQMGKKRTXLFTKRNQTLNS

SEQ ID NO: 115541 - protein, 171 aa, Triticum aestivum
  unsure (1)..(171): unsure at all Xaa locations
  Clone ID: PAT_TA_9959.pep
RGPPPPPEEPPPPPGEPPPPPPRXGPPPPPPPPPPPPALPXSPPPPARSLPTPPPPRRPPLSPPPPGPSLSPAPRLAPSPARRSRPGPSPPSPGLVRGGRPPSGRSPPSSSPPPSPPLPPGRSCAEGCGGCARALAGHPLGRHNPLLDCFMVVALRPAFALRHPLLPPWGS

SEQ ID NO: 115542 - protein, 128 aa, Triticum aestivum
  Clone ID: PAT_TA_9960.pep
GTRVGLCCQRPWLGSGPVAPSRASAGERSHATARKILPPPRVFRSFRSRGSCVACGGLLVRLWGGGGQRPTLSSSHSSLSSPSFWISFSLVAGASPSRFDAVLQVVSHPTFWVNHVGNLSGAMMIKFG

SEQ ID NO: 115543 - protein, 52 aa, Triticum aestivum
  unsure (1)..(52): unsure at all Xaa locations
  Clone ID: PAT_TA_9961.pep
GEYMNNTTTTGFSPVLSKFCSFGGFIQITECLVYSCHLLRACXLQTKSSSCR

SEQ ID NO: 115544 - protein, 341 aa, Triticum aestivum
  unsure (1)..(341): unsure at all Xaa locations
  Clone ID: PAT_TA_9962.pep
ARGSSRHTIKPSAADRRXKREEDADLHLANKIMHNKQYNMSKSVEDEYEYGDAPTKKGKRTREAHQENRGTQRHILTQKERCLYCFENPSRPKHLVIAIGNFTYLMLPQFEPLVPGHCVILPLQHESSTRTVDKNVWEEIRNFKKCLLKMFAQQDKDVVFMETVISLVKQQRHCMIECIPVPCEVSNKAPMYFKKAIDEVEEEWSQHEMKKLIPTSGNLRQVIPENFAYFHVEFGLDRGFVHVIDDESKFGAGFGLNVLRGVLRLPRXEDMHRRRGHESMDNQKQAVPGFMKDWEPFRRDEPPRGGPVPTHLWDPLGASRRPLRLLSGDGVPPGAGMFPCL

SEQ ID NO: 115545 - protein, 129 aa, Triticum aestivum
  unsure (1)..(129): unsure at all Xaa locations
  Clone ID: PAT_TA_9963.pep
QTLXEGKXSCCGPGVRDSAAAGFQHHSLATLVIIGFESEDCFVSYVRHVMVTAVNLADVFLYSRLECGNCEEKPNRYPWTKRQRVSLKRRLAAGIESFAIFHFGAKRPGHVAKMEYPQCSLLEAKRSFT

SEQ ID NO: 115546 - protein, 145 aa, Triticum aestivum
  Clone ID: PAT_TA_9964.pep
NKNVALAALPFHVLPSPRSTKNPKLLPLELKIPNNTSIPLLIPCRDLARPHLHAPLQLGSLVRPRGEPSLAHCTPPRSLRPVNSDGGVVGLDEKLRHGGCELADLDCVVLVSVLGGDVGVDLVSRSQLGSTSIVRMLAALFSLAS

SEQ ID NO: 115547 - protein, 99 aa, Triticum aestivum
  Clone ID: PAT_TA_9965.pep
VRGRVGKEAVLLLERYLRQWADGSLHIKVAQVFAATSLLSDALSHYQSALRINPHNEAAKKGLERLEKQMKGVDPDAPEDEDENEADDVDGDQDDAELL

SEQ ID NO: 115548 - protein, 115 aa, Triticum aestivum
  Clone ID: PAT_TA_9966.pep
ALKRDEDALEMMEKAIFSDKKNPLPKYQKALILVGLQKYQEALDELEQLREIAPHESSMYALMGKIYKQLNILDKAVFCFGVALDLKPPAADLAIIKSAMEKVHLPDELMEDDDL

SEQ ID NO: 115549 - protein, 361 aa, Triticum aestivum
  Clone ID: PAT_TA_9967.pep
HASAGFRHKVRQEQARSGVAGSPPAAGLRGPDQCRAMEIVIRNVLPTTTHRWCKWHVLKKCKETLGPMYTKQSDFRAEFHKVVIHMLTINEFEDAWKMLIEKYSLQSHTYMTQVYEIREKWAKPYFQGVFCAKMTSTERSESANSMLKTYVLPGCPMHMFVKHYMRLQSARDAEESYEEKRNKVAGVVFKCNMSTERHGSKVYTCAMIEQLGELLYQANAYRIEELDKGRLYRATHTQAEMREKWARGVYEVKMLDDGRLFECECGLFEHMGMPCCHMLKVMDVLGYTEIPEKLILKRWTRDARDVLLSHLQVYQRGHASSRIMTHRHTSLYMHAMELVRLGDASVEAYEKGMRIIRDGIT

SEQ ID NO: 115550 - protein, 383 aa, Triticum aestivum
  Clone ID: PAT_TA_9968.pep
ARPRRPRVRVSPLGLGSSPALLHPATGGACPCGRGPIPLTSGGGSWLGCLSQVPSSARPLGFRIDAAINSGNSGGPAFNDRGICVGIAFQSLKHEDVENIGYVIPTPVIKHFIQDYEKSGAYTGFPIIGIEWQKMENPDLRKAMGMKPDQKGVRVRRVEPTAPESGCLQPSDIILSFDGVDIANDGTVPFRHGERIGFSYLVSQKYTGDKALIKVLRNSKVHEFKIKLATHKRLIAAHVKGRPPSYYIVAGFVFAAVSVPYLRSEYGKDYEYDAPVKLLVKHLHSMAESPDEQLVVVSQVLVADINIGYEDIVNTQVLAVNGHPVKNLRDLVTTVENCKDEFLKFDLEYDQIVVLERKTAKAATEDILTTHCIPSAMSDDLKA

SEQ ID NO: 115551 - protein, 150 aa, Triticum aestivum
  Clone ID: PAT_TA_9969.pep
IPGHPSLNCAPPPPDPSPGCSASCTGALPAGGPAGAAPLAAGPALGRPCARRGGPPQRFLAGPASERRPAPAGQSRSLVARQFPPATHTPRPKTSLGRGRLGDGDLARRTDGAPKAEVSRQEVELGPHRNSEWIVDSTDNLHAVELSGPR

SEQ ID NO: 115552 - protein, 164 aa, Triticum aestivum
  Clone ID: PAT_TA_9970.pep
SKEPVVRDEDDYQNYRKAAKQHWDMMKQYYGKAVDAFREGNKKEAEYLMTEGKNYYRMARLSDEKSAAEITKSKQESKNELCLDLRSQDAANVANLLRLHLRQLANIPSFDNLRVIIGVDDGTFKMGQRRRKVEKFLEKKSVEWTEDEANPGTILIPINQVKDQ

SEQ ID NO: 115553 - protein, 116 aa, Triticum aestivum
  Clone ID: PAT_TA_9971.pep
RHEAYHSGRKMVYLNPVTGESKEQHLREERNEMWVKFFDFTLLKSMDEDLAEEADDGMHPGKDQWLWPLTGQVFWPGIADREREEKYIKKLDKKLKSKVKLLERQKLGYKQKPLGQ

SEQ ID NO: 115554 - protein, 393 aa, Triticum aestivum
  unsure (1)..(393): unsure at all Xaa locations
  Clone ID: PAT_TA_9972.pep
MARKVDLRGAKDAKGDTVLHFAACKGSLEICRFLVEDSGLDVDSASKTGETPMVYAALAGKVQVMRYLLDRGADPAVRDDNGSTPLHYAAEEGHCEAVRLLLSKGVPVDPVDHRGAPLQLAVAKDRVEVVKLLLEHGADPNKLVNHILTPLLMAVIRNSLKCMKLLIEAGADLNARGNSGPTPLTQAVDDGSTDFVKLLLEAGADPNIPSEHGAIPVELAAVHXRCDLVEVLFPRTKPIPSLPDWSVDGIIRTVKSPLMNHLQASVSVEEKIAFWKSQGKEAFAKEDYLTAMTFYGKVLDTDPSDATMYANQSLCWLRMRHGKLALEDALKCRMMRPRWSKAWYRQGAALSFMKDYEGAADAFRVALQLDPKNEEIKEALRKAEKAVEEPQRG

SEQ ID NO: 115555 - protein, 118 aa, Triticum aestivum
  Clone ID: PAT_TA_9973.pep
LNIRLIYVLNIIKKNDKETEPIKNEQYLSTYPPKMSILEDVIHKMRTPVVYLNITRLTDYRKDAHPSIYRKQHLSEEERRSPERYQDCSHWCLPGVPDSWNELVYAQLLISQHQMLQQ

SEQ ID NO: 115556 - protein, 134 aa, Triticum aestivum
  Clone ID: PAT_TA_9974.pep
LSKPKLKPQILACFGEIALAIGKHFEEYHLQAVRKKLKEAANPRYYANVSDEDKVDYGNQLRQGICKAYSGILRGIKDQKSGLKVAADLVEFIEAVSEDESRDARVTSAAVDVLDQFGFMAESWKKGLISELGR

SEQ ID NO: 115557 - protein, 198 aa, Triticum aestivum
  Clone ID: PAT_TA_9975.pep
PRAAGENISSRCKTFEKHYEAISKMLSQSGFGWDWVNNKLSIDSEDVWLKYVAANKKVGFYKNRVIKNWDAITTIYSKDHANGEGAVTGAETVVEPTTEPNEASPEVPKKKQRLGDAILCLLGDMKGSFHDALKSLEPLPLPQVTPPAEILATLEMIPDLARGDILRSYGKLILSEHLYKALLELPMNFRKEWLLMLN

SEQ ID NO: 115558 - protein, 110 aa, Triticum aestivum
  Clone ID: PAT_TA_9976.pep
LCTRTHTTPRLQAQGRRHTHSQLLTGATRSESRAHVSRDGGREGNTKEEEAKFQDKQPRMRLAYHPSKSMESSSLSPPPRHHLLRRAPPCTTACPSTAASVDDHSQLHRH

SEQ ID NO: 115559 - protein, 98 aa, Triticum aestivum
  Clone ID: PAT_TA_9977.pep
SRQKSRLWCASCHSGIESQKSLQIHQTMKEVSFYLSRNGGRQGRAAAALLVERLRLRAAPPPPGRSPPSAAGLHPDPLPCPPAAWPPPRHAPARRSEL

SEQ ID NO: 115560 - protein, 199 aa, Triticum aestivum
  unsure (1)..(199): unsure at all Xaa locations
  Clone ID: PAT_TA_9978.pep
APSRLPYPSFPPASFLTFLYLSFLGCSATMGASQKLRAGRLLAKSQHGHPPDPRGLSVSSDEQELQESMAPPLPRLVPGDSNAKSVPPRISSVLPITRCRRHQRARKRRVDSPRSKPCSIRGWSSLARSRSLDVSLPASNRPLLSSPAVAAALYSALRSRETMSGQQPRWPDRSDPARPAMIPRRPSAHPXXPSFSSAC

SEQ ID NO: 115561 - protein, 329 aa, Triticum aestivum
  unsure (1)..(329): unsure at all Xaa locations
  Clone ID: PAT_TA_9979.pep
YPLLVATIVCAAVFIVFTHLPSESSTRVLPWVFSLLVALFPITYLLEGQLRANSFAVEDEAEKFTNMLAIEGARMSLLGLYAAIFMIIALEIKFELALLLHDKAADVTHGVSGGRGSAFPPKARLLQQRRSHAAPTFTIKRLAAEAAWMPAIGNLSTVLCFIICLVLNITLTGGSNRAIFFLAPILLLLNQDSDIVAGFGDRQRYFPVTISISGYLLLASLYKIWEEAWPGTGSGGWALDIGGSVWXYAVKNVALLVLTLPNHILFNRFMWDYVRQTDSKLLLTLPLNLPSIIMTDVLSVRVLGLLGAIYSLAQYLISRRIRIAGMKYI

SEQ ID NO: 115562 - protein, 111 aa, Triticum aestivum
  unsure (1)..(111): unsure at all Xaa locations
  Clone ID: PAT_TA_9980.pep
FKCRPPDPYQARPVPNWLFPVKNSPEILYLCKKYNPLVPKNSGISESSPRLTMEPTHIHIQENSPRLRHHKPCFGAEDEEGRQSVTWGDVGGXVLLPVPGGEERWDSFXAL

SEQ ID NO: 115563 - protein, 43 aa, Triticum aestivum
  Clone ID: PAT_TA_9981.pep
AGKHFGSPLAAVPCAVSSICPSVYGSLLAGVWRSMPPNDKQGA

SEQ ID NO: 115564 - protein, 215 aa, Triticum aestivum
  Clone ID: PAT_TA_9982.pep
DMFGAGSETSATTLQWAMAELIRNPRVMRKAQDEVRQQLAGHDKVREADLADLRYLGFVIKETLRMHPPAPLLLPRRCGSPCQVLGLDVPEGVMVIVNAWAIGMDPAHWEAPEEFAPERFEQNGRDFKGADFEFVPFGGGRRICPGMAFGLAHVELALAALLFHFDWELPGGAAAEDLDMTEEFWRHGTASGLTFVVVPRPRSKRTFDVHPIFFF

SEQ ID NO: 115565 - protein, 355 aa, Triticum aestivum
  unsure (1)..(355): unsure at all Xaa locations
  Clone ID: PAT_TA_9983.pep
MRRPQRRAVAKQSRAKDGDEIRLLEAWIDAGKPLPGTKPPPPSEESSAANARVRARDVVAKAAAGDYSDYGASTRFDELPLSQKTKDALRKAGYKEMSEIQRAALPHALCGHDVLGAAKTGSGKTLAXFVIPVIEKLYREKWSQEDGVGCIILSPTNDLAGQIWEVVRKVGKHHNFSGGAIVKRTGIEQEKERINSLNILVCTPGRLVQHFDETPNFDCSNLQILVLDEADQILDKNFKSQVDIILSQIPKARQTLLFSATQTKSVKDLARVSLKNPEYISVHEQASTATPDNLEQCAMIVPLEQKLNMLWSFIKRHLKSXILVFLSSVKQVKFVYEIFKXLRPGIPLKCMHGRM

SEQ ID NO: 115566 - protein, 249 aa, Triticum aestivum
  Clone ID: PAT_TA_9984.pep
PRVRFLSSVKQVKFVYEIFKKLRPGIPLKCMHGRMKYEVQQAIVAEFSESTSVLFSTDIFARGLDIGNVDWVVQVDCPESVALYIHRVGRTARYNKKGKSLIFLCPQEERMLEKLKATESKIPINVRKPKVEQLEQISQNVAAVLVKFPNLQQLGKRAFVTYLKSVYLQGDKEVFDLSRFSAENFAAYASSLGLPVTPKIRFVSHKKNVSKKDMKDIDVKQMKHKAEVIEINPQVNRDMLADDGPDDDI

SEQ ID NO: 115567 - protein, 162 aa, Triticum aestivum
  Clone ID: PAT_TA_9985.pep
MRGEAEPAARAGAADAGHPRSPDPHDLSDDPDYADAASVPASIHAAMRTDMADIGSEETARMDVVYEKERVTIHPTHSVTAEIEKYRSLYTIQALPLSDVRFIRRHTPTFGLEYIIIVLSSGLAFPPFYFYNGGIRELFATLKQHVFIIRSDDDPNVFLVND

SEQ ID NO: 115568 - protein, 165 aa, Triticum aestivum
  Clone ID: PAT_TA_9986.pep
RNSPRRPYRVPSLSSSPNAPAASTCHTASPPSLPPPTRRPPPPAIPRPRCRHGLFRRHAPPWCEAAGQDLDEEEEIRAPQRWMDRCEVTTSSSGRGGQRGRRSSRRMPIRVEAAALRSPSCLQARFLLHPRARRQGSPAAAGTSRQRATPRQVGDRFVLQLLSPL

SEQ ID NO: 115569 - protein, 129 aa, Triticum aestivum
  unsure (1)..(129): unsure at all Xaa locations
  Clone ID: PAT_TA_9987.pep
XKIGCYSTKLASPRNIIYCRFTVDILWFLFFASLARFARSRGPPFFLLCFWRKPLLADISSYNLRIDCFLLQPVVYATHGTLLGMFPLGHDFACPNAWTFQQNALVPLSPNNFILLLLYLRKCANTHPS

SEQ ID NO: 115570 - protein, 48 aa, Triticum aestivum
  Clone ID: PAT_TA_9988.pep
FFLKYERWQYRVTVSVLPELQLDWFSEEENTNEHRAIGTSKLQNFQHK

SEQ ID NO: 115571 - protein, 131 aa, Triticum aestivum
  Clone ID: PAT_TA_9989.pep
MAPSDFSFHPSALMGSNAAGSTSRFPDWALLCEEPRLSERRNETTAECETSEGQSVEVSFWLVDPPGASYFSFNCPGLHASAFDDYAPPSLVCAGAAFVLFSLTIRGSTHHFVYKAAPAGEQSLQLLPDPP

SEQ ID NO: 115572 - protein, 221 aa, Triticum aestivum
  unsure (1)..(221): unsure at all Xaa locations
  Clone ID: PAT_TA_9990.pep
NLLLYLIASHVLGALWYLLSVDRQTACWKMNCRNGSDCNIRYLDCDTPNQTWASTTDLFSRCNASNDTITFDYGMFQPALSNQAPAQGFLRKFFYSLWWGLQNLSCYGQTLSVSTYXXETLYCIFLAVLGLVLFAHLIXGNVQTYLQSITVRVEEXAIXQRDTEEWMRHPQLXPDELRERXRRFIQYKGLATRGVDEVPILLVLPAARRRAPWRHLCRDLP

SEQ ID NO: 115573 - protein, 129 aa, Triticum aestivum
  Clone ID: PAT_TA_9991.pep
MSLRELSLTRPRELGGTGRRGSRASPRPTRRREPRRRMRSRRPQGTLSTRRPSGRSSCAGWRAGRRRGPHTPSRRWNTRRPTPRRSGPGGRRWWPPSRDTSSWPVTSAARHPTGRHRRRKSTTSTGWAA

SEQ ID NO: 115574 - protein, 247 aa, Triticum aestivum
  unsure (1)..(247): unsure at all Xaa locations
  Clone ID: PAT_TA_9992.pep
VTSCSCKFRHVFQGAAPGAAETNGKNEPGKTSGPSANGVTSNSESGSDSESEGRDANSXNDSHSKENDVNENGTFGDAGSAQNGVSHSSSHGTFNKPMPLVPVQSGAVIGVAGPATNLNIGMDYWGATGSSPVPAMRGKVPSGSARGEQWDERELKKQKRKLSNRESARRSRLRKQAECEELGQRAEALKSENSSLRIELDRIKKEYEELLSKNTSLKAKLGESGGGGGSDAVPDMNERCDTNGGSH

SEQ ID NO: 115575 - protein, 150 aa, Triticum aestivum
  Clone ID: PAT_TA_9993.pep
MDGAGMATPPEANTSPAPNGGGCGGIRVENCYVFKSRLQEYAQKAGLMTPEYQTLKEGPSHEPIFKSSVVINNVKYDSLPGFFSRKAAEQSAAEVALMEIGKSVALPTNATIPAVQETGLCKNLLQEYAQKMNYAIPSYICNKQGPYICT

SEQ ID NO: 115576 - protein, 416 aa, Triticum aestivum
  Clone ID: PAT_TA_9994.pep
VRGRVGYNRDGGSGRGFDDHRGGSGAGYGGRGQENNQGDGGYGQAPPKGPPSYGGPPGDYAPPPSSYGGNNVYSSDSAVPPPNSYGGGRGPYPPSYGAPPPNPYSGGAPGGQGGLPPTYDGGYGGRSAPGGGGARAQHMVPPYGTPPPPYMMYPPGTVYAHPTTPGVHPFHYPMQTNGNLEPAGAQGAAPGAAETNGKNEPGKTSGPSANGVTSNSESGSDSESEGSDANSQNDSHSKENDVNENGSAQNGVSHSSSHGTFNKPMPLVPVQSGAVIGGVAGPATNLNIGMDYWGATGSSPVPAMRGKAPSGSARGEQWDERELKKQKRKLSNRESARRSRLRKQAECEELGQRAEALKSENSSLRIELDRIKKEYEELLSKNTSLKAKLGETGGGDSVPDMNERGDTNGGSHHKEP

SEQ ID NO: 115577 - protein, 134 aa, Triticum aestivum
  Clone ID: PAT_TA_9995.pep
FSNLPPDVTVEELQELFGGIGQVGRIKQKGGYKDQWPWNIKIYTDDSGKAKGDACLAYEDPSAAHSAGGFYNDYDMRGRKISVVMAEKSAPRAPTSGHGGGRGGGGGYGADRRRDGGGHGPNRNQGGGSRSRPY

SEQ ID NO: 115578 - protein, 183 aa, Triticum aestivum
  Clone ID: PAT_TA_9996.pep
IDDSRAYFSNYGKCTDIFAPGLNIVSTWIGTDKAINTISGTSMASPHIAGRRAYYDSLQPAEDSEYALASITPKKLKENLISVATENALSDIPSDTPNLLAWNGGGCSDYKKIVEAGSYKVNKAAPSSRVEDIKHAVEQGVEVVSGKLTTGAKQLGSKAEKFSKKIHELVDEELEQFIKELNL

SEQ ID NO: 115579 - protein, 131 aa, Triticum aestivum
  Clone ID: PAT_TA_9997.pep
MIDDDDSCNKQTWRPRSATHSHNEMVLLFCAKKENALSDIPSDTPNLLAWNGGGCSDYKKIVEAGSYKVNKAAPSSRVEDIKHAVEQEVEVVSGKLTTGAKQLGSKAEKFSKKIHELVDEELEQFIKELNL

SEQ ID NO: 115580 - protein, 175 aa, Triticum aestivum
  Clone ID: PAT_TA_9998.pep
EFPHLLVPARSAPLLACVAARAAATRGAGARLSGELLTPRARARSGPLVEVELEAIAAERLGSIRGDWGRGSSRRNAREPDGVLRAKQASHAVPVKATEETARYQLWHPISSLTWLAQHSGGATAATVRVYLPTTSYGHDETIHIGMSARSAALRHPNKEAQAVTPRHRISASER

SEQ ID NO: 115581 - protein, 100 aa, Triticum aestivum
  Clone ID: PAT_TA_9999.pep
PSVLYRAAAGNVTKISPAFVLFFNCSEEEMERRLLGRNEGRVDDNIETIRKRFKVFVESSLPVIEYYDAKDKVKKIDAAKPIPEVFEDVKAIFAPYAKAT

SEQ ID NO: 115582 - protein, 271 aa, Triticum aestivum
  Clone ID: PAT_TA_10000.pep
VLPRVRPRVRPRVRSTPTPQHAPRAPPPCDRSPWSRRRADPSTGIRFGAQLDPAAPGPWARVVDAPAVVTEKEVVAENMLGDKKVTVVFVLGGPGSGKGTQCSNIVEHFGFTHLSAGDLLRAEIKSGSENGTMIENMIKEGKIVPSEVNIKLLQQAMIKNENDKFLIDGFPRNEENRAAFENVTKISPAFVLFFNCSEEEMERRLLGRNEGRVDDNIETIRKRFKVFVESSLPVIEYYDAKDKVKEIDAAKPIPEVFEDVKAIFAPYAKAT

SEQ ID NO: 115583 - protein, 118 aa, Triticum aestivum
  unsure (1)..(118): unsure at all Xaa locations
  Clone ID: PAT_TA_10001.pep
DWSSWAWLCHALSVLWRDFVGRXVKRLEVALRIKRRVAQLRVMSSSHLSCRVACDVFKPSWLPTSKILVCASAAGCTCLYMGGGAWVEVAETVKADRKPVFFSMXLVPVLELPHVRSG

SEQ ID NO: 115584 - protein, 168 aa, Triticum aestivum
  Clone ID: PAT_TA_10002.pep
LGLGLERLGGDQAMATALRHAARRFGTRAAAEAEAEAIIERSPLYTSTRIVDSTTGRDLTPNQRKDAIFRLAQIHAQKEDLYNTIAAWQADYTAKGNVVTRKNNLLLKQLSQHVKPRPDDPRWRSSQRAVYFNDFLKFTGAVLIGKMAGDAFSHYKAKQDHDGHKGSS

SEQ ID NO: 115585 - protein, 204 aa, Triticum aestivum
  Clone ID: PAT_TA_10003.pep
VADPPIIYRDMKAANILLDEDFSPKLSDFGLAKVGPVGDRTHVSTRVMGTYGYCAPDYVVSGKLTMKSDIYSFGVLLLELITGRRIYDASRPKPEQSLLTWSRPFMHDKRKFHRLADPALRGSYPPSALNQLVVISIMCLQDQPHVRPIIADVATGVTPVSSQPYPSLATLASPAESGGAGQRGTRYGRQRGSGGSRRVAQYAS

SEQ ID NO: 115586 - protein, 114 aa, Triticum aestivum
  Clone ID: PAT_TA_10004.pep
GVENLTNLHTLGVIKATVAGLKELKKLTQLRKLGVSGINRRNHKELCAVISGHGHLESLSIWFDKDTERIADPCSPSNDDFKPPEKLRRLKLHGHTDNLPAWVSTLKIFVTQDQ

SEQ ID NO: 115587 - protein, 276 aa, Triticum aestivum
  unsure (1)..(276): unsure at all Xaa locations
  Clone ID: PAT_TA_10005.pep
HLGRLFLPLAHLAHSFHQIKIRSSILPSCVLEPYLPHAERRPTPPPSPPPSRARWRPGGPSPPLSAAAVARGPGPRAAAAPARGCAPGPGRASPEDLYGAVSRGQQPLDLTTGFDIEWVQEDKITLFTSXDGLVQIGGNMVPRPVTASEKRQQKGKGKLRRFQESSYMDPNQXFALAALFNIAATNGLDMGRRLCIFGFCRSIEMLSDVVEDTVLEHGGEIVTAEKASSDGLQEKLTMSVAVPLLWGVPPASETLHVAVRSGGGIVDKIYWQWDLF

SEQ ID NO: 115588 - protein, 152 aa, Triticum aestivum
  Clone ID: PAT_TA_10006.pep
AYVYMLDDSSVEEMLISKGREYPEKRVSKDSQSSEIKRALASCISNALPVLVSNMRMHTPVSKLETTLGYLIDTMSLVDALPALRSRQWQLLVLVLLDALSVHRLPALAPVISDSKLVQKILNSAQVSREEYDSMVDLILPFGRSGETPMSS

SEQ ID NO: 115589 - protein, 210 aa, Triticum aestivum
  Clone ID: PAT_TA_10007.pep
EKIGSPLSAGSKYKKIKTDSNTEAMYQHYVMKRYKMKKMKRGEVEPPFIRIDDFHITYTNFQKSLKPRAHICSEVMSLFIESFNIEQLSSSNMQKKFAFSVLMSLQLSVHPEVFDPSVCAKELRRACQNFQISVFDLLYFTIVYDGHWIVCVINLLHKEFNLFDSWDNGKLDIAARNLVSDISTFSTEEPAFPVDLSSFKSDWPLLDYPQ

SEQ ID NO: 115590 - protein, 115 aa, Triticum aestivum
  Clone ID: PAT_TA_10008.pep
LCRSRGPPTYGLPPPLLSHLRAALNCDHNESTPEADIKENDRMVLGADDRDLPPMAGGRGGGDDSERERAGRAAELAQGQKARQRRGRWWKDTSGGSGRGMQGSAREVFLSSLIK

SEQ ID NO: 115591 - protein, 133 aa, Triticum aestivum
  Clone ID: PAT_TA_10009.pep
RGRGRGSKLADMPWRMGYVFRPAPSIGELRSGSPRLVELNDFVRQRYSKGLLDVLSFSESEVTPIVEGYGGWAFRAEIVPIESAYPGYGELVVLQNTDHINSCKPVNKNDPSYAETLAFLEKSLKSRGKRAEA

SEQ ID NO: 115592 - protein, 272 aa, Triticum aestivum
  unsure (1)..(272): unsure at all Xaa locations
  Clone ID: PAT_TA_10010.pep
MDRYQRVEKPREEAPIGANEIRITAQGRTRNYITYALALLQEEATDEIVXIKAMGRAINKTVAIVXELLNEKDCWLSIKNNSIESINITDTWEPLEEGLNVLETTRHVSLITITLSKTELDTSSPGYQLPIPADQVRPPTEFDQDAEDVPSGRGRGRGRRGRGRGRGGFSDGGADYDDVNGDIVGPRGYRGRGRGRGRRGSFGPGRGYGGDGYGYVNEEAGGYHGMEHNGPPVQGYEGDGGRGRGRGRTRGRGRGRGGGRGRGPFPQGPPQE

SEQ ID NO: 115593 - protein, 182 aa, Triticum aestivum
  Clone ID: PAT_TA_10011.pep
EDQSAHPACSRDLHERNRPYLCTGFDIYLVWEPCTMCAMALEAHRNPRAGAAGRDPRTGGQGSVNRQHGEKRMKDPEAELRGTAAGAEKRGSTAGSAKWGSTTGSAQQQRSRRKGRQQRGLPRCPRGCRDMRYSRHEGGGERGQAVQPAAGWRRKVGRARKGHWSPQRDSMVEMAPGTAPPA

SEQ ID NO: 115594 - protein, 64 aa, Triticum aestivum
  Clone ID: PAT_TA_10012.pep
VLPLVLFLGTPFALLIILNGSKIPSSMFPGYLRMVLTTMLHSGMMKSKLGINVSKKHLKQTSGS

SEQ ID NO: 115595 - protein, 476 aa, Triticum aestivum
  Clone ID: PAT_TA_10013.pep
MAAAAAAAAAVTPHVAAVGTGSHNHHQPPHRPPVSISARPRARLVPVAAAAATPATDGVAPVPPHPRRSVVKRHTISVFVGDESGMINRIAGVFARRGYNIESLAVGLNKDKALFTIVVSGTEKILTQVVEQLYKLVNVIQVDDLSKEPQVERELMLIKLNVEPEQRLEVMGLVDIFRAKVVDLSDHTLTVEVTGDPGKIAAVQRNLSKFGIKEVARTGKIALRREKMGQTAPFWRFSVASYPDLEVKMPSKSTLSTAKTTSGDSEESSQGDVYPVESYESFSMNQILDAHWGAMTDSDPTGFCSHTLSILVNDSPGVLNVVTGVFARRGYNIQSLAVRPAEKAGTSRITTVVPGNDESIAKLVQQLYKLIDVYEVQDLTHLPFAARELMIIKVAGNTSARREILDIAEDVFRAKTVDVSGHTITLQLTGDLDKMVALQRLLEPYGICEIARTGRVALCRESGVDSKYLRGYSLPG

SEQ ID NO: 115596 - protein, 96 aa, Triticum aestivum
  unsure (1)..(96): unsure at all Xaa locations
  Clone ID: PAT_TA_10014.pep
FRAKKLDKVTNFVQIVLEAYDIPLMDADCGYPTSTTCLPLRSDKVQHAAFFRKPLQLMHAVCCEELWQSLVCXPCLMYFHTESSNIHLPPQKKKKK

SEQ ID NO: 115597 - protein, 151 aa, Triticum aestivum
  Clone ID: PAT_TA_10015.pep
MDADWTWACRAWEKWTAKHVGSSVAGMPVKAALLLNYDPTGPSRLLPIVAEEEGTKFTAVDLQPFINFFRRNNLQTEFFSIGPNQYLVTSIHEHWFCARCVNTTQPGGEGVIVMQIGAYLLVSMYDGSVGSASQAMVAVDQFAWHFNRRTH

SEQ ID NO: 115598 - protein, 131 aa, Triticum aestivum
  Clone ID: PAT_TA_10016.pep
YRSNERITTPKGPGRFLSTTSAAVSRAQTVTTYCGALRPSPFLWRMAGFRAPMLIVGEEWPASSSIFQDNRSTWILQFNDPKFRLGVGDERTETLRTFLIFFRRRYTCTDATNHVVATPAPRCLIISLTAA

SEQ ID NO: 115599 - protein, 266 aa, Triticum aestivum
  Clone ID: PAT_TA_10017.pep
SADAWANAVAMDWLEGHDWTVEKDLPANRLIEFKFLLQDSLGKFHWQNGPNRSLQTGETKKTLVVYVDWGNAKNKEVVEEGDTPVEMAEAVVADDDQGRNGVVAGNELQVRDNQEIKEDESTISDGENPMAPAIASVGEETMKACEADQPELLMDEDKIQDGLHDEIDTAPQNGRATTYADADSEYGETADDVLSKNGVLVKRAGAQEGGLQGGRKGEEAPGGASADSRGARRLGRHAVPARGEGENAGRQQQQRRKWRRPAGGSS

SEQ ID NO: 115600 - protein, 143 aa, Triticum aestivum
  Clone ID: PAT_TA_10018.pep
SIWRFSPVIILQIQQFRRWSTKPECQSCLFQKGTIAPFGVCGTIMMWDLSTGRCVSPLAGHNSCVWSLAFSCEGALLASGSADCTVKLWDVASSTKALKMDDTKAGSTNRLRLLKALPTKSTPVYNLRFSRRNLLFASGALSL

SEQ ID NO: 115601 - protein, 149 aa, Triticum aestivum
  Clone ID: PAT_TA_10019.pep
SQGTFNRGHLILQEFVEDNNGNEQVGICEASSEPFQLFQRHKESLKSGYVQSSTLASPRICIIIRSPKNESSQRYENGTHLRSYEKKVAQLRIQDANSAELFAIERTRAAIRDIWTKFNISLASVNAGDRLYKRLAVLYDMMNAAIACF

SEQ ID NO: 115602 - protein, 199 aa, Triticum aestivum
  unsure (1)..(199): unsure at all Xaa locations
  Clone ID: PAT_TA_10020.pep
PKNTLCIGILEQAERREPELGEASVSLAMAGDCLHGKLLYLENRVALAMILFPAEARVAMEVAQVNGTLEFTLGSSANPLTEIQRTTFDLNETPFKMKDVYLARMRVLSKTVELGKRFFPRCSDVLEKMMDDEPGLAALGSDXTTSEMNRFHDLPDVLQKAFTAGKRKQQSSMAEQDVVEQVQGQGAVAGTDNGSRRIA

SEQ ID NO: 115603 - protein, 175 aa, Triticum aestivum
  Clone ID: PAT_TA_10021.pep
SVRKLSLSLVAEMLRNQKDQMEESIESSREKLVEKPGDAEGEDAKEADECLSDALAREEPISRLAVIVPLLVTDDEKTLVMCINCLTKLVGRLSQEELVAQLPSFLPALFDAFSNQSPDIRKTVVFCLVDITIMLGKAFVPYLEGLSSTQLRLVTIYANRISQARSGAPIGCLTQ

SEQ ID NO: 115604 - protein, 419 aa, Triticum aestivum
  unsure (1)..(419): unsure at all Xaa locations
  Clone ID: PAT_TA_10022.pep
EEFRAEVXDLLINEEYKIWKKNTPFLYDLVITHALEWASLTVQWLPDRTEPAGKDHSVQKMVLGTHTSDNEPNYLMLAQVQLPLDDAEADARHYDDDHADIGGFGAASGKVQIVQQINHDGEVNRARYMPQNSFIIATKTVSAEVYVFDYSKHPSKPPLDGACNPDLRLKGHNSEGYGLSWSIFKEGHLLSGSDDAQICLWDITANGKNKTLDAYQIFKFHDGVVEDVAWHLRHEYLFGSVGDDHHLLIWDMRTPAPTKPVQSVVAHQGEVNCLAFNPFNEWVVATVSTDKTVKLFDLRKIDTSLHTFDCHKEEVFQVGWSPKNETILASCCLGRRLMVWDLSRIDQEQTPEDAEDGPPELLFIHGGHTSKISDFSWNPCEDWVLASVAEDNILQIWQMAENIYHDEDDLPSDEPAKAS

SEQ ID NO: 115605 - protein, 87 aa, Triticum aestivum
  Clone ID: PAT_TA_10023.pep
PIFMMASVLFPQNVGRKGSHSGQFENRQVVHLILTKGGLRLLSFWSCRCGGLGDDIYPTVLAILVSLHRNGNLCQMTSVLLCLSLPP

SEQ ID NO: 115606 - protein, 124 aa, Triticum aestivum
  unsure (1)..(124): unsure at all Xaa locations
  Clone ID: PAT_TA_10024.pep
SADAWVGLLQGDTDRFTSXAGMGYVHIDDVARSHILVYETPEARGRYLCSSVVLDNNELVGLLTKQFPVFPIPRRLNNPYGKQAYQLNTSKLQGLGLKFKGVQEMFNDCVESLKAQGHLLECPL

SEQ ID NO: 115607 - protein, 111 aa, Triticum aestivum
  Clone ID: PAT_TA_10025.pep
MYCWNFIYKFGKCSCRSTKGKVCVTGASGFLASWLIKRLLECGYHVIGTVRDPGNRKKVGHLWKLPGANERLQLVRADLLEEGSFDDAVMACEGVFHIASPVLGKSDSNCK

SEQ ID NO: 115608 - protein, 205 aa, Triticum aestivum
  Clone ID: PAT_TA_10026.pep
MVSSTKGKVCVTGASGFLASWLIKRLLECGYHVIGTVRDPGNRKKVGHLWKLPGANERLQLVRADLLEEGSFDDAVMACEGVFHIASPVLGKSDSNCKEATLGPAINGTLNVLRSCKKSPFLKRVVLTSSSSAVRIRDETQQPELLWDETTWSSVPLCEKLQLWYALAKVFAEKAALDFAKENNIDLVTDLPSFVIGPSLSHDYC

SEQ ID NO: 115609 - protein, 142 aa, Triticum aestivum
  Clone ID: PAT_TA_10027.pep
FLCRLVTITKHQLSLADYATTRNVSKCFPIIQSAINIDPFCGKEQDLYAILFKGQNGNAQASMTDGKSQWSPARGRTTYTKDNKYDSVGTSSCFGSSVHYGGREYYGSSAPKQATEYSDYKVDKKDPVADSHGDWWQGSFYY

SEQ ID NO: 115610 - protein, 183 aa, Triticum aestivum
  Clone ID: PAT_TA_10028.pep
MAPSASHAGAALVRLPPRPAPSSLPQQGFGRAGASLLAVRATKDSDGFRRLVSEKPEWPAPAPAKREGLDGFGREASNGEEDGQVQGELAPWSVLNQLGVELDSDSSYTALVYGSSAIVAIWISSIVVSALESVPVVPQVMEVVGLGFTVWFTSRYLIFKENRDELITRIGSIKRQVLGSRDD

SEQ ID NO: 115611 - protein, 345 aa, Triticum aestivum
  Clone ID: PAT_TA_10029.pep
FEGGDISGVLVPWVYVGMCFSSFCWHVEDHHLYSLNYLHWGAPKMWYGVPGKDAVNLESAMRKHLPDLFEEQPDLLHNLVTQFSPSLLKSEGVQAYRCVQREGDFVLTFPRAYHAGFNCGFNCAEAVNVAPIDWLPVGQNAVELYREQARKITVSHDKLLLGAAREAIRAQWDILFLKRNTADNLRWKSVCGPDSTICKSLKARIETELAQRQNLCSPSQSRKMDAEFDSTDRECAFCYYDLHLSASGCPCCPEKYACLLHAKQLCSCDWDKRFFLFRYDVNELNILADALGGKLSAVHRWGVSDLGLSLSSCVKREKVQDSKTVRRATDGPRRSYMSQASTVSL

SEQ ID NO: 115612 - protein, 138 aa, Triticum aestivum
  Clone ID: PAT_TA_10030.pep
MSGTASTLAGDGALNGAAMHSGSNGRRSSGGVRENARPSSVPEAAPVPVRHLGFQKLQEGMNQLDVGTKACIRDALYRLAYSVEQRHQAVEQNVGSSAANRLSTSSVWAETERSPMDRSVAQLLLQKPLDRRTANRAA

SEQ ID NO: 115613 - protein, 186 aa, Triticum aestivum
  Clone ID: PAT_TA_10031.pep
TRPKIYNDSAEAKIPAVLDYLATVIEADCKFLIFAHHQPMIDAIHQHLLKKKVKCIRDGGQTREVGRENMDTEVPLFEAEDRAHRIGQVSSVNIYYLLANDTVDDIIWDVVQGKLENLGQMLDGQEETPEDTQSEPGPGPAEEKTRDADHGRRGTSGEAQAGPESRRNGRQGERGAGRSRARTRGT

SEQ ID NO: 115614 - protein, 137 aa, Triticum aestivum
  Clone ID: PAT_TA_10032.pep
AGAAPGIQGYTGGGGFSHPSSYGAAGYGGLQQQQQQQQNGNLMASMQGYHNNPAAAAAMMNNLRGNMMMHQPQAQPQMMYHRSPQISPYTAYYNPYSYYYQQPGGGGGGSSAYHPGAGAGDVETMFSDENTKGCAIM

SEQ ID NO: 115615 - protein, 153 aa, Triticum aestivum
  Clone ID: PAT_TA_10033.pep
HRCIIWATKALLALVIVSKFLMLPRSQMAIQLTLLLISCSLYVRYSSSSFSTSSSLALLVLVISTCLSLLFSNLRQLVRTSSHKASMEVVAHQEKSTVPQDEVSEDALEDSAGSLSGSSDCQVSEEGTDEVSVSDDDDDESLIEISLVDGYYV

SEQ ID NO: 115616 - protein, 318 aa, Triticum aestivum
  Clone ID: PAT_TA_10034.pep
MVNESGDAVHRSSSKEEHDSICVVRSRLDLVCFHWNVYSRTFCVLNPVTGATLDLPMGHSKELEHELEVQGRKWGCHVEWCAFGKVSSTREYKALRICSIRDRQVCEVITFDDTNHGSWRRKQDPPPRICTGRQMRCVVVDGVVYFLMDFHYTYFETGVITIEPGSIASFNLETEEWGVLRGPEQLERFLQENRGYTYSGLERELSLAELNGCLVVVHNIYDISMDLWFLTDFEKGLWVKKYSLPSHVARLFWYPFLMLDDGRIFFSGMDCLEGILSGGEQGEGFLQCYDPRNGTCTDELELRDPRSIGIYTGSVLSL

SEQ ID NO: 115617 - protein, 141 aa, Triticum aestivum
  Clone ID: PAT_TA_10035.pep
RRDDDGYGRRLGYSSRRSFGRARRTPGRGSIDDGLQACSPAVRPRVRLASTASAKAKFRSMSTPKERFAVPSDAYSEQCFADRLMSPIPSMSPMPSIASDMGFCSLQQAAGCAAFAARQGGTDDAVEDPLQEVPEPPQLRL

SEQ ID NO: 115618 - protein, 169 aa, Triticum aestivum
  Clone ID: PAT_TA_10036.pep
PRLFPCTATSVRANRQSAARSKERKIKYTGELERKVQTLQTEATTLSSVFFVTQRDTSGLTVENRELKLRLQSMEEQAKLRDALNDALREEVQRLKIAAGQVPNRPGNPFGGGLQQHQQQQQQIPNYFSQQQMHYQGHQHHHPQNHSQNSSNGGQSLSGQSLSDSMDFM

SEQ ID NO: 115619 - protein, 215 aa, Triticum aestivum
  unsure (1)..(215): unsure at all Xaa locations
  Clone ID: PAT_TA_10037.pep
RGINYLHQGCEMQILHFDIKPHNILLDNNFXVPKVADFGLAKLYPRDKSFVPSNALRGTVGYIAPEMISRSFGTISSKSDVYSFGMLLLEMAGGRRNADPNAANSSQSYYPSWVYDKLTAQEADAISLVADMHELERKLCIVGLWCIQMKSHDRPTMSEVIEMLEGGFDGLQMPSRPFFCDDEHTAVPDSYPLLSELTEISAEDEISDSYVSRVL

SEQ ID NO: 115620 - protein, 451 aa, Triticum aestivum
  unsure (1)..(451): unsure at all Xaa locations
  Clone ID: PAT_TA_10038.pep
QKFADYVAGIFVPIVLXLSLLTFSSGFVCGTLGAYPNSWVSETSNCFVFSLMFSISVVVIACPCALGLATPTAVMVATGVGANHGVLVKGGDALERAQHVNYIIFDKTGTLTQGKATVTTTIVFSGMDVGDFLTLVASAEASSEHPLAKAILDYAFHFHFFGKLPSSNAAGKKRKDDAFSQWLLEVADFSALPGKRVHCLINGKMILVGNRALISENGVNIPEEAESFLVDMELNAKTGILVAYDGNFIGLMGVTDPLKREAAVVIEGLKKMGIYPVMVTGDNWRTALAVAKEIGIEDVRAEVMPAGKADVIRIFQKDGSVVAMVGDGINDSPALAAADVGMAIGAGTDIAIEAADYVLVRNNLEDVITAIDLSRKTFSRIRWNYFFAMAYNIVAIPVAAGALFPFTGLQMPPWLAGACMAFSSVSVVCSSLLLRRYRKPRLTTVLQITVE

SEQ ID NO: 115621 - protein, 254 aa, Triticum aestivum
  unsure (1)..(254): unsure at all Xaa locations
  Clone ID: PAT_TA_10039.pep
RVRGRVGGTVQIWDATRCKRMRXMESHRMRVGALAWNSSLLSSGSRDKNILHHDLRAPEDYVSKLTGHKSEVCGLKWSYDNRQLASGGNDNKLFVWNQHSVQPVLKYTEHTAAVKAIAWSPHLHGLLASGGGTADRCIRFWNTTTNTHLSSMDTGSQVCNLVWSKNVNELVSTHGYSQNQIIVWRYPTMSKLATLTGHTFRVLYLAISPDGQTIVTGAGDETLRFWNVFPSPKSQSSDSLSSIGATSFVRSYIR

SEQ ID NO: 115622 - protein, 200 aa, Triticum aestivum
  unsure (1)..(200): unsure at all Xaa locations
  Clone ID: PAT_TA_10040.pep
HFLASNNDCGLRDFDMEKFQMCNHFHFDWAVNHTSLXSPDGKIIAVVGDNPDGVLVDANSGKMIHELSGHLXDYSFASAWNPDGRTFATGNQDKTCRIWDARNLSKSVAVLGGNMGAIRSIRYTSDGKFLAMAEAADFIHIFDVRSGYDRKQELDFFGEIAGISFSPDTEALFVSVHDRNYSSLLQYSRRRFYGYLDSAL

SEQ ID NO: 115623 - protein, 123 aa, Triticum aestivum
  Clone ID: PAT_TA_10041.pep
EIFAENYFPQSEHIKCCTMSVLNPDGQASNEDIIFLYRLVPGQALLSFGLHCAQLAGVPSEVIQRAASVLEDIHSKRPVRRMICDNLAAKDKQYQDAMAKLLAFDPRKGDLNHFFEDVFPPEA

SEQ ID NO: 115624 - protein, 243 aa, Triticum aestivum
  Clone ID: PAT_TA_10042.pep
MRVAATRPASSAPVALLAALALLFLVGSASLAIGAMASHVLGGKSENPDAANSLETDGLARFAVDEHNKRENALLEFVRVVEAKEQTVAGTLHHLTLEALEAGRKKVYEAKVWVKPWLDFKELQEFRHTGDATSFTISDLGAKRGGHEPGWRDVPVHDPVVKDAASHAVKSIQQRSNSLLPYELVEIVRAKAEVVEDFAKFDILMKLKRGTKEEKMKAEVHKNLEGAFVLNQMQPEHDESSSQ

SEQ ID NO: 115625 - protein, 72 aa, Triticum aestivum
  Clone ID: PAT_TA_10043.pep
QLLIVELAQVAGDEADESVLLLVAACNATARNPEFGLQGDGGACLRAPTYWTARQLSFMLLGHDALLSLADC

SEQ ID NO: 115626 - protein, 246 aa, Triticum aestivum
  unsure (1)..(246): unsure at all Xaa locations
  Clone ID: PAT_TA_10044.pep
MKKPVGMTDDMKKLEDWLAKSDKSSYEERAVLSIVGFGGVGKTTIAMALYQNVRDKFDYRASVTVSQNYDEDAVLMMILKQVKPKESDHENQHNTGSSDVKQIKFEISHDKLVKELQDHLAXKKYLLLIDDIWSAKTWESIRKCLPHENKKGSRVIVTTRFQAVGATCSQGVIDFVHPVEFLNEDESKRLFKRSVSESKSIKYSEKELDQVTEEICKICRGLPLAIVTMAGLVASNPNTLSKKWEA

SEQ ID NO: 115627 - protein, 236 aa, Triticum aestivum
  unsure (1)..(236): unsure at all Xaa locations
  Clone ID: PAT_TA_10045.pep
GFLGFAVNMILMDQAYLSCLTPHGHGLRETLFYSLFSHLQVYKTTADLRRAIPFINDGAVSLDGGCXRGARGSFCLGDRKDVEVKFTVALSSGDSNTPGSITEVEEQVKLKNWEKERLVEDIKREEDLLKQVKDSFSNQKQQLVDYITQSPAAKRVQGSPTIRSPATPGSNPFAATPGRNPFTSTPGSHPFATTPGGNPFAAATPGGHPIAATPGSHPIAATPGNISFAVKPPHMR

SEQ ID NO: 115628 - protein, 108 aa, Triticum aestivum
  Clone ID: PAT_TA_10046.pep
APPIRNGGTTWAVTPRSPPSSRSYVCRPQSNPMALGWPSLSRATVHGCRLQLSSAKVLLLGDARFGVYNTSLDLPRPCPPKIRRATRRWRARSFFRGAGAAAVRPSPV

SEQ ID NO: 115629 - protein, 305 aa, Triticum aestivum
  unsure (1)..(305): unsure at all Xaa locations
  Clone ID: PAT_TA_10047.pep
MDKYEKLEKVGEGTYGKVYKARVAATGQLVALKKTRLEMDEEGIPPTALREISLLRLLSASLYVVRLLSVEQVTKPCGKTVLYLVFEFLDTDLKXKFVDGFRKGPSPRPVPTQVVKSFFYQLCKGTAHCHGHGVLHRDLKPQNLLIDKEKGVLKIADLGLSRAFTVPMKSYTHEIVTLWYRAPEVLLGATHYSTGVDIWSIGCIFAEMVRRQALFPGDSELQQLLHIFRLLGTPNEEKWPGVCALRDWHDYPQWKPQHLSRAVPTLEPEGLDLLGKMLQFDPANRISAKAAMDHPYFDSLDKSQF

SEQ ID NO: 115630 - protein, 122 aa, Triticum aestivum
  unsure (1)..(122): unsure at all Xaa locations
  Clone ID: PAT_TA_10048.pep
LVKSIALLVVLAGLVVAIAMTPLTVLDVLASILAYVPTGWGILSIAVAWKPIVKRSGGRTVGRSLARLYDAGMGMIIFVPIAIXPWFPFISTFQTRLLFNQAFSRGLEISLILAGNNQNAGI

SEQ ID NO: 115631 - protein, 187 aa, Triticum aestivum
  Clone ID: PAT_TA_10049.pep
PFDRGTKEFWIQKSKGGLCMSISSKALAITGIDDRRYWSHLTTDESRFHSVAYLQQIWWLEVAGEIDFCFPAGSYSLLFRLHLGRPHKRMGRRVYDSELIYGWDIKPTRFQLSTSDGQHTTSDYHLDGPGHWILYHVGDFVISSSDELTKLKFSMMQIDCTHTKGGLCVDSVFIYPKDHQPEECIRK

SEQ ID NO: 115632 - protein, 46 aa, Triticum aestivum
  Clone ID: PAT_TA_10050.pep
IYHPPADQKMAQDPETDPQLFKKLLPFIKKNPFFKKFPPAKEDTKP

SEQ ID NO: 115633 - protein, 262 aa, Triticum aestivum
  unsure (1)..(262): unsure at all Xaa locations
  Clone ID: PAT_TA_10051.pep
GNRVPLLNNGETSRILSDLEEGSNVQAANVGFCRVIKLAKHDAGKLVFATMALLVASLSNLLVPKYGGKIIDIVSRDVQRPEDKAQALADVNGTILYIVLIVVTGYILSXKLIFEDYRGIFCYMTTGSLTSFILYSLTVGSSVSALSGLYTTVMKASGASRRVFQLLDRVSSMTNTGDKCPKIENEGEVELDDVWFAYPSRPSHMILKGITLKLAPGSKVALVGPSGGGKTTIANLIERFYDPLKGRILLNGVPLVEISHQY

SEQ ID NO: 115634 - protein, 105 aa, Triticum aestivum
  unsure (1)..(105): unsure at all Xaa locations
  Clone ID: PAT_TA_10052.pep
HMVEGASLVVRSAHGARGFLYPIVDPEDIRRGGRCXAVHHPEGEVINSVIVARKAVDAQLSGPQNGDAHARGAVPLVSPPCSFSTKMEAGALEKSEELATKELAF

SEQ ID NO: 115635 - protein, 92 aa, Triticum aestivum
  Clone ID: PAT_TA_10053.pep
MELEMASQHGALLKVGLFVLVQALVYLILAHSSSVFSTTKTLCPPPARSHSARRMVALLSDLPLGGEPSPRAGIVEPSSPVALAAHAHQKED

SEQ ID NO: 115636 - protein, 272 aa, Triticum aestivum
  Clone ID: PAT_TA_10054.pep
MGALPRGLLLLGVCAVLVAAVLADASPASSMVVGLAKCADCTRKNMKAEAAFAGLQVAVKCKNADGEYETKAVGAVDKSGAFGVPLGADLLREDGELKQDCFAQLHSAPDHPCPGQEPSMIVRQSADGAEKKSFVAVPGEVHYSSQECASAFLCHFFHKKHLFHKKSALVVPHLKKKAIVIPHIHKKPIVIPHIHKKPAPVPVPEYKPPTPTPVYTHPTPVPEYKPPEEFSRVSRWCKTLETDPQLFKKLLPFIKKNPFFKKFPPAKEDTKP

SEQ ID NO: 115637 - protein, 209 aa, Triticum aestivum
  Clone ID: PAT_TA_10055.pep
MAEVEAALPVAATETPEVAAESDAGAAEAKGPHKLQRQWTFWYDIQTKPKPGAAWGTSLKKGYTFDTVEEFWCLYDQIFRPSKLVGSADFHLFKAGVEPKWEDPECANGGKWTVISSRKANLDTMWLETCMALIGEQFDESQEICGVVASVRQRQDKLSLWTKTASNEAVQVDIGKKWKEVIDYNDKMVYSFHDDSRSQKPSRGGRYTV

SEQ ID NO: 115638 - protein, 209 aa, Triticum aestivum
  unsure (1)..(209): unsure at all Xaa locations
  Clone ID: PAT_TA_10056.pep
MAEVEAALPVAATETPEVAAEGDAGAAEAKGPHKLQRQWTFWYDIQTKPKPGAAWGTSLKKRYTCHTVQEVWCLXDHIFRPSKLVSGADFHLFKAGVESXWEHPXCANGGKXTEISNMKTNLVTMWLETCMALIGEQFDESXNVCGVVASVRLRKDKLSLWTKTASNEAVQVDIGKKWKEVIDYNDKMVYSFHDDSRSQKPSRGGRYTV

SEQ ID NO: 115639 - protein, 268 aa, Triticum aestivum
  unsure (1)..(268): unsure at all Xaa locations
  Clone ID: PAT_TA_10057.pep
PCVRGRGRAASQSPKCRRSYSHRGCRRRCSGSGGFPAVASLASHPLNGATLPTGRLCFGGGEAAPRRLTVAAAASSSSSGPLYPTPPPTEQTIERAKLEQVIKRLEKTARYFKNLGTLGFWSQLVCTFVSAGILSFSXVVTGKXTSPFTFYTTAAGVAAAFISVFWSXFGYIXRLSERLRKTASAPAKAPPRADVXLKVLKNGIVLNILGMGSAVLGVXHLLVLWIPKALTTSAVPYPYNLCTSQIPVLVLPVLRPSCGTRTPYCLLS

SEQ ID NO: 115640 - protein, 310 aa, Triticum aestivum
  Clone ID: PAT_TA_10058.pep
NSDEASLELPIPASDLPEVLLDRDNRQYSTTLGLFKQLPRAKGILSNTFEWLEPRAVKAIKEGIPRPGESLPKLFCVGPLVGEERGSNANHECLVWLDKQPAGSVVFVCFGSASSVPAEQLNEIAVGLEKSGHAFLWAVRAPVAPEADSTKRFEGRGDAAVDALLPDGFLDRTRGRGMVLSSWAPQVEVLRHPATGAFVTHCGWNSTLEAVMAGVPMLCWPMYAEQRMNKVFVVEEMKLGVALNGYDEAMVKAEEVEAKVRLVMESEQGNEIRQRMTKAQEIAANALEIGGSSAAAIIDLLDSLKISTND

SEQ ID NO: 115641 - protein, 82 aa, Triticum aestivum
  Clone ID: PAT_TA_10059.pep
GSSLTDCHHQSVPALQVVGFCSQDHPNQCRLSHHFFRPLGCHCHVHELELRALFFKSEQFVNTVISIRIRITYINLHEFADI

SEQ ID NO: 115642 - protein, 177 aa, Triticum aestivum
  unsure (1)..(177): unsure at all Xaa locations
  Clone ID: PAT_TA_10060.pep
EIAYTQQTTLWSRDRPSGAYRWTRGGGSRAPRAAGPRPPSAAGVRWRQEHVXRRPPAAAEPALERAEEAQKSTSMRGRRGGGARARQLRRPRQREKRGPAGGTNEKGAAVRGGNENDPGKDGGHRNGPGEDRQHSNGPGGTKEERISHGRTRSEVLAHVEDPTSCLIEHGPNDCWRE

SEQ ID NO: 115643 - protein, 103 aa, Triticum aestivum
  Clone ID: PAT_TA_10061.pep
SASSSSRIDIEAGTWQESYSSPRLRDRIRTGQQHLGYAIRQLDSIFSAGHNFLRKNPKAQVGAAVYLVCLHIWVMYILSSHPVVPDTRPGATFSLESINKTSI

SEQ ID NO: 115644 - protein, 110 aa, Triticum aestivum
  Clone ID: PAT_TA_10062.pep
QGGAGGWQQDKVVNPLFEKRPKQFGIGGALPPKKDLHRFVKWPKVMRIQRQCRILKQRFKVPPTLHQFTRTLDKNLDAGLHSSKVGCTGALGRRIPKKNHTQQCILAHWS

SEQ ID NO: 115645 - protein, 118 aa, Triticum aestivum
  Clone ID: PAT_TA_10063.pep
PLKRPHESQLQSCPEGTMRIAKKVCKSVAMAPQFKGSFLPKSGGAPFNLLMLPPDKISRGGPPRYMDNSDQDLLLEVPLNARQPEAELLCQPFQLSSVTRSSTSADVVADGEGRLKQP

SEQ ID NO: 115646 - protein, 135 aa, Triticum aestivum
  Clone ID: PAT_TA_10064.pep
RATQAEIGKIPHLPPPIASPPPPSVDPVADGPDPPGSAATVLDTLGEEVLAVMSPVSICMALVVLLITLLAPPSSSPSAPPPVTAATLVYLESPSDSPAQKLGGALLDAAVFVALVAVVTFILVALYYYRLHRLS

SEQ ID NO: 115647 - protein, 87 aa, Triticum aestivum
  Clone ID: PAT_TA_10065.pep
MQASDRFNINSQLEHLQAKYVGTGHADLTRFEWAVNIQRDSYASYIGHYPMLAYFSIAENESIGRERYEFMQKMLLPCGLPPERDED

SEQ ID NO: 115648 - protein, 128 aa, Triticum aestivum
  Clone ID: PAT_TA_10066.pep
VPLRGWQVLPRLERHPSSASNPPRPPPPPAGHLPAPFPLRRPPPAPGLPAPSAPPPPPAPPRAPAAGFPPPRPRARGPPSRSSAGSLPPPARDPPLPLPPRAASRSDSGVPSYICRVHRSYSGPQYAG

SEQ ID NO: 115649 - protein, 152 aa, Triticum aestivum
  Clone ID: PAT_TA_10067.pep
SFRLVHGRRSRAQDKPSLSLSCRRCSFWLRPRGLLLGLRLHLLPAKQRAGLVGDVVAGGAEPVLDAVPVRVGAGVRELLEVVLGGLQDGGVVARRLLGAHRRRRLLGPLLRLLPAVAHLHLLHPLPALLTLHHRRPNPLASPRLPTAHATSS

SEQ ID NO: 115650 - protein, 335 aa, Triticum aestivum
  Clone ID: PAT_TA_10068.pep
MASSSLLPPPTFANKHHALLHPHGARHRLIRCGAAPTDGGAGDELLTGALNLGRPDPVVATVVSDTGTDGWGDLFTELKRSLQADSSDPAASQATSMADRAFPANPERLMFGRALRGVAALTRAALVVKQVMRQLVTSLRRIHDTGIVHRDIKPSNLVVTRRGQVKLIDFGAATDLRIGKNYVPDRTLLDPDYCPPELYVLPEETPTPPAEPIAAILSPILWQLNSPDLFDMYSAGIVLMQMATPALRSPSGLKNFNSELKAAGYDLNRWRETTRRRPDLQILDLDSGRGWDLATKLIAQREKGRLSAAAALRHPYFLLGGDRAAAVLSKLQLTK

SEQ ID NO: 115651 - protein, 177 aa, Triticum aestivum
  unsure (1)..(177): unsure at all Xaa locations
  Clone ID: PAT_TA_10069.pep
PACVGRGERRPGAEDGRRRKRVVLVAVDDSDHSYRALEWAVRHVXDGRRTAAAAELVVVHAKPPASSVXVPSAALAAAGDVVRVVDAXDCGKRAEDVVDRARRLCVANSVHGLIEVMEGEARYVLCDAVDKHHADLLVVGSHGYGAIKRAFLGSVSDYCAHHAHCSVMIVKQPKTKK

SEQ ID NO: 115652 - protein, 100 aa, Triticum aestivum
  Clone ID: PAT_TA_10070.pep
NVVPVHAPDTLPVIFERGPDGVHHADHLFSRLKNRCKEPVSILVEMDRILRPGGWAIIREKLEILDPLEAILKSLHWEIVMTFRKDKEGIMSVKKTTWRP

SEQ ID NO: 115653 - protein, 183 aa, Triticum aestivum
  Clone ID: PAT_TA_10071.pep
MSQKAQKRIDDYTTLVKEKYPDNWEGRELDGELLYEASGGIPHGRVSIGDGVVKKEDIKSAARKRNASAPISLTLREKEQLRRANEENAELRGAKEMLQQKVDMHGQLITALFKEIGKELPAHILHILSHGAVSQPEGTNNSSQAGSQAVDGNNDVMESSEENDTTGNVGDQIVDAAANHGGN

SEQ ID NO: 115654 - protein, 233 aa, Triticum aestivum
  unsure (1)..(233): unsure at all Xaa locations
  Clone ID: PAT_TA_10072.pep
PRARPRPRSPSPAGGPGQLLQARVDIAMYSLPRAKARVDRAKRRLADPDEDPEAEAALVVKQAGDFVLECSEIGDDRPLTGCSFSRDASMLATSSWSGILKVWSMPQITKIATLKGHTERATDVAFSPVPNSLATASADKTAKLWNSDGSLLMSFDGHLDRLARVAFHPSGKYXLGTASFDKTWRLWDINTGTELLLQEGHSRXSVYGVSFHPDGSLAASCGLDANARVWDLR

SEQ ID NO: 115655 - protein, 203 aa, Triticum aestivum
  unsure (1)..(203): unsure at all Xaa locations
  Clone ID: PAT_TA_10073.pep
MATTPPPPPLPLLLLPLLLLAAFSAAEEFPRDGKVIDLDDSNFEAALSSIDFLFVDFYAPWCGHCKRLAPELDEAAPVLVGLSEPIMVAKVNADKYRKLGSKYGVDGFPTLMLFIHGVPIEYTGSRKADLLVRNLKKFVAPDVSTLESDSAIKSFVENAGTSFPMFIGFXVNESLIAEYGGKYKKRAWVAVAKDFSEDWMATY

SEQ ID NO: 115656 - protein, 199 aa, Triticum aestivum
  Clone ID: PAT_TA_10074.pep
MCELCSSRIYGPFEGRFLDPSAPRPLLPLTVPINTETLKLLDDDDRKVVLAILEDDSDVNSTHLVKVLRSAAHANRDLVFGYVGVKQWEEFVETFDVSKSSQLPKLLVWDRNEEYRLVEGSEKLEEGDQSSQLSQFLEGYRAGRTIKKKVSGPSFMGFMHSLVSMNSLYILMFVVALLGVMMYFAGQDDTPQPRRVHDE

SEQ ID NO: 115657 - protein, 63 aa, Triticum aestivum
  Clone ID: PAT_TA_10075.pep
SKRHLPDHLIEIDRSKNKILTASTGLTTLPAHARTHHGRIATIGGMGMASQAEEASALARRRR

SEQ ID NO: 115658 - protein, 72 aa, Triticum aestivum
  Clone ID: PAT_TA_10076.pep
ALSSTEFVGWFSETHDVFLLQHTVIHRCGNPVEWAHLSSYPSLTLISLYTLLGNSFGGTRHLTTLHLMGYIR

SEQ ID NO: 115659 - protein, 209 aa, Triticum aestivum
  Clone ID: PAT_TA_10077.pep
PASAHASDNMESRSTLHKVGTDMVSESEDRPREEEIIKSSISVGTSRSKISFESAEKHTTLPSGDASETENVSTDMLLRSLGKRKVLKGPRSSDDFPYKKPRMLASDIPFASHILNKHSTSEIGDTRPDIREFGGNQLDDPNKKTSNKDSCGGSPTSTTEDAARNTNKESSANNLFSSSREHTLSHWSTLERGLYLKGIEIFGKKSWLI

SEQ ID NO: 115660 - protein, 109 aa, Triticum aestivum
  unsure (1)..(109): unsure at all Xaa locations
  Clone ID: PAT_TA_10078.pep
QGDGAALRRAGKCGIKIPKEHNVQLCLMIPDGGCVMTCTYLDLLHALTKARQAPDEAQASHAICSDCCMIFRVYHLILIFIXTSWHGSSITLVSIVARLACGGAQCFFN

SEQ ID NO: 115661 - protein, 190 aa, Triticum aestivum
  Clone ID: PAT_TA_10079.pep
MAAAPNAFSAHLEKWIVEQIKDSIFFVNVFPNLNYKEDLENLMAAVKTVPVKKREEVLKQGQCGTGSVVGVTEDEITILSSAHLIEHVFTVSKPISVRDANTYFYTDVLCDHYEASFSEPGQRRHSERQYGAATIIGIDCAQDLLLISVPRVNIRNLARKCTSNHPPLTFSSVHQVALERTVMLSWPPLQ

SEQ ID NO: 115662 - protein, 124 aa, Triticum aestivum
  Clone ID: PAT_TA_10080.pep
TRVQGAVARRRRLRRVPAARQGRGRAGGPAAEGGGAGAEAGGARPAPGARGAGGRRGGGRPRGRGGSGRRGRGGGAPRARCTSRGRRAGCPGSAGAATTSATSAALRWRRATIVAASASVRGDR

SEQ ID NO: 115663 - protein, 74 aa, Triticum aestivum
  Clone ID: PAT_TA_10081.pep
NTQDDNWVSAASPERPVRGIDDPLLSGSTSDSGVLKGKKQRRVVSTVATADSWGGGDKTPDGYEIRGRRWAVKN

SEQ ID NO: 115664 - protein, 219 aa, Triticum aestivum
  Clone ID: PAT_TA_10082.pep
WSITSYTPSVRKSLSQHGCIKGIFLCNQKMDESFSCCSQVPWLHSSNGHWCGCCMKQCPLHLFVHAPFSEENLIQVVKVLANEIIGVLEKKWYSQQKAFLEVRYIWSTTCKIPPYTFSYTSFQFICFGSWRLPPLLWQLPTTLIRPECYSPASPAAFTLPRVALNTLSTIIPLQENIGDAPLQMLLGSRFLLEFPSLTSLSLVHDLALRRSCRITACNE

SEQ ID NO: 115665 - protein, 200 aa, Triticum aestivum
  unsure (1)..(200): unsure at all Xaa locations
  Clone ID: PAT_TA_10083.pep
MATTDDPTATGEVRRLLEHLDSQQQLLATCHEAWSRTLAHFASLDQDVASRSASVDEALAAADASTSESLAALEAREASVPVRLTEASDALSAALAEAEAESAAPPPADIHGALKWICRRMDAAALWRFMAARRKELATVRXXIAPTVAASVDPPRLVLDVLSDFLEAGESAGEDQCWVLGMLLRSLFGXXXRKPPXIGX

SEQ ID NO: 115666 - protein, 182 aa, Triticum aestivum
  unsure (1)..(182): unsure at all Xaa locations
  Clone ID: PAT_TA_10084.pep
VVRSPATLALDPLTPSPPALPLIVLCPPRHXNHHDPVILTLPSCNVVFILLRWGLTCAFTSGKINLGAVIFTAVGLFSFWTSYWCWGCRDFPCIFLPPFVFGALMVLXVFSLTXIFFSLGXISTHDIWGRGAASTYCGYIIXDTDNIIKRHTYDEYIWGLPCPSIATSTTCLLNLDAIPAGG

SEQ ID NO: 115667 - protein, 376 aa, Triticum aestivum
  Clone ID: PAT_TA_10085.pep
MPPSGPSLPLPWPTPDSGGRRILFAGAVEEAPEIPFQPRRGAPPTTALAWSGADRRPVQANIVQMSSKKVPFNRHKENEEARKKREEDEAARVYAEFVKSFEGESASGSKFVRGGVIDPNAKLRADSEGGNSKDRGSVPKKGSRYVPSFVPPSFGREPEKKKEDERPKEKEKGKPRAIDTVMVRLELEKELRERRNQERASRHGDTSMPSSRFDELPDEFDPTGRLPGSFDDGDPQTTNLYVGNLSPQVDENFLLRTFGRFGPIASVKIMWPRTEEERRRQRHCGFVAFMNRAEGQAAKDEMQGVVVYDYELKIGWGKSVALPSQALPAPPPGHMAIRNKEGGTVIISGPGGPPVASVAQQTSELVLTPNVPDIVV

SEQ ID NO: 115668 - protein, 143 aa, Triticum aestivum
  unsure (1)..(143): unsure at all Xaa locations
  Clone ID: PAT_TA_10086.pep
TLAAVPCILGVDLTGXKILRTFIQQLDESDGSSSIPAAVLRILNYKACRGAIMFGDPLLPSECSLIIEELKATSLCFQCAHGRPTTVPIVNVASLRRQLARLGAPSGRSEAEEPWHGLSQHEASLERARTRLRQLRRLRRGTL

SEQ ID NO: 115669 - protein, 145 aa, Triticum aestivum
  Clone ID: PAT_TA_10087.pep
RRVASRCRRRRRRRSRLRPQPQAPPPPTSSPASSATPSTRNPTLLPLPHARRCRDTSSLVSTMSRTTCNCPKCFQGTCDCLIRNALCCSGCNCGGDCQKDLSLGTINPAAAQGTTPTLASGSSAAQDTSQTQPLAPSSSTAQGIL

SEQ ID NO: 115670 - protein, 364 aa, Triticum aestivum
  unsure (1)..(364): unsure at all Xaa locations
  Clone ID: PAT_TA_10088.pep
WRRGGASIARSKNLDHYLDALAGTTALGKAGALSIPTAHVDVMWQVAEFYNNKXVLVEYKNKDADHVEWAKALKELYMPGLRDYIKKYYPLGPVWGPAGCAPPKAAAPTSKAPAAKGPPPPAAPSAPLFSTDKSPKSSQPKQGMSAVFQEIGGGKDVTSGLRKVTDDMKAKNRADRSGVVTSSAAAPAPAKTSRAGTFASKTGTPKLELQMGRKWVVENQVGRKDLAIDECDSKQSIYIYGCKDSVLQVNGKVNNITVDKCTKFGIVFKDVVAAFEVVNCNGVEVQCQGTAPTISIDNTAGCQLYLNKESLGASITSAKSSEMNVLVPSDETDGDWVEHPLPQQYIHFFQDGQFTTSPVSHSGA

SEQ ID NO: 115671 - protein, 174 aa, Triticum aestivum
  Clone ID: PAT_TA_10089.pep
AFSIQLIILATWKQAIHICNSYAASAARESPSHDITMKGLDTDAPHLLANSQMADEECTQIERQFLTEVEHAEELASTVGQIPDATAMPDAVELIFQYALEYGRHGGVVEMMGKAAVAMSRYTKAICLLRFLLIEAPSLALNPPLSLTRSDRHRLRSYIEALNARLSQLQCPSH

SEQ ID NO: 115672 - protein, 192 aa, Triticum aestivum
  Clone ID: PAT_TA_10090.pep
MARNPGCAVYIGNLDEKVSERVLYEILIQVGRVVDLHIPRDKETSRPKGFAFAEYETEEIAQYAVRLFSGLVRLHNRTLKFAISGQDKASSNVNVPVTPKMNPIPLSNPPQPMRFGDTPVSQHRVINGRIAGHGVSPNHSYDFHSQASSGVASRGLNDGTYEYSRRVFGSVMNDVSRRADQTTSSIPVLLAY

SEQ ID NO: 115673 - protein, 345 aa, Triticum aestivum
  Clone ID: PAT_TA_10091.pep
MEAFRKQASKFKEQVAKQQQAVIKQFSTTGYERSDSVVIDEVELQQHQRLEKLYSSTRSGRDFQKDIVRAAEGLVSIGSKHIEVGTKFSEDCYRYGGENNADGEALTKAASLYGGALRNVEKEYEDFNRTLCSQIIDPLKAMAVCAPLEEARGFAQRYSRMRHEAEILSAEIARRKARVRESPVAEHTTKLEQSEGKMIEHKASMAVLGKEAVAALGAVESQQKRVTLQRLVGMVEAEKLFYLRLAAILDDVEAEMSSEKQKRESAPPSRKRAEMAQYFIAEAVHNFNGTTEKELSLIVGDYVVVRQIAPNGWAEGECRAKAGWFPAAYVERRENIPPNKVFPQA

SEQ ID NO: 115674 - protein, 76 aa, Triticum aestivum
  Clone ID: PAT_TA_10092.pep
REGTMLHILKAYVPVYDSFGLSKAISAATSELVTPQCIFGYWSDMCSDPFQANAPAGQMVLDIRKRKKMGRPSFQK

SEQ ID NO: 115675 - protein, 102 aa, Triticum aestivum
  Clone ID: PAT_TA_10093.pep
QTPKDLKNGVTDVPLHNLLEVHVVQLIMDEEPIDDERQVLECVQREVDVCRLRELVAALHAHRLIVQDLNLRHGCFSLLYSMYDDVHLILYGISLTPLYLAF

SEQ ID NO: 115676 - protein, 414 aa, Triticum aestivum
  Clone ID: PAT_TA_10094.pep
DPEKNTRPKVSSNAAKRAKMQDTVVERDAIQDQVKLIGDGIDGVKKERQAVRSKIKVLDDEMRVVDGEIALLQEDLNAATARKDKAYESLTELRKARDLANASFHQNRIVLNRARDYSSRNEVEELQELHKTEVEKFMTQWCSSKTFREDYEKRILTSLNGRQLTRDGRMRNPDEKPIFIETQQPAAPVQQEPIPSKAPLKQAKEAGAPQVVAPKEEPLAKASAKSAKVKAAVDADDDAYEAEPPKEKPKPKEVDVAKLKEIKRQEEIEKNRLALERKKKQAEKQAAKAAARAQKEAEKKLKKEEKKTKKKTEADTDEPTDSDTKSDEAAETQAEDEFTPVSVVNKEQKQNTRTRNVVTKTKAPLPKAILKRKKAQSYRSWATPAVMISAVTVLVALLAALGYYQYYRPASTSN

SEQ ID NO: 115677 - protein, 122 aa, Triticum aestivum
  Clone ID: PAT_TA_10095.pep
MDPDSVAKAFVEHYYRTFDTNRAALVGLYQEGSMLSFEGEKFQGAAAIATKLTSLPFTKCAHTVVTVDCQPAGPTGGMLVFVSGSLQVDGEHHIKFSQMFHLMPIGPGNFYVHNDMFRLNYG

SEQ ID NO: 115678 - protein, 128 aa, Triticum aestivum
  Clone ID: PAT_TA_10096.pep
LGRFPGRNKSISHSLTSPAAAAAADGPRLSGEGVRRAPLLHDRHQRGGAGGGLSWGGTRTPSRATSSREPPPSPPSSPPSPSFTTVPFPQVRPTPSPRRTPSPPAPTGGLLALRLRRASQLDRRSTAI

SEQ ID NO: 115679 - protein, 166 aa, Triticum aestivum
  Clone ID: PAT_TA_10097.pep
NDADQGSADVAYRTPPAPYEKSKSTTGAKIQFGKLAMEILCGQRCIQAELPAHLKGKATNAYLGSQKDAVSLRQSIIRGHGMYNFLVRVLTVMSMLDSKVAIEQGNCVKFFMATEFCEFSPEIEDHFEIFETIGGFNVTIVTTACSKEETSLLWSGFLLKDEGEIS

SEQ ID NO: 115680 - protein, 297 aa, Triticum aestivum
  Clone ID: PAT_TA_10098.pep
CFLFPLLWRRTGRIDVAVWRLNTRGLQGHKQWLAEVQFLGVLEHPNLVKLLGYCAVDGERGAQRLLVYEYMPNKSLEDHLFSRIHPALSWNRRLQIILGAAEGLAYLHEGLELQVIYRDFKASNVLLDKDFQAKLSDFGLAREGPTEGNTHVSTAAVGTHGYAAPEYIEKGHLTAKSDVWGFGVVLYELLTGRRSLDRNRPQGEQKLIEWVVQFPPDSRNFRMIMDPKLRGEYSSKAAREIAKLAQSCLLKNPKERPAMSEIVEVLRRAVQTEQAYVDKAPVAGNGKRVNVAPPSRR

SEQ ID NO: 115681 - protein, 151 aa, Triticum aestivum
  Clone ID: PAT_TA_10099.pep
KKLRATNVKIDVITFSTMISAMFKTRRIEEAKDLFATISAIGLVPSVVTYSLMMTNFIKEGLLADADDMFLAMEKAGCAPDSRLLNQVVRVFLKNGEVVKAVTYLAKLDAKQLSVEASTISLIVSLFSRKGKLREHVKLLPVKYQPPEMLG

SEQ ID NO: 115682 - protein, 556 aa, Triticum aestivum
  unsure (1)..(556): unsure at all Xaa locations
  Clone ID: PAT_TA_10100.pep
MAQPSQEAIETFISITGADEAVAARKLEEHSGDLNEAVNAYFNEGDRSTTRINQNPIPDSHDDIMDLDEPFDPMFTRSMGNPFGILDPSFVERAAAGFFGQGPQVTHPRDVRQIPIEVKDTDNPQIGSSGQGPVIEDVTGRESLYGLEVHGTVVIDEDDDDLPSTHAPVIPRNTPSTYSSAPSAPPLVDVSDYNNDIEEEMIRAAIEASKRDAEGLTNVAERERVLLQEGMHAVDNSSDLSDKEDIEGASEAVERQVLTTGQAGTSRQLVDEENFQDDIEDVDEEPLVRQRSRRVLSGTAGPTEAVQRAESPPSGPQPHGTENAHQHNGAFPSEWGGISSEEHDEAVMLEAAMFGGIPEHTEYPFPLPSHGISTGYPRIAHPPSPTLTAQRLLREQQDDEYLAALQADREKELKAVEDAELRRLEEVAAREAAIEMEKQKNEEKLRKQLEEEELESMLAAKRASLPKEPLPNPEGAVTVVVRMPDGSRQGRRFSKSDQLQDLFDFIDISKSFMPGTYXLVRSYPRRAFTDEECQMSLSDVGLTSKQEALFLEQISG

SEQ ID NO: 115683 - protein, 131 aa, Triticum aestivum
  Clone ID: PAT_TA_10101.pep
RSGIEIHYKRLIEEDPCNGLFLRNYAQFLYQVKGDRRRAEEYYSRAILADPNDRELLSEYARLVWEVHGDEERASSYFHRAARADPHNSHVLAAQAAFLWDTDDGAGPEDDDATSYAGFLAAHPSMASATS

SEQ ID NO: 115684 - protein, 185 aa, Triticum aestivum
  Clone ID: PAT_TA_10102.pep
KKKKRKDEKKDLGKKAAVTNSWGKYGRGREVDMWNKRPEFTAWLLEVKQVNLEALANWEEKQMFKEFMEDHNTATFPSKKYYDLDAYHQRMMEKEKRNGLKNAGSVAVRTVFNDEEVRRLELLQERERRKEEEVTALKRSMQTGMAQAMKQQSLLREEMMLQYKLGNFEAAAAIQKRLDPDAPPQ

SEQ ID NO: 115685 - protein, 222 aa, Triticum aestivum
  Clone ID: PAT_TA_10103.pep
IIRELLLDFYKTSQQRKPAHIIIFRDGVSESQFSQVLDLEVDQIIKVVVGTWHGNLCFLEMLLYRILMMQAYKNMDQGALPKITVIIAQKNHHTKLFQADAPDNVPPGTVVDSGIVHPKQYDFYMCAHAGPIGTSRPTHYHVLLDQIGFSPDDLQKLVLSLSYVNQRSTTAISVVAPICYAHLAAAQMSQFMKFEEFDDSSTEVVPELPRLHPRVSSSMFFC

SEQ ID NO: 115686 - protein, 161 aa, Triticum aestivum
  Clone ID: PAT_TA_10104.pep
RLKLIANIVKGPWIVRKAVGEQAICILGRALSCKYVEGSNFIEVDVDIGSSIVANAIVHLAFGYVATLTIDLAFVIESQAESELPERLLGAVRFSELSPGSAGVYEVPSEEQQEIAPILPSRLWRSFSQLLQNPGNSMQPSPSSENTNGNFHKEDAGNNDN

SEQ ID NO: 115687 - protein, 147 aa, Triticum aestivum
  Clone ID: PAT_TA_10105.pep
CMAEYLSTSHLHKNGRVSIPKVRRIRYMTIDIYISYSKSNEFSRKNLANLTIHSLINSHKATYFITTGSRSRHPQPELGVLAGDLTVTSPSAGMLAPPLLFFVANAKRGASVGRGPPPRGVLVRLGTSAKKMSDCLDRVVFTRSLAD

SEQ ID NO: 115688 - protein, 189 aa, Triticum aestivum
  Clone ID: PAT_TA_10106.pep
EGMLYVIDEFNDLLAINVREDNDNGKLRVPRIERLLDGAPCVLKLIQGGISYFESYLVESHGALLLVQRTIFGECDNDTIGGIKPVGIEFEVCQSDFQSQSWVKVSSVGDDQTLFVSQSSSQSVDVSQYKLKGDCIYFLDDGSCDWFWKDAPSSCAVYDMRDGHCFFIPLPTVGCKDVKMLAAWLFPQS

SEQ ID NO: 115689 - protein, 203 aa, Triticum aestivum
  Clone ID: PAT_TA_10107.pep
HGARSESLRESPLRVACSFPDPARSPISDDGDAGRTRDGRGVWSSVNSRSRIRSSLAQVASGAWWLASAFLMVVVARCCVQPEKMTAATPSISSLCFLLRWRPGCSSLSFQAIVVVDGGRRRGGELDYAVWEGAHPQWCLRRGNGARFGCRQPVLTISPLNMLAEGRPFLFLPAWCLDGRQLISESESKASCSAVLCYGRSSC

SEQ ID NO: 115690 - protein, 230 aa, Triticum aestivum
  Clone ID: PAT_TA_10108.pep
IESCPSGVWRYAVVERAAGARELRLVASVGVSDGCGGEVLRATGGNDGGDSFNKLVVFPVKVEARLLFPFFSSHRGGGWRKKERRRAGLCSLGRSSSSMGLRRGNGARFGCRQPVLTVSPLNMLAEGRPFLFLPAWCLDGRQFISESESKASSSAVLCYGRSSCGGPDVPSANVPGDDGIGSGWEMIWTRLHFLFPVRGPPCKKQGLVCNFLSFVCPVVNYGVLVLPIYG

SEQ ID NO: 115691 - protein, 431 aa, Triticum aestivum
  unsure (1)..(431): unsure at all Xaa locations
  Clone ID: PAT_TA_10109.pep
MGVYELVRSEDAAGPALDLEAGRCGPAPPAKASPPAPRQQRLVSLDVFRGITVLLMIIVDDAGSFLPAMNHSPWEGVTIADFVMPFFLFIVGVALALAYKSVRGRVGATRKATLLALKLFCVGLVLQGGFFHGVRSLTFGVDITQIRLMGILQRIAIAYXVTALCQIWLKGDDDVDSGLDLIKRYRYQLLAGLLITITYMVLLYGTYVPDWEYRISGPGSTEKTFTVKCGVRGDSGPGCNAVGMIDRKILGIQHLYGRPVYARSQQCSIDSPQNGPLPPDAPSWCQAPFDPEGLLSSVMAIVTCLIGLQYGHIIVHFQKHRERIMHWLVPSFGMLVLAFAMDFFGMHMNKPLYTVSYTLCTAGAAGLLFAGIYTLVDLYGYRRPTIAMEWMGMHALMIFVLIACNILPIFIHGFYWGEPNNNLLKFIGIRA

SEQ ID NO: 115692 - protein, 102 aa, Triticum aestivum
  Clone ID: PAT_TA_10110.pep
GIMRQIVIEECHDLGIPVREVSPSWSKHELWEEAFVTSSLRLIQHVGTVQAPLLWEDIETKTWRDVSWAVKQFQGAGHITTLIQRKISERAITEEYDINYFL

SEQ ID NO: 115693 - protein, 476 aa, Triticum aestivum
  unsure (1)..(476): unsure at all Xaa locations
  Clone ID: PAT_TA_10111.pep
MARSGSRSGASPCDLDKEFAPQIAQLLAAPSPQSAQEYYEELIQSKKHDGIRVNYKGDHGKGVCANKDFAEGDLILKDQILVGAQHSLNKIDCVVCSYCFRFIGSVEFQIGHRLYFQSIASSIGCSSERHCHGSDVGSSTCSSGVTKEKSSTLPEEVIESLITGDVSLPFSDHFPLPEIVACQGCEERXYCSQSCADSDWESYHSLLCAGPNTEPPRRSALXKFVEHANETNDIFLVAAKAITFTMLRYKKLKRQNDFQNKSPESNFSLLMEAWKPLSMGFKKRWWDYVALPEDVDASDEDSFRQEIRDLAFTSLQLLKDAIFDAECAPLFSLEVYGHIIGMFELNNLDLVVASPVEDYFIHIDDLPDDKKEEAEKATAPLLDALDDDYAVPCDGTAFFPLQSCMNHSCCPNAKAFKRDEDNDGHAVIIALGPISKGEEITISYIDEDLPYEERQAELADYGFTCTCSKCQEEKPN

SEQ ID NO: 115694 - protein, 70 aa, Triticum aestivum
  Clone ID: PAT_TA_10112.pep
KVNSNSDSSSLQNRWMRHEGWWCVATQGGSGKWPLDEDPTVDDEPGWFGASPWVLNSSVNNMTSIDFFGR

SEQ ID NO: 115695 - protein, 237 aa, Triticum aestivum
  Clone ID: PAT_TA_10113.pep
KDEETWRTVEKVQELAKAELAAALAKEKASQIEQIAEADLNIDALCMAFYARSEEARQSHSVHKLALGTLALEEALSSGSPIRTEVDQLRKSLEGIDKDSLLELALSSLPEDVLKYGSDTRMELKQKFNSLKATIRHFGLIPSGGGGILTHAVAHVASNIKVEEDPSGDGVESLISRVEDLIVGGDLTAATEALTGGLQGTAAEEAAAEWVKQARKRAIAEQTLTLLHSYASSITFS

SEQ ID NO: 115696 - protein, 171 aa, Triticum aestivum
  unsure (1)..(171): unsure at all Xaa locations
  Clone ID: PAT_TA_10114.pep
LQNDKSKIKKVIEELDEKKKETLKVTRRTERRAAGPVWCDCHSGTIARQKRARLGICLGXGGPGAGRGAECRQSATGPCGGGRSHSCVSVRGGVRRLQRAALDEIYEGGGACDPNRPDNMGMMVMAGLKGPVVIVLGMKRDKSSNCEVSWRRRCGGGVQTEARTVPWKAGG

SEQ ID NO: 115697 - protein, 242 aa, Triticum aestivum
  unsure (1)..(242): unsure at all Xaa locations
  Clone ID: PAT_TA_10115.pep
SSGRPGRYKASGIXXDSGDLAYLSIETRKVFHAIEKEFNIPGFGKMIITASNDLNEETIDALNKQGHEVDAFGIGTYLVTCYSQAALGCVFKLVEINSRPRIKLSEDVAKVSIPCKKRCFRLYGKEGYPLVDIMIRESEPSPKAGERILCRHPFLESKRAYVVPQHVEELLHCYWPGSSDKPRAELPPLLKIRSRCMQQLEKLRPDHIRRLNPTPYKVSVSAKLYEFIHYLWLNEAPVGELQ

SEQ ID NO: 115698 - protein, 291 aa, Triticum aestivum
  Clone ID: PAT_TA_10116.pep
IRHEVFTVNIYPFISLYIDPNFPAEYAFFDGRSQPVVDGSATYTNMFDANHDTLIWALKKNGYGNLPIVIGEIGWPTDGDMNANAQLAQRFNQGFMTHIATGQGTPMRPGPIDAYLFSLIDEDDKSIQPGNFERHWGIYTYDGIPKYQLNFGVPNSQIKRASGVKYLDKKWCVLKPTVSLDDPKLPDTVSYACARADCTSLGYRTSCGMLDTRSNISYAYNSFYQKNDQDDVACGFSGYATTTGQDPSTGTCRFGIMIEVDSAYSWKPRRVRSNYLLVLLLALVHLCVSSS

SEQ ID NO: 115699 - protein, 668 aa, Triticum aestivum
  Clone ID: PAT_TA_10117.pep
MPVLRSAARRAREAQENPAAAAAAEAPVVPPAPGRPMAVPWQGARSVHEAAGAPEEWAAAEEIAPAEGSGERAGEEPMDDQDSADKQAGEDASPIPETLLVALAPWYPGEGVLGKGGFGQVYVGRRISANAPGAVEVALKFEHKNVRGCNHGPPYEWQVYDILGGIHGVPRVHYKGRQGDYFIMVMDMLGLSLWDACSNNSHTMSVEMVACIAIEAISILEKVHSKGYVHGDVKPENFLLGPPGTPEEKKLFLVDLGLPTKWKDRSTGHHVEYDQRPDIFRGTVRYASVHAHLGRIGSRRDDLESLAYTLVFLLRGRLPWQGYHGENKGFLVYKKKMCTSPESRPSFCPQPFKEFVEYVVNLKFDEEPNYAKCISLFDSIVGPNPDIRPINTDGAQKLIHQVGQKRGRISLEGETDEQPKKKVRMGMPATQWISVYNARRPMKQRYHYNVADSRLVQHIDKGNEDGLFISCISSCANLWALIMDAGTGFSSQVYELSPHFLHKEWIMDQWDRNYYITALAGANNGSSLVVMSKGTLYTQQSYKVSDTFPFKWINKKWRDGFYVTSMATAGNKWAIVMSRNAGFSEQVVELDFLYPSEGVHKRWDSGYRITAVAATWDQTALILSVPRRKPTDETQETLRTSAFPSQHVKEKWSKNLYLASVCYGRTVS

SEQ ID NO: 115700 - protein, 402 aa, Triticum aestivum
  Clone ID: PAT_TA_10118.pep
AFAAGGIGSRDLGPRTRVYAVRGRARLGDAAREGAGVEDMGKVGESLFGPYEWERFDLLVLPPSFPYGGMENPRMVFLTPTVIKGDAAGAHVVAHELAHSWTGNLITNKTNEDFWLNEGFTTYAERRIVEVVQGEERAALNSGIGWRGLNRMMERFKDNMEFTKLKPKMAGIDPDDVYSEVPYEKGFQFLWRIERQIGRPAFDEFLKKYIANFKFQSIDTETFLEFLRANVPGIENQVDLHEWINGTGLPPDAMEPESATYKKICVLAAEFKSGKIPSEEEVADWSGQEWELYLENLPTDVEASQVTALDERYKLSESRDYEVKVAFLQLAIPTGCRCYFNEVEKCLKQVGRMKYLRPLYSSLARCSGEEEKMLAKRIFSEAQEFYHPIARGVAESILLKHG

SEQ ID NO: 115701 - protein, 130 aa, Triticum aestivum
  Clone ID: PAT_TA_10119.pep
WARKWRNDGHRYPVGVDPWLGTPAGRRRPDPWNRKNSSPSPPHPATSQGQHPKDLCRRAKEHPEIWLMEFVMQPIQRSPLSEEADGSVAPMDLLAFGTVGSLREVDEATAAALSEDPRIYEEETSVDSRR

SEQ ID NO: 115702 - protein, 260 aa, Triticum aestivum
  unsure (1)..(260): unsure at all Xaa locations
  Clone ID: PAT_TA_10120.pep
VMTTKVLPDIKTAEAEYADLQQRQQEYFKKASIICSESDMEALSHVAGSTPEQLSAKINXLKQRFDQESRRYAESIDDLRALHDKKERKILRKQQLYAGFRVKLNSCQKALDLRWKKXQRNAGLLKRQLTWLFNEHLGKKGISGFINVDYKSKVLSVELTMPQDASRDTVRDTRGLSGGERSFSTLCFTLALHGMTEAPFRAMDEFDVFMDAVSRKISLDTLVDFAVAQGSQWVFITPHDISMVKPGDRVKKQQMAAPRG

SEQ ID NO: 115703 - protein, 399 aa, Triticum aestivum
  Clone ID: PAT_TA_10121.pep
MDSALASAAAIADQRQKIEQYRHILASVISSSPPDIPQAKRFLNHMVSDEVPLVVSRQLLQTFAQELGKLEPDSQKEVAHYALTQIQPRVVSFEEQVVVIREKLAELYESEQQWSRAAQMLSGIDLDSGIRMLDDTNKLSKCVQIARLYLEDDDAVNAEAFINKASFLVTNSNQEVLNLQYLPGRPRILDLKRKFLEAARRYYGISQIEQRQIGDEEIDENALEQALSAAVTCTILAGAGPQRSRVLATLYKDERCSKLKIYPILQKVFLERILRKPEIDAFAEELKPHQKALLPDKSTVLDRAMIEHNLLSASKLYTNISFEELGTLLGIDPRKAEKIACRMICEDRMRGSIDQVEAVIHFEDDTEGLQQWDQQIAGLCQALNDILDSMSSKGIAIPV

SEQ ID NO: 115704 - protein, 51 aa, Triticum aestivum
  Clone ID: PAT_TA_10122.pep
LVEETFFVACSAHESRKKNEKNIFCLACRTSICPHCAPAHRHHPLIQVQRE

SEQ ID NO: 115705 - protein, 188 aa, Triticum aestivum
  Clone ID: PAT_TA_10123.pep
ERLISEGAIYVVVPGNPPNGCSPIVLATRSSLSKMEDYDHIGCLRDINHVARYHNFVLREALGHLKGKYPHARIIFADFYNPIISILENPSHFGVADSDALRACCGGGGEYNWNTSAICGMPGVTACKDPTTYVSWDGVHYTEATYQYIANGWLYGPFADPPIMSAISYTQEDLIKNITSNIRSSRIY

SEQ ID NO: 115706 - protein, 217 aa, Triticum aestivum
  unsure (1)..(217): unsure at all Xaa locations
  Clone ID: PAT_TA_10124.pep
PISVYGILAVRDDLDQRRNYLFNCPRDTAVEIVNQESFDLPLCSPCRGIYVLDEALLEVDLWVKXEGDGSADKHILSAYAEIEVRXILNIMLGGRIPGXDCNLDLTYMIIARSIEAVVQVYAEVDHPHHVKFTALSTGYDDEIVLFDDKISGSVKLFQHIVAVKRNENLDVLLRVDESLFQWTFHDEYVGPVSSPDDSILQYGQFFVRVLFAPKNSA

SEQ ID NO: 115707 - protein, 55 aa, Triticum aestivum
  Clone ID: PAT_TA_10125.pep
NQPQPRRTYQEQDLSSVLKEENFEGSSSPRMPSEDIYGRSQLGIIFPCAVKNLSR

SEQ ID NO: 115708 - protein, 151 aa, Triticum aestivum
  unsure (1)..(151): unsure at all Xaa locations
  Clone ID: PAT_TA_10126.pep
TVRWGNPVVKYDLGKNFLSMIDPPAEDVYYVSLMVMENSSLGFACTRDSSLYMWSRKVDTEEAADWVQCRVIELEKIIPIANPDDEPCVVGSAEGVGVIFISTDAGLXFMINLKSGLVRKVGEAGVYFSVLPYMSFYTPDRGRLLSLARTN

SEQ ID NO: 115709 - protein, 54 aa, Triticum aestivum
  Clone ID: PAT_TA_10127.pep
SNLNITQPKTLHSSEHYTSKVCNKLRSHTHTHTHTHTERERERERESNQIHIQR

SEQ ID NO: 115710 - protein, 95 aa, Triticum aestivum
  unsure (1)..(95): unsure at all Xaa locations
  Clone ID: PAT_TA_10128.pep
GXALYALXGYDGDQMMSTVEIFDPRANSWRIGSPFSVPRGYGCAVTADDNVYLIGGSESNGETVETVEVYNERQGWTIPGYKAIGKRAFASAIVV

SEQ ID NO: 115711 - protein, 136 aa, Triticum aestivum
  unsure (1)..(136): unsure at all Xaa locations
  Clone ID: PAT_TA_10129.pep
PSVRPASGLDEHIVIHMXGVNILAVNYGSVGGCQYPRPMKVPSKWTFNSYTILKTADQAPRTPSFVEQLIETESGLGEVMKPPEKSFWAKYWMYIIPLGLIVMNAVTAAANIPEEQAGGQGQAPAQRVPIAAPRRR

SEQ ID NO: 115712 - protein, 303 aa, Triticum aestivum
  unsure (1)..(303): unsure at all Xaa locations
  Clone ID: PAT_TA_10130.pep
MAARRRSLLMLPPLLLLLSHFLSLAAAFQSDELLLHDDDEFEGTRASSTPSLRPPSTPPVVSSRRRSADATQAAGASESNTVQFTLEHDLGAGLGFGPAGSFSARLKSSAHGSQTLTKLRFTRNELTEDEKNAFKKLLEEDSFYTIRLPSNVLDPTRNDYIYSSIKAXRCIPRDSLDEHIVIHMHGVKILGVNYGSVGGCQYPRPMKVPSKWTFNSYTILKTADQAPRTPSFVEQLIETESGLGEVMKPPEKSFWAKYWMYIIPLGLIVMNAVTAAANIPEEQAGGQGQAPAQRAPIAAPRRR

SEQ ID NO: 115713 - protein, 79 aa, Triticum aestivum
  unsure (1)..(79): unsure at all Xaa locations
  Clone ID: PAT_TA_10131.pep
MAVNRSDMIRTSDMWFWIMVGLKICDLQGNCKLKICGLGLARFASSDTPTTVFWMEQDHVATXWYRADELCNVLSSPED

SEQ ID NO: 115714 - protein, 154 aa, Triticum aestivum
  Clone ID: PAT_TA_10132.pep
RAAARAGTLLLICQKEHTVINRTSTFTEVGITISLMAFRNNFCGTKRVTPQLQSTVNGFTLSGARKIGSTDENAHTGRPSSMGSGKVFCTWRAKPFSVKPFLFWEPLLGKPCGICNPDPPHFSPAVLRPFILPLWGPLPPPRPRQNNQSCNQDM

SEQ ID NO: 115715 - protein, 84 aa, Triticum aestivum
  Clone ID: PAT_TA_10133.pep
LPPPVLPTPSRPTKNAKQSSQHCTSRPPHSHRCPPIPLPAPPSPSRDLSLPPRAVWAVRTPAIPPVPSAPAPAPATHTMQSHWI

SEQ ID NO: 115716 - protein, 116 aa, Triticum aestivum
  Clone ID: PAT_TA_10134.pep
TSFAHSNISESAPAENVIFIIGNLLLGKNLSNHFIGSSVSSKAHANFPLFVVCKKPWVFLGFIVQSSTTETSRWKLGRAPLRRMFVDDIIIGASHTMPLMCQTLPNGQRRLRQFLV

SEQ ID NO: 115717 - protein, 359 aa, Triticum aestivum
  Clone ID: PAT_TA_10135.pep
NFNSRFKLTLNKLYAWSLVSYDRVVMLDSDNMFLQNTDELFQCGHFCAVFINPCIFHTGLFVLKPSMDGFKNMLHELAGGRENPDGADQGFLASYFPDLLDQPMFHPPVNGTKLDGNYRLPLGYQMDASYFYLKLRWSIPCGPNSVVTFPSAPWMKPWYWWSWPVLPLGLSWHEQRRENLGYSSEIPMALFQALLYIGVIAVNRLARPSLSKLCYNRRMEKSTMFLLTTLRVVAAWSILAAYTIPFFLVPRTVHPLLGWPLYLLGSFSLSLIVINFFLLHPLAVLTTWFGIIGTLFVMACPWYTNGVVRALAVFAYAFLCAPVVWASLVKIMSSLQVLIERDAFRLGEPNQTAEFTKLY

SEQ ID NO: 115718 - protein, 194 aa, Triticum aestivum
  Clone ID: PAT_TA_10136.pep
RSTASIGEDNADDGPYFNRKGGMNELSEDEIRLKARKEIAALGVQLGKMNIASWASKEELELVSATPSIADLERMKQEYATRAAAFEDAENSKHTARFKKEELKIEAWESRQRTKVESEMKRLEERAEKMRSEAMARMAERLELARRVAEEKRASANAKMNKQAARAVQKADLIRQTGRIPGSRILCCGCFCEP

SEQ ID NO: 115719 - protein, 70 aa, Triticum aestivum
  Clone ID: PAT_TA_10137.pep
CNINLVLLGTYVIAKDPHSNPFRVWGNEIFMNQHQVRKLIKIVTKMGQKMSIELFVYTLCKTKGELQDGK

SEQ ID NO: 115720 - protein, 74 aa, Triticum aestivum
  Clone ID: PAT_TA_10138.pep
MPGFLAPPFSAVPAGPAPPPPNPVLPWFPWYYQHDNPITGSTASASSPPAVHRGTTCMVALLLQLCLAILLRAP

SEQ ID NO: 115721 - protein, 191 aa, Triticum aestivum
  Clone ID: PAT_TA_10139.pep
FAISRLKLSSRWDEEEKLEQFSSFITPNNPGFGQHSARGYSVVPHKQLQEDLVANRGGIVGGTNNLCQVSLDNNSVQVFDIEDDMPIEGAGFDSSKAKNEMICSSMDVIMHPGIHTDDLPVIEDGYNLTLSDYLAADIPCYTSLRPDLQAGICTNDSEGIPVMDDPIYGSLTDIGFMDVWSQPAEDFEKFF

SEQ ID NO: 115722 - protein, 95 aa, Triticum aestivum
  Clone ID: PAT_TA_10140.pep
VEKYNSVVNMWRRVAFMSRGLRYGDAVKLMSSLEEASNGFSHAVNSTISSLHPAKCARQRKIDVQLDMTTIPAFIVVFGLLWFLLRPRRPKPKIN

SEQ ID NO: 115723 - protein, 94 aa, Triticum aestivum
  Clone ID: PAT_TA_10141.pep
RSEAKRWSEGRDPVETAALQGQATWFRKGLIGDRQNQIAVSEVVYITEGFYSTIPIGFVLVAFCPIYIAVDLGWWIWVVDKLQSFFFPSVLDLS

SEQ ID NO: 115724 - protein, 252 aa, Triticum aestivum
  Clone ID: PAT_TA_10142.pep
WSPKAGDAEKLGDGWHSEEGPHSDFSGPTCGSTACVAIIRNDQLVVANAGDPRGRISSTGQARDLSRDHKPELQSEKERIENAGGYIVAGRVNGSFNLATAVGGPEVVENKLLPAEKQTVSAEPEVNTVTLSEDDEFIVLACDGIWDCMSSQQVVDFVHEKLKTEDSLSAVCEKVLDRCLAPESGGEGCDNMTMILVVLKKPTDPAATSSSEQSPVTPTKSAATASSEQSAVTDEEMRPSEPDAPETPSSSK

SEQ ID NO: 115725 - protein, 124 aa, Triticum aestivum
  Clone ID: PAT_TA_10143.pep
RPWVVKHKTPYVVALANPCRGVAGHLHMPGVHVSNQSSVWIRIDTFTRHQMQQQHTASCHEQIHFAEVMGRRHAESSWVTIKLTMHQDLETFTSKKSNAAADGLSVTSKSRAVGVAYVPQQTIV

SEQ ID NO: 115726 - protein, 152 aa, Triticum aestivum
  unsure (1)..(152): unsure at all Xaa locations
  Clone ID: PAT_TA_10144.pep
SGHQHTGHRRNCRLDRYVARYGEFSYNSTKWRPSVPCVDQXESFQELIGKGKVQYIGVSNETTYGVMQFVHAAKLDGLPKIMSIXNGYSQLVRCSFEGETEMSAIIYSFSFTGIPCHPCCSETYLQTCNLEKEGGKNSSVVVQIIGLLSSLS

SEQ ID NO: 115727 - protein, 104 aa, Triticum aestivum
  Clone ID: PAT_TA_10145.pep
PSLVFGYFQPRAVSYKGISPGVAAECSTLGGLKCTYPVQKIIGPSLCGLGGLKLITHMHLESCSSVKDTMLDMSSSSSCWVAHMHLESCSSVKDTMLDLSSSSY

SEQ ID NO: 115728 - protein, 160 aa, Triticum aestivum
  Clone ID: PAT_TA_10146.pep
KLTLSSFLILWVVIPVVTRGCSLQPSMNTSTRHILKYLTGEAKAYVNESHAYVHVKDAAEAHVRVLEAPNAGGRRYVCAERTLHRGELCRILAGLFPEYPIPTRCKDEVNPPKKGYKYTNQPLKDLGMKFTPVQEYLYEAVKSLQEKGFIHQGFWHQGAC

SEQ ID NO: 115729 - protein, 189 aa, Triticum aestivum
  Clone ID: PAT_TA_10147.pep
ESTCEADKFNQQCSAESSHLFIVLTRDERLASSHLGRSNQQHSALLCLPSFLSFLLVFFLSLILPRFFSGARRSSHGAASEKPGALQGPAATHLDSAAIARPSVAALCRRAAYRPAGSLSRSDPDRLGDADGLTQPADSPLFSSFISERSSRLAAPPSAASPSWLPPAIRIKYSKIQGLFCKNESFFSD

SEQ ID NO: 115730 - protein, 111 aa, Triticum aestivum
  Clone ID: PAT_TA_10148.pep
PKRPISVDDIEVFKFEEFDDKDTPLMPKSEHQPKVKKPKAASASKSVKGPCVDKNATRLMRGMPSARRKGLLDCMISQQNVAQEPRRGSRSDPLGKKKTSAATELVSVLQY

SEQ ID NO: 115731 - protein, 111 aa, Triticum aestivum
  Clone ID: PAT_TA_10149.pep
VRGNGISDSKKMASEVNGTVETSWRKPHYANVVSQGSSGPARRLTVLTRELTSTDTRSKVTGQVGSWISSKAAGQASSSISSTDTRFKAAGQVVSLISSTNTRSKVVSNSS

SEQ ID NO: 115732 - protein, 240 aa, Triticum aestivum
  Clone ID: PAT_TA_10150.pep
EKTVMQNPEILLYCQAGRLLNPSTFAGWFGRSLYHAIVIFLITIHAYANEKSEMEELSMVALSGSIWLQAFVVTLEMNSFTFLQLLAIWGNLIAFYVLNFFISSIPTSGMYTVMFRLCRQPSSRIALLLISGVGMGPVLALKYFRYTYSPSAINILQKAERSRGPMYTLVNLESQLRSEKDNSTNASLTAPVKNKNSVYEPLLSDSPMASRRSLASSSFDIFQPAQSRVPAAYPRNIKTS

SEQ ID NO: 115733 - protein, 82 aa, Triticum aestivum
  unsure (1)..(82): unsure at all Xaa locations
  Clone ID: PAT_TA_10151.pep
VYIYIYPKKGASLYQQVKKFLAKQACRVCQFKYSTAPQHVQDLQSWKRWCPKYHLRVNHHIKRPAYCAPRYFCCXWGHCTKN

SEQ ID NO: 115734 - protein, 160 aa, Triticum aestivum
  Clone ID: PAT_TA_10152.pep
GTSPGEVFINESPTKCWNMVRERLNMEIRRQLSMGRPNVPTLQPPGSIDGLEMFGLLSPEIVAGKFAGNLFPKPLRAIEARDRDRICTEYWRYRPHAATSNQHTLPQNPPSIVLRGLFQRASPDELRALRSLLASNTNLDDRSRQQATHMLDEEIAKQWR

SEQ ID NO: 115735 - protein, 204 aa, Triticum aestivum
  Clone ID: PAT_TA_10153.pep
DVALEDKEDLFWQQGVLIIRTIYHGAMEALPSSLTLRKKILEILNSVELAHSEELRLEASDDLKKDFSHNEDYWDWLARLQLSDSTNSSTLNRKEAVLDKLNKSIQVYDEAVRKLPTSKMYSLYANFWLGVVFSDREDSISLFHDADFDASEFTSAILKVFENAESCGCLSEDLACQYVSLCLKLGRSEEAPERMGKVRILRKA

SEQ ID NO: 115736 - protein, 120 aa, Triticum aestivum
  Clone ID: PAT_TA_10154.pep
YTWSTSTGSRADAVRPRLFFLAYLCLSCTCCQSYCATAGWPGPCGPVLAHYCRRAALVRCSPSSSPSRAAARRRHLCPPMGLVVFVLHVLCMPLTEGMSVPLHDVLAHDYPTKPQNIVRC

SEQ ID NO: 115737 - protein, 127 aa, Triticum aestivum
  Clone ID: PAT_TA_10155.pep
VRILEAYQWVWNQAGKPAGRSIQCTYNHGSKSKGLETYIPACNVKWLGLRGDDLQLIPQSAFQELKPRDLQIAKSLLSSKFLQDTHRAELTRMVETGTRAEIEALYCHGFDFLGKFIARKIVQGDYI

SEQ ID NO: 115738 - protein, 435 aa, Triticum aestivum
  Clone ID: PAT_TA_10156.pep
AGAAAAAAAASREWLVVPASGRARVEEAGKHAVMARTGLPARDLRVLDPVVSYPSTILGRERAIVVNLERVKAVITAAEVLLPNSKDPDFARFVRDLQARVLAYSADQAAEFTDMDGESSAIASPFPAPSSSKGHELEMAKRTPNAVGEMTHSSSVPTLTAMKDGSTKVLPFEFRALEVCLESACRSLEEETVTLEKEAYPALDELTSKISTLNLERVRQIKSRLVAISGRVQKVRDELEHLLDDEMDMAEMYLTEKLAREDISETSSRVEVDDHDHDHDPSQLEEDMDEDYRSEPAGTASNGSSIGYKPNIEELEMLLEAYFVQIDGTLNKLSHLREYVDDTEDYINIMLDDKQNQLLQMGVMLSTATVVITAGVAVVGLFGMNIGISLYTPVGEEQTRAAHVKFWETTFGTIAGCTILYVIAMGWGKRSGLLQ

SEQ ID NO: 115739 - protein, 106 aa, Triticum aestivum
  Clone ID: PAT_TA_10157.pep
AGNSDMSLQHVFEGCTRLQKLEVRDSPFGDKGLLSGLNYFYNMRFFWMNSCRLTVKGCGDVAQQMPNLVVEVMKENEGEMDTVDKLYLYRSLAGPREDAPSFVNIL

SEQ ID NO: 115740 - protein, 192 aa, Triticum aestivum
  unsure (1)..(192): unsure at all Xaa locations
  Clone ID: PAT_TA_10158.pep
SAGTSSPSPSPSPRLLHRASASASPLLSVAHARSPPAPTFVCSIHCKLSGHILYGRTHVPSFLALASADWNQAPQGKACSGLQVIMVDPQEAKRLAVRQMQEIRAXEKLKKRRQAEAINGAFAGIGLTPTLVSEHWTVIGLIGALVLYMSDRKGYLGDRLQLFGQLCHFFRRAVLEILLAGFCKFPQQIGEL

SEQ ID NO: 115741 - protein, 136 aa, Triticum aestivum
  Clone ID: PAT_TA_10159.pep
QSNHGAGEGRGEGWFQLDAFVAVALSCLFGLLISFFGFAARKAISATAFTVTGVVNKFLTVAINVTIWDKHASAFGLVSLLFTLAGGVLYQQEISHQLSMERHRRNLRMKVTVLSMMRRNRSLFHLECPVHEECHS

SEQ ID NO: 115742 - protein, 317 aa, Triticum aestivum
  Clone ID: PAT_TA_10160.pep
MPKDRSSRSVSHEGCRSRVSPYKLRSGSRRSEEAAAAAAAAAAKQAAEWEEVRCPVCMDHPHNAVMLVCSSHEKGCRPFICDTSYRHSNCLDQSRKASKESSKDSGAAECAECQQPVKLACPLCRGPVSHWTKDYDARKFMNSKDRACTMESCEFKGAYNQLRKHAREDHPAVRPTEVDPNRQRDWHRMEQQRDLGDLFSMLRSGISGREDGVGVSEGDEGVSERSLHATSITMVFIVRSGRSILHYTDGEIPGRRSRTILLVGEPRGEASRAGGSSGNGDAEATTTDNEETDLAMSTQASAGSQEDAGEADGDPAQ

SEQ ID NO: 115743 - protein, 92 aa, Triticum aestivum
  Clone ID: PAT_TA_10161.pep
AFELLGMNVKFLLKRIDDLLSLSALPRDPAEHEGYKEMKLERARAGAKMKELESMMSSVKDTLKKMDVEMEEMESSAKRTDEMLRRLATAPW

SEQ ID NO: 115744 - protein, 200 aa, Triticum aestivum
  unsure (1)..(200): unsure at all Xaa locations
  Clone ID: PAT_TA_10162.pep
SSRLQYSFFGDVITFDTTYRTNLYDMPFGLFVGVNNHFRSVILAGVLVRDETEDSFEWVFSGFLRMMGGSPPVTILTNQNRAMELAIKKVMPDATHRWCKXHVLKKAKESLGSLYTKKSDFRSEFHKVINHILTEDEFEQAWEMLLDKYKLRAHSYMTNLFEIRKKXRSLNLREFFXVKMTSTQRSESANHMLKDYVPPG

SEQ ID NO: 115745 - protein, 152 aa, Triticum aestivum
  Clone ID: PAT_TA_10163.pep
TSDVPEGHEIIREHIPITNLFTCLWFNEVDRFTSRDQISFSTVRDKIRSRVNWTADMFLDCERRDFVVQAYHRELMEQRLAALRSQPPPPPPPPPPPPPVVRVQQPRKMLPDSAPKEPGRASKKPAGRRSRRSGSKRSHRTKASSVKEPIRL

SEQ ID NO: 115746 - protein, 194 aa, Triticum aestivum
  Clone ID: PAT_TA_10164.pep
LEVHIMKRWTKNACENLPEHLMIYKACNSALKDATYRHSSLYSKALEIVQMGDKNTEAYGAAMKQLLDAISVLNDTNQESDGRGLHDQAAAPAHDQDAPVTPGANGLSGSMNVVSRKRDRGRPTNARAKPGYENVSKPRTKFCSICRGRGHKASKCPSYGGATKKQRKVPKCTKCGLEGHKRNNCSGSLFGVFQ

SEQ ID NO: 115747 - protein, 102 aa, Triticum aestivum
  Clone ID: PAT_TA_10165.pep
PCCHIFRLFTQFGVNEIPGQYIVPRWTAKFKEEQMKQYREKCLDSPGIDQSENTMRYAMRLSKVADIGKEICGDGSKCDKFRLELDTIQGKTGNDGMRDTSN

SEQ ID NO: 115748 - protein, 99 aa, Triticum aestivum
  Clone ID: PAT_TA_10166.pep
RPYISCTDPHGKICYVHLMESYKIPLFSSFLCHNYTSASLAVPPLDIVSFALVTSLVPWRSLNSIGGGGRFTSRAGEQNRRSGGALGPWAAAGYIVELA

SEQ ID NO: 115749 - protein, 112 aa, Triticum aestivum
  unsure (1)..(112): unsure at all Xaa locations
  Clone ID: PAT_TA_10167.pep
ARHCRAASFHSRLCCLRWNSSARAPPXVFTYFXXXTSPHQCFQXMKEAXTQQXHYTMAXTXXVASWXTSLFNVPXEMPLLPKFFKHXFSKXPXXCTCIRXKTLXPXMPKFIS

SEQ ID NO: 115750 - protein, 395 aa, Triticum aestivum
  Clone ID: PAT_TA_10168.pep
RPQLSYLQKHMANVLTLLADSVDGEGDESMVLTMETFEHLGFLLQFSEGTPLSQAAPFFANSDPDMPAAPVPATQVHDWILQNIASSLEYTAEKAITKENNQRSVSDPDVAMADAVTNTRIQSSSSTGASVQNNPGYYRNTSFVEGISKTSVVKHGSDIKGHSIKVLNCHDSVIYILAPLKYATVYGCSDTTGVLGAIGKVVKVEHCERVQIVVASKRICIANCRECIFYLGVNHQPLIVGDNHKLQVAPFNTCYPQLGEHLAQVGVDPNVNKWDQPFVLGVVDPHDSLSHPAGVSDVQAESATCLDPDLFTDFMIPSWFEAEGPTKYNPFTLPEVYWASQRKKNASLEDIQKNIRELELDDNRKKELACALHAQFKDWLYASGNIRQLYCLQGE

SEQ ID NO: 115751 - protein, 76 aa, Triticum aestivum
  Clone ID: PAT_TA_10169.pep
EKSRSSIRLLRNLQLFQCTTVFSKIGQHLNYQPFMYIQNVKHNVHWCIFCTQKNIMPSEFFCRLELSYNFNLLLCS

SEQ ID NO: 115752 - protein, 129 aa, Triticum aestivum
  Clone ID: PAT_TA_10170.pep
HRAALLLLPSIHPSSEPTNPHRQRCSPSLLSISGCSPSSSIRSPATPSSRTPVAAASRSSPGCGAAAYRVWARGGRAARTVLAGLVAGGAAALASTLEARQWCGPAAHTVLAGPMAEGATAVVYSTQQR

SEQ ID NO: 115753 - protein, 353 aa, Triticum aestivum
  unsure (1)..(353): unsure at all Xaa locations
  Clone ID: PAT_TA_10171.pep
MSEASSSSAAAPVSAPPPAPALDPEAISLMAEEAPSEEITLVVKWGGKEYTVRAMGDDTLLELKRRICEFTDVLPKRQKLLYPKLILNDESVLLSFLPFKPNGKLTMIGTVEDEIFVDRPDDPEVLDDYEIFKDEVTAIKDNVLYKQKVKRRASQYKIKLLNPCREGKRLLVLDIDYTLFDHRSPAENPLELMCPFLHEFLAAAYAEYDIMIWSATNMKWVQLKMEQLGVLSNPNYKITALLDHMAMITVHAPDKKVFDCKPLGVIWTKFPEHYSEKNTIMFDDLRRNFVMNPQNGLVIRPFKNASKNRGRDQELRKLTQYLLSIAELEDFSKLXHDGWESFMDETGKRRRRR

SEQ ID NO: 115754 - protein, 162 aa, Triticum aestivum
  unsure (1)..(162): unsure at all Xaa locations
  Clone ID: PAT_TA_10172.pep
QALYELMSMVHDSVEAVXQNDIAESASQDTSSSQSNERKKTAADDSSLLEKDPVAKIILPVEPLELRSMLLAMVHTFPRTLEGLVLNILGPTGAEILTRKFDEMDQQTTTEEQTEFYKTFYSAFDDQYAAMDTLLNRKELFSFQVFQSVLDQYLRVHVDRPS

SEQ ID NO: 115755 - protein, 75 aa, Triticum aestivum
  Clone ID: PAT_TA_10173.pep
DDKVKANDLTTESRGKCIRAKRISNSPTPFVLAFPIEMKLQKGTVLVRAPPWLNAILFSYIADRKECCQFYRLVF

SEQ ID NO: 115756 - protein, 166 aa, Triticum aestivum
  unsure (1)..(166): unsure at all Xaa locations
  Clone ID: PAT_TA_10174.pep
GQKLXHFVDAFHQYVMDRVYHSAWTELCDGMASATTLDEVMEVHEAYLSSIQRQCFVASDKLWALIASRVKTILGLALDFHNVEQTLGTGGTAASVRARCEMELDRIEKQFDECVVFLLRILSFKLNVGHFPHLADLVTRINYNHYYMSDTGSFTAIPGSRPRQQP

SEQ ID NO: 115757 - protein, 87 aa, Triticum aestivum
  Clone ID: PAT_TA_10175.pep
LEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 115758 - protein, 178 aa, Triticum aestivum
  unsure (1)..(178): unsure at all Xaa locations
  Clone ID: PAT_TA_10176.pep
MAPTVMASSATSVAPFQGLKSTAGLPVSRRSNGASLGSVSNGGRIRCMQVWPIXEGIKNSETLSYLPPLKHGGLLKAXSDYLDPSKWVPCLRFSKLGXLPXEHNHPLGYYDGRYWAMWXLPISGSPTPPRRLEGGQEGYPYPISHHFTNRKSCVTYPTGARSGRLNITTAFKSCICPT

SEQ ID NO: 115759 - protein, 151 aa, Triticum aestivum
  unsure (1)..(151): unsure at all Xaa locations
  Clone ID: PAT_TA_10177.pep
ILFPLKKRYPPFFFFFFFFFFFFFFFFFFFFFFFFFFFFFFFFFFFFFFFFFFFFLVTIKTYIVDILYNIMRPFIYIATDSILIRACFLEPCWYMNMDIHIFPFSAHHTSQQQHQHXAAHGTTPKAIVSSLHHTTCQLCPLSSSLCLVCCS

SEQ ID NO: 115760 - protein, 146 aa, Triticum aestivum
  Clone ID: PAT_TA_10178.pep
LLPGESITNGHVPSMPSSHLAPLALVHKQASSLLDGLLWKVAYIWMDSSWMLADNEDRWLLAREARMVHMLVLPKPLKFFMPARREGWLLTAPARSAHDSGGCALLMAASLGFLEPCGKEGTTLGHRVALATYRERGERRRHEGLR

SEQ ID NO: 115761 - protein, 203 aa, Triticum aestivum
  unsure (1)..(203): unsure at all Xaa locations
  Clone ID: PAT_TA_10179.pep
KLYTYIVQPWPPPVMASSATSVAPFQGLKSTAGLPVSRRSNGASLGSVSNGGRIRCMQVWPIEGIKKFETLSYLPPLSTEALLKQVDYLXFRPKWVPCLDSSKVXXLPVEHNASPGXYYDGRYWDMWXLPISGAPTHTVFNEVEESRRIPGPYSASSVQLKCMRQIALNHGLKIKAKQSHRHIKCDFAKFFGFSITSIKLSRK

SEQ ID NO: 115762 - protein, 136 aa, Triticum aestivum
  Clone ID: PAT_TA_10180.pep
MYQKCQSYLQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 115763 - protein, 164 aa, Triticum aestivum
  unsure (1)..(164): unsure at all Xaa locations
  Clone ID: PAT_TA_10181.pep
MAPAVMASSATTVAPFQGLKSTAGLPVSRRSSGSLGRVSNGGRIXRCMQVWPIXEGIKNSETLSYLPPXSTEASLKQXHYLIXRSKWVPCLXFNKVGSSFPXXXQSPGYNDGRYWTMLXLLFXGXTDPASLNKVEESKRIPDPIPLIGXTQFILNSIKHGSREG

SEQ ID NO: 115764 - protein, 134 aa, Triticum aestivum
  unsure (1)..(134): unsure at all Xaa locations
  Clone ID: PAT_TA_10182.pep
MAPTVMASSATSVAPFQGLKSTAGLPVSRRSNGASLGSVSNGGRIRCMQVXWPSEGIKNSETLSYLPPLXTGGLPLSKSDYLDSVPSWVLSSEFKKVGFIFXVEHNASPWGTTMARYWACWXLPISGCTDARST

SEQ ID NO: 115765 - protein, 156 aa, Triticum aestivum
  Clone ID: PAT_TA_10183.pep
EQSVAIMDLIEERWEELIGDMPLKICYPAIENHEWRIVTGCDPKNTRWSYHNGGSWPVLLWLLTAACIKTGRPQIARRAIDLAERRLLKDGWPEYYDGKLGRYVGKQARKFQTWSIAGYLVAKMMLEDPSHLGMISLEEDKAMLKPVLKRSASWTN

SEQ ID NO: 115766 - protein, 142 aa, Triticum aestivum
  unsure (1)..(142): unsure at all Xaa locations
  Clone ID: PAT_TA_10184.pep
MAPTVMASSATSVAPFQGLKSTAGLPVSRRSSSAGLGSVSNGGRIRCMQVWPIEGIKNSETLSYLPPLSTEASLKQVDYLIXRSNWVPCLXFNKXGSFSREHNXPPGYXDGXYWDMLXLPMFXGCTDATQVLNEWRRSKKXT

SEQ ID NO: 115767 - protein, 48 aa, Triticum aestivum
  Clone ID: PAT_TA_10185.pep
AQVAQFIKFDEMSETSSSQGGGHTSAGSAPVQELPRLHEKVRSSMFFC

SEQ ID NO: 115768 - protein, 101 aa, Triticum aestivum
  unsure (1)..(101): unsure at all Xaa locations
  Clone ID: PAT_TA_10186.pep
MAGIRRLNPVPSTGLLVEKVVQPKKSAGGILLPETSKQLNSGKVIAVGPGXRDKEGKLIPVALKEGDHVLLPEYGGLEVKLAPEKEYLLYRDDDILGTLHE

SEQ ID NO: 115769 - protein, 140 aa, Triticum aestivum
  unsure (1)..(140): unsure at all Xaa locations
  Clone ID: PAT_TA_10187.pep
MAPTVMASSATSVAPFQGLKSTAGLPVSRRSNGASLGSVSNGGRIRCMQVWPIEGIKNSKTLSYLPPLKHGGLLKAXSDYLDPSKWVPCLRXKQVGFIFPXSTTTPXYYDGRYWDMWKLPISGCTDPHKCQRSGGVKKDT

SEQ ID NO: 115770 - protein, 139 aa, Triticum aestivum
  unsure (1)..(139): unsure at all Xaa locations
  Clone ID: PAT_TA_10188.pep
MGTMRSSAVAVAARKQQLLPCLALLLLAGAASAQAQKYNAVFNFGDSITDTGNLCTSGKPTAITFTQPPYGETYFGTPTCRCSDGRVIVDFLSTKFGVPFLPPSKANGTDFKQGANMAITGATAMDXPFXRGLAFGQDL

SEQ ID NO: 115771 - protein, 75 aa, Triticum aestivum
  Clone ID: PAT_TA_10189.pep
MTVDRKHAEAAAAAPFEIPALQPGRTCGAEESTRSHVLVKPIAGSSNLPCNEYAFLARQNPKGDALPVASILRCV

SEQ ID NO: 115772 - protein, 148 aa, Triticum aestivum
  unsure (1)..(148): unsure at all Xaa locations
  Clone ID: PAT_TA_10190.pep
GCFPIYLTVYGTNSSADYDSLGCLRKFNDLSTFHNNLLQAKIARLRKRYGRAARIMYADFYSAVYDIVPEPXANYGFNAAFEACCGSXGGGKYNYANSARCGMPGAAACANPADHLSWDGIHLTEAAYKQITDGWLNGAYCSPPILHT

SEQ ID NO: 115773 - protein, 168 aa, Triticum aestivum
  Clone ID: PAT_TA_10191.pep
MELAATGAAALRRSLASGYPVVPRERRRRMPARVSCVGRGGRGVGGGFADEAHLRYYEAPPRKAVEAAARDLTKLRAMGLVAGDPAKEKILSEATELLLKELNQMKDAEDELKKKDELKKKQKEEKAAMKALKKQQKEAKKAAMNCGDGSSESSESECEEEQSMKMSC

SEQ ID NO: 115774 - protein, 170 aa, Triticum aestivum
  unsure (1)..(170): unsure at all Xaa locations
  Clone ID: PAT_TA_10192.pep
SKXPESRGPRGAPCVPRXSICAXFNRRVTWRGRRERTCXEDRRCPPSDTGSWAPRSSLAVGGLLKVIARGRPLVHRLPVSVNRSRRNCTPHCTSCAAACRASDDSSTSNSGSLVAIGDGRRPRHRLTRKRGGGKSRQATGRRRGRRWCARCDAASARGDEPAGGAESRAE

SEQ ID NO: 115775 - protein, 275 aa, Triticum aestivum
  Clone ID: PAT_TA_10193.pep
MARSSSSPTARLPLPLLVLLLCLSSLSMAAAQKYNAVYSFGDSITDTGNLCTNGRPSAITFTQPPYGETYFGSPTCRCSDGRVIVDFLSTKYGLPFLPPSKSTSADFKKGANMAITGATAMDAPFFRSLGLSDKIWNNGPISFQLQWFQTITSSVCGSSEPSPQSSPIMLFFSFFTPFKAQPTMSACSAAPLMHEQQHDFLLHPAVAAATAMPLPPLIRALHTFHGAWRIDSLTRVLSLLAARATWRTRSSSSGESGGNDYNAMLGHYNTDQAST

SEQ ID NO: 115776 - protein, 132 aa, Triticum aestivum
  Clone ID: PAT_TA_10194.pep
SADYDSLGCLRKFNDLSTFHNNLLQAKIARLRKRYGRAARIMYADFYSAVYDMVQNPSKYGFNAVFEACCGSGGGKYNYANSARCGMQGAAACANPADHLSWDGIHLTEAAYKQITDGWLNGPYCSPPILHS

SEQ ID NO: 115777 - protein, 79 aa, Triticum aestivum
  Clone ID: PAT_TA_10195.pep
MVRSPSKYGFSSVFEACCGSGGGKYNYANSARCGMSGASACASPASHLSWDGIHLTEAAYKQITDGWLNGAFCHPGISH

SEQ ID NO: 115778 - protein, 197 aa, Triticum aestivum
  unsure (1)..(197): unsure at all Xaa locations
  Clone ID: PAT_TA_10196.pep
REKETKKAAKKAMKMKKEEEKRMATLNSCKDEDSSCSSESSNSECEGEVVRMSRCATISVPRTPSASTVFPIIVPQISDSVALDAQIISGSANAMQRTTTSIAVVEKPVLNRIEVCMGGKCKKAGSLAVLQEFETVVGTGGXVVGCXCFGXCGLGPNVRLRSEGSVQKNSPICIGVGLDDVGTIVAGFIGDDDLGMN

SEQ ID NO: 115779 - protein, 283 aa, Triticum aestivum
  unsure (1)..(283): unsure at all Xaa locations
  Clone ID: PAT_TA_10197.pep
MKALKKQQKEAKKAAMNCGDGSSESSESECEEEQSMKMSCVATTSMPAIEQGMAMSMSVPQIAASNIATAPAMDCDMAAMKAMKKREKEQKKAAKKAMKMKKEEEKRMATLNSCKDEDSSCSSESSNSECEGEVVGMSRCATISAPRTPPASTVFPIIVPQIPDSVALDAQIFSGSANAMQCTATSLAVVEKPVLNRINVCMGXGKCKKAGSLAVLQEFETEVGTGGMVVGCKCLGKCRLGPNVRLRSEGSVQKNSPICIGVGLDDVGTIVAGFIGDGDVGMN

SEQ ID NO: 115780 - protein, 200 aa, Triticum aestivum
  unsure (1)..(200): unsure at all Xaa locations
  Clone ID: PAT_TA_10198.pep
MARTSSSPTATRLPLLLVLLSSLALQAAAQKYNAVYSFGDSITDTGNLCTNGRPSAITFTQPPYGGDLXFGSPTCRCSDGRVIVDFLSTKYGLPFLPPSKSTSADFKKGANMAITGATAMDAPFFRSLGLSDKIWNNGPISFQLQWFQTITSSVCGSSCKSYLGXSLFIFGEFGGNDYNAMLFGNYNTDQASTYLGRDHA

SEQ ID NO: 115781 - protein, 155 aa, Triticum aestivum
  unsure (1)..(155): unsure at all Xaa locations
  Clone ID: PAT_TA_10199.pep
MAPTVMASSATSVAPFQGLKSTAGLPVSRRSNGASLGSVSNGGRIRCMQVWPIEGIKKFETLSYLPPLSTEALLKQVDYLXIRSKWVPCLRFSKVGFIFPLSTTHPLGYYDGRYWXTMWKLPISGCTDATQVINEGGGVKKXYLTLFRIIGFDKS

SEQ ID NO: 115782 - protein, 374 aa, Triticum aestivum
  Clone ID: PAT_TA_10200.pep
MGTMSSPSVPARKQQLLLCLAVLLLAGAASAQAQKYNAVFNFGDSITDTGNLCTSGKPTEITFTHPPYGETYFGTPTCRCSDGRVIVDFLSTKFGVPFLPPSKANGTDFKQGANMAITGATAMDAPFFRGLGLSDKIWNNGPISFQIQWFQQITATVCGNDCMRYLRDSLVVFGEFGGNDYNAMLFGNYNPDQASRYTTKIVNTIIRGVEKVVAMGARDVVVPGVLPIGCFPIYLTVYGTNSSADYDALGCLRKFNDLSTFHNNLLQAKIARLRKRYGRAARIMYGDFYSAVYDMVQNPNKYGFNAAFEACCGSGGGKYNYANSARCGMQGAAACANPADHLSWDGIHLTEAAYKQITDGWLNGPYCSPPILHT

SEQ ID NO: 115783 - protein, 369 aa, Triticum aestivum
  unsure (1)..(369): unsure at all Xaa locations
  Clone ID: PAT_TA_10201.pep
MTFPDAWDAEAAAAAATPFEIPALQPGRTCGAEESTRSHVLVKPIXKKRPRRSRDGPNSVSETIRRWKEVNQQLEHDPQGAKRARKPPAKGSKKGCMQGKGGPENTQCGFRGVRQRTWGKWVAEIREPNXRVSRLXWLGTFPTXAEDAARAYDEAARAMYGALARTNFPVHPAQAPAVAVPAAIEGVVRGASASCESTTTSTNHSDVASSLPRQAQAPEIYSQPDALESTESVVLESVEHYSHQDTVPDAWLKHFKEHIPKEDVFEPLEPISSLPDGEADGFDIEELLRLMEADPIEVELVTGGSWNGGANTGVEMGQQEPLYLDGLDQGMLEGMLQSDYPYPMWISEDRAMHNSAFHDAEMSEFFEGL

SEQ ID NO: 115784 - protein, 403 aa, Triticum aestivum
  Clone ID: PAT_TA_10202.pep
MELAATSAAALRRSLASGYPVVPRERRSGMPARVSCVGRGGRGVGGGFADEAHLRYYEAPRKAVEAAARDLTKLRAMGLVAGDPAKEKILSEATELLLQELNQMKDAEDELKKKQKEEKAAMKALKKQQKEAKKAAMNCGDGSSESSESECEEGQSMKMRCVATTSVPAVEQGMVMSMSVPQIAASNIATAPAMDFDKAAMKAMKKREKEQKKAAKKAMKMKKEEEKRMATLNSCKDEDSSCSSESSNSECEGEVVRMSRCATISAPRTPPASTVFPIIVPQIPDSVALDAQIFSGSANAMQHTATSIAVVEKPVQNRIEVCMGGKCKKAGSLAVLQEFETEVGTGCMVVGCKCLGKCGLGPNVRLHSEGSVQKNSPICIGVGLDDVGTIVAGFIGDGDVGMN

SEQ ID NO: 115785 - protein, 341 aa, Triticum aestivum
  unsure (1)..(341): unsure at all Xaa locations
  Clone ID: PAT_TA_10203.pep
MTVDRKDAEAAAAAATPFEIPALQPGRKKRPRRSRDGPNSVSETIRRWKEVNQQLEHDPQGAKRARKPPAKGSKKGCMQGKGGPENTQCGFRGVRQRTWGKWVAEIREPNRVSRLWLGTFPTAEDAARAYDEAARAMYGALARTNFPVHPAQAPAVAVAAAIEGVVRGASASCESTTTSTNHSDVASSLPRQAQALEIYSQPDVLESTESVVLTPVEHYSHQDSVPDAXSSIARSTSEEDVFEPLEPISSLPDGESDGFDIEELLRLMEADPIEVEPVNGGSWNGVEIGQQEPLYLDGLDQGMLEGMLQSDYPYPMWISEDRAMHNPAFHDAEMSEFFEGL

SEQ ID NO: 115786 - protein, 368 aa, Triticum aestivum
  unsure (1)..(368): unsure at all Xaa locations
  Clone ID: PAT_TA_10204.pep
MARPSSSPMATRLPLLLVLLSSLALQAAAQKYNAVYSFGDSITDTGNLCTNGRPSAITFTQPPYGETYFGSPTCRCSDGRVIVDFLSTKYGLPFLPPSKSTSADFKKGANMAITGATAMDAPFFRSLGLSDKIWNNGPISFQLQWFQTITSSVXGSSCKSYLANSLFIFGEFGGNDYNAMLFGNYNTDQASTYAPQIVDTIGAGVEKLVXMGAVDVVVPGVLPIGCFPIYLTIYGTSSAADYDALGCLKKFNDLSTYHNSLLQAKVSALQAKYKSARIMYADFYAGVYDMVRSPSKYGFSSVFEACCGSGGGKYNYANSARCGMSGASACASPASHLSWDGIHLTEAAYKQITDGWLNGAFCHPGITH

SEQ ID NO: 115787 - protein, 100 aa, Triticum aestivum
  Clone ID: PAT_TA_10205.pep
MAAIRRLIPSFNRVLVEKVVQPKKSAGGILLPETSKQLNSGKVIAVGPGSRDKEGKLIPVALKEGDHVLLPEYGGLEVKLAPEKEYLLYRDDDILGTLHE

SEQ ID NO: 115788 - protein, 364 aa, Triticum aestivum
  unsure (1)..(364): unsure at all Xaa locations
  Clone ID: PAT_TA_10206.pep
MTVDRKHAEAAAAAATPFEIPALQPGRTCGAEESTRSHVLVKPIXKKRPRRSRDGPNSVSETIRRWKEVNQQLEHDPQGAKRARKPPAKGSKKGCMQGKGGPENTQCGFRGVRQRTWGKWVAEIREPNRVSRLWLGTFPTAEDAARAYDEAARAMYGALARTNFPMHPAQAPAVALPAAIEGVVRGASASCESTTTSANHSDVASNLPRQAQALEIYSQPDVLESTESVVLESVEHYSHKDTVPDAGSSIARSTSEEDVFEPLEPISSLPDGEADGFDIEELLRLMEADPIEVEPVTGGSWNCGTNTGVEMGLQEPLYLDGLDQGMLEGMLQADYPYPMWISEDRAMRNPAFHDAEMSEFFEGL

SEQ ID NO: 115789 - protein, 265 aa, Triticum aestivum
  Clone ID: PAT_TA_10207.pep
VQSKSPGQSDIPSIAAVVGSREWPLVSKYRASVRSQSPKLEMIDSLFKPQGTDDDGLVRECLIDFYTSSGKRKPDQIIIFRDGVSESQFNQVLNIELDQIIEACKFLDENWNPKFTLIVAQKNHHTKFFIPGSPDNVPPGTVVDNAVCHPRNYDFYMCAHAGMIGTTRPTHYHILHDEIHFAADDLQDLVHSLSYVYQRSTTAISVVSPICYAHLAAAQVAQFIKFDEMSETSSSQGGGHTSAGSAPVQELPRLHEKVRSSMFFC

SEQ ID NO: 115790 - protein, 560 aa, Triticum aestivum
  unsure (1)..(560): unsure at all Xaa locations
  Clone ID: PAT_TA_10208.pep
MELGAAGMRRSASHNSLSGSDDFDLTHLLNKPRINVERQRSFDDRSLSDVSYSGGHARGGGGFDGMYSPGGGLRSLVGTPASSALHSFEPHPIVGDAWEALRRSLVFFRGQPLGTIAAFDHASEEVLNYDQVFVRDFVPSAMAFLMNGEPEIVKNFLLKTVLLQGWEKKVDRFKLGEGAMPASFKVLHDDKKGVDTLHADFGESAIGRVAPVDSGFWXWIILLRAYTKSTGNLTLAERPECQKAMRLILSLCLPEGFDTFPTLLCADGCCMIDRRMGVYGYPIEIQSLFFMALRCALLMLKHDAEGKDFVERIATRLHALSYHMRSYFWLDFQQLNDIYRYKTEEYSHTAVNKFNVIPDSIPDWLFDFMPCEGGFFVGNVSPARMDFRWFALGNMIAIVSSLATPEQSMAIMDLIEERWEELIGEMPLKICYPAIENHEWRIVTGCDPKNTRWSYHNGGSWPVLLWLLTAASIKTGRPQIARRAIDLAERRLLKDGWPEYYDGKLGKYVGKQARKFQTWSIAGYLVAKMLLEDPSHLGMIALEEDKAMKPVLRRSASWTN

SEQ ID NO: 115791 - protein, 607 aa, Triticum aestivum
  unsure (1)..(607): unsure at all Xaa locations
  Clone ID: PAT_TA_10209.pep
QFLSLKPTILYSVFAGNGDPEAIEISVYDYFVKNRGIELRYSGDFPCINVGKPRRPTYFPIELCQLVPLQRYTKSLSTLQRSSLVEKSRQKPQERMSVLSDVLKRSSYDTEPMLKACGISIAQGFTQVSGRVLQAPKLKAGNGEDIFTRNGRWNFNNKVIVLTAFLSCMFSSITLLVMLLQRLARACVVDRWAVVNFSARCNTMNLVNDLIKCGGMKGITVEKPHIVIEENGAMRRAPAPKRVEDMFEQVKSKLPGAPKFLLCILAERKNSDVYGPWKRKCLXDFGIVTQCVAPTRVNDQYLTNVLLKINAKLGGMNSLLQIEMSPSIPLVSKVPTLILGMDVSHGSPGQSDIPSIAAVVGSREWPLVSKYRASVRSQSPKLEMIDSLFKPQGTDDDGLVRECLIDFYTSSGKRKPDQIIIFRDGVSESQFNQVLNIELDQIIEACKFLDENWNPKFTLIVAQKNHHTKFFIPGSPDNVPPGTVVDNAVCHPRNYDFYMCAHAGMIGTTRPTHYHILHDEIHFAADDLQDLVHSLSYVYQRSTTAISVVSPICYAHLAAAQVAQFIKFDEMSETSSSQGGGHTSAGSAPVQELPRLHEKVRSSMFFC

SEQ ID NO: 115792 - protein, 100 aa, Triticum aestivum; identical to SEQ ID NO: 115787
  Clone ID: PAT_TA_10210.pep

SEQ ID NO: 115793 - protein, 100 aa, Triticum aestivum; identical to SEQ ID NO: 115787
  Clone ID: PAT_TA_10211.pep

SEQ ID NO: 115794 - protein, 240 aa, Triticum aestivum
  Clone ID: PAT_TA_10212.pep
MVREEVAGSTQTLQWKCVESRVDSKRLYYGRFILSPLRKGQADTVGIALRRALLGEIEGTCITRAKFGSVPHEYSTIAGIEESVQEILLNLKEIVLRSNLYGVRDASICVKGPRYITAQDIILPPSVEIVDTAQPIANLTEPIDFCIDLQIKRDRGYQTELRKNYQDGSYPIDAVSMPVRNVNYSIFSCGNGNEKHEILFLEIWTNGSLTPKEALYEASRNLIDLFLPFLHAEEEGASFE

SEQ ID NO: 115795 - protein, 178 aa, Triticum aestivum
  unsure (1)..(178): unsure at all Xaa locations
  Clone ID: PAT_TA_10213.pep
MAPTVMASSATSVAPFQGLKSTAXGLPVSRRSNXAASLGSVSNGGRIRCMQVWPIXEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 115796 - protein, 919 aa, Triticum aestivum
  unsure (1)..(919): unsure at all Xaa locations
  Clone ID: PAT_TA_10214.pep
MESHGEDLPPPPPLPPNAEPIKAESADDLPPPPPLPPIKPEEAKKISKPKRALIARPGFGKRGNPIQLVTNHFKVSLKTTDEFFHHYYVNLKYEDDRPVDGKGVGRKVIDKLSQTYASELAHKDFAYDGEKSLFTIGALPQINNEFVVVLEDVSSGKTPANGSPGNDSPGNDKKRVKRPYQTKTFKVELSFAARIPMSAIAMALKGQESEHTQEAIRVIDIILRQHSAKQGCLLVRQSFFHNNPSNFVDLGGGVMGCRGFHSSFRATQSGLSLNIDVSTTMIVKPGPVVDFLLANQKVDHPNKIDWAKAKRALKNLRIKTSPANTEYKIVGLSERNCYEQMFSLKQRNGGNGDPEAIEISVYDYFVKNRGIELRYSGDFPCINVGKPRRPTYFPIELCQLVPLQRYTKSLSTLQRSSLVEKSRQKPQERMSVLSDVLKRSSYDTEPMLKACGISIAQGFTQVAGRVLQAPKLKAGNGEDIFTRNGRWNFNNKRLARACVVDRWAVVNFSARCNTMNLVNDLIKCGGMKGITVEKPHIVIEENGSMRRAPAPKRVEDMFEQVKSKLPGAPKFLLCILAERKNSDVYGPWKRKCLADFGIVTQCVAPTRVNDQYLTNVLLKINAKLGGMNSLLQIEMSPSIPLVSKVPTLILGMDVSHGSPGQSDIPSIAAVVGSREWPLVSKYRASVRSQSPKLEMIDSLFKPQGTDDDGLVRECLIDFYTSSGKRKPDQIIIFRDGVSESQFNQVLNIELDQIIEACKFLDENWNPKFTLIVAQKNHHTKFFIPGSPENVPPGTVVDNAVCHPRNYDFYMCAHAGMIGTTRPTHYHILHDEIHFAADDLQDLVHSLSYVYQRSTTAISVVSPICYAHLXAAAQVAQFIKFDEMSETSSSQGGGHTSAGSAPVQELPRLHEKVRSSMFFC

SEQ ID NO: 115797 - protein, 175 aa, Triticum aestivum
  Clone ID: PAT_TA_10215.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 115798 - protein, 175 aa, Triticum aestivum; identical to SEQ ID NO: 115797
  Clone ID: PAT_TA_10216.pep

SEQ ID NO: 115799 - protein, 175 aa, Triticum aestivum; identical to SEQ ID NO: 115797
  Clone ID: PAT_TA_10217.pep

SEQ ID NO: 115800 - protein, 168 aa, Triticum aestivum
  Clone ID: PAT_TA_10218.pep
ANASLEDKLSSTEAQLKQLHAEKAEASAESEKLISGLKQDIANLKTELELLSSQKAAVDNKVSGLLSDLATCDEKMKEMDSHLHQLHLEHVQVIAEADAARKSVADLRARVCELEEEVEKQKLMAFDSAEGKREAIRQLCFSLEHYRDGYQHLRQVLQGHKRPMVMAT

SEQ ID NO: 115801 - protein, 529 aa, Triticum aestivum
  unsure (1)..(529): unsure at all Xaa locations
  Clone ID: PAT_TA_10219.pep
MKRMSRMPTRKAHSWWWDSHISPKNNKWLXADNLXEEMDKQVKDDAEXLFQDGGESLAKMAEXMKYQERPLLVTHVENFYSEWRARCLSVDDNVXTGELRKEMPSSRKSQDAXRMSETDAEAQSTPASPDSEKXRPQKRKAKKATDCSSPSSSSDSDCEIGQPEQGNGNGIAYALKERVIELKDELKEPLEKLEALEEKNMRCQCENLEEKLLASQSEINSLQKDLEEKIPKHHEAQLSYRDLEIEKCKRELEEVSERYTYDKSTLETEIRELQEVVKNLEGNLAKLSEEKLQLEEQVMELEQTSHSLDDSSAEIKKLQKVIKDLQARLENDSNEKRVLESRAIEFEQVHRELEDSRAETVELQTRIEKLKADLEGALQEKLMLEGCVKDLEHAIASKLEKSSLEKSSLDAEILQLSEANASLEDKLSSTEAQLKQLHAEKAEASAESEKLISGLKQDIANLKTELELLSSQKAAVDNKVSGLLSDLARALPRRVSAPPASSAGPQEADGDGNVISQPAACWILFSLDA

SEQ ID NO: 115802 - protein, 416 aa, Triticum aestivum
  unsure (1)..(416): unsure at all Xaa locations
  Clone ID: PAT_TA_10220.pep
HGYGAVGDDRTXHTAAFASAVADLGRRAGDGGAALVVPEGRWLTGPFNLTSHFTLFLRPPTRPLASQDLDDWPLIAPLPSYGRAGDEPGPRYSNFIGGSNLTDVIISGHNGTINGQGQVWWDKFHAKELHYTRGYLLELLYSRDIIISNVTFVDAPSWNLHPTYCTNVTISGVTILAPVHSPNTDGIDPDSSSHVKIEDCYIVSGDDCIAVKSGWDEYGIKFNMPSQHIVVRRLTCISPTSAMIALGSEMSGGIQDVRVEDNIAINTESAVRIKSGVGRGGFVRDVFVRRLSLHTMKWVFWMTGNYGQHPDNSSDPKALPEVTGINYRDVFAENVTMAGRMEGIPNDPYTGICMSNVTAQLAPKAKKLQWNCTDVQGVAYGVSPEPCPELGAEGKPCTFPEEELVIGPPELPKCTY

SEQ ID NO: 115803 - protein, 131 aa, Triticum aestivum
  Clone ID: PAT_TA_10221.pep
SLFRLSRRSTRREGEAMSKGGLKLLARLELHESTDPIYMHHAMELPNAWPQPLAARSTQWCLSGRSTRPLGSSPREFFLSCFVTPSWVMSYDHHDAGRASERLWSVHRRPALFSFFGHRRVRSIRNMEWRE

SEQ ID NO: 115804 - protein, 164 aa, Triticum aestivum
  unsure (1)..(164): unsure at all Xaa locations
  Clone ID: PAT_TA_10222.pep
SADAWADAWADAWVDILEVGDGGAGGGVSLAGTWWGKEALALAEEVSTSFDGDLKIYAFKATASLEIRVRIEKMSTRYGSPTIDDIEAYTIAYRAKLDDAESAGRIPKNVSLEVSSPGVERVIRVPDDLERFKERSMYVRYVMTSEDAATAXEGDGVFRLISYL

SEQ ID NO: 115805 - protein, 170 aa, Triticum aestivum
  Clone ID: PAT_TA_10223.pep
MKMASQNIGRRKRMKMVVKAHKGQDNQNKQKEDETKVFRAAMRRILISKAPPVLTITLNRFSHDSHGRFRKLKGHVRFKETLDIRPYMDPRSKDNDITTYRLVAVVEHMGSMTGGHYVAYVRSGKIGGRQQQSRSSKSWFYASDSHVRETSLEEVLNCEAYILFYERVAE

SEQ ID NO: 115806 - protein, 206 aa, Triticum aestivum
  Clone ID: PAT_TA_10224.pep
EVRECGVDVRHIASLCVNAPRLLTTNPERVRAMAACAEAVGVPRGSGMFREALQAVAFLSEEEIAAKLDYLKNTFRWSDAEVRIALSRYPSLLRRSKGMLLRKSEFLISKVGLEPAYIARLPVILCLSLEGRLRPRYDVIMFLMANGLLKRVPKYYPIFKATEKVFFEVYICPHKEAAPHLAEYYATACRGEVPTGSTLTGTKNGL

SEQ ID NO: 115807 - protein, 143 aa, Triticum aestivum
  Clone ID: PAT_TA_10225.pep
VRPRVRHHPASLSQFPGLILREIKGFWRVALFISILVYPEVGNASDSLGKQDELDKRKERYISVERSITNLDLDGVWKMKPLLDGKAIMGVMQVKSGGPLIGKWQQRLVKWQLAHPQGTMEECMEWMKQSEQQSKRQKIECST

SEQ ID NO: 115808 - protein, 332 aa, Triticum aestivum
  Clone ID: PAT_TA_10226.pep
PLVLCWAELSHGRRRLSPAEPHRRCGCSWPWRADSGSEGSDMQLGDPDDGETQRGSGKDGGGKRQQCKNLIAERRRRKKLNNRLYTLRSLVPNITKMDRASILGDAIDYIVGLQKQVKDLQDELEDPNPRGGTGGDSKAPDVLLDDHPPPGLDNDEDSPQQQPFPSAGGKGARKEEAGDEEGKEAEDQDMEPQVEVRQVEGKEFFLQVLCSHKSGRFVRIMGEIAALGLQITSVNVTSYNKLVLNVFRAVMKDNEAAVPADRVRDSLLEVTREMYGGGGAWSSPLPPPPSTNAKLDGMDGQAVPAAAGDHYQLHHQVLGGYHHQHLQYLAMD

SEQ ID NO: 115809 - protein, 527 aa, Triticum aestivum
  Clone ID: PAT_TA_10227.pep
GRSSAAPTAGTTACTGGSLLTRGSWRWRGFAAARSSRRRWPLPPTCLAPSLLTPPPSGCTLRRYCRTSQSGRAAAGRRVRISSRATRLPPAAARRRGSSSPSPAGSSSSSRRDIWRRSSRWLSWSWRSAAAVGRGGRRRRRRGSRGTRRRRRRQTRGGSTRRRRSTCSTAPGESGSGEPFLAGVHDDGAAGVGWQYAAESSEPPSTVAQEHQQLHGSGVGRADSGSEGSDMQLGDPDDDGNGETQRGSGKDGKDAEVRRQQCKNLEAERKRRRKLNDRLYKLRSLVPNITKMDRASILGDAIDYIVGLQKQVKDLQDELEDPNPPGVTGGDSKAPDVLLDDHPPPGLDNDEDSPQQQPFPSAGGKRPRKEEAGDEEEKEAEDQDMEPQVEVRQVEGKEFFLQVLCSHKSGRFVRIMDEIAALGLQITSVNVTSYNKLVLNVFRAVMKDNEAAVPADRVRDSLLEVTREMYGGAGAWSSPVPPPPLTNAKLDGMDGQAVPTVAGEHYQLHHQVLGGYHHQHLQYLAMD

SEQ ID NO: 115810 - protein, 87 aa, Triticum aestivum
  Clone ID: PAT_TA_10228.pep
PFTIHYNITIYSLLQSQKNSLQSTASLLRTWLHGFTLKKLGLELLVDEGGRAGDELDVVAIEDDLILDLLGLHLRQMQQQRLRQPQQ

SEQ ID NO: 115811 - protein, 193 aa, Triticum aestivum
  unsure (1)..(193): unsure at all Xaa locations
  Clone ID: PAT_TA_10229.pep
MSEQPLPQPRSSMREALQKEDKEKASAAAPPAKEKAAVPPPPVAAPPMAKNGGGGGKGGNGAQPPAAEETTREIQVVREAYRQPAAPAYVMPEEPPAMVELVGWYLYGFCSFFITHLLLPVLFPAIVTQVAFPSSDFTPDQVHRQGRLASEMSMYQRLTRYSIDFSSSHMSPLGWSXSWAIGILLAALFLTKC

SEQ ID NO: 115812 - protein, 588 aa, Triticum aestivum
  unsure (1)..(588): unsure at all Xaa locations
  Clone ID: PAT_TA_10230.pep
MSEQPLPQPRSSMREALQKEDKEKASAAAPPAKEKAAVPPPPVAAPPMAKNGGGGGKGGNGAQPPAAEETTREIQVVREAYRQPAAPAYVMPEEPPAMVELVGWDRPLVGARHPPRGAAPHPGRAPPRPVPVPAAHPTPRAMFRVLLLPAHRLLQDGLQWLLFYILLHRRVHHHRLGGAHPQPRADDPRACPPLTQVAHHLDRGQYQSLILIAAAPPSAGIGAALMAAFTDHMFVVHXHLTGPLGPSPSSVDSSGLXISARVVVNDSGKHLVLRRRAAASQLILYCTXAIGGIGAALMAAFMYHMLSRHXRLTGLRLLSHALRHWRRLHQAGPGAPDVPTRSSPSTAFEPHFISPLQFRLPIRRRPPASCWGSAVFLSSFAPMCIFTSGTLYAIGGVCIKPVLVLALXILYFLAPLISLTPLHPVRRISSADAARMHLAGSTXAPSVSRAGALVKSHRWRAAHIIIIALVQSTANGILYSFGRILLLDASPPGKEGAFAIWYAYVRCMGAMIGFAVASAGPGRAGGSFAAAFLGSFLGIIVLIFGNVSNIGALKAAGHLKGMEDDKRIGEKGEGMSAVADSGESRGRV

SEQ ID NO: 115813 - protein, 162 aa, Triticum aestivum
  Clone ID: PAT_TA_10231.pep
ERILPLPSIAFENLSNARYELVCSAVMPRGLEFNYHNNRLFVRSIFRTSSFVHCVPFVHVMTATNTEKFTMKIPKLVVFSLRNFVDMPISARISLEAYLGDTHVIMPSSFKLCKQHGRMVIEKTSFSEFISATSRATGPVVLITFNESTYDCSISIVFQWLL

SEQ ID NO: 115814 - protein, 138 aa, Triticum aestivum
  Clone ID: PAT_TA_10232.pep
SGEIPLSPRAANPSALTLSAPHFLLDLDAPPSPTPLPPSGSRRAAAPTPLPPMLSTGVPLTLSPLGPLIRLPSSRPRRPPHRYPPTPAATSTARYHSRSSSSSSTCSSRPRSSSTSSAPASTTPPHIASSPRPGASTS

SEQ ID NO: 115815 - protein, 79 aa, Triticum aestivum
  Clone ID: PAT_TA_10233.pep
MTQLCTNFSTRLAIYFGTEGVAKILCAFSVNNQTGEIELRPISVSLANWYSSQFNTEPSNTDTQTQPNLFFLRRNPHHI

SEQ ID NO: 115816 - protein, 230 aa, Triticum aestivum
  unsure (1)..(230): unsure at all Xaa locations
  Clone ID: PAT_TA_10234.pep
TRPPSCSASKTLRSTMPSLAAAAAARRAGEALRRGVMGGRYLSSLRPSPATAAAPDSDEVLVEGKASARASVLNRPGHLNALTTTMGARLNKFYESWEDSPDIGFVMMKGSGRAFCAGGDVVGLRQLINEGKLDESKDFFRTLYSFIYVLGTYLKPHVAILDGVTMGGGGGVSIPGTFRVATDRTXVFANPEVHIIWVLDAAALFYLSHLTGHVGEXYLALTGEKTNGVF

SEQ ID NO: 115817 - protein, 190 aa, Triticum aestivum
  Clone ID: PAT_TA_10235.pep
NDSLLSLSNPPLHIETLRMNGIVTFRIPRWIGDLHYFRYLDLRVRETSTDDIRLLGELRSLMEFRLYLFHFAANGVIVIRTGLFPALEYFQADFREQRHEVHAGGDDVMAHLCFEVGSMPKLQRLELHLSERHWGGATPVGVEHLLALKQIKLAFAYRGSSDIDEVDRRAESAFRDALQGHPNHHSIRIN

SEQ ID NO: 115818 - protein, 217 aa, Triticum aestivum
  Clone ID: PAT_TA_10236.pep
TRPKDFFDQSGDEIVRLKFVNKYDPSDEHHVLGLYDYFYHQEHLFIVTELLRANLYEFQKYNQDSGGDLYFTFPRIQAIARQCLKALLYLHHLRIIHCDLKPENILIKSYSRCEIKVIDLGSSCFLTDSLCLYVQSRSYRAPEVILGLPYDQRIDIWSLGCILAELYTGEVLFPNEPVSMMLARMIGMIGPIDMEMLELGQETHKYFTDDYGLFTKN

SEQ ID NO: 115819 - protein, 223 aa, Triticum aestivum
  unsure (1)..(223): unsure at all Xaa locations
  Clone ID: PAT_TA_10237.pep
TRPRPNYXELRKNTIKALCNADVSEGVFIRGRDVSLPETYIKSARRPVRDIGGKPAAERSILAFFAGQMHGRVRPVLVKYWGGKDADMRIYTRIPRQITRRMNYAKHMKSSKYCICPMGYEVNSPRIVEAIYYECVPVIIADNFVLPFDDALDWTAFSVVVAEKDVPRLKEILLAIQESRYITMRSNVKKVQRHFLWHAKPVKYDIFHMILHSVWFSRVNQVG

SEQ ID NO: 115820 - protein, 158 aa, Triticum aestivum
  unsure (1)..(158): unsure at all Xaa locations
  Clone ID: PAT_TA_10238.pep
TRSWALFFAEFXSIVDSKVEQSXNVPFXCPVKDSINAYSIRCIICDRTSCKIAHPSCGNXYFXGNNAQYGFPVHHKWGXDLGGMLESDFIYFDHENXXEFSKIVSEASXSSSPXKPRXREKSXWSXRNTRARTGAGFGGAVPXXKVXLFILSNYPXFS

SEQ ID NO: 115821 - protein, 145 aa, Triticum aestivum
  unsure (1)..(145): unsure at all Xaa locations
  Clone ID: PAT_TA_10239.pep
SSARPILRSNSRVATXNPNKRKSSTDLSASQPPLKKMASDVSMSPMGSAAPGAGNMPGSMDGFSAQLPNPSMMQASSSGQKVESMTAAGAIRRDQGNNHAQRVSTVLRQAWKEDQDAGHLLGSLHEVFGEAIFSFIQPPELSIFL

SEQ ID NO: 115822 - protein, 208 aa, Triticum aestivum
  Clone ID: PAT_TA_10240.pep
RRGGCRPPPPGPGRPRSPRGPRPGPGAAPAPPAAPAAPGAGAPRLAGPPRPGPAAAPPPAPRPRPPRPPPPRRRARRRRRLLPTTPAPQRQRPRLLPAAAPGRRRRPLLPATKRGRRLLPAAAPQRRRLLPAGAPQPPGVPAVPAALPLRHGAALADVQRREPQLLLRHVTRPAARKFTHQRRRPAPASRPGEKINADIVADSDEALH

SEQ ID NO: 115823 - protein, 215 aa, Triticum aestivum
  Clone ID: PAT_TA_10241.pep
QVFVRLSREGEAGGGRQLTHVLQEKLHALSTAINSLQLVEPSCAWLDSICEADDQISPSKKPRNLLMENSAFGTDSELSTLQFCVDIEILEKEYTLTEALYMLSTVNSKSKFSESYSIEALTDILVNENLYDLAFTIVLKFWKESGMKRELERVFAAIAQQCCPNRVGNSGRNLTDTQQLLLLPSSEDDGWDGNSKTIAVAHQVQGSCQWETLEL

SEQ ID NO: 115824 - protein, 517 aa, Triticum aestivum
  unsure (1)..(517): unsure at all Xaa locations
  Clone ID: PAT_TA_10242.pep
SAPAECGLSSAPPPPPLSSSSSSPSPPASDSAASPTSSTAAPRPPLTDSRGLRWDPDRPXVSAGSARPLSVQGLLDPTLASLRVFPYRPAAKFCYALPVDPNRRYLLRPTFFYGPSSTAPPVFDLIVDGTFWTAVDTADDILAGSASHYEAVFPARGRNLTFCLGVNPDYTDSGPFINALQVIQLHDSVYNATDFTGSAMGLIARTKFGSTGDVERYPDDSFDRYWQPFPDRKHAVSSTHNVTSADFWNLPPPDVFNTALVAEQNSPLVLQWPPISLQNGSYYVSLYFADTLANSSRTLDVNINDYQFYEGTVTSAGLSVFATQWILSGLTRVILTSKSVLPPLINAGEVFGIFPIGRLTITRDALAMESMKRSLQNIPDDWIGDPCMPHGYAWTGVTCDEGQNIRVISLNFSSMGISGSLSPDIANLTALTDISFANNSLSGTIPDFINLGKLHRLHLNDNKLKATFAQSLGTIQPLRVLFLRGRGRGGAVPQNLLNKTGLTSKFCPGNQFTQPQC

SEQ ID NO: 115825 - protein, 132 aa, Triticum aestivum
  Clone ID: PAT_TA_10243.pep
PPPDLGWDRVERRRAPPEVEMEKNYRWCPTFPNLTDLTLHSWCVCGNFYALTVFLQNSPNLKKLTLDLYQPWYENGVICAITGELEDRSFTCEQLEIVEIICSEGNELLPWVNQFLLDSGIRPDQMRVSYED

SEQ ID NO: 115826 - protein, 546 aa, Triticum aestivum
  unsure (1)..(546): unsure at all Xaa locations
  Clone ID: PAT_TA_10244.pep
RQGSSSADHRFRSAWTDEVELQDNLLTGDFPAVVGAAAPNLGEINLSNNQLTGALPASIGNFSGVQKLLLDRNSFSGALPAEVGRLQELSKADLSGNAIEGGVPPEIGKCRLLTYLDLSRNNLSGRIPPAIPPRGRLNYLNLSKNHLDGEIPPSISTMQSLTAVDFSYNNLSGLVPGTGQFSYFNATSFVGNPNLCGPYLGPCRPGIADAGHTNHGHGGLSSTIKLLIVLGLLLCSIIFATAAILKARSLKKASDARMWKLTAFQRLDFTCDDVLDSLKEENIIGKGGAGTVYKGSMPNGDHVAVKRLSAMVRGSSHDHGFSAEIQTLGRIRHRHIVRLLGFCSNNETNLLVYEYMPNGSLGELLHGKKGEHLHWDTRYKIAIEAAKGLCYLHHDCSPLILHRDVKSNNILLDSDFEAHVADFGLAKFLQDTGASECMSAIAGSYGYIAPEYAYTLKVDEKSDVYSFGVVLLELVTGRKPGGEFGDGVDIGQGVKMMTGPNKEQVMKILDPRLSTRPXHEGNHVFYVVLLXTEEHKVQGPTIPEVV

SEQ ID NO: 115827 - protein, 288 aa, Triticum aestivum
  Clone ID: PAT_TA_10245.pep
TKPWFTAETFLCKDDHRKIVAGTNNHQVRLYNTASQRRPVVSVDFRESPIKAVAGDPDGHTVYIGTGTGDLASFDMRTGKLLGCYVGKCSGSIRSIVRHPELPLIASCGLDSYLRIWDTNTRQPLSAVYLKQHLMTVVIDSHFSAEESEETKSKQPDSSMVAEAAVRREKKKKKNVFVEEDEEGTQMVDPDDCDAEAVRKEKKKKKKKTVTEDDEETQMVDPDEGDAETVRKVKKKKKNRRVAEDEEGTQMADLNDSDAEMYAPKRIKSESGERSKGTKKKSKKQQVA

SEQ ID NO: 115828 - protein, 308 aa, Triticum aestivum
  unsure (1)..(308): unsure at all Xaa locations
  Clone ID: PAT_TA_10246.pep
AVRAQPALGFSERQRVPGRSPVRSVDIAVPAADLPKLKDVSESTLKNGTISGSLEPKVVRPDQLKKPRGKPYSYKDVQPNNTDYGDKVTFHPANRNSLSGANPKGPSGVPDTYMYRRNGHALSRYAAMPKPLRRSKAGLPGETPYLLHVQGRXERPHDSGACPRPSERNQRMGSPQGRELRDRPQSRPEPSERNQCLGSPHGRESRDRSRSRSKPSERSQRSVSPRRRESRDRSRSRPERTSRDHGRSDRGSSDHHHEDHHDRKRMRVSSTVDGDTESSQRSRHSSRSSLRRDDVSDDEQNFKRKWGR

SEQ ID NO: 115829 - protein, 227 aa, Triticum aestivum
  Clone ID: PAT_TA_10247.pep
FHLKHMRVRGSEFKIQLIPVYEGTFKNLLLDLSRLATRPSGFCGPIGACQAPPPLGVVLCMAVITSPRVASASSALHFASRSGFRRFRPTREAAGRRIARSSGCQEAIAGMDEAESRRVMQSVGKIRMTRRSWRREPRKVPLMRKVLYFGQGGKTHTKQGYDTTAAQLLRFIRNFYAHTGGRTTYLPGRHLMISMLEGELAMSHLFSDFMAGAVAALVMDTGMHGHA

SEQ ID NO: 115830 - protein, 237 aa, Triticum aestivum
  Clone ID: PAT_TA_10248.pep
SPYPRGYYRCSSSKGCPARKQVERSRTDPNMLVITYTSEHNHPWPTQRNVLAGSTRSHYAKNSSNTDAASSKNSKNSSRNQHKPVVKAESKDQSAATPAATSTTTTATTSTGNNTPPMAVKEEAEMERRIGGDTTATVGYYSDHLLQQMFSQSYRPMMPEEAGGYHHQDDFFADLTELDSDPVSLIFSTEYMEARPGKEKAAAKDDVDSLFMMDWAPASAAVTTSAGSALEQGDMGL

SEQ ID NO: 115831 - protein, 72 aa, Triticum aestivum
  Clone ID: PAT_TA_10249.pep
SFEPSTLAMASSSMLKMAALLMLALFAAQLLMTTMASVACYNDEYKACFTTYKPTPTYQICHAQANLICGTN

SEQ ID NO: 115832 - protein, 309 aa, Triticum aestivum
  unsure (1)..(309): unsure at all Xaa locations
  Clone ID: PAT_TA_10250.pep
LTHNSFGPRVFELPVYTGPSLQYRVVTSFPTMLNLSNNKFTGVILPQIGQWNVLAVLDFSFNKLSGQIPQSVCNLTNLQVLDLSSNNLTGAIPAALNTLHFLSAFNISNNDLEGPIPSGGQFNTFQNSSFNGNPKLCGSMLTHKCGXSSNTSILHEKNETRRLFLQLHLVCSSGGIAVLLLLARLLVSIRLKGXQGKNRRESNGDVEATSFYSSSEQTLVVMRMPQGKEEETKLKFADILKATNNFDKENIIGCGGLGFLYKAVLPPAASLAIGMLSGGMWLRVPAGNAAVEALSXAQRENLVPRPRPR

SEQ ID NO: 115833 - protein, 83 aa, Triticum aestivum
  Clone ID: PAT_TA_10251.pep
EEPNKNYFSLAFVVSKYVNAAWELARGLVIGHVDGAEYVEGWTMRVARAVGLIIPGLPAHAPQDYVNATRLGAASLDLLLRDH

SEQ ID NO: 115834 - protein, 84 aa, Triticum aestivum
  unsure (1)..(84): unsure at all Xaa locations
  Clone ID: PAT_TA_10252.pep
FXXSPESHDIATQQRPACLLRVVDKQYPLDKQANVCSTIYSILLAAKIKRSICAEEIYSCTVVASSARNLLSACLNKMNRGINV

SEQ ID NO: 115835 - protein, 130 aa, Triticum aestivum
  Clone ID: PAT_TA_10253.pep
SGEIASFPLRDICAALGRWGLRDCPGVLCLSLPGLLSRLSALGGALRGKLLLMDCFAPGLSIFLFPARSVPLSFAPAVPAKNVHIECLEFGQSNIVLHARTKLLSYAPNVETLVISSPNEMTRTPTLSRK

SEQ ID NO: 115836 - protein, 168 aa, Triticum aestivum
  Clone ID: PAT_TA_10254.pep
ASPPPPPPPPPPFHSFPTFPPLTIWISIASISDLSLYLAVPTMVSSSSSMPAVSLTAPEDIAPLPLIRCPRCNLGVIQWFISETSLNPGCHFYKCEFRDTGRCSFWKWENKYIDYLRARWSHVFLPAAPPPHEAPTLILREIQYDIKIALAVALGTLAAVMTLLVSKM

SEQ ID NO: 115837 - protein, 95 aa, Triticum aestivum
  unsure (1)..(95): unsure at all Xaa locations
  Clone ID: PAT_TA_10255.pep
MCMDRSPVPAKKIWLAIASRLGLRPTAGLRKLRKEVRTCEYRDVHIMWEMLREXDSPVPLQEKQAAAAAAVAXAAAAARKKKEAWSRFVYYCCAF

SEQ ID NO: 115838 - protein, 67 aa, Triticum aestivum
  Clone ID: PAT_TA_10256.pep
KAMASSYGRLQVKMLALFLFHHLRTACGLYIFLINLHCDEQRCQANKTKKEIQSRIKRKHNQVTSRE

SEQ ID NO: 115839 - protein, 154 aa, Triticum aestivum
  Clone ID: PAT_TA_10257.pep
GIKYTSGSIQLLRTEDSGLGLAYLSELTIQLWERKSNFYGVTGWVLLQKAIQLQEVFPQGMFSAARGVHITGYAEETNAIVLSVLRDDFMLQVDTMEIKHIQKRKGDGFTFPYANFYVAGMQVDGGDIGDENWDVVDELMHYLGVPAHLDVDEF

SEQ ID NO: 115840 - protein, 263 aa, Triticum aestivum
  unsure (1)..(263): unsure at all Xaa locations
  Clone ID: PAT_TA_10258.pep
LLVGGVLALLRYSLFSQFDPGNAKAARYWPSAGNLQRLPSWGGGGCDDTSFSVPKEFSCPISLDLMRDPVVASTGQTYDRPSIIQWIGEGHSTCPNSGQALADNRLVPNRALRSLISQWCGMYCFQYDSPXSNEGMAECVATACSSKAAIEANKATARILVRMLVESSDSSKAVAAKEIRLLAKAGKRNRAFIAELGAIPLLCRLLLSSDQIAQENAVTALLNLSIYEPNKTRIMEQEGCLWLIVSVLQNGWTTEARENAAAT

SEQ ID NO: 115841 - protein, 157 aa, Triticum aestivum
  Clone ID: PAT_TA_10259.pep
RPPTPGSAPHRRPGWTSASRAPTSPSTSAASQNSRIRASSPTQPSPPQPLPPTTESPRHRRATPCTGSPRRTATGGTCSWDATALVRRRGPAAAVAAPAGPPAVHARRHALRKQPSAKGDMPAPSRRRSFRHLRPGRHRSRKQKQSNGVVVIECRPC

SEQ ID NO: 115842 - protein, 107 aa, Triticum aestivum
  Clone ID: PAT_TA_10260.pep
MKMHAGTFSLRNAIEIERPGVAGTAIRPDNKIAASAGWDHRIRVYNYNKGNALAILKYHSATCAAVTFSHDCKLLASCSADTTVALWELYPPKTPGKVDIAIEEVEK

SEQ ID NO: 115843 - protein, 187 aa, Triticum aestivum
  Clone ID: PAT_TA_10261.pep
PPPPCFSLPPRRKDSRFPAHPIATTSALPTPRVALGELIKMFSKLNLDARDMTALSGAHTVGMATCDTYRDRVYGTDRDEEIDPYFAQTTQHTCQGPSGKAPFDVQTPMRFDNAYYKNLIARRGLLSSDQTLYGGGGLQDNLVEMYSTDGEAFARDFAKAMVKMGNVPPPHGMPVEVRLKCSKANNY

SEQ ID NO: 115844 - protein, 138 aa, Triticum aestivum
  Clone ID: PAT_TA_10262.pep
SALLLLILIAAVSPPLLSIHLTSPPSSPLPIYSSKPTNGWLALALPMTALPWSALGRETRGRVRAAVRPEEAMGAPLCRGPDLAANSPPLAPDSGDPAPLILALTVRGGGQRLVQQRPTRVAPAYYATASLAREALAG

SEQ ID NO: 115845 - protein, 135 aa, Triticum aestivum
  Clone ID: PAT_TA_10263.pep
ARSATPRRPGSWCSTRFTGSPGPWHKHPPCSAGASHDWIAVRQQRKEHQHCFRPCIIMPVPTINPLANMFQAVPRMMRPVYICFGIWIDVCIVLVRALYSVNELQNYVVIVIQIRAPTVLYRLKFGGPADVLRSF

SEQ ID NO: 115846 - protein, 210 aa, Triticum aestivum
  Clone ID: PAT_TA_10264.pep
ERSSAADVAPNTPKPGANITDLIALFARFNLTAKDLAVLSGAHTIGKAHCSAFSPRLYNFTANNSASDPTLDANYTATLRGQCRAGDLATLVDLDPGSGTTFDLGYYRDVAASRGLLSTDAALLLDGDTRAYVMRQANATAPDEFFADFAASFVNMSKIGVLTHHKGEVRRQCSAVNPPSASSLAPVTMSAHAVLLASCFISIVTMALVL

SEQ ID NO: 115847 - protein, 107 aa, Triticum aestivum
  Clone ID: PAT_TA_10265.pep
EGINGQDLVSGQVPDIQIPSSSFFEHEQPIINGTNQNSDYSANSGEGENGTRKLLLLSEDSLPPLADFPTSNFGDACSTSSCEAVGNSTQLPIWSDSFYDEFMSEFA

SEQ ID NO: 115848 - protein, 233 aa, Triticum aestivum
  unsure (1)..(233): unsure at all Xaa locations
  Clone ID: PAT_TA_10266.pep
MGSNEMVLVPEIKHTKLFINGEFVDAASGKTFETRDPRTGDVLAHIAQADKADVDLAVNAAADAFEHGKWPRMSRYXRGARPCTTLPDLIEHHIRXPIRRYDAAAADKIHGESLRVSGKYQGYTLKEPIGXVGIIIPWNFPSLMFFLKISPALAAGCTVVVKPAEQTPLSALYYAHLAKLAGIPDGVINVVPGFSPTAGAAIASHMDVDSVAFTGSGEVRRLIMEASARSNLK

SEQ ID NO: 115849 - protein, 584 aa, Triticum aestivum
  unsure (1)..(584): unsure at all Xaa locations
  Clone ID: PAT_TA_10267.pep
MPLPLPFQRRRPPHPTAPRVPTAPPTSLPTSATAPPTAPPVSSAPPPRAAPGLLGRPTSGVGGRFGGGGAPPRRWDREPNPFGDEEEVPAEPVPFDEHQNTGINFEAYEDIPVETSGREVPPAVGTFAEIDLGAALNDNIRRCKYVRPTPVQRHAIPISLAGRDLMACAQTGSGKTAAFCFPIISGIMRGPPMQRSQLXGSRTACPLALILSPTRELSMQIHEEARKFSYQTGVRVVVAYGGAPITQQLRDLERGVDILVATPGRLVDLLERARVSLQSIRYLALDEADRMLDMGFEPQVRRIVEQMDMPPRGVRQTLLFSATFPGEIQRMASDFLENYIFLAVGRVGSSTELIAQRVEFVQEADKRSHLMDLLHAQRDSSEQGKQALTLVFVETKRGADSLENWLCTNGFPATSIHGDRNQQEREYALRSFKSGQTPILVATDVAARGLDIPHVAHVVNFDLPNDIDDYVHRIGRTGRAGKSGIATAFFNDNNSSMAKSLADLMQESNQEVPAWLTRYAARPSYGGGGGRNRRGAGGGSRFGGRDFRRESSSFGKGGGASDYAGGSSYGGGGYGGAGAPSAWD

SEQ ID NO: 115850 - protein, 103 aa, Triticum aestivum
  unsure (1)..(103): unsure at all Xaa locations
  Clone ID: PAT_TA_10268.pep
IRHEAKSPALAALLLLLLLLARSAEAEAREVPLSWELGVEDVADDGFGDVVVXRVLRSNYISYGAXRDSVPCSVCGTSYYNYRPGGQANPYSRGCSAITHCRG

SEQ ID NO: 115851 - protein, 166 aa, Triticum aestivum
  Clone ID: PAT_TA_10269.pep
PPPTPSPPPPSPPPPSPPPPTPSPPPPSPPPPSPSPPPPYYEVSPEERYLSPPPPAYQEPTTPPRYDVPAPYYEVSPEDRYHSPPPQAYQESPPPPYYEVSPEDRYLSPPPPEYEEPTTPPHYDLPAPPNYEVSPEDRHLSPPPPTTWKMPAYDYSSPPPPAAGQP

SEQ ID NO: 115852 - protein, 158 aa, Triticum aestivum
  Clone ID: PAT_TA_10270.pep
RAAARAGTTCIGNSGDLDKSLSDAIVDNDVVVVAVLSGNRNYEGRVHPLTRANYLASPPLVVAYALAGTVDIDFENEPIGIGKDGKEVYFKDVWPTNEEIEQVIKSNVLPKMFVDTYGSIMEGNDAWNNLVVPKETLYPWDPKSTYIHKPAYLGRDHA

SEQ ID NO: 115853 - protein, 201 aa, Triticum aestivum
  Clone ID: PAT_TA_10271.pep
RSSAAVVRAALLVLGALLLPAHHVMADYSAVAPTPPPPKPASAISKPPLPANDTNMSPSPSPPVQPVPPFVVVQGVIYCKSCKSRGYNRGMDASPIQGATVNLVCYGKKVVNVTATVSDEHGYFLVMFYDLANFNARNCKLYLGTSPTPLCDKPVYPPNKWIGLSLVKETVTSPPAGLQGVYCPTSVLFYGPSAGQHCPFY

SEQ ID NO: 115854 - protein, 145 aa, Triticum aestivum
  Clone ID: PAT_TA_10272.pep
KRRRRLASLRVLVASRFAMLTRFHAGYFRISLALSGQALLWRTLSDRSTDPSALHPLVQSLPSAAFVLLWSLALLTLFALCVLYVARCVLRLPAVRAEFRRHVGVNYLFAPWISWLLLLQATPFLRPDAPSYHMLWWAFSLPILV

SEQ ID NO: 115855 - protein, 300 aa, Triticum aestivum
  Clone ID: PAT_TA_10273.pep
KLHQPVLVRLANWEAITSSRSTREFDHHATCVVAKYETVDTFYRKCSCANYIGNVSVPLLCISALDDPLCTREAIPWDECRANKNIVLATTPNGGHLGFFQGLTAGRLWWVEPVSEFFSALHDSPCMHRQKTQEHGLQSPLESSIDKGPYVNLMEDGMVAAVTNEDTNTHESLDKHNQAVSEMEGSDVINVQQNGITSVLQDESHSAVKNTSGTEDNVPSAQGLVGSQEQREELSTDKIRDAIAPVKKSINQLIRSQGRSVWWLAYIAVVTSWPLLGAIGFFLYRKKFRNSSPAKRLLRG

SEQ ID NO: 115856 - protein, 170 aa, Triticum aestivum
  Clone ID: PAT_TA_10274.pep
MAFAVVGDAAAVTQLIGQAIGLVAMIIRAVETAHQNRLECERLACRVSTVDGVLSDLPRAQEMAPPLKVLNNTLEEAHRMVIACQNRGAASHFFGSRRHADCFNQVNNRITSDIVILNLSLNSFMARRHFNHVLHPNHVGVPTATVAMAPPWPGFSSGSLKTQLVVVPPP

SEQ ID NO: 115857 - protein, 182 aa, Triticum aestivum
  Clone ID: PAT_TA_10275.pep
YMQSRGRTDGSSRGRVLALVDLGGAARLNQLIHMERLGVGDVPGDGDVDGIAEPVLTFPETVVDAEDDAARPDAFRVREAEFVGAATVEPGTIGVFLVCHDGAAAALAVGEQPEVHESLRAVPRPVPRLHLQPVLTIPLGGAAASEEGGHQNDKGELGHGNGDGHGCGGYLLRILGSYTIDI

SEQ ID NO: 115858 - protein, 77 aa, Triticum aestivum
  Clone ID: PAT_TA_10276.pep
RRTIEKDSRTAYFIHRSHCVHLHPSWKDIQGGTDRPRSITKREESFHQENSMHLTPGATEPIVRRHPTRDTNQHLTQ

SEQ ID NO: 115859 - protein, 165 aa, Triticum aestivum
  Clone ID: PAT_TA_10277.pep
MDALTRLHRSLAGGDDEEWQEDDILGDTEGLCSLSPLQRLYAFAACLVAGLALMMLSLIVFARPIKFALLFTFGNIMAVGSTVFVMGVNKQLRMMLDPVRVYATAIYVGCAVFALIFALLIHDKLLTLIAIICEICALFWYSLSYIPFARRIVSDLMVKLCDTEL

SEQ ID NO: 115860 - protein, 499 aa, Triticum aestivum
  unsure (1)..(499): unsure at all Xaa locations
  Clone ID: PAT_TA_10278.pep
APRGGTKRNRWPLVLRKVLAALTTLLLSLVQQWELVLLALVSLVPLLLLTRSRRPWSQIQMKLPPGPAPLPFGGNLHQAGPLPHRTSRDLARRPGPVSQLPLGKAPTVVLSSPGAAWEGGKAHDLGCRTRPAAPGPKRLTYHLRNVACALFGSYRRNIRKLLVVELLSGRRAQXAWAARQERVQATCQHPYAGGREASGAGTRTDLDGQKPPTPQCRSAPRICPGISMGIATVEFTLANMLCCFQWALPDGMEPEDVSIGGGRKNKLPPQNPAPTSAHHTLGLNFTKDHVKALIFDTFIAGCXGTSSVTILWAMSELIRIPXRLLSKVHPEIWAVVGRNDRVRXEDVSKLEYLKLVVKETLRLHPPAPLLVPRETMRHIQIGGYDVPAKTRIYVNAWAIGRDPTSWPNHPEEFNPERFEGNEIDFKGEHPQMLPFGXGRRSCPGIAFGIATGKFTRPGLLWGFQRALPDGLAPEDVSMEEEGKINFHRKTPLILVPTIR

SEQ ID NO: 115861 - protein, 549 aa, Triticum aestivum
  Clone ID: PAT_TA_10279.pep
LAFAECRGPGTRPAELYDLSRIVRFLDTWGIINYLAAGSVHRGLRLASSLIREEQTGELQLASAPLKSIDGLILFDRPKCSARAEDIASVASTSSALEVPNGDTGFAHLDEKIWERLSENFCSYCSQPLPSLHYESQKEADIALCSDCFHDARFVPGHSSLDFQRVDGTKDGSDNDGDSWTHEETLLLLEGLEKYLPGRPPVAEHVGTKSKAQCIHHFIRIPVEDGLLESIEVPEASVSSRVQSNGFSYSIPHGGISGSVPQSSQPGQQLPFVNSANPVRPLVAFLASAVGPRIAASCANAALSVLTRDDSRMCSEGNDVMGQAARPNYDASSSVSPENVKYAAMCGLSAAATKCKLFADQEEREIQRLAATIINHQLKRLELKLKQFAEVETLLLKESEQVERARQNLTAQRVRFMSARFASSGGPMPGGSSSTMASNPMNQASPRPPAMPGSMPPASMQAFYGNNMQGHPAQMAFLQQQQRQQQQQQQQQQMLSFGPRLPLSAIHPGSSSSAAPSIMFNTGMPSSATPNHHSMLRPPPSGSNNSSFG

SEQ ID NO: 115862 - protein, 241 aa, Triticum aestivum
  Clone ID: PAT_TA_10280.pep
RQFGTRPRTLKSPMANEHFFPGEYFSSGLAAPFLGASYVQPPCSGFEAAAAMAFGLPWADQHLPVDSSATTAHFDSALSSLVSSPASATAGGGLGFAHGGEDDVAIGDLIGRLGSICNGASANNSCYSTPISSPPRGAPQAFRGYGAIAALETGRLSRVSSSKSLVGNTSGVAATAPLDQSAQLEMSPETDSQPAMQEPPTKKGAACSARKRKAAPAKGKAKASLPRSTAQLLRQFFFSLS

SEQ ID NO: 115863 - protein, 148 aa, Triticum aestivum
  Clone ID: PAT_TA_10281.pep
PICREESGRGLYKGLGATLLGVGPGIAISFYVYESLRSHWQMERPNDSNAVVSLFSGSLSGIAASTATFPLDLVKRRMQLHGAAGASQIEKSSITGTIRQILQKEGPRGFYRGIVPEYLKVVPSVGIAFMTYEVLKSMLSSIDGDDEN

SEQ ID NO: 115864 - protein, 81 aa, Triticum aestivum
  unsure (1)..(81): unsure at all Xaa locations
  Clone ID: PAT_TA_10282.pep
MGLLSPNASQERKGYRREYADIFLPLNKPPNCESKPPSPPPPPPTFFPLPNPSXSPAMAPKRAAKKAAPPPPPPPPAASSD

SEQ ID NO: 115865 - protein, 194 aa, Triticum aestivum
  Clone ID: PAT_TA_10283.pep
PAPACEHPTAHPLLRTDFDHPRSNFGLPTPIDRPPSQEFEFKMGNRFHTAQGRRGVDAVRCTKKSAVPVEEEGEKGTPPVNEVKIRVTTNQLGGPAAAPPPGGSVQRPPPLAAPRRGPRRRRPPRGAGRTVDAAAARHTRVASYPPAASGSSSSGVRRFFWLVASCSARAFCVAPPLRARRSGHRCAPGRPGNR

SEQ ID NO: 115866 - protein, 100 aa, Triticum aestivum
  Clone ID: PAT_TA_10284.pep
SSYMNKITIHERALQCIKKTTKKTDEQNNKIQALTGRLNGRRLGRLITIISIYVNMILPSSDRLAKNTATLTKVVGISQMHFLVCFCCGKQKVNLLDLSA

SEQ ID NO: 115867 - protein, 88 aa, Triticum aestivum
  Clone ID: PAT_TA_10285.pep
DCMLWLAVAVRTQATCSAFSTPRTPPAWADVSGRVQSSAMKLMSNDSGDGANKGLAMDMAHLGGGGGGGELWVVCGAGRGRTAQLLAD

SEQ ID NO: 115868 - protein, 107 aa, Triticum aestivum
  Clone ID: PAT_TA_10286.pep
MDGIMFSVARPFTRMIKNRESASRSRARKQAHVTQIESEVHQLRAEHQQLRLKYHQLKASVEVSVPVRKTLQRVLSGALLILLPSRGAEIEASSSSSHHRHYYYSHS

SEQ ID NO: 115869 - protein, 214 aa, Triticum aestivum
  unsure (1)..(214): unsure at all Xaa locations
  Clone ID: PAT_TA_10287.pep
PPPLNLPVLGFYVCDGPLPGPLVPRQLSLDALFANDNRFNVSLASGSLTNSTASVIVLANTKLAGCLPPSIGDMADTLAELILLNTSISSCIPPEIGQLKKLKVLDLSHNXRFAGELPESIGDMESLEVINVGYNMLSGAVPETICLLPNLKNLTVVGNYFCEEPVSCLHVPRRDDRMNCIPDWPHQRSHEQCIAFEHRPPVHCGADGCILPPP

SEQ ID NO: 115870 - protein, 295 aa, Triticum aestivum
  Clone ID: PAT_TA_10288.pep
NSARAEVCAFDDSSEKSFLPKRDLEWFFRGPRDRKYPNGSRTNRATTTGYWKATGKDRKVSCDGGAVCGVRKTLVFYKGRAPGGERTDWVMHEYRLCQDLLHGASNFIGAYALCRVIKRTEAGLLHGDAAAKARPGHQQMSKVGSSSSLVTTDQQLSSLTPSPPRLDIVGNAFQLHSSPSPLYGGEVVSGMGAPLGFPQQDAAATFFIDGDLAGAGETTQAHMPFFDDMGVVSDHELRWDTLPLCTNNAFSTTAGAAELWNPVAPNAAAPMLCREASDDLAAFFSSLDENNMVVY

SEQ ID NO: 115871 - protein, 341 aa, Triticum aestivum
  Clone ID: PAT_TA_10289.pep
RPRTRGLLAAFLIGQRMNRETDRELKGYCLAFDDELGPPPIADVNSLTHYGEPYDGNTRFFRSTLFVAAVRACYGEACLLHGVEWMPPKGGITEGQMLKFMGANTHLSPTQAKTLLEDKDTGFAYLNLQEACPPLYSIIGLREHIKISPPRPPSRPPQQFVRARGRESMVAGFYHVGYEDPLLMLMRRRTVHAGLVVKGEEGALSLTTKERSAHASKGIPVNHCSGFRTPSSANFSETDGISRESFRVAVDAQELGFKSTETPRTDKSVLKNLELGLSALGGDKGPAYDRIVLNAAMADHLLGCSGAQDINSALDRAREAIDSGNALRRLMNYIKISHKVS

SEQ ID NO: 115872 - protein, 111 aa, Triticum aestivum
  Clone ID: PAT_TA_10290.pep
SSNGVVAPSRVANILINITGSKENTNKHHHRHQEKHDGRQKRADCMIRVRSSWLKISCLLQINGNPNDFLLHPRHTGRIKSKEKQYTFEPQSKQDLTMHTEHSFYNQSYCT

SEQ ID NO: 115873 - protein, 57 aa, Triticum aestivum
  Clone ID: PAT_TA_10291.pep
QGYYSSAQGFLGNQFQSQPRTTPKQRHRLSNRPPNTRAKKDTYIYIVYCNNKSKKFP

SEQ ID NO: 115874 - protein, 381 aa, Triticum aestivum
  Clone ID: PAT_TA_10292.pep
FGPRVLQVFINGKFAGSSKGNASSSLISLTTPVTLVPGNSLGHLLRASVGRTVARCPLGSALRSPVPWPSPPRVRPRNSTRDRLSATVGLTNYGAFFDLVGAGITGPVKLTGPKGTLDLSSADWTYQIGLRGEDLHLYNPSEASPEWVSDNSYPTNNPLTWYKSKFTTPAGDDPVAIDFTGMGKGEAWVNGQSIGRYWPTNIAPQSGCVNSCNYRGPYGASKCLKKCGQPSQTLYHVPRSFLQPGSNDIVLFEQFGGDPSKISFTTKQTESVCAHVSEDHPDQIDSWISPQQKLQRSGPALRLECPKEGQVISSIKFASFGTPSGTCGSYSHGECSSSQALAVAQEACVGVSSCSVPVSAKNFGDPCRGVTKSLVVEAACS

SEQ ID NO: 115875 - protein, 102 aa, Triticum aestivum
  unsure (1)..(102): unsure at all Xaa locations
  Clone ID: PAT_TA_10293.pep
MPSQRKISALQAFEIETADDSGIVPHKKKDEEGPNVLADFSACMYKYEEEEAFEEAFNAIRSNVEXQTLLDSIFGFATGAWPGRRAPRSSYRDPAVRGPVQP

SEQ ID NO: 115876 - protein, 135 aa, Triticum aestivum
  Clone ID: PAT_TA_10294.pep
RRALASLASRPAPPPRPGPPRRATAGPAPPPPPPPPPPPPRPAPRPPRGCPSPRQLRLCRSGPGQGRRAPRQGPCLRASVPPLRHSSALRPPGDPVPKLVSYHSRRSLQRGAPHICCSPSLLLSCLGNQQVNVNQ

SEQ ID NO: 115877 - protein, 47 aa, Triticum aestivum
  Clone ID: PAT_TA_10295.pep
SARGVQPSCRRKLENKPKEEDYFYANPHECLANSSLCSGSKDTVTVR

SEQ ID NO: 115878 - protein, 157 aa, Triticum aestivum
  unsure (1)..(157): unsure at all Xaa locations
  Clone ID: PAT_TA_10296.pep
IAMVSEETKPKKQRDEECIINCLPGELIERIFLKLPVSTLLRCTGVCEQWHKIIRDPQFVTSHLQHASHYALLFFPQESVSREPHPADAILIDEAFALSTYAVPVIGPDDFLCGSCNGLLCLYTKSSTLKIANLATGEFLHLEKPAXXEKXLXXRXF

SEQ ID NO: 115879 - protein, 128 aa, Triticum aestivum
  unsure (1)..(128): unsure at all Xaa locations
  Clone ID: PAT_TA_10297.pep
SFHXPLGLXRNWPLEEVVAAAPGEMSPPSVAQTAASSGGLACPRAFPCGPRRGGGGGLPCSRRQEPPHVVRLAKISPLPAQLHAARGDRTRTGRSVDGVARLGRRRPGLSAMARRSARVFRRGILAWP

SEQ ID NO: 115880 - protein, 77 aa, Triticum aestivum
  Clone ID: PAT_TA_10298.pep
EFRHEGHHGRSSTTRDRNEDLHRGTAGVWCMCGLIDQVSLFAAHISPPISVHTLVPAFAFPCRIHQSIVMATPVVGL

SEQ ID NO: 115881 - protein, 180 aa, Triticum aestivum
  Clone ID: PAT_TA_10299.pep
RRHRRHYRGCCCRIRAPRTWRPTTSRAEIVRCSPQPNGTGAEAATDAHQAHGRRRTTEKFSREEEASGSGSPSPTARERRHGGGYSLHVKPCGRLKRRTPAADSGGDHRAVEATRRLQESLVVVKESGDPDFPASMAEMIAADDDVRASARGLEEPLACYLTFNDAEHNPAIVAAFPTCR

SEQ ID NO: 115882 - protein, 613 aa, Triticum aestivum
  unsure (1)..(613): unsure at all Xaa locations
  Clone ID: PAT_TA_10300.pep
RETKKAEKKKKQKKKQTAVDVGKGAPNTVSQHPTLEGEVDASNQAVTKHGLPDDTDELFWGSTARVESSSRAVGPPLGFRARVLPPKSLPEGYAINRAEWEPSALSEPHAAATQKGWKPTLGPRPKSLLEIQAEERLRAQRVAADSAQITMPAPPVPSGPWNTMSASSEQQFGGAGKSLGGQESAGDSRNKRSQLHDLLAEEVLARSSNADNENTGNANDVLFPLSPAVVQSDAPAFDDDDFIEAKDSKKNKKKGTKSKGSAAKAPLPVSSIDSSAMSIPAEKGKSSKQAKQEKEIPPAPPSGPSFGDFVPWKTDQTNFAPAPAWSNDSAKVHKPLSLRDIQREEERRSXLSKQQPPSPTPAKVSVNQRNHGNASSKQASGSSPSKAVAPVQMSSNPSNRSKSNAEDDLFWGPSDHSKQDKKQSEFPSLASQSKSSMTKDQSSVNRHKSQASKLPLSTAPSANLIGKGKAEAANKQTEAMDFRDWCDSEWSRLTGTNDTSFLEFCIKQSTAEAEMLLRENVGSLDRNGQFIDRFLNYKAFLSTDVIEMAFRAPSNRAPRLNPASAAKGGPSAEAEQDTGGKKKGKKGKKVSAAVLGFNVVSNRIMMGEIQNVD

SEQ ID NO: 115883 - protein, 116 aa, Triticum aestivum
  Clone ID: PAT_TA_10301.pep
PRVRPNSPAPPRRSNLAGTLNPPSSSRPRRRPGNPPSSSPRRPPSTTRTSPTPRTAAGEGDHAKQSAPTPSVSGCAAQQDRHSPQNPRRPGGINPRKLAALPSHPTEHAATRRPRE

SEQ ID NO: 115884 - protein, 346 aa, Triticum aestivum
  unsure (1)..(346): unsure at all Xaa locations
  Clone ID: PAT_TA_10302.pep
MSDALINGLAGAGGGIVAQLLTYPLQTVNARQQTERDPSKPAFKDGAVRQLCLVVQNEGWERLXGGLAPSLVGTAASQGVYYFFYQIFRSRAEAASLRRSIRGIGDGSVGMFQSLTVAALSGCVNVLLTNPIWVVVTRMQTHRKANKQQGPQDQGLTSALDKALQPAPVENVPHKTINVIQDLYKEAGAFGFWKGVIPALIMVSNPAIQFMLYETLLKKLKKRRASNFKGAQGLTAIEVFLLGAVAKLGATLVTYPLLVVKARLQAKQMIDDDKRHRYKGTFDAITKMMHYEGLSGLYKGMGTKIVQSVFASALLFMIKEELVKGARFLVTGDTSLVKKLPSKPSR

SEQ ID NO: 115885 - protein, 204 aa, Triticum aestivum
  unsure (1)..(204): unsure at all Xaa locations
  Clone ID: PAT_TA_10303.pep
MDAGDLSIVHHIGLVLLALWAAASFGCCHSVVFLIAFLYLYMVNARCAMRLXKRIQHAEMKSAYQQRLLSDGESVRWLNHAVKKMWPICLEKIVSQLLXPIIPWFLGKFKPWAVSKASVQELYMGRDSPIFTSMRVLPETSDDDHLVLELGMNFLSAEDMSVVLAMQLHKSVGLGMTANMHLTRMHVEGKVLLGVKFVRSWPFL

SEQ ID NO: 115886 - protein, 239 aa, Triticum aestivum
  unsure (1)..(239): unsure at all Xaa locations
  Clone ID: PAT_TA_10304.pep
PTQPARIRLPFPAPVRVQHHRRGAARALDPARRCSSAPPRDPPPRRTVTVGDHFHQAGPRSPRCFSFSRSLRFPSLTYSLSSPGNCRRQAPCHGIPCSTTASPSLTSRPSPPDSAAPPPVFFVQGKLCCCPARAAKSLSPRRCTPSSTSFSSPRRKPRPPQPPPESAPPRLCRIRSSTGPSRTVPFLSSSPLEPNHGHRRPRVAAARICSPPLPPAPXLSPGGCNPAASNPLXRPWVET

SEQ ID NO: 115887 - protein, 452 aa, Triticum aestivum
  Clone ID: PAT_TA_10305.pep
MRVKVISRSTDDFTRERSQDLQKVFRNYDPALRSQEKAVEYTRALNAAKLEKIFARPFIGAMDGHIDAVSCMAKNSNYVKAMFSGSMDGDIRLWDIAARKTVCQFPGHQGAVRGLATSTDGDLLISCGVDCTVRLWKDPMRKMMDTNDAIGDASQPSAVYTWKHAFWGAGHQWDRNVFATVGAQVDIWDHNRSEPINTFEWGKDTVLSVRFNPGEPDVLLTSSSDRSLTLFDLRMSSPARKLIMKTRCNSVCWNPREPMNFTAANEDTNCYSFDARKLNEAKVVHKGHVSAVMDVDYNPTGREFVTGSYDRTVRIFNYNGDHSREIYHTKRMQRVFCVKYTYDGTYLVSGSDDTNLRLWKSKASEQLGVILPRERKKQEYHDAVKARYSHLPEIRRIDKHKHLPKPIYKAGKIRRAMIEAESRKEERRRAHSAPGSRTMQPFRKRRLITEVE

SEQ ID NO: 115888 - protein, 158 aa, Triticum aestivum
  Clone ID: PAT_TA_10306.pep
MGAIGGNESVQWDKMNGAEVVNGGGSGAGSLDRIQVLVRVRPLSDKEIARGEPAEWECINDTTIMFRSTFPDRPTAPTAYTFDRVFHSECSTKEVYQEGVKEVALSVVGGINSSVFAYGQTSSGKTYTMTGVTECTVADIYDYINKHEERAFVLKFSA

SEQ ID NO: 115889 - protein, 135 aa, Triticum aestivum
  Clone ID: PAT_TA_10307.pep
LADEVHGLNGPRKPRLSAFPRIWVWTPRLPCVDGVDVAAAISLAAAFGMDGTLSADAEDVGTGADVRINKDAGRVGGFAPFPGTGHLIGQHPAGRRCSGHENDDGDQEEEQHGGPSHGCHRSITDAGRGYEMRLV

SEQ ID NO: 115890 - protein, 190 aa, Triticum aestivum
  unsure (1)..(190): unsure at all Xaa locations
  Clone ID: PAT_TA_10308.pep
QIYPQKLSYCIAHLVEKAYQQHTEPLEAPREWPDRINSQKEVLFVGEPEEVLEATQPAEFQRCMVPLFKQIGRCLNSAHFQVAERALFLWNNDHIVSLIAXQNRGVIFPIIFEALERNLQSHWNQAVHGLTANVRKMFLDMDSDLFDECHQQYIEKEEKAKELEEQRESAWRQLEAVAAKASGDDMVLVK

SEQ ID NO: 115891 - protein, 210 aa, Triticum aestivum
  unsure (1)..(210): unsure at all Xaa locations
  Clone ID: PAT_TA_10309.pep
MFGGGLVSAGGRARTGARLKGSVVLTRKNALDFNDLGATVMDSVTEFLGRGVTCQLISSTIVDSNNGNXAGXVGAEASLERWXTSLPFITVGDSKFSVTFDWAVDKLGVPGAIIVKNNHASXEFFLKTITLANVPGLGPVVFVATSGLPPQASDRPGRARHVPANKIRGGLNLTSFELGGTTEGPATLHYTTEPPLGVKEFLPCVRRSLH

SEQ ID NO: 115892 - protein, 141 aa, Triticum aestivum
  unsure (1)..(141): unsure at all Xaa locations
  Clone ID: PAT_TA_10310.pep
PPPRTHPPPSVSSLVFISSPPLLPPPPCPRPPSATPPSILIPSPPPSSSSPRPHRSHPPNRSQSLPDRERVRAHLLPSRSPPPPPSGGARRCPWPAPGPRSFAPPDPXPPRSCPTRSTGAXTPTPATPPXGASSPTCATSR

SEQ ID NO: 115893 - protein, 276 aa, Triticum aestivum
  Clone ID: PAT_TA_10311.pep
PSCSCRTRRAAPLLVSEGRHPSLGWQAGRAPRSSYCSARDATYTGGSPRARTGMGSTIRSVSSPHPIPCSGSTSYRKERLPARKGDKHALGQINKAPGNRGTAVPCGGRLSVVVTDSGALLAFGWGLYGQCGQGNTDDVLSPTCVSAILGVKMQDVAAGLWHTVSISADGDVYSFGGSLCALLGAASDQAETIPKLVDAPSLENKNARSVSCGARHSAIITDEGEVFCWGWNKYGQLGLGDSMDRNVPCIVPVDEYHPLNVSCGWWHTLVLAESPT

SEQ ID NO: 115894 - protein, 189 aa, Triticum aestivum
  unsure (1)..(189): unsure at all Xaa locations
  Clone ID: PAT_TA_10312.pep
NGSYAYXNMVPHPDGSNRVFLGTQAGKIVLATVPDQGSGGTLQFSEAGLFVDLTDQVHFDSTFGLMGMAFHPDFATNGRFFASYNCDRTKSPSCSGRCSCNSDVGCDPSKLGTDNGAQPCQYQVVVSRIFCXRLRPSNVSEVTSADPTEVKRIFTMGLPYTNNHGGQILLGPTDGYLYLMMGDGXRRIL

SEQ ID NO: 115895 - protein, 235 aa, Triticum aestivum
  unsure (1)..(235): unsure at all Xaa locations
  Clone ID: PAT_TA_10313.pep
MGDSQYSFSLTTFSPSGKLVQIEHALTAVGSGQTSLGIKAANGVVIATEKKLPSILVDETSVQKIQSLTPXIGVVYSGMGPDFRVLGRKSRKQAQQYYXLYKETIPGTQLVRETAAVMQEFTQSGGVRPFGVSLLIAGYDDNGPQLYQVDPSGSYFSWKASAMGKNVSNAKTFLEKRYTEDMELDDAIHTAILTLKEGYEGQISANNIEIGVIRADREFKVLTPAEIKDFLEEVE

SEQ ID NO: 115896 - protein, 256 aa, Triticum aestivum
  unsure (1)..(256): unsure at all Xaa locations
  Clone ID: PAT_TA_10314.pep
MGDSQYSFSLTTFSPSGKLVQIEXALTAVGSGQTSLGIKAANGVVIATEKKLPSILVDETSXVQKIQSLTPNIGVVYSGMGPDFRVLVRKSRKQXAQQYYRLYKENCSRLTQLVRXETAAVMQEFTQSGGVRPFGVSLLIAGYDDNGPQLYQVDPSGSYFSWKASAMGKNVSNAKTFLEKRYTEDMELDDAIHTAILTLKEGYEGQISANNIEIGVIRADREFKVLTPSEIKXSWKRWSKLPVDSLLSRTRKVSGP

SEQ ID NO: 115897 - protein, 175 aa, Triticum aestivum
  Clone ID: PAT_TA_10315.pep
LMFRTATRMLFSRLGVELLGLSEHRRSISGAATEHRRAAKTLSVLQWSFSGCQSIAGASQVLRRSIVEPPKHHQCCSGASRVVRALPVLRWSIVEPLKHHRCCRGASRGCQSIAGAATEHRRAADAMEEHRLSCRGITSRAMEHHQFLKELRPWCWDSSDVVLGLEMLQRDMGAR

SEQ ID NO: 115898 - protein, 204 aa, Triticum aestivum
  Clone ID: PAT_TA_10316.pep
RRAGLGHRLRARLPGLAAYHLARALPQGGRPGPPAGRGAPGGGAARAEGPGDDRPLPAPPGVAGRVRSLMVPADTKALRRLMDICAHGPPKYLPECLARDLLRAGQVNQGVGRSELIKGIASGPGFQITPLPQEVRIGWGEFDQIFPVAKAHKVIEKLGEKATVRIIPDTGHLPQQEDSKLFNQILLDFLLPPPSSSNGAAAAK

SEQ ID NO: 115899 - protein, 354 aa, Triticum aestivum
  unsure (1)..(354): unsure at all Xaa locations
  Clone ID: PAT_TA_10317.pep
MAASDETPMVQDLASTGVEEPPSRYLVHEQDRHGDLLAAGEMPEPIPLIDLSRLMDADEADKLRAALQTWGFFLATNHGIEDSLMDAMMSASREFFRQPSEEKQKCSNLVDGNGKHYQVEGYGSDKVVSEDHGLNWNDRLHLRVEPEDERNFAKWPSQPESFRDVLHEYASXTKKLRDLVLRSIAKLLDIDEDYFVNQISNKASGFASLYYYPPCPXRPDLXFGASGPHSDGSLLTILFNDDNVGGLQIQRDGRWYNVPTKPHTLLINLAXCLEIMNNGIFRSPFHKVVTNVEKDRLSLAVFYAVDAETMLEPAPGLLDDKRPSRSHGLWEASAQSKSPSYKNIASSLQLSGVA

SEQ ID NO: 115900 - protein, 360 aa, Triticum aestivum
  unsure (1)..(360): unsure at all Xaa locations
  Clone ID: PAT_TA_10318.pep
MAASDESPMVRPTVQELTAAGVEEPPRQYVLPEQDRHGDLLAADEFPEPTPLIDLSRLTDADEAERLRAALQTWGFFLATNHGIEDSLMDAMMSVSREFFRQPAEEKQKCSNLVDGNGKDYQVEGYGSDKVVSEDQVLNWSDRLHLRVEPEDERNFAKWPSHPESFRHQXDVLQEYASKNQENKRPXLRSIAELLEIDEDYFVNQISNKAPGFARFNYYPPCPRXPDLVLGLRPHSDGGLLTILFNDDTVGGLQIQRDGRWYNVPAKPHTLLINLADCLEIMNNGIFTSPVHRVVTNVEKDRLSLAVFYAVDAETMLEPAPGLLDDKRPPRYRKMLAKDFVAGLFEHFRQGKRFINTLKI

SEQ ID NO: 115901 - protein, 200 aa, Triticum aestivum
  Clone ID: PAT_TA_10319.pep
MVGTKLVALGYVVLLSIGLANAARVVRFGSGSATGTGAGGGEGGGTVSGGGSGAGSGTGSSVSSSSGSHASGGGGGGGGGGGGGQNGGTGYGSGSGSGSGSSQYSQGSSYPYGGGYGGYTSAGGAGGGGGGGKASGYQGSSGYGAGSGTGSGSATATNNWYRQGSTNADAGGNGGGNGGGRNGGSGAGKGAGSGYGNANP

SEQ ID NO: 115902 - protein, 214 aa, Triticum aestivum
  unsure (1)..(214): unsure at all Xaa locations
  Clone ID: PAT_TA_10320.pep
XSATLSQDMRQTAKKFMNPNSLIEVTVDSDSKLTLHGLQQYYIVLKEEEKNNKLLSWLDALEFNQVVIFVRTKNRAEKLKDILEKNGFPCLTMHSDMSQDERLKQYQSFKNFEKRIMISTDLLGRGIDIQRVNIVFNYDMPDEPDSYLHRVGRAGRFGTKGLAISFISSDMPSKIGNYERNITDQEVLDNIQKRFEVKIKEMPTQIDVGTYXTS

SEQ ID NO: 115903 - protein, 158 aa, Triticum aestivum
  Clone ID: PAT_TA_10321.pep
QGRSLQTSLWILPSPAAFGTATPLATTKSRNYSAGDVADYLVAIGFGEAVGPYESRVLPLFGGELPHPGVPVTSVIGVGVGTPERIDYPRDDFDATPSVVAGDGDGVVNLASLVAVQTPWSRHGGDFTLVKVSNMSHNDLLVDDRALDIIVREIQRAD

SEQ ID NO: 115904 - protein, 186 aa, Triticum aestivum
  Clone ID: PAT_TA_10322.pep
RQQLVAKQLESPDFRRSTIDGQTSAPTLLITVVVDSAFRARSVVQWHGLCQGPPTGTLPAGCIDDVTSTYYYYVADRACSERDCTGKFTGVQGGEAGRTAGGCVRHETNNHVHPSGQGPYACPEAQLMANCPVIRLNEDSAVERLLRWSAVTLEAAGCWVAGICGGRDHVLYACPESQLMADGFGG

SEQ ID NO: 115905 - protein, 98 aa, Triticum aestivum
  Clone ID: PAT_TA_10323.pep
RRNDGSPASSSLSRGRSMALHQIQRRCRRPLPAGRRRRRSSPPRPHVSDPVRDEEGWMRCGRGAREDGGGGRLRACGGCGGWRRGGRGAGAWGGTAVD

SEQ ID NO: 115906 - protein, 181 aa, Triticum aestivum
  unsure (1)..(181): unsure at all Xaa locations
  Clone ID: PAT_TA_10324.pep
FGTREMVDLRTLLLNCAQALSTDNRRTASELLKRIRQHSTPKGDAAQRLAHYFAEALDARLAGRGSELYQSLMARRTSVADFLKANQLYMAACCCKKVAFIFANKTICNAVVGKSRLHIVDYGLKXGLQWPGLLPMLAAREGGPPEXXITGIDLPQPGFQGAYHIEETGRRLSNFARVFGV

SEQ ID NO: 115907 - protein, 334 aa, Triticum aestivum
  unsure (1)..(334): unsure at all Xaa locations
  Clone ID: PAT_TA_10325.pep
MKELFEELPDNISMSIAASVKNIIEAPARALMEERAAGFKLGLFSRRFDGLWDSMRQLTSTELKFLAISMFTCDESFVRCCSTLKSISAVIDRLGDWVPELTGVIRQTKKDEAILIRDVDVVMRQNKEDEDVLTRDGDVVMRQNKEDEDVLSRDEEEEEEEDLDVRTYEVEKKAEEYYFAAYRRYWERRHGNGCNFEDPTVFTPMQATRSLPAFPGLPTNDAKLLRTMQIYSIKVAETKGIPLEWPXMYNGVVAARDVVDHRRNHLFLRTRDDCQILTEENPFLHLTGPSRAIMSXDTVMIEVQLQLKGRVQSEDAVLIGKAFTYDDDDHDDHG

SEQ ID NO: 115908 - protein, 84 aa, Triticum aestivum
  Clone ID: PAT_TA_10326.pep
TLSTLKEKNTTLCILVLDDTRQHQQQQRKIMVQDQKSQFQMFADVQRIHRAVEQASRLNQAVSSVMGGASTRATVSFGGHYSGF

SEQ ID NO: 115909 - protein, 290 aa, Triticum aestivum
  Clone ID: PAT_TA_10327.pep
MNAAAADCCNLFIIVFELDSFKGSTLAVMGATTEEQGEWAIVGGTGQFAMARGVIQRKMHQKLADGQGDVLELTIEAFCRRKGQPEPPATTPQTPTTQPIQPPVQPPPATTQPIQPPVQPPPAPTKPIQPPTPTPIKNGPWGGTTSDKLHHFNPNMSTGLKSVTFIYYRAVNGLRFNYTGAVGSVGSCALVGSAGHGPDAKRQTVHLGPREFVTELSGTHQHERRSNNIAIYSLKLVTNLGKTHGPFGSANIGAAFRFSVPPNSKIVGFFGGSTGYAVNSIGAYTLENSA

SEQ ID NO: 115910 - protein, 129 aa, Triticum aestivum
  Clone ID: PAT_TA_10328.pep
SVLIKQLRELIEEKDTVQSQLNCLMKSDADDHAQRGYCRLWRQFCRSSESFARNASEEALSVSDTYGGSYQDQGHAVFDESYVFSADHDDLSVPNQTMDLPQQTRVRKPISPWHPPSNYCSVPSEPDAM

SEQ ID NO: 115911 - protein, 207 aa, Triticum aestivum
  Clone ID: PAT_TA_10329.pep
MRLLWTACLLGLIILIDLLYLVEIYMDIEFHLLETITNKFADKVGSGGYGEVYKGLYNGKEIAVKRLHPLQGLDDKAFDSEFRNLSKVKHKNVVQLLGYCYQIVKKFVPYNGELVMAMEMERILCFEYMEGGSLDKHIGDESCGLDWQSCYQIIKGTCDGLNHLHGAHEKPIFQSWDLKPSNILLGKNSKDGQNCRSWVVQLPQLKP

SEQ ID NO: 115912 - protein, 82 aa, Triticum aestivum
  unsure (1)..(82): unsure at all Xaa locations
  Clone ID: PAT_TA_10330.pep
ATLSRFVFVLEIRIKRAFTLLFHTRFLFSLSSXLGHLRYLLTDVPPQPNSPPDNVFRPDRPGKTGPWSQKEGTCPASDPRNK

SEQ ID NO: 115913 - protein, 107 aa, Triticum aestivum
  unsure (1)..(107): unsure at all Xaa locations
  Clone ID: PAT_TA_10331.pep
FAYGERGLGFAGGDDSSTASATGAELTSAGDSVAATTVAFTMIGRADIEGSKSNVAMNAWLPQASYPCGNFSDTSSFKLRRSKGSXATLSRFVFVLEIRIKRAFTLL

SEQ ID NO: 115914 - protein, 238 aa, Triticum aestivum
  unsure (1)..(238): unsure at all Xaa locations
  Clone ID: PAT_TA_10332.pep
MRARRLEKTRGDLLCLLAGSIVVAAAWRGRRRLHALLYQVVAQPLHHQVALPRGHGLVVDADHQRLPGLLQGDASRALLAADDGARFTMIGRADIEGSKSNVAMNAWLPQASYPCGNFSDTSSFKLRRSKGSXATLSRFVFVLEIRIKRAFTLLFHTRFLFSLSSXLGHLRYLLTDVPPQPNSPPDNVFRPDRPGKTGPWSQKEGTCPASDPRNKXNNVKSSGIXTCAREGSHLSYTS

SEQ ID NO: 115915 - protein, 137 aa, Triticum aestivum
  Clone ID: PAT_TA_10333.pep
MARTKQTARKSTGGKAPRKQLATSIAARKSAPTTGGVKKPHRYRPGTVALREIRKYQKSTDLLIRKLPFQRLVREIAQDFKTDLRFQSHAVLALQEAAEAYLVGLFEDTNLCAIHAKRVTIMPKDIQLARRIRGERA

SEQ ID NO: 115916 - protein, 161 aa, Triticum aestivum
  Clone ID: PAT_TA_10334.pep
AQREQKSRVEQKGKSSFDSDFQYEYEPWKQKKIKNPNYQGKWKAPMIANPDFKDDPYIYAFDSLKYIGIELWQVKSGTLFDNILITDDAALAKTFAEETWAKHKEAEKAAFDAAEKKKEEEDASKAGEDDDDLDDEEADDEDKDDKAGSDAESDDEKHDEL

SEQ ID NO: 115917 - protein, 110 aa, Triticum aestivum
  Clone ID: PAT_TA_10335.pep
AGRFGLSGRETITRVTGGMKVKADRDESSPYAAMLAAQDVAARCKELGINALHIKIRATGGNGTKTPGPGAQSALRALARAGMKIGRIEDVTPTPSDSTRRKGGRRGRRL

SEQ ID NO: 115918 - protein, 81 aa, Triticum aestivum
  Clone ID: PAT_TA_10336.pep
MQNEVGDMVDLYVPRKCSATNRIITAKDHASVQINIGHVDANGLYNGSFTTFALSGFVRAQGDADGSLDRLWQQKRAEIKQ

SEQ ID NO: 115919 - protein, 78 aa, Triticum aestivum
  Clone ID: PAT_TA_10337.pep
FPVRIRTVKAWPIDPLDLRSLKLEVSEKLPQGNGAGHCRQFRDWGRKRRLAPTGWISFNSKHSRLFPSDSLVNVKHKF

SEQ ID NO: 115920 - protein, 114 aa, Triticum aestivum
  Clone ID: PAT_TA_10338.pep
YQIWKYHFVFLSCSPANTNQNNTISSIIVNIKGWDKNVSTQNTQWHLNLILINTSSTKCSTLGLFSVYQKIPSICSMKGKIFPTAQLTTHTSQPHLRRTPAFKNRRKARRKEQL

SEQ ID NO: 115921 - protein, 136 aa, Triticum aestivum; identical to SEQ ID NO: 106789
  Clone ID: PAT_TA_10339.pep

SEQ ID NO: 115922 - protein, 131 aa, Triticum aestivum
  Clone ID: PAT_TA_10340.pep
EYKGPWIQKKIKNPNFKGKWKAPLIDNPEFKDDPYIYAFDSLKHIGIELWQVKSGTLFDNILITDDPEYAKKFVEETWGKHKDAEKAAFDEAKKKRLEEVYMQTSSICYTAFYAKSSTNYSVFSLSGIRKR

SEQ ID NO: 115923 - protein, 122 aa, Triticum aestivum
  unsure (1)..(122): unsure at all Xaa locations
  Clone ID: PAT_TA_10341.pep
MATPLRLAALLLLVLVAAFASAARADLVISRADRKVDLTSHIVRVLTSLKVENAGSEPVSKVLLAFPNIQAKNLAAIRAFGTEGKVKGLSSILPIEVVXLPGVPPELTFLSAFVHKPLDKGK

SEQ ID NO: 115924 - protein, 223 aa, Triticum aestivum
  Clone ID: PAT_TA_10342.pep
RPTALSRTELSQTYILQHQWPPPIPPPPPLPIPKPNPPPSQPFKGARISGSLHMTIQTAVLIETLTALGAEVRWCSCNIFSTQDHAAAAIARDSAAVFAWKGETLEEYWWCTERCLDWGVGGGPDLIVDDGGDATLLIHEGVKAEEEFEKSGKVPDPESTDNPEFKIVLTIIRDGLKTDASKYRKMKERLVGVSEETTTGVKRLYQMQESLQACGLPVLVCPA

SEQ ID NO: 115925 - protein, 107 aa, Triticum aestivum
  Clone ID: PAT_TA_10343.pep
SFLEINPTKGNKSWSSTAVAAALELVDPPGCRNSAPGRRMMMTSGEAVKYKSSLDAFQQILAKEGAKSLFKGAGANILRAIAGAGVLSGYDQLQILFFGKKYGSGGA

SEQ ID NO: 115926 - protein, 129 aa, Triticum aestivum
  Clone ID: PAT_TA_10344.pep
IRGIELITRDTRVDPVGSSKPTIATTLRTDSSSHRTRLARAGDPIPIGITPRSGIKPNSTKEIGQLQLVCTRQLRAPPPFSLQPAAPAASARDRAKPQLAPRAASLFSRTPEVVVGWRQRSQNIYYHRG

SEQ ID NO: 115927 - protein, 95 aa, Triticum aestivum
  Clone ID: PAT_TA_10345.pep
MAKKGKWFSAVRRVFSSSDPEGKEAKTEKADKPKSRRKWPFGKSKRFDPPTSTVSDITPVAPSPLPLSFSPTQPSQPQPEEIKDVKPVETESEQN

SEQ ID NO: 115928 - protein, 65 aa, Triticum aestivum
  Clone ID: PAT_TA_10346.pep
SSSCKSKLQGKVGEETITGTANYKSKMHLVRRSTYVLLVIRLRIRPSLVILVLVIGFLILSTKTR

SEQ ID NO: 115929 - protein, 147 aa, Triticum aestivum
  unsure (1)..(147): unsure at all Xaa locations
  Clone ID: PAT_TA_10347.pep
MALSVEKTSSGREYKVKDLSQADFGRLEIELAEVEMPGLMACRAEFGPSKPFAGARISGSLHMTIQXTAVLIETLTALGADVRWCSCNIFSTQDHAAAAIARDSAAVFAXKGETLEEYWWXCTXRXLDWGEAGGPTHRREPRCYHKV

SEQ ID NO: 115930 - protein, 83 aa, Triticum aestivum
  Clone ID: PAT_TA_10348.pep
MYQKSTELLIRKLPFQRLVREIAQDFKTDLRFQSSAVSALQEAAEAYLVGLFEDTNLCAIHAKRVTIMPKDIQLARRIRGERA

SEQ ID NO: 115931 - protein, 105 aa, Triticum aestivum
  Clone ID: PAT_TA_10349.pep
ENLIMIRWIAHGIPRVPWDGHARFDGASVYKLDRNGKIYEHKVHNIATTPPTKYKVLSVQELVRSLSCPSTPKPTYFEASSQSLSTASLYSRLAWIRRLANLRGE

SEQ ID NO: 115932 - protein, 200 aa, Triticum aestivum
  Clone ID: PAT_TA_10350.pep
IRCPHDRTKKTNEHTSLCFLPNRLTALLAMIACRTLCLLMVELAQVTPHLVGQHDGGFHGAARPWCRRASRWSPRAGRGACQSWSRRSCAAGPRRRSSISSRLLPPSRHSPPPPPLLGPVTARGRPSSWSWIAVDRLRPSSRKAGRRRQQLCWPCLDHVDGGGSGRRRRVDATVDLGAASPRPPRALGAGCGSWPFPSTL

SEQ ID NO: 115933 - protein, 300 aa, Triticum aestivum
  unsure (1)..(300): unsure at all Xaa locations
  Clone ID: PAT_TA_10351.pep
RLDSIDLFFGSLLVHQLQLTSDPKTTTGRKNRSGEVISEIISSSLAPLHLDLLLEHLAELHLLAHHPRLHELLLQAVLLGRPRVLHAAPEAAVELDVHRVRRAPLPHARRAEADVLNAALDGGFCFTMIGRADIEGSKSNVAMNAWLPQASYPCGNFSDTSSFKLRRSKGSXATLSRFVFVLEIRIKRAFTLLFHTRFLFSLSSXLGHXLRYLLTDVPPQPNSPPDNVFRPDRPGKTGPWSQKEGTCPASDPRNKXNNVKSSGIXTCAREGSHLSYTSQVISQSRTRVKLNRVFFPRYSA

SEQ ID NO: 115934 - protein, 112 aa, Triticum aestivum
  Clone ID: PAT_TA_10352.pep
VHVKIPVGKRCGFVQYANRPSAEQALQLLQGTLVGGQNVRLSWGRSPSNKQTQPQEASQWGAGAAAGAAGGYYAGYGQGYEAYGQGYGYGAYAGYPNYQQPAAAPQPPPPQQ

SEQ ID NO: 115935 - protein, 178 aa, Triticum aestivum
  unsure (1)..(178): unsure at all Xaa locations
  Clone ID: PAT_TA_10353.pep
RAWLPQASYPCGNFSDTSSFKLRRSKGSXATLSRFVFVLEIRIKRAFTLLFHTRFLFSLSSXLRHLRYLLTDVPPQPNSPPDNVFRPDRPGKTGPWSQIEGGPSGCLTGSSARSGCSMARAHCEEGTHSHKQNSFPTVSVEALGHGFLVNVSSDKSCPGLLVAVLEAFEELGLTVLQA

SEQ ID NO: 115936 - protein, 134 aa, Triticum aestivum
  unsure (1)..(134): unsure at all Xaa locations
  Clone ID: PAT_TA_10354.pep
VDDQAQSLGSAFEGKSIYSPFVHVCPMEEVAPXXSDGGPFVNTFDKAGCDSSSSISNSDWQFTLITIHVWEKGTHRKGNRKVHSFDVCCKCFCHVAHIVAIRRGDVVDDLSQSKNIMIVELNCVAPHNVATKLI

SEQ ID NO: 115937 - protein, 138 aa, Triticum aestivum
  Clone ID: PAT_TA_10355.pep
IHRPWKANSIQKFKGKKIHGEPCIHYLDEFSHHIVWANTVKLYNHNVRTLRKIIRSTTTPDNYYVCHMTETFATQGKRMYFSVPFSRGSISHTWMLTMVNCQSLLETELPLSRPALSRVFTKGQPSLKAGATSSVRHT

SEQ ID NO: 115938 - protein, 116 aa, Triticum aestivum
  Clone ID: PAT_TA_10356.pep
VDDQAQSLGSAFEGESICLPFAHVCLREEVLQPMVTLLSNTLDKVVVTAVVPSRRMYFPGFSWIFLPLNFWIEPALRIFIAHALMNSKQNTYMGNLATADITGCVCFFLFNCCHLG

SEQ ID NO: 115939 - protein, 161 aa, Triticum aestivum
  Clone ID: PAT_TA_10357.pep
MADRANHPSVMQKFGGQFHLASSFSEGVRARNICPSVPSYERRFTTSSYMTQNLGISVPMMSSSPLFANAPPEKKGVKNFAIDFLMGGVSAAVSKTAAAPIERVKLLIQNQDEMIKAGRLSEPYKGIGDCFGRTIAGAGVLSGYDQLQILFFGKKYGSGGA

SEQ ID NO: 115940 - protein, 69 aa, Triticum aestivum
  Clone ID: PAT_TA_10358.pep
SVVAAEVHNIATNPPTKYKVLSVQELVRSLSCPSTPKPTYFEASSQSLSTASLYSRLAWIRRLANLRGG

SEQ ID NO: 115941 - protein, 58 aa, Triticum aestivum
  unsure (1)..(58): unsure at all Xaa locations
  Clone ID: PAT_TA_10359.pep
MVTQKKAKTLPVVPATTCRTWFVFVLEIRIKRAFTLLFHTRFLFSLSSXLGHLRFSRA

SEQ ID NO: 115942 - protein, 81 aa, Triticum aestivum
  Clone ID: PAT_TA_10360.pep
SSGRPGRLRGLLQELVVVLLVLSNLKEELNALLDKVLPDDLEDLDLVGLFEDTNLCAIHAKRVTIMPKDIQLARRIRGERA

SEQ ID NO: 115943 - protein, 128 aa, Triticum aestivum
  Clone ID: PAT_TA_10361.pep
SYQATLTSFREAGSTFGGSEWRLALSFSLSAGVTFGFSAAGKDRRFFIDEWTRDALSGTSNLSANTMWYRDFALADFVLNYSDSSKRRPLGQSRSARPVVLKQGETTLARSLFSFCPAPRKQRSTCMC

SEQ ID NO: 115944 - protein, 244 aa, Triticum aestivum
  Clone ID: PAT_TA_10362.pep
VVAVKKLVVGPWAGSAGPPHGEHRPTRPFGRHRAPSLNWPGRVSGIVTLKKLVEEGKVKYIGLSEASPDTIRRAHAVHPISSVQMEWSLWARDIEPEIVPLCRELGIGIVPYSPIARGFFGGRGVTQQVSAESSLKGHPRFSAENLEKNKQLYLKIEELAKKHQCSPAQLALSWVLHQGDDVVPIPGTTKIKNLDSNIDSLKVRLTEDDLKEISNEIREEDVAGGRQYTSFAKFTWNYADTPKK

SEQ ID NO: 115945 - protein, 83 aa, Triticum aestivum
  Clone ID: PAT_TA_10363.pep
MSYYGQQQAPVGAPPQQGYPPQGYPPAVYPPPQQGYPPAGYGQQGYPPQQGYPPQQQQQNSGPSFMQGCLAALCCCCLLDACF

SEQ ID NO: 115946 - protein, 254 aa, Triticum aestivum
  Clone ID: PAT_TA_10364.pep
AIEIAEAVTGALKGELAASAVNAPMVPAEVLSELAPYVMLAEKLGRLAVQLVAGGGGIKSVKVTYASARAPDDLDTRLLRAMITKGVIEPISDVFVNLVNADFTAKQRGIRVSEEKIVMDGSPSPETPLEYIQVQIANVDSKFPSAISDSGLVTVEGRVKDGIPHLTKVGAFEVDVSMEGSLILCRQVDQPGMIGSVGSVLGEENVNVSFMSVGRIAPRKTAIMAIGVDEEPSKATLTKIGEIPAIEEFVFLKL

SEQ ID NO: 115947 - protein, 185 aa, Triticum aestivum
  Clone ID: PAT_TA_10365.pep
LGLPDISEAKKKAVAVPYDGEDKNGFLKKLALRFKDPENTTLIILDKFDGNSELVAELVTSNGYKGAFAVKDGAEGPRGWQSSDLPWTAPKKGFSLDFGELFGDGSEGLPVTIGLAAATGLGLLAYTEIETVLQFLGSAAIVQLVASKLVYAEDRKKTLQQIDDFFNKKIAPKELVDEIKEIGQA

SEQ ID NO: 115948 - protein, 276 aa, Triticum aestivum
  unsure (1)..(276): unsure at all Xaa locations
  Clone ID: PAT_TA_10366.pep
RNSARGGLGGGGGYGGGGGLGGGAGHGVGGGLGGGFGKGGLGGGFGKGGGLGGGIGKGGGLGGGIGHGIGGGFGKGGGLGGGIGKGEGLGGGFGKGGGLGGGIGKGGGLGGGFGKGGGLGGGIGKGGGLGGGFGKGGXGLGGGIGKGGGLDGGFGKGGGLGGGIXKGGGLGGGFGKGGGLGGGIGKGGGXGGGIGHGIGGGFGKGGGLGXGIGNGGGLGGGAGGGYGNGGGLGNXGGLGGGIGHGLGGGIGKGGGLGGGFGKGGGLGGYKRPRPAQ

SEQ ID NO: 115949 - protein, 148 aa, Triticum aestivum
  Clone ID: PAT_TA_10367.pep
KGASQHKTHVGDDLGHRKKHRKHDYQFNVNKYKKPVPNLIRLAPSTNHLKGAIYIECKTTQMEKALFITGLKYHSRSDTGILLSLRYSKLLGMRPSSVVLFFGINDDRTSQSVLILQSLVCSNDACRSSRQKHLCRLDWWHSMVLTLE

SEQ ID NO: 115950 - protein, 213 aa, Triticum aestivum
  Clone ID: PAT_TA_10368.pep
MNPRDSGDDSPGATAGSSSAAPAQQHQRQSLEWRFAQVFGERAAGEDVQEVDIISAIEFDKSGDHLATGDRGGRVVLFERTDARDEHANRRELERQDVPITRHPEFRYKTEFQSHEPEFDYLKSLEIEEKINKIKWCQTANNALFLLSTNDKTIKYWKVQEKKVKQVSVMALDTSRTVGDGTTSRASTSTSEPPLPNGGCSKKSDSLNSDLAF

SEQ ID NO: 115951 - protein, 74 aa, Triticum aestivum
  Clone ID: PAT_TA_10369.pep
MSYYGQQQGYPPQGYPPAVYPPPQQGYPPAGYGQQGYPPQQGYPPQQQQQNSGPSFMQGCLAALCCCCLLDACF

SEQ ID NO: 115952 - protein, 93 aa, Triticum aestivum
  Clone ID: PAT_TA_10370.pep
GIPHLTKVGAFKVDVSMEGSLILCRQVDQPGMIGSVGSVLGEENVNVSFMSVGRIAPRKTAVMAIGVDEEPSKATLTKIGEIPAIEEFVFLKL

SEQ ID NO: 115953 - protein, 77 aa, Triticum aestivum
  Clone ID: PAT_TA_10371.pep
MSYYGQQQAPVGAPPQQGYPPQGYPPAGYPPPQQGYPPAGYGQQGYPPQQQQQNSGPSFMQGCLAALCCCCLLDACF

SEQ ID NO: 115954 - protein, 157 aa, Triticum aestivum
  Clone ID: PAT_TA_10372.pep
VGALTGASEIPLLLTLFYLFRGSEAGHVPSFWLQGPVLPGRSGRKTLSGGEFGWGGTSVCSQEELAAVKIQTAFRGYLARRALRALRGLVRLKSLVDGNAVKRQTAHTLHCTQTMARVQTQIYSRRVKMEEEKQALQRQLQLKHQRELEKMKIDEDW

SEQ ID NO: 115955 - protein, 132 aa, Triticum aestivum
  unsure (1)..(132): unsure at all Xaa locations
  Clone ID: PAT_TA_10373.pep
MSWQTYVDEHLMCDIEGHHLASAAILGHDGXTVWAQSADFPSFKPEEMTNIMKDFDEPGTLAPTGLLLGDAKYMVIQGEPGAVIRGKKGAGGITLKKTGQALVVGIYDEPMTPGQCNLVVERLGDYLVEQGM

SEQ ID NO: 115956 - protein, 150 aa, Triticum aestivum
  unsure (1)..(150): unsure at all Xaa locations
  Clone ID: PAT_TA_10374.pep
WIQKKIKNPNFKGKWKAPLIDNPEFKDDPYIYAFDSLKHIGIELWQVKSGTLFDNILITDDPEYAKKFVEETXWGKHKDAEKAAFDEAKKKRLEEESANTKTEDNDDAADEDEGKAAGDSDEENKDASGDEKVEEISKDASSSSDKKDEL

SEQ ID NO: 115957 - protein, 110 aa, Triticum aestivum
  unsure (1)..(110): unsure at all Xaa locations
  Clone ID: PAT_TA_10375.pep
LQATVQQIQGIFDQCLAVHDKLETSLHDLSRTGGAKSCKAAHKAADAQFKELVKELKRLLLSVXSSPQSYQIWPKLEGLVAKEREMQEKLMARHATVVDSFEKKQRRQES

SEQ ID NO: 115958 - protein, 78 aa, Triticum aestivum
  Clone ID: PAT_TA_10376.pep
ITCNKGHHGPVHCVRFAPGGESYASGSEDGTIRIWQLSPPNVDAEEAVDTNGKPKAGAEEIACKIEGFHIAKEEKAGE

SEQ ID NO: 115959 - protein, 181 aa, Triticum aestivum
  Clone ID: PAT_TA_10377.pep
LIEPMMLITGFFLLFVACIAYMHTDMSISKNSPSYLAKLQWDEVQATVQQIQGIFGQCLAVHDKLETSLHDLSRTGDAKSCKAARKAADAQLKELAKELKPLWLSVQSSPQSYQIWPKLEDLVAKEKELQEKLMARHATVVDSVEKKQRGQDIENRIASQQQKIAALRQEVESLLEYLSEI

SEQ ID NO: 115960 - protein, 135 aa, Triticum aestivum
  Clone ID: PAT_TA_10378.pep
PERTVVRDVTHYMTLWSRSPLTLRYLSCAPPPTCNLSCDLSCLRFILTNPLTRSSISSSSSLCHSLSMSCLGRHVTSCLALALSMHFYSRNDKQYVVPLSACISTSQFPAAPCDVYHLSYSPTGSRRIPLILSTL

SEQ ID NO: 115961 - protein, 46 aa, Triticum aestivum
  Clone ID: PAT_TA_10379.pep
PRVRPRVRAYLVGLFEDTNLCAIHAKRVTIMPKDIQLARRIRGERA

SEQ ID NO: 115962 - protein, 121 aa, Triticum aestivum
  Clone ID: PAT_TA_10380.pep
MAATGEETVRASHILIKHEGSRRKASWKDPEGRVISATTRADAAARLGDLRAQILAGRGSFADLAAQHSDCSSARRGGDLGTFGRRQMQKPFEDATYALKVGEISDIIDTESGVHIILRTA

SEQ ID NO: 115963 - protein, 193 aa, Triticum aestivum
  unsure (1)..(193): unsure at all Xaa locations
  Clone ID: PAT_TA_10381.pep
MAAAQLRGSAVPGTAGRWPAPSGAILRFAPLATSRLPAASLRQRGAFSGLSAGVVRELIALQSLTTMCMKSKCTSTPIDHATAPEHTEDEVPEPTAVVTASEEINIDQEVAPPHKSAIIHDFCLGIPFGGLLFSXALVGFLFWRSPVSLTFGVAPGLAILGLAVLSLKGWREXGKSSLPFILAQAAVAAAVAW

SEQ ID NO: 115964 - protein, 202 aa, Triticum aestivum
  unsure (1)..(202): unsure at all Xaa locations
  Clone ID: PAT_TA_10382.pep
GFGKGGGLGGGIGKGGGLGGGIGHGIGGGFGKGGGLGGGIGKGGGLDGGFGKGGGLGGGISKGGGLGGGFGKGGGLGGGIGKGGGLGGGIGHGIGGGFGKGGGLGGGIGNGGGLGGGAGGGYGNGGGLGNGGGXGGGIGHGLGGGIGKGGGLGGGXGKGGGLGGGFGGGDGGGGGFGGGFGKGGGFGFGIGKGGGGGIGGGH

SEQ ID NO: 115965 - protein, 212 aa, Triticum aestivum
  unsure (1)..(212): unsure at all Xaa locations
  Clone ID: PAT_TA_10383.pep
SLAKIGYFDISIWKRVTMIGRADIEGSKSNVAMNAWLPTSQXYPCGNFLDTSSFKIPEDLKDRXATLSRFVFVLEIRIKRAFTLLFHTRFLFSLSSXLGHLRYLLTDVPPQPNSPPDNVFRPDRPGKTGPWSQKEGTCPASDPRNKXNNVKSSGIXTCAREGSHLSYTSQVISQSRTRVKLNRVFFPXADSAKPVPLAVVSLDSRQGQWESR

SEQ ID NO: 115966 - protein, 129 aa, Triticum aestivum
  Clone ID: PAT_TA_10384.pep
MTSNQFDLPGSPDAASARSHHPAAVAPRHPAGINGHVATPATPPPMATPPSMAPTTSPTVAPTTSPTATPSMSPTSPKTTSPTSSPTSSPSLTPAGTPVTGQQRLERARRPGVGGRWWPWRAAGLAVFL

SEQ ID NO: 115967 - protein, 124 aa, Triticum aestivum
  Clone ID: PAT_TA_10385.pep
RYFTYSVGRKQELEKLLQDQEVMRTSLLQWCYASYSEVFSSWMHFSAVRVFVESILRYGLPARFLSVVLAPSTKSEKKVRNILEGLCGNANSSYWRSEDDVGMAAGLGGETESHPYVSFTINFV

SEQ ID NO: 115968 - protein, 45 aa, Triticum aestivum
  Clone ID: PAT_TA_10386.pep
KHLDEKVAALHLGKLGAKLTKLTKSQADYISVPIEGPYKPAHYRY

SEQ ID NO: 115969 - protein, 266 aa, Triticum aestivum
  Clone ID: PAT_TA_10387.pep
MRRYSPQYRSPPRRGYGGRGRSPPRRGYGGRREQGSGSLLVRNIPLSCRPEDLRVPFERFGPVRDVYLPKDYYTREPRGFAFVEFVDPYDASDAQYHLNHTVFFGREITVVVAAESRKRPDDMRNRARIRGYSGEPERRHSRYGRSRSRSCSYSPRYRGRPRSRSRSRSYSPAPRRRDDYSASPPRSHHTQSPRRLPKGHEEDERRSYSPAGRGGGERDANTNGKRSPPSDIDGSPPRIRRSPRQSSGSPVGSRSRSPEASPARSD

SEQ ID NO: 115970 - protein, 358 aa, Triticum aestivum
  Clone ID: PAT_TA_10388.pep
RHEALLRLPLLSLRKPLPSLPRPLLRLSASQQSPRAHQGHLFAHTLHCTQTMARVQTQIYSRRVKMEEEKQALQRQLQLKHQRELEKMKIDEDWDHSHQSKEQIEASLMMKQEAALRRERALAYAFSHQWKNSGRTVTPTFTDQGNPNWGWSWMERWMSARPWENRVVSNKDKDGALTKNPSTNAARTFVPRALSIQRPATPSKSSRPPSRQSPSTPPSKNPSVAGKFRPSSPRDSWLYREDDLRSITSIRSERPRRLSTGGGSIQDDSSLTSTPALPSYMQSTKSARAKSRYHMVFADKFEVPDRASLVHSSIKKRLSFPAAEKPNVTPADKLKERARRHSDPPKVDPASLKDVNVA

SEQ ID NO: 115971 - protein, 318 aa, Triticum aestivum
  unsure (1)..(318): unsure at all Xaa locations
  Clone ID: PAT_TA_10389.pep
RAAEQGNLEELYVMNDGISGEAAKALSELIPSTEKLKVLHFHNNMTGDEGAMPIAEMVKRSPNLESFRCSATRIGSDGGVALAEALGTCTRLKKLDIRDNLFGVEAGVALSKTLPKLSGLVELYLSDLNLENEGTIAIVNVLKQSAPQLEVLEMAGNEITAKAAKAVAECLTAMQSLKKLTLAENELKDDGAVTIAKSLEEGHPSLKELXDVSTNLFQRSGARCFAQAVANKPGFALLNINSNFISDEGVDEVKEILKGGKNSLEVLGLLDENDPEGDPEDGEEEEDGEDDDDEEKDGDDNGDGGLGSKLQGLKVEED

SEQ ID NO: 115972 - protein, 215 aa, Triticum aestivum
  Clone ID: PAT_TA_10390.pep
STLLEIPPKGLSSPGYCLREEKREATRGASWGSARSRALAAGATGWREDGGGARSCRVHTSCSCAVSLVEFGFMPELGVVPMGIGSPARASRMRWLLESVLKVVAMEGLLLPTGSTLVSQGISSMPLIWRRILLLSPASEAIMVMAKRWPTLATLELAGWDAADRAVDHQQWMICWRSDGACCGGRWPALTGSPLFLLAEGRSFKFLPAMKPKGR

SEQ ID NO: 115973 - protein, 157 aa, Triticum aestivum
  Clone ID: PAT_TA_10391.pep
APPFGSKARSYRADPGGRHCQVGSLAGAAHVLVLLSGRNFMKEKVKTSGSFVLRRFGAFDFAKPGSGKGMKIEDLDFTEEEMEMYVDLHPITNTSPYTVVETMSLAKAAVLFRALGLRHLLVVPKTPGRFPIVGILTRHDLMPEHIHGLFPNLRKSH

SEQ ID NO: 115974 - protein, 163 aa, Triticum aestivum
  unsure (1)..(163): unsure at all Xaa locations
  Clone ID: PAT_TA_10392.pep
MPLLLSIQKMKFPSQPAVVTASEEINIDQEVAPPHKSAIIHDFCLGIPFGGLLFSMGLVGFLFWRSPVSLTFGVAPGLAILGLAVLSLKGWRSGKSSLPFILGXQAAVAAAVAWKHCQAYATTKKLXFPGGFNTALMSLMICFNPYVLLTGGNPQQKKNHNSI

SEQ ID NO: 115975 - protein, 207 aa, Triticum aestivum
  Clone ID: PAT_TA_10393.pep
MASAAQDFQPRTFSIKLWPPSESTRLMLVERMTKNLSSESIFSRKYGLLGKEEAHKNAKRIEEMCFASADEHFKKEPDGDGSSAVQLYAKETSKLMLEVLKKGPVTTAEPEAPVIDTPIEPADTVFDISGGKRAFIEADEAKELLSPLTEPGNSYSRICLSNRSFGIGAANVAGPILESIKSQLKEVDISDFVAGRPEDEALDVMRI

SEQ ID NO: 115976 - protein, 90 aa, Triticum aestivum
  unsure (1)..(90): unsure at all Xaa locations
  Clone ID: PAT_TA_10394.pep
SSSASTFRSCSFEPRPASFPLSSPYFASSSSSSSSSSSSGFPSGSFSLSSXLGHLRYLLTDVPPQPNSPPDNVFRPDRPGKTGPWSQKEG

SEQ ID NO: 115977 - protein, 206 aa, Triticum aestivum
  Clone ID: PAT_TA_10395.pep
IFLEKPAKAAYSNKNPHNESEAGDASSWETISHEEMQGSSGSPDGSRSSINKIFDGSISWTSRNDFEYGEIEKLKDDLADAYLTTMTQPKKKESAISKLWKSSRPKNSDVSKKDATEALNGRSSNVRLSVGTNSTIESGVQDIGLSSPSVGQWSSPDSMNIQFNRGFRGCMEYPRASQKHSLKEKLMEARMVSQKVQLRQVLKQKI

SEQ ID NO: 115978 - protein, 86 aa, Triticum aestivum
  Clone ID: PAT_TA_10396.pep
CTPGNTEATTLEASRNPMRRQVANPTRPTRTLTSLTRAVRRGGENAGADGNGNSNDFSTKLLHLAWHPTENSIACAAGNSLYMYYA

SEQ ID NO: 115979 - protein, 111 aa, Triticum aestivum
  Clone ID: PAT_TA_10397.pep
KLTDFVSHSGARRHAGDGQQRLQRARGRRRGAGGLGERGASPSSSEQSGGACCVLLPARRCCFFLLSWRYLIFTGGATMVDRFLMMYYDDALVVRPVPSRFPFDDRRVVVG

SEQ ID NO: 115980 - protein, 136 aa, Triticum aestivum; identical to SEQ ID NO: 106789
  Clone ID: PAT_TA_10398.pep

SEQ ID NO: 115981 - protein, 160 aa, Triticum aestivum
  unsure (1)..(160): unsure at all Xaa locations
  Clone ID: PAT_TA_10399.pep
KAPVTSAEVSQDGRFITTADGSSVKFWDANHFGLXKSYDMSCTVESASLEPKSGSKFITGGEDMWVHVYDFFTGEEIACNKGHHGPVHCVRFAPVGESYASGSEDGTIRIWPLNPANADDTEAPNANGKPKAAAVANAVANDVARKIEGFHITKEGQTEA

SEQ ID NO: 115982 - protein, 256 aa, Triticum aestivum
  Clone ID: PAT_TA_10400.pep
MNPRDSDDDRPGAAAGSSSAATEQQQQQQSLEWRFAQVFGERAAGEDVQEVDIISAIEFDKSGDHLATGDRGGRVVLFERTDVRDEHANRRELERQDVPITRHPEFRYKTEFQSHEPEFDYLKSLEIEEKINKIKWCQTANNALFLLSTNDKTIKYWKVQEKKVKQVSVMALDTSRTVGDGTTSRASTSTSEPPLPNGGCSKKSDSLNSDLLFPPGGYPSLRLPVVTSQDVNLCARCRRVYAHAHDYHINSISNNR

SEQ ID NO: 115983 - protein, 172 aa, Triticum aestivum
  Clone ID: PAT_TA_10401.pep
MSHSTLLVRPPAPANPSLPPRQCAPVSAAAATLRTSPAASSVAQFSRLRTKCRFAAPGVREDYSSTPIDVVADVKTEKIVVLGGSGFVGSAICRAAVAKGIEVVSLSRSGRPSYSDPWADEVTWLAGDVFYARWEDVLVGATAVVSTLGGFGNEEQMKRINGEANTIAVDAA

SEQ ID NO: 115984 - protein, 196 aa, Triticum aestivum
  Clone ID: PAT_TA_10402.pep
MRRYSPPHRSPPRRGYGGSPAHRSPPRRGYGGSPPHRSPPRRGYGGRGRSPPRRGGYGGRKEQGSGSLLVRNIPLSARFGPVRDVYLPKDYYSGEPRGFAFVEFVDPYDASEAQYHMNRQVFFGREITVVLAAESRKRPEDMRTRTRVRGYSGGHEGRRSSHYGRSRSRSRSASPRPRGGGRARSRSYPPAPRRRR

SEQ ID NO: 115985 - protein, 82 aa, Triticum aestivum
  Clone ID: PAT_TA_10403.pep
MQNEVGDMVDLYVPRKCSATNRIITAKDHASVQINIGHVDENGLYDGRFTTFALSGFVRAQGDADGSLDRLWQKRKAEIKQL

SEQ ID NO: 115986 - protein, 199 aa, Triticum aestivum
  Clone ID: PAT_TA_10404.pep
AAASTLSLSLSLSLHFKRAFIYRISTWRINCRDNQRERERSIMSRERKKAAALQEKMQILRSITHSHALSNPSIVMDASEYIKGLKQKIARLNQEIAREEGTHSHKQNSFPTVSVEALGHGFLVNVSSDKSCPGLLVAVLEAFEELGLTVLQATASCADTFRLEAVGGGENQAGSVDEDVIRRAVQQAITNCGAEQGDQ

SEQ ID NO: 115987 - protein, 222 aa, Triticum aestivum
  Clone ID: PAT_TA_10405.pep
MRKEEAAMSAATGKPILYSKWFSSCSHRVRIALNLKGVDFEYKATNPMTDPDYEKINPVKFVPALVDGDFVVSDSFAIILYMEDKYPQCPLLPRDLKKKALNLQIASIVCSSIQPLQSHAVIGSYLGTMDTNESLQMVQHYIDKGFRAIETLLEGCDSKYATGDEVQMADVFLAPQIHAGVTRFQIDMSKYPILARLQDAYNEHPAFQAALPANQPDAPPSQ

SEQ ID NO: 115988 - protein, 297 aa, Triticum aestivum
  Clone ID: PAT_TA_10406.pep
LAGSCFRHRYFEEKRAAQKAAVEAYKQLLEEASEGIDSKPGYQDFERKWGADPRFVALDKKEREALFKEKVRALEEKVQSARNAVITDFKSMLRECKDIIPTSRWTKVKENFRSDPRYKAVKHEERENAFNEYIAELKSAEREVEQAAKAKVDEQAKLRERERETRKRKEREEQEMERVKLKIRRKDATSSYQALLVETIKDPKASWTESKPKLEKDPQGRAVNPDLGQGEAEKLFREHVKDLYERCVRDFRALLSEAIAPEAATRTTEGGKTLVISWSEAKELLRSDPRHLGRDHA

SEQ ID NO: 115989 - protein, 120 aa, Triticum aestivum
  Clone ID: PAT_TA_10407.pep
MENSSGREVLPNGGGAGGMGNGAANGRAVQALQRSFAEVQAILEKNRILIQEITQNQESLEAGGLSRNVALIRELNSNIARVVDLYNALSCSFSSSLTNGSAPAASDASKGAYKRPRPAQ

SEQ ID NO: 115990 - protein, 81 aa, Triticum aestivum
  Clone ID: PAT_TA_10408.pep
FSTSHGTLLRIPSHALLQIACICITRRKFSRRNLSFLVCRIAPPQRPGPSAFNQRDSAGQCQILPRGQKRQPVSKIAWLLC

SEQ ID NO: 115991 - protein, 143 aa, Triticum aestivum
  Clone ID: PAT_TA_10409.pep
GLAVHLWPRSQSRRWSARRHLLLSPAVDGLTDEVVQKITKQVEYYFSDINLATTEHLMRFISKDPQGYVPISVIAGFKKIKALVHNNPMLAAALRTSSKLVVSGDGKRVKRRHPFTESDMQEFQSRIVVAENLPGDPSYQNLM

SEQ ID NO: 115992 - protein, 123 aa, Triticum aestivum
  Clone ID: PAT_TA_10410.pep
MASPATGEETVRASHILIKHEGSRRKASWKDPEGRVISATTRADAAARLGELRAQILAGRASFADLAAQHSDCSSARRGGDLGTFGRRQMQKPFEDATYALKVGEISNIIDTESGVHIILRTA

SEQ ID NO: 115993 - protein, 160 aa, Triticum aestivum
  Clone ID: PAT_TA_10411.pep
MSTAEATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESKVFYLKMKGDYHRYLAEFKAGAERKEDPVELDSSPTL

SEQ ID NO: 115994 - protein, 179 aa, Triticum aestivum
  unsure (1)..(179): unsure at all Xaa locations
  Clone ID: PAT_TA_10412.pep
PPPAPSAPPAPTTPPQAPQAPATPPPAPQAPATPPPAPTTPPATPPPAPTTPPPAPPTQPPPAPTTPPPSPPATPPPAPATPPPSPPMSPPPATPPPMATPPSMAPXPPRPSPRRHRPRATPSMSPTSPKTTSPTSSPTSSPTLAPAGTPVTDSSASSARAAGVAALVALASAGLAVFL

SEQ ID NO: 115995 - protein, 369 aa, Triticum aestivum
  unsure (1)..(369): unsure at all Xaa locations
  Clone ID: PAT_TA_10413.pep
PDLIVDDGGDATLLIHEGVKAEEDYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGFRSFPWEDVVSXEADIFXVTTTGNKDIIMGDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSXGKYEKKVYVLPKHLDEKVAALHLGKLGAKLTKLTKSQADYISVPIXGPYKPAHYRVLSTRLAAHSGRCVL

SEQ ID NO: 115996 - protein, 235 aa, Triticum aestivum
  Clone ID: PAT_TA_10414.pep
MATAQLRGSAVPGTARRWPAPSGAILRFGPLATSRLPAASLRRRGAFSDLSASVVRESLTTMCMKSKCTSTPIDHATAPEHTEDEVPEPTSVVTGEEINIDQEVAPPHKSAIIHDFCLGIPFGGLLFSMGLVGFLFWRSPVSLTFGVAPGLAILGLAVLSLKGWRSGKSSLPFILAQAAVAAAVAWKHCQAYATTKKLLPWGFYTALSALMICFYSYVLLAGGNPPPKKKPAAAI

SEQ ID NO: 115997 - protein, 131 aa, Triticum aestivum
  Clone ID: PAT_TA_10415.pep
MSWQTYVDEHLMCDIEGHHLASAAILGHDGTVWAQSADFPSFKPEEMTNIMKDFDEPGTLAPTGLLLGAAKYMVIQGEPGAVIRGKKGAGGITLKKTGQALVVGIYDEPMTPGQCNLVVERLGDYLVEQGM

SEQ ID NO: 115998 - protein, 620 aa, Triticum aestivum
  Clone ID: PAT_TA_10416.pep
TRPAGEARDVSVRRLAAGVWRLRPPEAVVGGHGGGGGGGGEGRVHVGLEHIPRHLQVQLLKQDTLGHHQSLKNEISSPISVLERKSEELHKVQFHGSSPMIPVTTMEKATKWEPENMKGMESHDAYLIASQLNLLDEQQDASYVANLQLELRQARDRVGELESERRSTKKKLDHLFKKLAEEKAAWRSREHEKMRAVLEDMKANLDHEKKNRRRLELINMKLVNELKETKMSANQLVQEYDEERKTRELTEEVCNELAREVEEDKAEIEALKHDIQKLREEVDEERKMLQMAEVWREERVQMKLVDAKLTLDAKYTELSRLQQDVEAFVAGCSSARGDITVVEQAENIIHAIKSVRAQDVEFRYEPPAESEDIFSIFEELRPSEEPVIKDIEQCYKNSSIVCESEIQEASPMTDIFLEKPAKAAYSNKNPHNESEAGDASSWETISHEDMQGSSGSPDGSQSSINKIFDGSISWTSRNDFEYGEIEKLKDDLADAYLMTMTQPKKKESAISKLWKSSRPKNSDVSKKDATEALNGRSSNVRLSVGTHSTIESGVQDIGLSSPSVGQWSSPDSMNIQFNRGFRGCMEYPRASQKHSLKEKLMEARMVSQKVQLRQVLKQKI

SEQ ID NO: 115999 - protein, 264 aa, Triticum aestivum
  Clone ID: PAT_TA_10417.pep
MRRYSPQYRSPPRRGYGGRGRSPPRRGYGGRREQGSGSLLVRNIPLSCRPEDLRVPFERFGPVRDVYLPKDYYTREPRGFAFVEFVDPYDASDAQYHLNHTVFCGREITVVVASESRKRPDDMRNRARIRGYSGEPERRHSRYGRSRSRSRSYSPRYRGRPRSRSRSYSPAPRRRDDYSASPPRSHHTQSPRRLPKGHEEDERRSYSPAGRGGGERDADTNGKRSPPSDTEGSPPRTRRSPRQSSGSPVGSRSRSPEASPARSD

SEQ ID NO: 116000 - protein, 349 aa, Triticum aestivum
  unsure (1)..(349): unsure at all Xaa locations
  Clone ID: PAT_TA_10418.pep
MEETPLPLPLPLVPRVRLGTQGLEVSKLGFGCMGLTGSYSAPLSDDAGASVVAHAFRRGVTFFDTSDFYGPHTNETLLGKALKQLPREQVQVATKFGIQEYAYDEGRGAVCGRPEYVRACCEASLRRLGVDYIDLYYQHRIDTTTPIEDTIGELKKLVEEGKVXYIGLXEASPDTIRRAHAVHSVFAGQMEWSLWARDIEPEIVPLCRELGIGIVPYSPIGRGFFGGRGVTEQVSAESNLKRHPRFSAENLEKNKHLYLKMEELAKKHQCSPAQLALAWVLHQGDDVVPIPGTTRIKNLDSNIDSLKIKLTEDDLEEISSQIREEDVAGGRSYTSLAHTNWNHADTPKK

SEQ ID NO: 116001 - protein, 297 aa, Triticum aestivum
  Clone ID: PAT_TA_10419.pep
LKCKPGRTAIARSCSREEKREATRGASWGSAHSRALAAGVAGWREDGGGARSCRVHTSCSCAVSLVEFGFMPELGVMPMGIGSPARASRVRWLLESVLKVVAMEGLLLPTGSTLVSLVISSMPLIWRRILLLSPASEAILAMAKRWPTLAALELVGWDAADRAVDHQKWMICWRSDGACCGGRRPALADSPLFLLAEGRSFKFLPAMKPKGRQLCSSMESMAWCYGAFVGPSGLVPGVGRKFSVEEQNRTRSRFLSSVPGPFRKVQGLFSSSSFLLGLCCNMCFHVYPKFRARVCSK

SEQ ID NO: 116002 - protein, 190 aa, Triticum aestivum
  Clone ID: PAT_TA_10420.pep
VAGSDASVNVAPQQLLGQGATQEGSSNVLSVGLPSVVVHQQDEHQPASGVSKVDSSVQGPPPQVGQVTGAKKRKLGSVRRFKQDEAQQEQGQVVNGTSEKPGNEKTDSAQGETGDRTKGEGGANRCITKIIKPVRYHATMTDDVQQVSITFRALRSDGQEVLVDDKELKSTNPLVLINYYEQHLRYSPTA

SEQ ID NO: 116003 - protein, 136 aa, Triticum aestivum
  Clone ID: PAT_TA_10421.pep
MARTKQTARKSTGGKAPRKQLATKAARKSAPATGGVKKPHRFRPGIVALREIRKYQKSTELLIRKLPFQRLVREIAQDFKTDLRFQSSAVSALQEAAEAYLVGLFEDTNLCAIHAKRVTIMPKDIQLARRIRGERA

SEQ ID NO: 116004 - protein, 131 aa, Triticum aestivum
  Clone ID: PAT_TA_10422.pep
MSWQTYVDEHLMCDIEGHHLASAAILGHDGTVWAQSADFPSFKPAEMANIMKDFDEPGTLAPTGLLLADAKYMVIQGEPGAVIRGKKGAGGITLKKTGQALVVGIYDEPMTPGQCNLVVERLGDYLVEQGM

SEQ ID NO: 116005 - protein, 136 aa, Triticum aestivum
  Clone ID: PAT_TA_10423.pep
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 116006 - protein, 227 aa, Triticum aestivum
  unsure (1)..(227): unsure at all Xaa locations
  Clone ID: PAT_TA_10424.pep
MAQTPPIPRVSLGTQGLEVSKLGFGCMGLTGSYNSPVEDDAGIAVITHAFNRGVTFFDTSDVYGPHANEILLGKALKQLPREQVQVATKFGIQRDAQGKSTICGRPEYVRACCEASLHRLGVHHIDLYYQHRIDTTIPIEDTIGELKKLVEEGKVKYIGLSEASPDTIRRAHAVHPISSVQMEWSLWARDIEXEIVPLCRELGIGIVPYSPMALGFSGEGEDTTGVC

SEQ ID NO: 116007 - protein, 446 aa, Triticum aestivum
  unsure (1)..(446): unsure at all Xaa locations
  Clone ID: PAT_TA_10425.pep
MALSVEKTASGREYKVKDLSQADFGRLELELAEVEMPGLMACRAEFGPSQPFKGARISGSLHMTIQTAVLIETLEEYWWCTERCLDWGAGGGPDLIVDDGGDATLLIHEGVKAEEEFEKSGKVPDPESTDNPEFKIVLTIIRDGLKTDARKYRKMKERLVGVSEETTTGVKRLYQMQESGTLLFPAINVNDSVTKSKFDNLYGCRHSLPDGLMRATDVMIAGKVAVVCGYGXDVGKGCAAALKQAGARVIVTEIDPICALQALMEGIQILTLEDVVSDADIFVTTTGNKDIIMVDHMRKMKNNAIVCNIGHFDNEIDMNGLETYPGVKRITIKPQTDRWVFPETNTGIIVLAEGRLMNLGCATGHPSFVMSCSFTNQVIAQLELWKEKASGKYEKKVYVLPKHLDEKVAALHLGKLGARLTKLTKAQSEYISIPVEGPYKPAAYRY

SEQ ID NO: 116008 - protein, 156 aa, Triticum aestivum
  Clone ID: PAT_TA_10426.pep
GESIHGLVDVYRKTLKSDGIAGLYRGFNISCVGIIVYRGLYFGLYDSLKPVLLTGTLQDNFFASFALGWLITNGAGLASYPIDTVRRRMMMTSGEAVKYKSSLDAFQQILKKEGAKSLFKGAGANILRAIAGAGVLSGYDQLQILFFGKKYGSGGA

SEQ ID NO: 116009 - protein, 222 aa, Triticum aestivum
  Clone ID: PAT_TA_10427.pep
MRKEEAAMSAATGKPILYSKWFSSCSHRVRIALNLKGVDFEYRATNPMTDPDYEKINPVKFVPAFVDGNFVVSDSFAIILYMEDKYPQCPLLPRDLKKKALNLQIASIVCSSIQPLQSHAVIGSYLGTMDTNESLQMVQHYIDKGFRAIEKLLEGCDSKYATGDEVQMADVFLAPQIHAGVTRFQIDMSKYPILARLQDTYNEHPAFQAALPANQPDAPPSQ

SEQ ID NO: 116010 - protein, 168 aa, Triticum aestivum
  Clone ID: PAT_TA_10428.pep
VTTLDVVRANTFVGEVLGLDPRDVNVPVVGGHAGVTILPLLSQVNPPCSFTSEEISYLTSRIQNGGTEVVEAKAGAGSATLSMAYAAAKFADACLRGLRGDAGIVECSYIACQVTELPFFASKVRLGRSGVEEVLPLGPLNEFERAGLEKAKGELAESIHKGVAFANK

SEQ ID NO: 116011 - protein, 136 aa, Triticum aestivum; identical to SEQ ID NO: 106789
  Clone ID: PAT_TA_10429.pep

SEQ ID NO: 116012 - protein, 88 aa, Triticum aestivum
  Clone ID: PAT_TA_10430.pep
MGRWLKPDVYPLIGAMSLVTGMCVFQLTRNVFLNPDVRVSKSNRQSAVLENAEEGERYSQHAFRRFVSAHRPEVFPAINRFFSGFAGK

SEQ ID NO: 116013 - protein, 485 aa, Triticum aestivum
  unsure (1)..(485): unsure at all Xaa locations
  Clone ID: PAT_TA_10431.pep
MALSVEKTASGREYKVKDLSQADFGRLELELAEVEMPGLMACRAEFGPSQPFKGARISGSLHMTIQTVVLIETLTALGAEVRWCSCNIFSTQDHAAAAIARDSAAVFAWKGETLEEYWWCTERCLDWGAGGGPDLIVDDGGDATLLIHEGVKAEEEFEKSGKVPDPESTDNPEFKIVLTIIRDGLKTDARKYRKMKERLVGVSEETTTGVKRLYQMQESGTLLFPAINVNDSVTKSKFDNLYGCRHSLPDGLMRATDVMIAGKVAVVCGYGDVGKGCAAALKQAGARVIVTEIDPICALQALMEGIQILTLEDVVSDADIFVTTTGNKDIIMVDHMRKMKNNAIVCNIGHFDNEIDMNGLETYPGVKRITIKPQTDRWVFPXTNTGFIVLAXGRLMNLGCATGHPSFVMSCSFTNQVIAQLELWKEKATGKYEKKVYVLPKHLDEKVAALHLGKLGARLTKLTKAQSEYISIPVEGPYKPAAYRY

SEQ ID NO: 116014 - protein, 342 aa, Triticum aestivum
  Clone ID: PAT_TA_10432.pep
MEKKKVAVSKVCHGHSRPVVDLFYSPVTPDGYFLISASKDSNPMLRNGDTGDWIGTFEGHKGAVWSSCLDTNALRAASGSADFSAKIWDALTGNELHSFEHKHIVRACAFSEDTHMLLTGGVEKILRIYDMNRPDAAPRELDKTPGSVRTVAWLHSDQSILSSCSDMGGVRLWDVRSGKIVQTLETKAPVTSAEVSQDGRFITTADGSSVKFWDANHFGLVKSYDMSCTVESASLEPKSGSKFITGGEDMWVHVYDFFTGEEIACNKGHHGPVHCVRFAPVGESYASGSEDGTIRIWPLNPANTEDPEAPNANGKPKSAAVANEVARKIEGFHITKEGQTEA

SEQ ID NO: 116015 - protein, 611 aa, Triticum aestivum
  Clone ID: PAT_TA_10433.pep
MAPPLRLAALLVVVVAVFASAARADLVISRADRKVDLTSHIVRVLTSLKVENAGSEPVSKVLLAFPNIQAKNLAAIRAFGTEGKVKGLSSILPIEIVEPSGVPPELTFFSASLHKPLTKGKILHLDVLTVFTHFLQPFPEEITQADSQLVVFQDSSHYLSPYPVKVQTLSIRLPGGRVESYTKYGNTKLVDSELKYGPYEDVPPFSYNPIIVHFENNNPFAVAKELIREIEISHWGNVQITEHYNIVHGGARLKGEFSRLDYQSRPYARGVSSFRHLIARLPARAHSIYYRDEIGNISTSHLWSDSKKTQLEIEPRFPLFGGWQTTFTIGYGLPLQDFVFSADGKRFLNITFGSPMEEILIEKLIVKVVLPEGSKDIDVSAPFPTNQWQEVKYSHLDIAGRPVLVLEKPDVIPEHNLHFQVYYKFNNISLLIEPMMLITGFFLLFVACIAYMHTDMSISKNSPSYLAKLQWDEVQATVQQIQGIFHQCLAVHDKLETSLHDLSRSGDAKSCKAARKAADAQFKELAKELKPLLLSVQSSPQSYQIWPKLEDLVAKEREMQEKLMARHATVVDSVEKKQRGQDIENRISSQQQKIAALRQEVESLLEYLSEI

SEQ ID NO: 116016 - protein, 429 aa, Triticum aestivum
  unsure (1)..(429): unsure at all Xaa locations
  Clone ID: PAT_TA_10434.pep
MALSVEKTSSGREYKVKDLSQADFGRLELELAEVEMPGLMACRTEFGPSQPFKGARISGSLHMTIQTAVLIETLTALGAEVRWCSCNIFSTQDHAAAAIARDSAAVFAWKGETLEEYWWCTERCLDWGVGGGPDLIVDDGGDATLLIHEGVKAEEEFEKSGKVPDPESTDNPEFKIVLTIIRDGLKTDASKYRKMKERLVGVSEETTTGVKRLYQMQESGTLLFPAINVNDSVTKSKFDNLYGCRHSLPDGLMRATDVMIAGKVAVVCGYGDVGKGCAAALKQAGXARVIVTEIDPICALQALMEGIQILTLEDVVSEADIFVTTTGNKDIIMVDHMRKMKNNAIVCNIXGHFDNEIDMNGFETXPGVKAHQHQAQTDRWVFPQNKDWQSIVXWXGGXLMXPGXXPMGQPNFXNVLAQFKTKLAQLRVG

SEQ ID NO: 116017 - protein, 351 aa, Triticum aestivum
  Clone ID: PAT_TA_10435.pep
RALVDIRPLKDAREVGSPDISEAKKKAVVVPYDGEDKNGFLKKLALRFKDPENTTLIILDKFDGNSELVAELVTSNGYKGAFAVKDGAEGPRGWQSSDLPWTAPKKGFSLDFGELFGDGSEGLPVTIGLAAATGLGLLAYTEIETVLQFLGSTAVIQLVASKLVYAEDRKKTLQQIDDFFNKKIAPKELVDEIKEIGQALLPSSGEAKSQPAAATAAAPAAATATAAPVAEPAAPAAATATAAPVAEPEAPAAEASTESPPDTTTSSRPLSPFANYPDLKPPASPSPPASEGKTEVKATVVAATESPAEVNSAPVAEAVEESSPPAKPRPLSPYANYPDLKPPASPSPSPP

SEQ ID NO: 116018 - protein, 485 aa, Triticum aestivum
  Clone ID: PAT_TA_10436.pep
MALSVEKTSSGREYKVKDLSQADFGRLELDLAEVEMPGLMACRTEFGPSQPFKGARISGSLHMTIQTAVLIETLTALGAEVRWCSCNIFSTQDHAAAAIARDSAAVFAWKGETLEEYWWCTERCLDWGAGGGPDLIVDDGGDATLLIHEGVKAEEEFEKSGKVPDPESTDNPEFKIVLTIIRDGLKTDAHKYRKMKERLVGVSEETTTGVKRLYQMQESGTLLFPAINVNDSVTKSKFDNLYGCRHSLPDGLMRATDVMIAGKVAVVCGYGDVGKGCAAALKQAGARVIVTEIDPICALQALMEGIQILTLEDVVSEADIFVTTTGNKDIIMVDHMRKMKNNAIVCNIGHFDNEIDMNGLETYPGVKRITIKPQTDRWVFPETKTGIIVLAEGRLMNLGCATGHPSFVMSCSFTNQVIAQLELWNEKATGKYEKKVYVLPKHLDEKVAALHLGKLGARLTKLTKSQSDYISIPVEGPYKPAAYRY

SEQ ID NO: 116019 - protein, 78 aa, Triticum aestivum
  Clone ID: PAT_TA_10437.pep
MSYYGQQQAPVGAPPQQGYPPQGYPPAGYPPPQQGYPPAGYGQQGYPPQQQQQQNSGPSFMQGCLAALCCCCLLDACF

SEQ ID NO: 116020 - protein, 554 aa, Triticum aestivum
  unsure (1)..(554): unsure at all Xaa locations
  Clone ID: PAT_TA_10438.pep
MDSTAQDFQPRTFSIKLWPPSESTRLMLIERMTKNLSAECIFSRKYGILSKEEAHENAKRIEGACFASAEEHFKKEPDGDGSSAVQLYAKETSKLMLEVLKKGPGTTAEPEAPVIDTPFEPADTVFDISGGKRAFIEAEEAKELLSPLTEPGNSYSRICLSNRSFGIGAANVAGPILESIKSQLKEVDISDFVAGRPEDEALDVMRIFSKALAGSVLRYLNISDNALGEKGVRAFTELLKSQGDLEELYVMNDGISGEAAKALSELIPSTEKLKVLHFHNNMTGDEGAMFIAEMVKRSPNLESFRCSATRIGSDGGVALAEALGTCTRLKKLDIRDNLFGVEAGVALSRXLPKLGDLVELYLSDLNLENEGTIAIVNVLKESAPQLEILEMAGNEITAEAAKPLAECLTAMQSLKKLTLAENELKDAGAAAVAKSLQEGHPDLKELDVSTNLFQRSGARCFAQAVANKPGFVLLNMNANYIPDEGIDEVRKILKAGENSADVLGPLDENEPEGNPDDEDEEEDDDDEAKYGDDNGKDAGLGSKLQDLKVEAEED

SEQ ID NO: 116021 - protein, 316 aa, Triticum aestivum
  Clone ID: PAT_TA_10439.pep
VAINKSDKFHLLRLQVTGQELNPVARCRRVYAHAHDYHINSISNNSDGETFISADDLRINLWNLEINSQSFNIVDVKPTNMEDLTEVITCAEFHPTHCNTLAYSSSKGSIRLIDLRQSALCDNHSKIFEEHEAPGARSFFTEIIASISDVKFSRDGRYLLSRDYMTLKLWDLNMDSGPVSTFQVHEHLRPRLCDLYENDSIFDKFECCLSGDGLHVATGSYGNLFRVFASTPGSMEVTTLEASRNPMRRQIANPTRPTRGTLTSMTRGVRRGGENLGVDANGNSLDFSTKLLHLAWHPTENSIACAAANSLYMYYA

SEQ ID NO: 116022 - protein, 368 aa, Triticum aestivum
  unsure (1)..(368): unsure at all Xaa locations
  Clone ID: PAT_TA_10440.pep
MAKKGKWFSAVRRVFSSSDPEGKEAKTEKADKPKSRRKWPFGKSKRFDPPTSTVSDITPVAPSPLPLPLPPTQPPQPQSEEIKDVKPVETESEQNKHAYSVALASAVAAEAAAVAAQAAAEVVRLTAVPAATSRPPVCSQEELAAVKIQTAFRGYLARRALRALRGLVRLKSLVDGNAVKRQTAHTLHCTQTMARVQTQIYSRRVKMEEEKQALQRQLQLKHQRELEKMKIDEDWDHSHQSKEQIEASLMMKQEAALRRERALAYAFSHQWKNSGRTVTPTFTDQGNPNWGXWSWMERWMSARPWENRVVSNKDKDGSLTKNPSTNAARTFACNTKQVEPSTKPAITINPAIKEPLCCRKIQTFKPKR

SEQ ID NO: 116023 - protein, 222 aa, Triticum aestivum
  Clone ID: PAT_TA_10441.pep
MRKEEAAMSAATGKPILYSKWFSSCSHRVRIALNLKGVDFEYRATNPMTDPDYEKINPVKFVPALVDGDFVVSDSFAIILYMEDKYPQCPLLPRDLKKKALNLQIASIVCSSIQPLQSHAVIGSYLGTMDTNESLQMVQYYIDKGFRAIEKLLEGCDSKYATGDEVQMADVFLAPQIHAGVTRFQIDMSKYPILARLQDAYNEHPAFQAALPANQPDAPPSQ

SEQ ID NO: 116024 - protein, 136 aa, Triticum aestivum
  Clone ID: PAT_TA_10442.pep
GAVRSLPPQTLRPQISPGKERAFAAMAAAGGTSSDDVPVIQAENLTSNVRSILYSRTFLSIISGVVAGIWGFTGLTGFVFYFLIMMVASIGLLAKSKFSVHTYFDSWSRILVEGVLAGLMSFVLFWTFAYDIVHIF

SEQ ID NO: 116025 - protein, 161 aa, Triticum aestivum
  Clone ID: PAT_TA_10443.pep
RPATPSKSSRPPSRQSPSTPPSKNPSVAGKFRPSSPRDSWLYREDDLRSITSIRSERPRRLSTGGGSIQDDSSLTSTPALPSYMQSTKSARAKSRYHMVFADKFEVPDRASLVHSSIKKRLSFPAAEKPNVTPADKLKERARRHSDPPKVDPASLKDVNVA

SEQ ID NO: 116026 - protein, 136 aa, Triticum aestivum; identical to SEQ ID NO: 112792
  Clone ID: PAT_TA_10444.pep

SEQ ID NO: 116027 - protein, 407 aa, Triticum aestivum
  unsure (1)..(407): unsure at all Xaa locations
  Clone ID: PAT_TA_10445.pep
MATRYWIAALPVADDNVAAGKTALWARLQDAISRHSFDTPLYRFTVPDLRPGTLDSLLALSDDLVKSNIFIEGVSHKIRRQIEDLERAGGVEPGTLTVDGVPVDSYLTRFVWDEGKYPVNAPLKETVASIQSQVAKIEDDMKVRVAEYGNVKSQLGTINRKQTGSLAVRDLSNLIKPEDMVTSEHLVTLLSIVPKYSQKDWLSSYESLDTFVVPRSSKKLYEDNEYALYTVTLFAKVVDNFKVHAREKGFQIRDFEYSPEAQESRKQELEKLLQDQEVMRTSLLQWCYASYSEVFSSWMHFSAVRVFVESILRYGXASTVPVCCPSTIYKEREESKEHLGRAMWQCQQQLLEIRRRRWHGCWPGRRDRVSPLRLLHHKLCLRVFDVYYFVTPILSWYVGFGSCFCSR

SEQ ID NO: 116028 - protein, 103 aa, Triticum aestivum
  unsure (1)..(103): unsure at all Xaa locations
  Clone ID: PAT_TA_10446.pep
MCRPSQTPHLTMSSARIGPVRPGLGAKRRGHAPLPTHGISKITLKVVVFHLRXVRAPTYPTPLKSFHKVGLESSSTGSSFPADSAKPVPLAVVSLDSRQGQWE

SEQ ID NO: 116029 - protein, 425 aa, Triticum aestivum
  unsure (1)..(425): unsure at all Xaa locations
  Clone ID: PAT_TA_10447.pep
MALSVEKTSSGREYKVKDLSQADFGRLELELAEVEMPGLMACRTEFGPSQPFKGARISGSLHMTIQTAVLIETLIVDDGGDATLLIHEGVKAEEEFEKSGKVPDPESTDNPEFKIVLTIIRDGLKTDASKYRKMKERLVGVSEETTTXGVKRLYQMQESGTLLFPAINVNDSVTKSKFDNLYGCRHSLPDGLMRATDVMIAGKVAVVCGYGDVGKGCAAALKQAGARVIVTEIDPICALQALMEGIQILTLEDVVSDADIFVTTTGNKDIIMVDHMRKMKNNAIVCNIGHFDNEIDMNGLETYPGVKRITIKPQTDRWVFPETNTGIIVLAEGRLMNLGCATGHPSFVMSCSFTNQVIAQLELWKEKATGKYEKKVYVLPKHLDEKVAALHLGKLGARLTKLTKAQSEYISIPVEGPYKPAAYRY

SEQ ID NO: 116030 - protein, 87 aa, Triticum aestivum
  Clone ID: PAT_TA_10448.pep
MATVPVNPKPFLQNLTGKMVIVKLKWGMEYKGYLVSVDSYMNLQLSGTEEYIDGQCSGNLGDILIRCNNVMYLRGVPEEDTDIPDAA

SEQ ID NO: 116031 - protein, 136 aa, Triticum aestivum; identical to SEQ ID NO: 106789
  Clone ID: PAT_TA_10449.pep

SEQ ID NO: 116032 - protein, 136 aa, Triticum aestivum; identical to SEQ ID NO: 106789
  Clone ID: PAT_TA_10450.pep

SEQ ID NO: 116033 - protein, 136 aa, Triticum aestivum
  Clone ID: PAT_TA_10451.pep
SARGSLPRQTLRPQISPGEKRDFAAMAAAGGTSSDDVPVIQAENLTSNVRSILYSRTFLSIISGVVAGIWGFTGLTGFVFYFLIMMVASIGLLAKSKFSVHTYFDSWSRILVEGVLAGLMSFVLFWTFAYDIVHIF

SEQ ID NO: 116034 - protein, 148 aa, Triticum aestivum
  Clone ID: PAT_TA_10452.pep
ENRNLVWNKRVKARLILISSTNTNRESVAYRSFRSSEFEARGVMKSYHRDNWLYPRMAKVRWIQGQDHRHRQVRRQRSCPEDLQGVRHHRGERHCRSQEPVRSHTRRGSVIVDGKEQTPHLKVSCPEAWNNGGRGGCLCRSVNGILGL

SEQ ID NO: 116035 - protein, 204 aa, Triticum aestivum
  Clone ID: PAT_TA_10453.pep
HNHEPTYSHAIHVHTHAMDTSLGAEPREEAVDGGEDLRAVRADEAAEGVLAVPLALLLVLRHRALPVALAHPDVRVEEDVPGELEDAHPRHQRHGADQRVNIWLQPTAHVVVAWPSVALCDDLNSDERRCCYLLFPRVLSCRIRHEPSLTTLASQLRVLTSLRPTGTSVSSTASGWPEPESEQRHQRELYQLSCFPSIILHAVS

SEQ ID NO: 116036 - protein, 356 aa, Triticum aestivum
  Clone ID: PAT_TA_10454.pep
MEQGADSAAARRMARVASHLRPPTSQMEEVAILKGSDCRAKGAAPGFKVAVLGASGGIGQPLSLLMKMNPLVSVLHLYDVVNTPGVTADISHMNTGAVVRGFLGQSQLESALTGMDLVIIPAGIPRKPGMTRDDLFNINAGIVRTLCEGIAKCCPNAIVNVISNPVNSTVPIAAEVFKKAGTYDPKRLLGVTTLDVVRANTFVGEVLGLDPRDVNVPVVGGHAGVTILPLLSQVNPPCSFTSEEISYLTSRIQNGGTEVVEAKAGAGSATLSMAYAAAKFADACLRGLRGDAGIVECSYIACQVTELPFFASKVRLGRSGVEEVLPLGPLNEFERAGLEKAKGELAESIHKGQQVK

SEQ ID NO: 116037 - protein, 131 aa, Triticum aestivum
  Clone ID: PAT_TA_10455.pep
MSWQTYVDEHLMCDIEGHHLASAAILGHDGTVWAQSADFPQFAPAEITAIMKDFDEPGHLAPTGMFVAGAKYMVIQGEPGAVIRGKKGAGGITIKKTGQALVVGAYEEPMTPGQCNMVVERLGDYLVEQGM

SEQ ID NO: 116038 - protein, 197 aa, Triticum aestivum
  unsure (1)..(197): unsure at all Xaa locations
  Clone ID: PAT_TA_10456.pep
NSLSDFERPPGQVILTLEDVVSEADIFVTTTGNKDIIMVDHMRKMKNNAIVCNIGHFDNEIDMNGLETYPGVKRITIKPQTDRWVFPETKTGIIVLAEGRLMNLGCCXTATPSFVMSCSFTNQXVIAQLELWNEXAVAKYEKKVYVLPKXHLDEKVAGLHLGKARRQXLTKLTKSQSXDYISIPIEGPYKACGLTGY

SEQ ID NO: 116039 - protein, 136 aa, Triticum aestivum
  Clone ID: PAT_TA_10457.pep
MARTKQTARKSTGGKAPRKQLATKAARKSAPATGGVKKPHRFRPGTVALREIRKYQKSTELLIRKLPFQRLVREIAQDFKIDLRFQSSAVSALQEAAEAYLVGLFEDTNLCAIHAKRVTIMPKDIQLARRIRGERA

SEQ ID NO: 116040 - protein, 341 aa, Triticum aestivum
  Clone ID: PAT_TA_10458.pep
MEKKKAAVPPGSATGHSRPVVDLFYSPVTPDGYFLISASKDSNPMLRNGETGDWIGTFEGHKGAVWSCCLDTNALRAASGSADFSAKVWDALTGDELHSFEHKHIVRACAFSKDTHLLLTGGMEKILRVYDLNKPDVAPKELDKSPGSVRTVAWLHNDQTILSSCTDTGGVRLWDVRSEKIVQTLETKGPVTSAEVSQDGRFITTADGSSVKFWDANHFGLVKSYDMSFIVESASLEPKSGSKFIAGGEDMWVHVFDFLTGEEITCNKGHHGPVHCVRFAPGGESYASGSEDGTIRIWQLSPPNADAEEAIDTNGKPKAGAEEIACKIEGFHIAKEEKAGE

SEQ ID NO: 116041 - protein, 193 aa, Triticum aestivum
  Clone ID: PAT_TA_10459.pep
PNLTLKNFEGLDLGKMDQANDSGLASYVAGQIDRTLSWKDVKWLQSITTMPILVKGVITAEDSRLAVENGAAGIIVSNHGARQLDYVPATISALEEVVKGAGGQIPVFLDGGVRRGTDVFKALALGAAGVFIGRPVVFSLAVAGEAGVSNVLKMLRDEFELTMALSGCNSLADITRNHVVTEADKFGVMPSRL

SEQ ID NO: 116042 - protein, 136 aa, Triticum aestivum; identical to SEQ ID NO: 116005
  Clone ID: PAT_TA_10460.pep

SEQ ID NO: 116043 - protein, 131 aa, Triticum aestivum; identical to SEQ ID NO: 116037
  Clone ID: PAT_TA_10461.pep

SEQ ID NO: 116044 - protein, 81 aa, Triticum aestivum; identical to SEQ ID NO: 115918
  Clone ID: PAT_TA_10462.pep

SEQ ID NO: 116045 - protein, 360 aa, Triticum aestivum
  unsure (1)..(360): unsure at all Xaa locations
  Clone ID: PAT_TA_10463.pep
MEQGTDSAAARRMARVASHLCPPTSQMEEVAILKGSNCRAKGAAPGFKVAVLGASGGIGQPLSLLMKMNPLVSVLHLYDVVNTPGXSQADISHMNTGXAVVRGFLGQPQLESALTGMDLVIIPAGIPRKPGMTRDDLFNINAGIVRTLCEGIAKCCPNAIVNVISNPVNSTVPIAAEVFKKAGTYYPKRLLGVTTLDVVRANTFVGEVLGLDPRDVNVPVVGGHAGVTILPLLSQVNPPCSFTSEEISYLTSRIQNGGTEVVEAKAGAGSATLSMAYAAAKFADACLRGLRGDAGIVECSYIASQVTELPFFASKVRLGRSGVEEVLPLGPLNEFERAGLEKAKGELAESIHKGVAFANK

SEQ ID NO: 116046 - protein, 234 aa, Triticum aestivum
  Clone ID: PAT_TA_10464.pep
SKCTHATADQSRKNHLIKKDVPCETDQLSHVYTLIIRPDATYSILIDNEEKQTGSIYEHWDILPPKEIKDPEAKKPEDWDDEEDGEWTAPTIPNPEYKGPWKQKKIKNPNYQGKWKAPMIANPDFKDDPYIYAFDSLKYIGIELWQVKSGTLFDNILITDDAALAKTFAEETWAKHKEAEKAAFDAAEKKKEEEDASKAGEDDDDLDDEEADEEDKDDKAGSDAESDDEKHDEL

SEQ ID NO: 116047 - protein, 358 aa, Triticum aestivum
  Clone ID: PAT_TA_10465.pep
MEQGADSAAARRMARVASHLRPPTSQEEEVAILKGSNCRAKGAAPGFKVAVLGASGGIGQPLSLLMKMNPLVSVLHLYDVVNTPGVTADISHMNTGAVVRGFLGQPQLESALTGMDLVIIPAGIPRKPGMTRDDLFNINAGIVRTLCGGIAKCCPNAIVNVISNPVNSTVPIAAEVFKKAGTYDPKRLLGVTTLDVVRANTFVGEVLGLDPRDVNVPVVGGHAGVTILPLLSQVNPPCSFTSEEISYLTSRIQNGGTEVVEAKAGAGSATLSMAYAAARFADACLRGLRGDAGIVECSYIASQVTELAFFASKVRLGRAGVEEVLPLGPLNEFERAGLEKAKGELAESIRKGVAFANK

SEQ ID NO: 116048 - protein, 136 aa, Triticum aestivum; identical to SEQ ID NO: 116005
  Clone ID: PAT_TA_10466.pep

SEQ ID NO: 116049 - protein, 243 aa, Triticum aestivum
  unsure (1)..(243): unsure at all Xaa locations
  Clone ID: PAT_TA_10467.pep
MANLLHLPDLAAARPPAPGVVRRRGARVVAAARAGGRVKQEEAGAGTGRGRVIRVTDPVRDGRLPVPAPPPLFSVPMTPASESPAATTRRDNDEEERRRYYLNLGYAIRTLREEIPDVFYKEPSFDIYRDDIVFRNPFNKFEGIDNYRSLFWGLRFTGRIFFKALWVDIVSIWQPAENLIMIRWIAHGXIPRVPWDGHARFDGASVYKLDRNGKIYEHKVHNIATDPTDKVQGPVCTRASQIT

SEQ ID NO: 116050 - protein, 128 aa, Triticum aestivum
  Clone ID: PAT_TA_10468.pep
MYVYISLDTMGKPLAGKRKEQRLSSEFRSIAKRNARPGDDMGRWLKPDVYPLIGAMSLVTGMCVFQLTRNVFLNPDVRVSKSNRQSAVLENAEEGERYSQHAFRRFVSAHRPEVFPAINRFFSGFSAK

SEQ ID NO: 116051 - protein, 722 aa, Triticum aestivum
  unsure (1)..(722): unsure at all Xaa locations
  Clone ID: PAT_TA_10469.pep
PRLRLESLDYEIVENDLFKQDWRSRKKNQIFQYVVLKWALVLLIGLLTGLVGFFNNLAVENIAGFKLVLTGDLMLQKRYFTAFLAYGGCNLVLGATAAALCAYIAPAAAGSGIPEVKAYLNGVDAYSILAPSTLFVKIFGSILGVSGGFVLGKEGPMVHTGACIANLLGQGGSRKYHLTWNWLKYFKNDRDRRDLITCGAAAGVAAAFRAPVGGVLFALEEAASWWRSALLWRTFFTTAVVAVVLRALIEFCRKGKCGLFGQGGLIMFDLSSNVPSYGTQDLIAIIILGVIGGVFGGLFNFLLDRILRVYSIINERGAPSKILLTITISIITSACSYGLPWLAACSPCPVGSMEECPTIGRSGNFKSFQCPPGHYNGLASLFFNTNVYAIRNLFSRGTENEFHMSSLFVFFIAIYCLGLVTYGIAVPSGLFIPVILAGATYGRIVGTLLGPMSDIDPGLFALLGAASFLGGTMRMTVSVCVILLELTNELHMLPLVMLVLLISKTIADCFNKGVYDQIVVMKGLPFMEAHAEPYMRHLVASDVVSGPLISFSGVEKVGNIVHALRITGHNGFPVVXDEPPVSEAPELVGLVLRSHVLVLLSGRNFMKEKVKTSGSFVLRRFGAFDFAKPGSGKGMKIEDLDFTEEEMEMYVDLHPITNTSPYTVVETMSLAKAAVLFRALGLRHLLVVPKTPGRFPIVGILTRHDLMPEHIHGLFPNLRKSH

SEQ ID NO: 116052 - protein, 81 aa, Triticum aestivum; identical to SEQ ID NO: 115918
  Clone ID: PAT_TA_10470.pep

SEQ ID NO: 116053 - protein, 131 aa, Triticum aestivum; identical to SEQ ID NO: 116037
  Clone ID: PAT_TA_10471.pep

SEQ ID NO: 116054 - protein, 99 aa, Triticum aestivum
  unsure (1)..(99): unsure at all Xaa locations
  Clone ID: PAT_TA_10472.pep
MCRPSQTPHLTMSSARIGPVRPGLGAKRRGHAPLPTHGISKITLKVVVFHLRXVRAPTYPTPLKSFHKVGLESSSTGSSFPADSAKPVPLALAAWLHRV

SEQ ID NO: 116055 - protein, 486 aa, Triticum aestivum
  unsure (1)..(486): unsure at all Xaa locations
  Clone ID: PAT_TA_10473.pep
MALSVEKTASGREYKVKDLSQADFGRLELELAEVEMPGLMACRAEFGPSQPFKGARISGSLHMTIQTAVLIETLTALGAEVRWCSCNIFSTQDHAAAAIARDSXAVFAWKGETLEEYWXWCTERCLDWGAGGGPDLIVDDGGDATLLIHEGVKAEEEFERSGKVPDPASTDNPEFKIVLTIIRDGLKTDARKYRKMKERLVGVSEETTTGVKRLYQMQESGTLLFPAINVNDSVTKSKFDNLYGCRHSLPDGLMRATDVMIAGKVAVVCGYGDVGKGCAAALKQAGARVIVTEIDPICALQALMEGIQILTLEDVVSDADIFVTTTGNKDIIMVDHMRKMKNNAIVCNIGHFDNEIDMNGLETYPGVKRITIKPQTDRWVFPETNTGIIVLAEGRLMNLGCATGHPSFVMSCSFTNQVIAQLELWKEKATGKYEKKVYVLPKHLDEKVAALHLGKLGARLTKLTKAQSEYISIPVEGPYKPAAYRY

SEQ ID NO: 116056 - protein, 81 aa, Triticum aestivum; identical to SEQ ID NO: 115918
  Clone ID: PAT_TA_10474.pep

SEQ ID NO: 116057 - protein, 513 aa, Triticum aestivum
  unsure (1)..(513): unsure at all Xaa locations
  Clone ID: PAT_TA_10475.pep
MDPKSPDDRPEAAAPQPLEWRFAQVFGERGAGEDVQEVDIISAIEFDKSGDHLATGDRGGRVVLFERTDARGNASRTELERQDYSVAXRHPEFRYKTEFQSHEPEFDYLKSLEIEEKINKIKWGQTANNALFILSTNDKTIKYWKVQDKKVKRISVMNLDTSQSADNGTTSSSSTSSSRGLPNGGSSEKSYNCANNDLPFPPGGYASLRLPVVVTGQELNPVARCRRVYAHAHDYHINSISNNSDGETFISADDLRINLWNLEINSQSFNIVDVKPANMEDLTEVITCAEFHPTHCNTLAYSSSKGAIRLIDLRQSALCDNHSKLFEEHEAPGSKSFFTEIIASVSDIKFARDGRHILSRDYMTLKLWDLNMDSGPVATFQVHEHLRPKLCDLYENDSIFDKFECCLSGDGHRLATGSYSNLFRVFGCTPGNTEATTLEASRNPMRRQVANPTRPTRTLTSLTRAVRRGGENAGADGNGNSNDFSTKLLHLAWHPTENSIACAAGNSLYMYYA

SEQ ID NO: 116058 - protein, 296 aa, Triticum aestivum
  Clone ID: PAT_TA_10476.pep
MRRYSPPHRSPPRRGYGGSPAHRSPPRRGYGGSPPHRSPPRRGYGGRGRSPPRRGGYGGRKEQGSGSLLVRNIPLSARAEDLRVPFERFGPVRDVYLPKDYYSGEPRGFAFVEFVDPYDASEAQYHMNRQVFFGREITVVLAAESRKRPEDMRTRTRVRGYSGGHEGRRSSHYGRSRSRSRSASPRPRGGGRARSRSYSPAPRRRDDYSASPRGRESHRTKSPVRHPKEHEEDKRRSYSPPGRDGDQRDADNGYEKRSPPADSDGSPSRPRVARPSSGSPPGSRSRSPDASPARSD

SEQ ID NO: 116059 - protein, 346 aa, Triticum aestivum
  Clone ID: PAT_TA_10477.pep
MYLLPGRSRTESNRIESNDPTTKVSKLGFGCMGLTGSYNSPVEDDAGVAVITHAFNRGVTFFDTSDVYGPHANEILLGKALKQLPREQVQVATKFGIQRDAQGKSTICGRPEYVRACCEASLHRLGVHHIDLYYQHRIDTTIPIEDTIGELKKLVEEGKVKYIGLSEASPDTIRRAHAVHPISSVQMEWSLWARDIEPEIVPLCRELGIGIVPYSPIARGFFGGRGVTQQVSAESSLKGHPRFSAENLEKNKQLYLKIEELAKKHQCSPAQLALSWVLHQGDDVVPIPGTTKIKNLDSNIDSLKVRLTEDDLKEISNEIREEDVAGGRQYTSFAKFTWNYADTPKK

SEQ ID NO: 116060 - protein, 344 aa, Triticum aestivum
  Clone ID: PAT_TA_10478.pep
MEKKKVAVSKVCHGHSRPVVDLFYSPVTPDGYFLISASKDSNPMLRNGDTGDWIGTFEGHKGAVWSSCLDTNALRAASGSADFSAKIWDALTGNELHSFEHKHIVRACAFSEDTHMLLTGGVEKILRIYDMNRPDAAPRELDKTPGSVRTVAWLHSDQSILSSCSDMGGVRLWDVRSGKIVQTLETKAPVTSAEVSQDGRFITTADGSSVKFWDANHFGLVKSYDMSCTVESASLEPKSGSKFITGGEDMWVHVYDFFTGEEIACNKGHHGPVHCVRFAPVGESYASGSEDGTIRIWPLNPANADDAEAPTANGKPKAAAVAAANEVARKIEGFHITKEGQTEA

SEQ ID NO: 116061 - protein, 136 aa, Triticum aestivum; identical to SEQ ID NO: 106789
  Clone ID: PAT_TA_10479.pep

SEQ ID NO: 116062 - protein, 605 aa, Triticum aestivum
  Clone ID: PAT_TA_10480.pep
MAAPSPTTAAATHHRALLPAPARRAALSLARASRGRICVSAPAAPAASTASPPATAAVAVEGKPTVLVAEKLGAAGLALLREFANVDCSYGLSPEELRAKISLCDALIVRSGTKVGRDVFEASGGRLRVVGRAGVGIDNVDLAAATEHGCLVVNAPTANTVAAAEHGIALLCAMARNVAQADASLKAGKWARTKYVGVSLVGKTLAILGFGKVGSEVARRAKGLGMHVIAHDPYASADRARAIGVDLLSMEEAMTTADFISLHMPLTPSTNKMLNDEAFAKMKKGVRIINVARGGVIDEDALVRALDAGIVAQAALDVFTKEPPAADSKLVLHENVTVTPHLGASTVEAQEGVAIEIAEAVTGALKGELAASAVNAPMVPAEVLSELAPYVMLAEKLGRLAVQLVAGGGGIKSVKVTYASARAPDDLDTRLLRAMITKGVIEPISDVFVNLVNADFTAKQRGIRVSEEKIVMDGSPETPLEYIQVQIANVESKFPSAICDSGLVTVEGRVKDGIPHLTKVGAFEVDVSMEGSLILCRQVDQPGMIGSVGSVLGEENVNVSFMSVGRIAPRKTAIMAIGVDEEPSKATLTKIGEIPAIEEFVFLKL

SEQ ID NO: 116063 - protein, 430 aa, Triticum aestivum
  unsure (1)..(430): unsure at all Xaa locations
  Clone ID: PAT_TA_10481.pep
MAIRRGSSCAVLALLALASVSAVSADVFFQEKFEDGWESRWVKSEWKKDENMAGEWNHTSGKWHGDAEDKGIQTSEDYRFYAISAEYPEFSNKDKTLVLQFTVKHEQKLDCGGGYVKLLGGDVDQKKFGGDTPYSIMFGPDICGYSTKKVHTILTKDGKNHLIKKDVPCETDQLSHVYTLIIRPDATYSILIDNEEKQTGSIYEHWDILPPKEIKDPEAKKPEDWDDKEYIPDPEDVKPEGYDDIPKEVTDSDAKKPEDWXDEEDGEWTAPTIPNPEYKGPWKQKKIKNPNYQGKWKAPMIDNPEFKDDPYIYAFDSLKHIGIELWQVKSGTLFDNILITDDPEYAKKFAEETWGKHKDAEKAAFDEAEKKRLEEESANAKTEDNDDAADEDEGKAAGASDEENKDASGDEKVEEISKDASSSSDKKDEL

SEQ ID NO: 116064 - protein, 137 aa, Triticum aestivum
  unsure (1)..(137): unsure at all Xaa locations
  Clone ID: PAT_TA_10482.pep
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKXDIQLARRIRGERA

SEQ ID NO: 116065 - protein, 415 aa, Triticum aestivum
  Clone ID: PAT_TA_10483.pep
MAIRRGPSCAVLALLALASVAAVSADVFFQEKFEDGWESRWVKSEWKKDENMAGEWNHTSGKWHGDAEDKGIQTSEDYRFYAISAEYPEFSNKDKTLVLQFTVKHEQKLDCGGGYVKLLGGDVDQKKFGGDTPYSIMFGPDICGYSTKKVHTILTKDGKNHLIKKDVPCETDQLSHVYTLIIRPDATYSILIDNEEKQTGSIYEHWDILPPKEIKDPEAKKPEDWDDKEYIPDPEDVKPEGYDDIPREVTDPDAKKPEDWDDEEDGEWTAPTIPNPEYKGPWKQKKIKNPNYQGKWKAPMIANPDFKDDPYIYAFNSLKYIGIELWQVKSGTLFDNILITDDAALAKTFAEETWAKHKEAEKAAFDAAEKKKEEEDASKAGEDDDDLDDEEADDEDKDDKAGSDAESDDEKHDEL

SEQ ID NO: 116066 - protein, 385 aa, Triticum aestivum
  unsure (1)..(385): unsure at all Xaa locations
  Clone ID: PAT_TA_10484.pep
RVTDLTGRFATDCLLATFTPALRFRPVTCLPSPAAAAASFRAPWRKPHRFPASASAPKGLEVSKLGFGCMGLTGSYNSPVEDDAGVAVITHAFRRGVTFFDTSDVYGAXANEILLGKALKQLPREQVQVATKFGIQRDAQGKSTICGRPEYVRACCEASLHRLGVDHIDLYYQHRIDTTIPIEDTIGELKKLVEEGKVKYIGLSEASPDTIRRAHAVHPISAVQMEWSLWARDIEPEIVPLCRELGIGIVPYSPIARGFFGGRGVTQQVSAESSLKGHPRFSAENLXEKNKQLYLKMEELAKKHQCSPAQLALSWVLHQGDDVVPIPGTTKIKNLDSNIDSLKVRLTEDDLKEISNEIREEDVAGGRQYTSFAKFTWNYADTPKK

SEQ ID NO: 116067 - protein, 368 aa, Triticum aestivum
  Clone ID: PAT_TA_10485.pep
MEITNVTEYQAIAKQKLPKMIYDYYASGAEDEWTLQENREAFARILFRPRILIDVSKIDMTTTILGFKLSMPIMISPTAMQKMAHPDGEYATARAASAAGTIMTLSSWATSSVEEVASTGPGIRFFQLYVYKDRKVVEQLVRRAEKAGFKAIALTVDTPRLGRREADIKNRFVLPPNLTLKNFEGLDLGKMDQANDSGLASYVAGQIDRTLSWKDVKWLQSITTMPILVKGVITAEDSRLAVENGAAGIIVSNHGARQLDYVPATISALEEVVKGAGGQIPVFLDGGVRRGTDVFKALALGAAGVFIGRPVVFSLAVAGEAGVSNVLKMLRDEFELTMALSGCNSLADITRNHVVTEADKFGVMPSRL

SEQ ID NO: 116068 - protein, 396 aa, Triticum aestivum
  unsure (1)..(396): unsure at all Xaa locations
  Clone ID: PAT_TA_10486.pep
MATRYWIAALPVADDNVAAGKTALWARLQDAISRHSFDTPLYRFTVPDLRPGTLDSLLALSDDLVKSNIFIEGVSHKIRRQIEDLERAGGVEPGTLTVDGVPVDSYLTRFVWDEGKYPVNAPLKETVASIQSQVAKIEDDMKVRVAEYGNVKSQLGAINRKQTGSLAVRDLSNLIKPEDMVTSEHLVTLLSIVPKYSQKDWLSSYESLDTFVVPRSSKKLYEDNEYALYTVTLFAKVVDNFKVHAREKGFQIRDFEYSPEAQESRKQELEKLLQDQEVMRTSLLQWCYASYSEVFSSWMHFSAVRVFVESILRYGXACTVPVCCPSTIYKEREESKEHLGRAMRQRQQQLLEIRRRRGHGCWPGRRGRVPPLRLLHHKLCLRVFDVYYFVTPILSW

SEQ ID NO: 116069 - protein, 485 aa, Triticum aestivum
  Clone ID: PAT_TA_10487.pep
MALSVEKTASGREYKVKDLSQADFGRLELELAEVEMPGLMACRAEFGPSQPFKGARISGSLHMTIQTAVLIETLTALGAEVRWCSCNIFSTQDHAAAAIARDSAAVFAWKGETLEEYWWCTERCLDWGAGGGPDLIVDDGGDATLLIHEGVKAEEEFERSGKVPDPDSTDNPEFKIVLTIIRDGLKTDARKYRKMKERLVGVSEETTTGVKRLYQMQESGTLLFPAINVNDSVTKSKFDNLYGCRHSLPDGLMRATDVMIAGKVAVVCGYGDVGKGCAAALKQAGARVIVTEIDPICALQALMEGIQILTLEDVVSDADIFVTTTGNKDIIMVDHMRKMKNNAIVCNIGHFDNEIDMNGLETYPGVKRITIKPQTDRWVFPETNTGIIVLAEGRLMNLGCATGHPSFVMSCSFTNQVIAQLELWKEKATGKYEKKVYVLPKHLDEKVAALHLGKLGARLTKLTKAQSEYISIPVDGPYKPAAYRY

SEQ ID NO: 116070 - protein, 437 aa, Triticum aestivum
  unsure (1)..(437): unsure at all Xaa locations
  Clone ID: PAT_TA_10488.pep
MMQPPPPSQPQPGMGAPMPPQGAGGQPPHWGAIPPPMPHYAQPPPQQQPPPQAMWGQPPPQAAPYGQVPAPQQYYAAPQAPAAPAASDEVRTLWIGDLQYWMDENYIYSCFANTGEFQSVKLIRDKQTGQLQGYGFVEFASHAGAERVLQTFNGQMMPNVELAYRLNWASAGEKRDDTPDYTIFVGDLAADVTDYMLQETFRVHYPSVKGAKVVTDKMTMRSKGYGFVKFGXDPTEQARAMTEMNGMPCSSRPMRIGPAANRKTTGVQERVPIPNTNTQGAQSDNDPNNTTIFVGGLDPNVTEDALKQVFAPYGEVVHVKIPVGKRCGFVQYANRPSAEQALQLLQGTLVGGQNVRLSWGRSPSNKQTQPQEASQWGAGAAAGAAGGYYAGYGQGYEAYGQGYAQPQDPNMYGYGAYAGYPNYQQPAAAPQPPPPQQ

SEQ ID NO: 116071 - protein, 296 aa, Triticum aestivum; identical to SEQ ID NO: 116058
  Clone ID: PAT_TA_10489.pep

SEQ ID NO: 116072 - protein, 639 aa, Triticum aestivum
  unsure (1)..(639): unsure at all Xaa locations
  Clone ID: PAT_TA_10490.pep
HPGLPMGCAPMGHILYDEVMRYNPKNPYWFNRDRFVLSAGHGCMLQYALLHLAGYDAVKEEDLKQFRQWGSSTPGHPENFETPGVEVTTGPLGQGIANAVGLALAEKHLAARFNKPDSEIVDHYTYCIVGDGCNMEGILTEACSLAGHWGLGKLIVFYDDNHISIDGDTEIAFTEDVSGRFEALGWHTLWVKNGNDGYDEIRKAIQEAKSVTDKPTMIKVTTTIGFGSPNKANSYAVHGAALGTSEVEATRANLGWPYEPFFVPEDVKSHWSRHIPQGAALEADWDAKFAQYEQKYPEDAATLKSIITGELPAGWADALPQYTTESPADATRNLSQQCLNALAKVVPGLIGGSADLASSNMTLLKMFGDFQKDTPEERNVRFGVREHGMGAICNGIALHTPGLIPYCATFFVFTDYMRGAMRISALSEAGVIYVMTHDSIGLGEDGPTHQPIEHLVSFRAMPNMLMFRPADGKETAGAYKVAVLNRKRPSILALSRQKLPHLPGTSIEGVAKGGYTISDNSTDNKPDFIIMSTGSEVEIAVKAAEELTKEGKTVRVVSFVCWELFDEQSDEYKESVLPEAVTARISIEAGSTLGWQKYVGSKGKTIGIXDKFGASAPAPKIYKEYGITAESVIAAAKSL

SEQ ID NO: 116073 - protein, 371 aa, Triticum aestivum
  unsure (1)..(371): unsure at all Xaa locations
  Clone ID: PAT_TA_10491.pep
MEITNVTEYQAIAKQKLPKMIYDYYASGAEDEWTLQENREAFARILFRPRILIDVSKIDMTTTILGFKLSMPIMISPTAMQKMAHPDGEYATARAASAAGTIMTLSSWATSSVEEVASTGPGIRFFQLYVYKDRKVVEQLVRRAEKAGFKAIALTVDTPRLGRREADIKNRFVLPPNLTLKNFEGLDLXGKMDQANDSGLASYVAXGQIDRTLSWKDVKWLQSITTMPILVKGVITAEDSRLAVENGAAGIIVSNHGARQLDYVPATISALEEVVKGAGGQIPVFLDGGVRRGTDVFKALALGAAGVFIGRPVVFSLAVAGEAXGVSNVLKMLRDEFELTMALSGCNSLADITRNHVVTEADKFGVMPSRL

SEQ ID NO: 116074 - protein, 166 aa, Triticum aestivum
  Clone ID: PAT_TA_10492.pep
PAGFQKSASSVNNSELSFALLQKKKKKKKKKKKKKKKKKKKKKKKKKSRRRTSFSSSSRSASSNPRDQVAVVVPLPLQPPSCRTRWVTWWTSTSPGSARPPTGSSRPRTTPLSRSTLVTLMRMASMMAASPPLLSLGSSVLRVMLMAPWTGCGRRGRLRSSSSRCC

SEQ ID NO: 116075 - protein, 124 aa, Triticum aestivum
  Clone ID: PAT_TA_10493.pep
MAARRAHAAAALALLVAALVLSAAPAPAEGAVANCGQVVSYLAPCISYAMGRVSVPGGGCCSGVRGLNAAAATPADRKTTCTCLKQQASGMGGIKPNLVAGIPGKCGVNIPYAISQGTDCSKVR

SEQ ID NO: 116076 - protein, 118 aa, Triticum aestivum
  Clone ID: PAT_TA_10494.pep
MRLHCSIMLRGNHQLLFVLPQPHRIQEIKSLFPAATMQNEVGDMVDLYVPRKCSATNRIITAKDHASVQINIGHVDENGLYDGRFTTFALSGFVRAQGDADGSLDRLWQKRKAEIKQL

SEQ ID NO: 116077 - protein, 485 aa, Triticum aestivum; identical to SEQ ID NO: 116018
  Clone ID: PAT_TA_10495.pep

SEQ ID NO: 116078 - protein, 415 aa, Triticum aestivum
  Clone ID: PAT_TA_10496.pep
MAIRRGSSCAVLALLALASVAAVSADVFFQEKFEDGWESRWVKSEWKKDENMAGEWNHTSGKWHGDAEDKGIQTSEDYRFYAISAEYPEFSNKDKTLVLQFTVKHEQKLDCGGGYVKLLGGDVDQKKFGGDTPYSIMFGPDICGYSTKKVHTILTKDGKNHLIKKDVPCETDQLSHVYTLIIRPDATYSILIDNEEKQTGSIYEHWDILPPKEIKDPEAKKPEDWDDKEYIPDPEDVKPEGYDDIPKEVTDPDAKKPEDWDDEEDGEWTAPTIPNPEYKGPWKQKKIKNPNYQGKWKAPMIANPDFKDDPYIYAFDSLKYIGIELWQVKSGTLFDNILITDDAALAKTFAEETWAKHKEAEKAAFDAAEKKKEEEDASKAGEDDDDLDDEEADDEDKDDKAGSDAESDDEKHDEL

SEQ ID NO: 116079 - protein, 415 aa, Triticum aestivum
  Clone ID: PAT_TA_10497.pep
MAIRRGPSCAALALLALASVAAVSADVFFQEKFEDGWESRWVKSEWKKDENMAGEWNHTSGKWHGDAEDKGIQTSEDYRFYAISAEYPEFSNKDKTLVLQFTVKHEQKLDCGGGYVKLLGGDVDQKKFGGDTPYSIMFGPDICGYSTKKVHTILTKDGKNHLIKKDVPCETDQLSHVYTLIIRPDATYSILIDNEEKQTGSIYEHWDILPPKEIKDPEAKKPEDWDDKEYIPDPEDVKPEGYDDIPKEVTDPDAKKPEDWDDEEDGEWTAPTIPNPEYKGPWKQKKIKNPNYQGKWKAPMIANPDFKDDPYIYAFDSLKYIGIELWQVKSGTLFDNILITDDAALAKTFAEETWAKHKEAEKAAFDAAEKKKEEEDASKAGEDDDDLDDEDADDEDKDDKAGSDVESDDEKHDEL

SEQ ID NO: 116080 - protein, 745 aa, Triticum aestivum
  Clone ID: PAT_TA_10498.pep
MAAHSVAAAHATIAARAGAAPSSPAAAPAERLGFRLSSLAGRALRSPLPARRAAAAASSSRRSGSQRVRASAAVETVEAAATGELLDKSVNAIRFLAIDAVEKAVSGHPGLPMGCAPMGHILYDEVMRYNPKNPYWFNRDRFVLSAGHGCMLQYALLHLAGYDAVKEEDLKQFRQWGSSTPGHPENFETPGVEVTTGPLGQGIANAVGLALAEKHLAARFNKPDSEIVDHYTYCIVGDGCNMEGILTEACSLAGHWGLGKLIVFYDDNHISIDGDTEIAFTEDVSGRFEALGWHTLWVKNGNDGYDEIRKAIQEAKSVTDKPTMIKVTTTIGFGSPNKANSYAVHGAALGTSEVEATRANLGWPYEPFFVPEDVKSHWSRHIPQGAALEADWDAKFAQYEQKYPEDAATLKSIITGELPAGWADALPQYTTESPADATRNLSQQCLNALAKVVPGLIGGSADLASSNMTLLKMFGDFQKDTPEERNVRFGVREHGMGAICNGIALHTPGLIPYCATFFVFTDYMRGAMRISALSEAGVIYVMTHDSIGLGEDGPTHQPIEHLVSFRAMPNMLMFRPADGKETAGAYKVAVLNRKRPSILALSRQKLPHLPGTSIEGVAKGGYTISDNSTDNKPDYIIMSTGSEVEIAVKAAEELTKEGKTVRVVSFVCWELFDEQSDEYKESVLPEAVTARISIEAGSTLGWQKYVGSKGKTIGIDKFGASAPAPKIYKEYGITAENVIAAAKSL

SEQ ID NO: 116081 - protein, 124 aa, Triticum aestivum
  Clone ID: PAT_TA_10499.pep
MAARRAHAAATLALLVAALVLSAAPAPAEGAVANCGQVVSYLAPCISYAMGRVSAPGGGCCSGVRGLNAAAATPADRKATCTCLKQQASGIGGIKPDLVAGIPGKCGVNIPYAISPRTDCSKVR

SEQ ID NO: 116082 - protein, 380 aa, Triticum aestivum
  Clone ID: PAT_TA_10500.pep
MADRANHPSVMQKFGGQFHLASSFSEGVRARNICPSVPSYERRFTTSSYMTQNLGISVPIMSSSPMFANAPPEKKGVKNFAIDFLMGGVSAAVSKTAAAPIERVKLLIQNQDEMIKAGRLSEPYKGIGDCFGRTIKDEGFGSLWRGNTANVIRYFPTQALNFAFKDYFKRMFNFKKDKDGYWKWFGGNLASGGAAGASSLFFVYSLDYARTRLANDAKASKGGGERQFNGLVDVYRKTLKSDGIAGLYRGFNISCVGIIVYRGLYFGLYDSLKPVLLTGTLQDNFFASFALGWLITNGAGLASYPIDTVRRRMMMTSGEAVKYKSSLDAFQQILKKEGAKSLFKGAGANILRAIAGAGVLSGYDQLQILFFGKKYGSGGA

SEQ ID NO: 116083 - protein, 151 aa, Triticum aestivum
  Clone ID: PAT_TA_10501.pep
MPPKKTATRAPQENISLGPSVRDGELVFGVARIFASFNDTFVHVTDLSGRETITRVTGGMKVKADRDESSPYAAMLAAQDVAARCKELGINALHIKIRATGGNGTKTPGPGAQSALRALARAGMKIGRIEDVTPTPSDSTRRKGGRRGRRL

SEQ ID NO: 116084 - protein, 485 aa, Triticum aestivum
  Clone ID: PAT_TA_10502.pep
MALSVEKTSSGREYKVKDLSQADFGRLELELAEVEMPGLMACRTEFGPSQPFKGARISGSLHMTIQTAVLIETLTALGAEVRWCSCNIFSTQDHAAAAIARDSAAVFAWKGETLEEYWWCTERCLDWGAGGGPDLIVDDGGDATLLIHEGVKAEEEFEKSGKVPDPESTDNPEFKIVLTIIRDGLKTDASKYRKMKERLVGVSEETTTGVKRLYQMQESGTLLFPAINVNDSVTKSKFDNLYGCRHSLPDGLMRATDVMIAGKVAVVCGYGDVGKGCAAALKQAGARVIVTEIDPICALQALMEGIQILTLEDVVSEADIFVTTTGNKDIIMVDHMRKMKNNAIVCNIGHFDNEIDMNGLETYPGVKRITIKPQTDRWVFPETKTGIIVLAEGRLMNLGCATGHPSFVMSCSFTNQVIAQLELWNEKASGKYEKKVYVLPKHLDEKVAALHLGKLGARLTKLTKSQSDYISIPIEGPYKPAAYRY

SEQ ID NO: 116085 - protein, 380 aa, Triticum aestivum
  Clone ID: PAT_TA_10503.pep
MADRANHPSVMQKFGGQFHLASSFSEGVRARNICPSVPSYERRFTTSSYMTQNLGISVPMMSSSPLFANAPPEKKGVKNFAIDFLMGGVSAAVSKTAAAPIERVKLLIQNQDEMIKAGRLSEPYKGIGDCFGRTIKDEGFGSLWRGNTANVIRYFPTQALNFAFKDYFKRMFNFKKDKDGYWKWFGGNLASGGAAGASSLFFVYSLDYARTRLANDAKASKGGGERQFNGLVDVYRKTLKSDGIAGLYRGFNISCVGIIVYRGLYFGLYDSLKPVLLTGTLQDNFFASFALGWLITNGAGLASYPIDTVRRRMMMTSGEAVKYKSSLDAFQQILAKEGAKSLFKGAGANILRAIAGAGVLSGYDQLQILFFGKKYGSGGA

SEQ ID NO: 116086 - protein, 79 aa, Triticum aestivum
  Clone ID: PAT_TA_10504.pep
FFFTTSVLFILSLHSPPANHHLRAYPFPYTHGRSMGASTSNQRYNQPTNGAEHRFFSRIGEAQFLSSGSSSPPACICLY

SEQ ID NO: 116087 - protein, 181 aa, Triticum aestivum
  Clone ID: PAT_TA_10505.pep
KNLSIIHVHAVFRGVGNNLTPPGKNTPSQTMVTHQWHHSGSGTARSTGNACKTNHVVLSSKLEAARSLASLSSAHGKGRRRVGGAVERHGRDGLGPRHELPLHPLLVAPDHRIHELILACGDQQRRRLHDVAGDREWPEDLGSRGHARTALRRSSASCLSRAVPLPIADGKRAVAADLQRA

SEQ ID NO: 116088 - protein, 119 aa, Triticum aestivum
  Clone ID: PAT_TA_10506.pep
PNHRHLLQLMNSRFHGETDGAAKARHDGDPAGRRRTRTRMSWSLGTTHGKLTPMCRTYGGRRHPAFCAGLSAVRRSSARPLVEARYSGERRHRVAMEPGWPAPSRGRRSLLRMRDRAGG

SEQ ID NO: 116089 - protein, 302 aa, Triticum aestivum
  Clone ID: PAT_TA_10507.pep
MESSYSSAMPMETDTMSQFLGGDHHCFAYEQQDESMEAMAAMFLPALDTDSNSSSSCLNYEVSPQCWPQPQPQPGHSSSVTSFLDPGHGYESFEFPVMDPFPHSEFQSHCTDIPYLGGGGEDLSPLDSNCAPAAGEEAANDHIPVTNKRKSRAATTASKKAKKAGKKDFTSNDIEGDDTYVIDPQSSSSCTSEDGDLDGNTKSSSKKTGTRASRGAATDPQSLYARKRRERINERLKTLQNLVPNGTKVDISTMLEEAVEYVKFMQLQIKLLSSDDMWMYAPLAYNGINVSSLEMHIAALQK

SEQ ID NO: 116090 - protein, 67 aa, Triticum aestivum
  Clone ID: PAT_TA_10508.pep
YIVDGCSYFHVVTSWRLRWYYIVTSSADASGRHAPEPVLISFQQLCRSCRGRRRASACLSWRTWRRA

SEQ ID NO: 116091 - protein, 197 aa, Triticum aestivum
  Clone ID: PAT_TA_10509.pep
TAASPALRGPPRHSPRRLRSHPAASSAPPQHPAAPADRQLRPLRPSPCPSRAGLPPPATLAARQQGPPRPCRYRLTLQFTPRAALLCCNVIPQPVHQATMRPGKGPQGPTLPSAEEGKGPTNGRRELRPSKGALQTALEAGRARAGCAHPPFGKPARQPLEGNSLSPLFLILKTQKKLFTAPLMHGSPLSRTFHSPH

SEQ ID NO: 116092 - protein, 412 aa, Triticum aestivum
  unsure (1)..(412): unsure at all Xaa locations
  Clone ID: PAT_TA_10510.pep
MQACRLRVRVLPPQTPALLRRSYCGLRVLLLLRRLTPPTGAFDADTAAMVTAVCSGIAASSGAPVTAVLWTVSSVAAGTTTPWAESSGSVAMVPAVSSGVAASSAAAVMVASWTASSVAAGTAIPRTGSSASAATMPDVSSGVAASFGAPATAMSQTSSSASAATMAAVSSGVAASFGVPATATSQISXSASAATMAAVSSGVAASFGAPATVTSXTASSASAATMAAVSSGVAAKXGAPATATSLTSSTAPAARTGAAGTGVAASSGAAASAGAPAARTAPAGTAAAMPAGSPGAAAGTGGPGTAGAEATRSGGAXTRGRGGAGAGEAAGAREPAAAWRARAAERTAAATMSTPSGNLAAAGPHVGGVGRPARRPPGCGATPRGSGDSTSSRASWSTSFSISSGGVLSLAV

SEQ ID NO: 116093 - protein, 213 aa, Triticum aestivum
  Clone ID: PAT_TA_10511.pep
MYADQISTGRKRSIHDRLDADLPSDRGGADAAGRARNALSKRQRQTDDKWKHDLYRDDESASRSVDPRDLRFKLQKKSSQQGFAGQKGSGVRDLREMLSGTMHAQPSNVDPQKRKPVSEVVKVTRRENVDERPVRLSKKVSKPSTSKKTSQPKAESPLDSFLKSLGLEKYSITFQAEEVDMAALRHMTESDLKALGIPMGPRKKITLALESRA

SEQ ID NO: 116094 - protein, 151 aa, Triticum aestivum
  unsure (1)..(151): unsure at all Xaa locations
  Clone ID: PAT_TA_10512.pep
KLTRXIAYFVRPLPMDLNAFLCKENQLRGMFEYARRCTFKDHLQKHKQTEESTDHNTDNNLLVAQTLASKVLSNANVHPRAMDMPVTFSIDDASGLCWRFSSEILSTSYPCLITVVADGHTSEPLDLTVKVNSEDTAFGLNLLNRVVAIIE

SEQ ID NO: 116095 - protein, 163 aa, Triticum aestivum
  Clone ID: PAT_TA_10513.pep
ELPSVGLPLLAALAAAVTYQAAMSPPGGLWGDVVSTGHTAGDPVLASNYPRRYKAFFYCNATSFMASLVIMVLLLIKRVSDTPPALLALHAAMILDLFGLMGAYAAGSCRRVRTSAYILALVVGVSAYIAVLVVASIGIAGRLRSAMDWLTEQVTRCFSVHDM

SEQ ID NO: 116096 - protein, 300 aa, Triticum aestivum
  Clone ID: PAT_TA_10514.pep
MSGEDVRKVSRQDIQLVQNLIERCLQLYMNQKEVIDTLSLEAKIEPSFTELVWQKLEEENREFFKAYYLRLMLKNQITAFNKLLEDQFQLMNKDYSSGIPSMPPTNGSNSTTLKQNSCFLPESGPISAMPNGAMRNGSSGGLVNGTSSGDQSIYGGKNIHGPHSGMDASTSVLPAQNASALLYGADNNGTTIKTESSYSSNADFAFCGNAFLESCQSIGDASGGSFSSSELNGQPLNDALLDMESSSFGFLSQIPRNFSFSDLTEGFNQNTEVLENYGRSPFLSSEPNNFSDSTGGEHTG

SEQ ID NO: 116097 - protein, 229 aa, Triticum aestivum
  Clone ID: PAT_TA_10515.pep
EGDELAGAKRIGAGARRSQTNRRRSSPEPTESAPELAKSSSPVRPHDERLDSAAAAWKEAWARRVPPSSTIYPQRASPVAARHPPNHLSPPCIPGRRIHWPSLRSVPPSGRCGSGPEGGVGGGWARVGVAEGQRGHMRCSSCLTHSSTRSNRVRGCGEWIERWTSMGSDMVALGLLPAPQAGKRGGGGERWSGGTGRAAPGGAGPHDGRALGQPSLAAEGGRGARAARG

SEQ ID NO: 116098 - protein, 256 aa, Triticum aestivum
  Clone ID: PAT_TA_10516.pep
AFVHILPEAFERLGSPCLVDGPWQKFPFAGFVAMLAAIATLIVDTIATGYFQRAHAKNTSAAVGYVEASDSEQAHGGHSHGVSAVIVSSFSDDGAKLIRHRVISQVLELGIIVHSVIIGMSLGASENASTIKPLVVALTFHQFFEGIGLGGCIVQARFRLKSVLMMALFFSLTLPVGVVIGIGISSAYDENSPRALIVEGLLSAAAAGILNYMALVDLLAEDFMNPRVQNNGRLQVIINISLLVGTALMSMLAVWA

SEQ ID NO: 116099 - protein, 464 aa, Triticum aestivum
  unsure (1)..(464): unsure at all Xaa locations
  Clone ID: PAT_TA_10517.pep
GIRTRVGFPDENSFGALHAVXKGITVVYAAGNDGPRPQTLENTSPWVITVAASKVDRSFPTAITLGNNQHILGQSLNYHVVNSSAGSSRFTGLVSDECTIASLNATAKDVKGKILLCSPLPDDPLAIAPGITFNNALQYVRNGGGSGLIFAQYTTDLLGVCQGIAXCVIVDLDTGKKIKKYILGTSSPMAGTGLARTVIGKEISAPKVASFSSRGPSPDYPEIIKPDIAAPGANILAAVGNSYVFMSGTSMATPHVAGIVALLKAQHPDWSPAAIKSAIITSAHVTDERGMPILAEGLPRKIADPFDYGGGNINPGGAADPGLVYDIDPRDYNKFFGCTIIRRANVSCDATTLPAYHLNLPSIAIPELRHPITVWRTVTNVGEVNSVYHAEVQSPAGVKMEIEPPVLVFNAMNKVHTFKVKLSPMWKLQGDYTFGSITWHKEQKAVRIPVAARITIQDFYADVA

SEQ ID NO: 116100 - protein, 99 aa, Triticum aestivum
  Clone ID: PAT_TA_10518.pep
WKLHTVSAATDRNGKVVLRIKKMNLVMQAFSNAKECVVEDVRPCAPEKASREEDATYPVEVRTSRGKVELRADDYAVYKRWVTTVTHMLTSSTAITMRN

SEQ ID NO: 116101 - protein, 211 aa, Triticum aestivum
  unsure (1)..(211): unsure at all Xaa locations
  Clone ID: PAT_TA_10519.pep
ADDASLMSAVITGLVNVFATFVSIVTVDRLGRRKLFLQGGTQMLACQIVVGSLIGAKFGFTGVADIPKGYAAVXVVFFICAYVAGFAWSWGPLGWLVPSEIFPLEIRSAGQSITVSMNMLCTFIIAQAFLPMLCRFKFMLFFFFGAWVVVMTLFVAYFLPETKNVPIEEMVLXVWKAHWYWGRFIRDEDVHVGGADVEMRSNGKVQAAKLP

SEQ ID NO: 116102 - protein, 118 aa, Triticum aestivum
  Clone ID: PAT_TA_10520.pep
HDICMARRNQGFLGIQPEMISNTVPFVEQRRQLGGEGAIRRPGQVRTAGQSRRRGHERVAVEVRSESPSSSRLTPVVVNAVGASPRCLRERRWLTLGAGAGASRRQSPRSRSRARLFP

SEQ ID NO: 116103 - protein, 207 aa, Triticum aestivum
  Clone ID: PAT_TA_10521.pep
ESKQLQAPQAQAASECAVCLSEFQEGERLRLLPPCLHLFHIDCIDAWLHATANCPLCRTAISGSACQPQPHVMLNQIDIVNVLQADHVVIDIASPSRGETSNVAGVPATIVSMGDERIDPRRDELLDVQQPMRRSLSMDSCNDKHLYLALQKVLRHHHSHSASLGEDRKGESSTPAAAASSRAAGRLRRSFLSFSHSRSSRSAILPI

SEQ ID NO: 116104 - protein, 71 aa, Triticum aestivum
  Clone ID: PAT_TA_10522.pep
EDTKKALEEQYGGEEELPQVNPGFNNTPFKFTKYSNAYMLVYIRESDKEKIMCNVDEKDIAEHLRIRLKKK

SEQ ID NO: 116105 - protein, 203 aa, Triticum aestivum
  Clone ID: PAT_TA_10523.pep
ARAYNTRLDLTSLLISIGPMVKSVSFLVAVLTMAVSLHSTHAVSAALFNPKAIAQHLPKVDGWTKENLKSMKKLKEIVDAAKDGVEKGIKFHDKDAQGRSIQYSRVTGIIVGDHKLEDGQHGVILIVTAFPFPFLNEKAFGLLKDEFSTAKELHRQFGPLCTTDLYPPVTLVYADDGAEKKQECPWHKQSDGSMCLGILTFQK

SEQ ID NO: 116106 - protein, 87 aa, Triticum aestivum
  Clone ID: PAT_TA_10524.pep
IETFPLLSLCNPELAPAFDLLSRAIAICTGNRPTSLDNAHLRRATTCSFYIMAPPPTPTPTYDPILVIIVDSDGGIRIICIQSEATQ

SEQ ID NO: 116107 - protein, 109 aa, Triticum aestivum
  Clone ID: PAT_TA_10525.pep
MASGGQTKMVAVGMLLVILFAAVAHAVLVPPVPPHHQACIHTTGEVPAASDCICSKNCACAGKCILAGGTGDHVKACFIDCVLKNDCRCNDNCFAHQPPVPIILAEHQK

SEQ ID NO: 116108 - protein, 166 aa, Triticum aestivum
  Clone ID: PAT_TA_10526.pep
MWGSRAQDGVEMQQRRTTNRIFPDERQDQSKMPFQAGRVDRFAANRIDPKTLEKLKLMNEGNVPWHSRILDPRSSVLLTWNRVYLVACLFALFIDPFFYYLPFVRVMDKTNNFSCVAEDQRLRNTMTVLRTLADLFYVLNIAIKFHTAYVDPKSRVLGKGELIVDL

SEQ ID NO: 116109 - protein, 172 aa, Triticum aestivum
  unsure (1)..(172): unsure at all Xaa locations
  Clone ID: PAT_TA_10527.pep
MEMEGNQIQTSPMGSAPSRSSPRQWSWGSALAGAVTTAAAAGVLVCRPRDPSFELISMNLSSFHFRPPAALDIGLTLTVHATNPNVVPVRYGASNVSILYGGTLLGTARLDAGQQPATSCRLLHPRXRLDAMELAHXRRILADNARRHMXLDAVRAKATCSGPPSSTARRPF

SEQ ID NO: 116110 - protein, 266 aa, Triticum aestivum
  unsure (1)..(266): unsure at all Xaa locations
  Clone ID: PAT_TA_10528.pep
MAAARWSPAAFLALLLLLLPFAPSPARAATPGKSPSSSSTAVFQLQGAVYPIGHYHVTMNIGDPAKPYFLDVDTGSDLSWLQCDAPCQSCNKVPHPWYKPTKNKIVPCAASLCTSLSPNKKCAVPQQCDYQIKYTDKATSLGVLIADNFTLSLRNSSTVRANCTFGCGYDQQVGKNAALQAATDRLLALGKGSVSLLSQLKQQGITENVLGHCFSTNGGGFLFFGDDIVPTLACXTWVPMARTTYGNYYSPGSGTLYFDRRSLGVK

SEQ ID NO: 116111 - protein, 44 aa, Triticum aestivum
  Clone ID: PAT_TA_10529.pep
ITTNSHSRLQIHELNHACSNATKASCAATSGATELEMASAVHGR

SEQ ID NO: 116112 - protein, 140 aa, Triticum aestivum
  Clone ID: PAT_TA_10530.pep
MNSSVDKDHHTNLVIGDPGYIDPVYVKTGLLTKKSDVYSFSIILLELVTRKKAIYNGNESLPMDYIKASMEGTARQMFDKDIVANSEEHMECLEEVGKIALQCLNENNVNDRPTMREVVDRLKACKSQWLDCHWKKNEVM

SEQ ID NO: 116113 - protein, 370 aa, Triticum aestivum
  unsure (1)..(370): unsure at all Xaa locations
  Clone ID: PAT_TA_10531.pep
ARSNDFKGLYGYKVFVSISLILGDGIYNLVKIIYSTIKETMNARSNQGRLPLVWVQEGDKISKLPAKEKLLNEVFVKDNIPPWLAASAYVGLAAISTAIVPIMFSQLKWYLVLSAYVVAPLLAFCNSYDTGLTNWSLASTYGKIGLXFIFASWVGHRGGVIAGLAACGVMVSIVSTAGDLMQDIKTGYLTLSSPRSMFVSQLIGTALGCVIAPLTFWLYWAAFDIGNXXACSKXPYAAIYREMSIMGVEGFSVLPQHCLAICFVFFFAAIAFNLLRDVTPKSMSKFIPLPMAMAVPFYIGAYFAIDMFVGTVILFVWERVNRKESEDFAGAVASGLICGDGMWSAPSAMLSIMRIDPPMCMYIKPSLTYG

SEQ ID NO: 116114 - protein, 189 aa, Triticum aestivum
  Clone ID: PAT_TA_10532.pep
APWHLVSFGRLPLLQFPPPKRRTPAAAGRSHGELARPKRRASLDPRPHGLPDLGSPRLELRMVEGKSVQVDVEKGLNQMPNDSNSTSPATMQKMKPDMDDSGRRTESPTPEKPESGREEIVVSSLATNLLSERYKDRLAEKLLGNEDETDDEDDNEFALPDGSQSPVSNELLEKHKNLLTPFKPDGRVL

SEQ ID NO: 116115 - protein, 110 aa, Triticum aestivum
  Clone ID: PAT_TA_10533.pep
ACPTPVRPSPIRPTLTQFKILIQSGRRSHIAENHHAPRPRPRTTAPDLPISSRLTNESWCGVIHGSLVQLLFLANFSRERPRSGIARGGFSYLKPRWGGIWCYRFKISSS

SEQ ID NO: 116116 - protein, 75 aa, Triticum aestivum
  Clone ID: PAT_TA_10534.pep
ISYSLFDGTCYSDNRSNSRANTCNKPRLLGGAHLLDKRLTRALLADPMIHDNSTDRTAFVPATHHSNFCPINFRW

SEQ ID NO: 116117 - protein, 168 aa, Triticum aestivum
  unsure (1)..(168): unsure at all Xaa locations
  Clone ID: PAT_TA_10535.pep
SWHLPXSSLALFTLAMAMAVVANVSSQNTPQDYINLHNRARAADGVGPVVWNNNVAKFAQDYAAERRADCRLVHSGGRFGENIYWGSSQRMTAANAVNSWVSEKQNYHRGSNTCDTGKVCGHYTQVVWRRSTRIGCARVICDRNRGVFIICSYDPPGNVRGRGPFLAK

SEQ ID NO: 116118 - protein, 296 aa, Triticum aestivum
  unsure (1)..(296): unsure at all Xaa locations
  Clone ID: PAT_TA_10536.pep
PRVRKIGNEFYGTKLIAFPCLSELEFDDMPQWVEWTKEESVTNVFPKLRKLSLLNCPKLVKVPPFSQSIRKVTIRNTGFASHMKLSFSSSSRACSVALETCCTTILTIGLLHRQQVEAVAVLTLRRCQGVNFEDLXXLASLKKLHISHLDITDEQLGTCLRGLRSLTSLEIDNCSNITSLPHVESARGLTTLHIRQCSKLSSLHSLPSFAALESMSIDNCSKLTLESFPADFSSLSSLRKLNIMCCTGLESLPSGFPSSLQVLDLIGGKPALLNQLQLKDGPEWDKIAHIPIKRIH

SEQ ID NO: 116119 - protein, 221 aa, Triticum aestivum
  unsure (1)..(221): unsure at all Xaa locations
  Clone ID: PAT_TA_10537.pep
RSGRGSWSACSPTCPSASCSARVPTGRSRRGVLLLPPPPRRRLAGKSRKRPMEISTNVRPPRLREVIQVPKKVVRDPRFEPVYGAVDKEGFXKRYNFLFDHDLPAEKEKLQKSIKKLKDPNAIEEAKNQITWIDKQLRSNPQKNVESEILRGHIKKEREAAKAGKRPYYLKKSEIRERKLMDKYNELKETGKLDSFMEKRRKKNASKDHRFMPYRRDGGAA

SEQ ID NO: 116120 - protein, 76 aa, Triticum aestivum
  Clone ID: PAT_TA_10538.pep
NSTLKPFHGWISSAAYRVALGLIPEREIFIQLLMGNCQDPEDFGGDVMILVSIVQPLLEEINAILVKHQLDRLKST

SEQ ID NO: 116121 - protein, 353 aa, Triticum aestivum
  unsure (1)..(353): unsure at all Xaa locations
  Clone ID: PAT_TA_10539.pep
FGTRLGPGPREGLEIAKLGISSEIVDKLSAKGITKLFPIQRAVLEPAMQGKDMVGRAKTGTGKTLAFGIPIMDAIIRHNAANKPGIHPLAICLAPTRELAKQVEKEFVDSSRLETLCVYGGTPIQQQMRVLSQGVDVVVGTPGRVIDLLNRRALNLSSVQFVVLDEADQMLSVGFEXAARARIKKSLYKSQTLMFSATMPPWIRKLMQKYLKDPVIVDLVGEDDQKLAEGISLLSIATENHAKPAVLGQLIQDHAKGGKCIVFTQTKRDADRLSYTMGRSVQCQALHGDITQQQRERTLQGFREGRFNTLIATDVAARGLDIPNVDLVIHYELPNNSEIFVHRSGRTSAATTL

SEQ ID NO: 116122 - protein, 274 aa, Triticum aestivum
  unsure (1)..(274): unsure at all Xaa locations
  Clone ID: PAT_TA_10540.pep
MAPALMRLALALAVAVVGCCAARQPGGRVDLWPMPASVSRGARTLYVARDLKLSTAGSGYRDGKAILADAFRRMVAVIQLDHAINGSYHGLPVLAGVNVAVRSPDDELKFGVDESYKLTVPATGNPIYARIEAQTVFGALHALETLSQLCYFDFVLSVTGLHWAPWTIVDKPRFPYRGLLIXDTARHYLPVPVIKSVIXIQMVYSKLNVLHWAHPWDEQSFPXLEIPSYPKLSNGAYPYSRKIYNQWMQPTLYNMLKKGGVNALAEIDVPGHAG

SEQ ID NO: 116123 - protein, 140 aa, Triticum aestivum
  Clone ID: PAT_TA_10541.pep
ANGECCESVAPAQAFLGQASNCSNAGGRGNGGGGGINGNGGGAGAGAGQAGSDDTSGGFANGGGSGNGGGAIGGGAEGPSVGVGSGAGSGAGQTGSTGSYGDGYATGMGGGMGGGTGESQNGGTGSGGGSGSGSGSGGYN

SEQ ID NO: 116124 - protein, 274 aa, Triticum aestivum
  unsure (1)..(274): unsure at all Xaa locations
  Clone ID: PAT_TA_10542.pep
MGAVHGVCYGMVGDNLPPRSDVVQLYKSRNIHAMRIYNPDQEALAALRGSGISLLRPGRRPGRPHPLPRHPERAPCWVRSNVQAYYPDVLIRYIAVGNEVPAGDTGVILPAMQNVHNALASANLSSSIKVSXAVRFDVITNSFPPSSGVFRDPSRGAPVGRFRDRTSAPCLSDAMVDSIYAALEKAGTPNVRVVVSESGWPSAGGFGASVDNARSYNQGLIDHIRNGTPKRSGAIETYIFAMFNENKKPGDEVERNFGLFFPNKQPVYPTTFPN

SEQ ID NO: 116125 - protein, 262 aa, Triticum aestivum
  Clone ID: PAT_TA_10543.pep
ALLRQHLGDTKLDGALTHVVIPAFDIAYLQPTIFSSFQLENQPAKNALLSDIAIGTSAAPTFFPAHYFETNDGKGGTRAFNLIDGAVAANNPTLLAMNQVAEHMVLAGQQPAGKSYIVISIGCGTSSLPKLKYSAKDAAKWGVLSWLIKDGSVPILDMFNAGSADMVDFHLSVLSAVLGSSHQYLRIQYDKLSGSAGSIDDCSKANLDKLVKIGEELLSEKVSGVDLETGRNVEVPGGGTNAEELAKYARQLSDERRRRRNN

SEQ ID NO: 116126 - protein, 264 aa, Triticum aestivum
  unsure (1)..(264): unsure at all Xaa locations
  Clone ID: PAT_TA_10544.pep
GLILGSVDRVRARGRVTVLGRVRTVALTPRPVVGRARAPVTGMARALLMGAQLSVAVRVRRLARVRVXGSGSVGLDTSINVGVGVSVGSNGGANGGPDCNTGTGSNYGSGAGLGSGSGSGSGSGGGSYSSRGRESSGIGSGSGVSSGVGGGSNVGPSGGCLSCGSGTGGVVGGSSSNSNSNSGTGSGSNSYGGSNAGSYSNTAAGSGSSVGSGYDSSGSGSGSGSSSGSGAASFGGSRVGFGLRLWLYVGCKLRVEFWCNRCIR

SEQ ID NO: 116127 - protein, 200 aa, Triticum aestivum
  unsure (1)..(200): unsure at all Xaa locations
  Clone ID: PAT_TA_10545.pep
CXKPTRSHVNSPKPRSPGRKHPTHYYCNPQHMGLSIAKEKKINQLAATRRRHINKNHTRPSPHLQLRKPRTIHHGVICASRVVSSFLLLLLQGFPLRAPDLELEPPFLCFSLRDFSSKRHPIVFPEFSESKLARNSQILVAKRTPGLGTNTPATTISSAIGTTPPKGSSEHLPDVPGPPLSTHAGSKGGGEGVEATVIAP

SEQ ID NO: 116128 - protein, 220 aa, Triticum aestivum
  unsure (1)..(220): unsure at all Xaa locations
  Clone ID: PAT_TA_10546.pep
ACTPXEHGHEPLLSMDEIIDECKTFFFAGHDTSSHMLSWTMLLLSTHPEWEQKLREEVVRECGNEVPTGDVLNKLKLVNMFLLETLRLYSPLSTIQRKAGLDLEVGGITVPKGTVLTIPIASIHRDKEVWGEDAHEFNPLRFENGVTRAANHPNAFLSFSDGPRSCIGQNFAMIEAKIVIVMILQRFSFFLSPKYVHAPMDVITLRSKFGLPMVLKSLEM

SEQ ID NO: 116129 - protein, 451 aa, Triticum aestivum
  Clone ID: PAT_TA_10547.pep
LTDGEQTPDSSSSNKHSSLIKPDTALSNNMTPPPGVRLHHRAVVVAAETGGALGGMVRQLSIDQFENEGRRVSYGTPENATAARKLLDRQMSINSIPKKVIASFGTRRGWKPPVRRQFFLDCNEIADLCDSAERIFSSEPSVLQLKAPIKIFGDLHGQFGDLMRLFDEYGSPSTAGDIAYIDYLFLGDYVDRGQHSLETMSLLLALKVEYPQNVHLIRGNHEAADINALFGFRIECIERMGERDGIWTWHRMNRLFNWLPLAALIEKKIICMHGGIGRSINHVEQIENLQRPITMEAGSVVLMDLLWSDPTENDSVEGLRPNARGPGLVTFGPDRVMEFCNNNDLQLIVRAHECVMDGFERFAQGHLITLFSATNYGGTANNAGAILVLGRDLVVVPKLIHPLPPAITSPETSPDQIEDTWMQELNANRPATPTRGRPQAAANDRGALAWI

SEQ ID NO: 116130 - protein, 110 aa, Triticum aestivum
  unsure (1)..(110): unsure at all Xaa locations
  Clone ID: PAT_TA_10548.pep
CQGTFVLVYTVFSATDSKRNARDSHVPVLAPLPIGFAVFMVHLATIPITGTGINPARSLGAAVIYNGDKAWSDQWIFWVGPFIGAAIAALYHHXILRASARGYGSFRSNA

SEQ ID NO: 116131 - protein, 256 aa, Triticum aestivum
  Clone ID: PAT_TA_10549.pep
DTHGLMSIHMPAYYNSIIRGVSTVMVSYSSWNGEKMHANHFLITDFLKNKLKFRGFVITDYEGIDQITSPPGVNYSYSVEAGIGAGIDMVMVPFAYTEFIDDLTYQVKNNIIPMSRIDDAVYRILRVKFTMGLFGNPSPDPSRAGELGAHERREVAREAVRKSLVLLKNGKSASTPLLPLPKKAGKILVAGSHADNLGNQCGGWTITWQGEPGNNNTAGTTILSAIKSTVDPGTKVVYAEDPDSSAVDAGEYDYTG

SEQ ID NO: 116132 - protein, 123 aa, Triticum aestivum
  Clone ID: PAT_TA_10550.pep
AWESGEGAAEVAVEPLRRSSMMPPSSRRADSLPNMKPYQKETAEKTPAAATVCRSVSFLACIFRWDLGLVGVLRQRISSSAENRCSDRPRLALASGVGPWPVRVGGGGGGGGSRRRRGKENRP

SEQ ID NO: 116133 - protein, 270 aa, Triticum aestivum
  Clone ID: PAT_TA_10551.pep
MADPYGDGRALRNHQPPAQQQQQQRPRLKPALEMEDLISLLHGSDPVRIELTRLENDLHYKEKELGDAQAEIKALRLSERAREKAVEDLTEELAKVDGKLKLTESLLESKNLEAKKINDEKKAALAAQFAAEATLRRVHAAHKDDDMPPIEAILAPLEAELKLARQEIAKLQDDNRALDRLTKSKEAALLEAERTVQIALAKASLVDDLQNKNQELMKQIEICQEENKILDRMHRQKVAEVEKLTQTVRELEEAVLAGGAAANAVRDYQR

SEQ ID NO: 116134 - protein, 150 aa, Triticum aestivum
  Clone ID: PAT_TA_10552.pep
TINIGSWPGEAPLDPRNFRKTISRILGVQYSIPDYVRVSSDCRRLLSQIFTADPSKRITIAEIKKLPWYLKSLPKEIAERDRANFKEPETETGTAAAAAQPVEEIMRIIQEAKAPGEMSKSSADAALLAELAELQSDDEEEGPGAEGETY

SEQ ID NO: 116135 - protein, 124 aa, Triticum aestivum
  Clone ID: PAT_TA_10553.pep
ENISSVEVEAALYGHPAVQEAAVVAMPHPHWGETPCAFVALKKEFDSGAGEVSEEELVAFCRSKIAHFMVPRKVVFVHELPKNATGKVQKLALRERARGLRPRDSDKKKPDPTRPATMTALSRL

SEQ ID NO: 116136 - protein, 226 aa, Triticum aestivum
  unsure (1)..(226): unsure at all Xaa locations
  Clone ID: PAT_TA_10554.pep
TCYLPVEETKTMKSIVPHNASNVIIESDRKLKPKEPDGLLEVLKDQCLYRHGGWWSYDFCYYGKIRQVHVXENEKVIQDYVLGXYDPDATDAYXMTITPPISAVEDXSQDTSKRYHAHVYTNGTVCDLTDIPRYTEVRFVCSEPTVLISSIKEISSCKYVLTVQSPMLCKNPLFQQEKRTFFIHCNESLPEAEAEPAEDDDSLPKEAQMSIVPNPDELHNYAAYAT

SEQ ID NO: 116137 - protein, 232 aa, Triticum aestivum
  Clone ID: PAT_TA_10555.pep
MSANEGDLTMRVIAMGGDAAAERRAAEEKLCEYTLDGSVDIKGRPAVKGKSGGWLAGGLILGNQGLPPFACRGAAGIPPLLLPRVAPQRRRPPPDNLAERTGTACLVSLAGALRTVPRWGPYESCAGSHAWCVRGPGLLSRPSPPYLLGPAGPGAELSPRASHPPSGARICGFALYMIAFGNGGYQPNIATFGADQFDEEDPAEAHSKVSFFSYFYLALNLGSLFSNTFLSY

SEQ ID NO: 116138 - protein, 77 aa, Triticum aestivum
  Clone ID: PAT_TA_10556.pep
GCYYGVGIPVGYMIAFPLRRGIQGMWGGMLTGVGLQTVILIAITMRTNWNKEASEASSRIRQWGGGGGASSRIPDSF

SEQ ID NO: 116139 - protein, 165 aa, Triticum aestivum
  Clone ID: PAT_TA_10557.pep
MEYSPKLAAALLLALASAMIVTAQNGADDMLNAHNEVRAAVGVGPVTWDPIVAAYAQSYAEKRRADCQLLLSPEVRPYGENLFRAAGAEWNAVDAVIYWASGKQYYDHATNTCSAPTGESCMGYLQLVWRDTKTIGCGAVLCDGNAGVFVICSYSPPPVLGQIPY

SEQ ID NO: 116140 - protein, 296 aa, Triticum aestivum
  Clone ID: PAT_TA_10558.pep
MTSKQEPWTRLSHSKKLPGWVAYNPRTMRPPPLSGDTKQMKILSWNVNGLRNIVQSGGFSSALAQRENFDVLCLQETHLKEGDVKDFMNLIPGYEYNYWSCSVARLDYSGTGVISRVKPISVQYGIGIAEHDQEGRVITLEFENFYLVNAYVPNSGRGLRRLVYRVDSWDPSFADFVEKLESFKPVIVCGDLNCARQSIDIHNPPAKTEDAGFTEEERESFQINFDMRGFVDTFRKQHPKAVGYTFWGENQRRNNKGWRLDYFLASGSIIDRVHDSYILPDVTSSDHSPIGLVLKL

SEQ ID NO: 116141 - protein, 182 aa, Triticum aestivum
  Clone ID: PAT_TA_10559.pep
PLALLSFALAVVAALLSSSARPAPHTRPHTRLGVSSSSPPHWRSAVGAQLAAAPLEEVRLPAPPPPTSRRPPPPLHRVHRRSVVIHSHSCSARRRHHRREDSVSSLSCSRAPVRRTAALLSRCWRVTGASRSQSGPLRLSTRGAAAMSAGCPRDGRSCSASNSGSISTLTDGLRLNCLQQKG

SEQ ID NO: 116142 - protein, 304 aa, Triticum aestivum
  unsure (1)..(304): unsure at all Xaa locations
  Clone ID: PAT_TA_10560.pep
MAGLGDAAKEYIAGSAAGVAQVVVGHPFDTVKVKLQAHNTTAHGKVYKNAFHCTSRILVEEGIRGLYXGASSSFIGXALESSLFFGTYAQAKQLLQGKSEDCKPRLKVIIPSAACSGALISCILAPTELTKCRMQVQGKDVMYATQYSSPLDCAVKTLQREGVRGIFRGGLATLYREAIGNAVFFCTYEYSRYWMHNYIDSRQFSSNSGLVVAKDIGIGIMSGGLSGMAFWTATLPMDVAKTIIQTDHNPQSSRNPFRVLNMVYRRAGLAGCYAGLGPTLARAFPANAAAIVAWEYSAKIXGIR

SEQ ID NO: 116143 - protein, 159 aa, Triticum aestivum
  unsure (1)..(159): unsure at all Xaa locations
  Clone ID: PAT_TA_10561.pep
ILXNRKXGPQKTELGWLXFRLGLVGSWNPGKTKGTKGDWAAGXGTTEGGRTVGXRRAGRQSSSRMPPPSGFCSAQGKXHVRCASLSLEHNCPGIPIIPFLASGHMAPAFILGIFFFFKRAPNQPILFFPFSPRYAVLRSHLLLTLPQWNVPLLSLLLLL

SEQ ID NO: 116144 - protein, 70 aa, Triticum aestivum
  Clone ID: PAT_TA_10562.pep
APSPQLPRRRRRITRREADLVMGEQATKVPQKKAKALSSSTQLTKTAASRRKSLLPQKKQMKQTTPSKKN

SEQ ID NO: 116145 - protein, 186 aa, Triticum aestivum
  unsure (1)..(186): unsure at all Xaa locations
  Clone ID: PAT_TA_10563.pep
TTQVTERVPPGTGRAPATVSWPGAELRGKGQGGRAAAVRQRSRSRGRTRLTGHDGLHFPNVDCRLKEPLRCYPVAPLLVPRLSRGATSIHGYDIPAGARVLGRVSYMGHDPELWKAAGGVDARNAFSVGYLDVQGHGYERLPFXGAGRRMCPGACTPVQGDPCKPWGTSWRGPDVQGAGRRVAQHG

SEQ ID NO: 116146 - protein, 327 aa, Triticum aestivum
  Clone ID: PAT_TA_10564.pep
RSRHVHLLLLLLVLLPFATADAHPAASCSNATCGGQSIAYPFWLANSGPNCGYPGLGVSCNDNAPILDVQFHQYRVLRIDYANRTVSLADVDAWNTTCPRLSFTLSVDPRSSLQLTPSNSRLTLLYSCKAGVSRPSAVKLDGCPEQSMAWYVLPDDDRVMGKAHAYGCEEAVTTPVLMSPHRPANPSLRAVLSGGFEMRYDDRSERCGAREQSGGRCRYGRIEEHGGTGFSCVCDDGANKLRCGDALSLRLKKQNLYKIASTSRVVLILFACLLVYKKYNSAVSGSRLPFSFHEPVEVSLSLLTSHTGSGSSRGDAELPRDGGDLLQ

SEQ ID NO: 116147 - protein, 197 aa, Triticum aestivum
  unsure (1)..(197): unsure at all Xaa locations
  Clone ID: PAT_TA_10565.pep
TRIDWNGRMRVIMGVAYCMQYMHELNPXITHXXLQSSAILLSEDGAAKIADMSVWQEVISKEKMPKNDDASEHHEPIRADPAGNVCSFGLLMLEIMSGKPPDSEHEGSLANLAMECIKDDRSISCLLDPTLTTHKENDLDIICELIEDCIQSDPKKRPSMREVTTKLREVLAISPEAATPRLSPLWWAELEILSVES

SEQ ID NO: 116148 - protein, 333 aa, Triticum aestivum
  unsure (1)..(333): unsure at all Xaa locations
  Clone ID: PAT_TA_10566.pep
RPPTRPPTRPLGTGAASHGSPSSPPTPPPPPPPRAIHRLRHPPRLRLLRPPRPPPPPPPSASTTPGSTPPPSRRPTPSSTTTAATSSTASTASCARSRTPASTARTTITSPAAPPHPPRPPLPXAAHHDPRRHGATPRRGLRLRGAGHARQVRRARQVGQPDALRARRPGHLRRGRPRLRLGGALPHRPQPPPHARRPPPPPPAPTTTTTPPGGTRPPPTSTPSLAPRPPCTKTTSTRTPSPCSPPSTSTPSSPTRRPRTRRRPVPXPLVPPQAEAASPPPTLVLPVPDLAEATPQPQAEGSAPTTPGAATTTTTSTPXPLPATGATTASPPP

SEQ ID NO: 116149 - protein, 229 aa, Triticum aestivum
  Clone ID: PAT_TA_10567.pep
MALARVSSSSRLLLLPSTTTTSSLLHSLLRPFSTSSVSARRLSHPRSLPIDASLSQASPLLPTAREEGEVAGAPRSTSRRPWKPTCLYYTQGRCTMMDDALHLEKFNHNLSVDLPVNASAADKVKPQKLDYFLVLDLEGKVEILEFPVVMIDAHSMEFIDSFHRFVRPTAMSEQRIEEYIEGKYGKFGVDRVWHDTAVPFEEVLREFEDWIGGHKLWKQKQGESLNSAA

SEQ ID NO: 116150 - protein, 232 aa, Triticum aestivum
  Clone ID: PAT_TA_10568.pep
MRKSSCGHVIGVPVTSKAYALEEATTRGAGAAKKDGDRLAVSLTHPSPYASFGYKHSSKGQVIHWVNKLGRRAQGFRDHVTLGPKLSETVKGKLSLGARILQAGGIERVFRKAFTAEKGERLVKALQCYLYTTGGPIAGMLFVSTKRIAFRSDRPVTVTSPRGDVARVSYKVVVPLKRIDKVRPSENVDRPEEKYIHVATVDGFEFWFMGFVSYQRSCKYMQQVIGGVAELQ

SEQ ID NO: 116151 - protein, 133 aa, Triticum aestivum
  Clone ID: PAT_TA_10569.pep
MSRNNGKGPKLDLRLSFSRSRGGGGGGGGGGPSAAPPGGSNSPRRMSSSSSSSASPPSSCVSSEGSPEAGGGSGGSAMILAGCPRCMMYVMLSREDPKCPKCHSTVLLDFNDVGADHRNPGFGSGKVGKGKRG

SEQ ID NO: 116152 - protein, 205 aa, Triticum aestivum
  Clone ID: PAT_TA_10570.pep
MATEKKIISLTVKVGLVLFAVCILAPVSLMVLLRHAVPLQTLRLLFSAGSASLVAWEEVKMYSANKGAFLCECDMSSLRSDVCELKGDVRVIPSNITIIALLHPSVSESRRSWRMKPHARKNDGHALASVTEVLVSVTPSSPHVPECKAESAAPAVVFSVGAYAGNMFHDFTDVLIPLFITASRFRSDVHLLVSDAPPWWLDKYR

SEQ ID NO: 116153 - protein, 280 aa, Triticum aestivum
  Clone ID: PAT_TA_10571.pep
PLYLEWAPDNILSPTSTTMEEDETNTAGERIITKAIVDQTKEGVSAEEIDPDRVESRSVFVKNLNFKTTDESLKQHFSTKLKTGSLKSATVKKHIKKGKNVSMGFGFAEFDSVETATSVCKDLQGTVLDGHALILQLCHGRKDGQTAKKNEKDKSSTKLLVRNVAFEATEKDLRQLFSPFGQIKTLRLPMKFGSHRGFAFVEFVTKQEAQNALQALASTHLYGRHLVIERAKEGETLEELRARTAAQFVDEQSGFQRMSKKRKQTSLVDEGSVKFSRIVE

SEQ ID NO: 116154 - protein, 146 aa, Triticum aestivum
  Clone ID: PAT_TA_10572.pep
RNSARGKFVSALPEGYKTCVGERGVQLSGGQRQRIAIARALVKQAAIMLLDEATSALDAESERCVQEALDRAGSGSGRTTIVVAHRLATVRNAHTIAVIDDGKVVEQGPPPHLLNHHPDGCYARMLQFQRLTPHTLAVPGPSASNV

SEQ ID NO: 116155 - protein, 102 aa, Triticum aestivum
  unsure (1)..(102): unsure at all Xaa locations
  Clone ID: PAT_TA_10573.pep
SEGITRTASRPXGSEPVSPLAQSPRADPPKVLRSSTAISASGLSMLAGTTSIPKRAVINRATSMKEGVPTPEAPKDTSSTAATLKRPVSSSSRFGFLRGFAS

SEQ ID NO: 116156 - protein, 259 aa, Triticum aestivum
  Clone ID: PAT_TA_10574.pep
FGTRLGCVPVVGRNPSQTPSGKAVVSYAFNGNNPWMPPPTAPPAGPAWNNTAIRVEQSRASFAPPRFVEPMPARADRTLLLLNTQNRIDGHIKWTINGVSLMFPATPYLVAMKRGMKDAYEQRPPPDMYDHMSHDISAPAPTNGTVGSPVYRLALGSVVDVVLQNSNALNNKSETHPWHLHGHDFWVLGHGEGKFNPAADAWRLLNVRDPIMKNTVPLHPDGWTAVRFRADNPGVWLFHCHVEAHVFMGMGVVFEEGVE

SEQ ID NO: 116157 - protein, 298 aa, Triticum aestivum
  unsure (1)..(298): unsure at all Xaa locations
  Clone ID: PAT_TA_10575.pep
PPPPDPDPLPPPLPVPPLVLPPLPPPMPPPMPVAXPVPFEPVLPVCPVPDPTPDPTPTLGPSAPPPVAPPPLPLPPPFAKPPEVSSLPACPAPAPAPPPFPLLPPPPPRAQAPGPERQEPPPRGAGAGALERPLAPPASPAVGAKGXSRKCYLFLPRRPGPPLPCAPGHPRRQGAEAGRHTAQPVRSRDRKPDPEPPSXSPPPPDPDPLPPPLPLPPLMLPPXQRSRCPEPRRDPDRPPRPHSRDAPRPPPRPPRPPRPDARGGLARSHAGWGNPLHTRSPQPRARSQAVVAQGGAGA

SEQ ID NO: 116158 - protein, 187 aa, Triticum aestivum
  unsure (1)..(187): unsure at all Xaa locations
  Clone ID: PAT_TA_10576.pep
LLRSVRPLLPSNRPSSGKQPSSAQREGARWRWRCSLTTTSSSRSSASGFRSSSPTTTRPTSPPRSSPPPSTSHRVSPCPWRPMCRRCWRHRPTRCSTTPPAXAPTTAPATPGERGSSSNLSSSSSSAAARAPASSSPGPRPAPRTPRGRAGTGAAPRPPRTRPRPRPRPTPASQRARLLKGVPENLL

SEQ ID NO: 116159 - protein, 204 aa, Triticum aestivum
  unsure (1)..(204): unsure at all Xaa locations
  Clone ID: PAT_TA_10577.pep
XLSYTPTIMAAAAAGLVWATLLMCAALGAGVENPFFPPGSEPEPVRIYSQENAALNVAERDGNVVLAYGDCSDLRQKWFIVTSPHPSAPFELPPPFVLQNAQTFQVIIIPSGSGQKVRLSSEPPINPLDWLSWSRAALEQRWTPEKSTRADHFYQLSVTKSDPALTLNGLLGNVHDGTEVGIYHASPDSGNAIWQMTSYPLCAR

SEQ ID NO: 116160 - protein, 112 aa, Triticum aestivum
  Clone ID: PAT_TA_10578.pep
SGNKDKLLGMFTKSSAYLLSRCSDLDSQSDCQYKWSTTFLSEIFHARVRSSFSAPRTSSTSSMQQHSKTKLLIMKKDLLRVLSLPLIWECFPVGHILSIRSFSYCCVPSTTI

SEQ ID NO: 116161 - protein, 132 aa, Triticum aestivum
  unsure (1)..(132): unsure at all Xaa locations
  Clone ID: PAT_TA_10579.pep
NVHHSVYKEEPVEILPCHAPLKXGGLCQRRDLKICPFHGPIIPRDARGNPIGKIGGSSDAGGDPLEQKVDIREAGGNPINTNGGIDSEYTHEAGQEPSTSMMTSINNDTFDMARSKDTPNQLAMQANKHARM

SEQ ID NO: 116162 - protein, 170 aa, Triticum aestivum
  unsure (1)..(170): unsure at all Xaa locations
  Clone ID: PAT_TA_10580.pep
MSHRMMMNPVKVEGDGRAGGGGAPRPMDGLGDAGPTPFLAKTYDMVDDPATDAVVSWSATNNSFVVWDPHLFATVLLPRYFKHGNFSSFVRQLNTYGFRKVDPDRWEFANEGFCXGQRHLLRNIKRRKPNMGSKNNNLXVLLEXGNFGHDVEIDXLKRDRXLLXXEXVKL

SEQ ID NO: 116163 - protein, 86 aa, Triticum aestivum
  Clone ID: PAT_TA_10581.pep
KQTPHATSPHLPCTSEARRRRRRRRRRRRRRRGGGVMDKSGPKVPGTTVPPNRPTQPSTNKPGAQRRNLKKGRNRRINVRLTQKKR

SEQ ID NO: 116164 - protein, 148 aa, Triticum aestivum
  Clone ID: PAT_TA_10582.pep
MASSYLAILVLLLLRFSGRAVAVSSSYIARTTEQQIIATVAPAAFADADDGGQSAAQPFLASPSGSFAAYLRRAAVGDGGSGDVCYVEVVQQQGGGGGTSSVWESDCTPVGGAETCDLDFSPVGLELFAGGHSLGDTAVDSYPGNAQS

SEQ ID NO: 116165 - protein, 385 aa, Triticum aestivum
  unsure (1)..(385): unsure at all Xaa locations
  Clone ID: PAT_TA_10583.pep
ETGQEFTFTIKRGPRARTCVSVNYDDFVNDVEAGDMLLVDGGMMSFLVKSKTEDSVKCEVIDGGELKSRRHLNVRGKSATLPSITDKDWDDIKFGVENQVDYYAVSFVKDAQVVHELKDYLRSXSNADIHVIVKIESADSIPNLHSIITASDGAMVARGDLGAELPIEEVPLLQEEIIRMCRSMGKAVIVATNMLESMIVHPTPTRAEVSDIAIAVREGADAVMLSGETAHGKFPLKAVKVMHTVALRTEATIIGGETPSNLGQVFKNHMSEMFAYHSTMMSNTLGTSIVVFTRTGFMSILLSHYRPSGTIFAFTDQEIVRQRLALYQGVCPVHMEFSDCAEKTFGDALSYLLKHGMVKEGEEVALVQSGRQPIWRSQSTPQYSG

SEQ ID NO: 116166 - protein, 136 aa, Triticum aestivum
  unsure (1)..(136): unsure at all Xaa locations
  Clone ID: PAT_TA_10584.pep
GIRHEVTLDGNTEVMIRNLVAYESSAASGPLVLTRYTELMNGIIDTDTDVALLRQRGVVLNRLKSDGEVTKLWNSMSRSTRLTKVPAVDRAVEEMNRYYDGRWRVKTKRFMRRXFCSVYTCSRWFGAVTVTAASGE

SEQ ID NO: 116167 - protein, 147 aa, Triticum aestivum
  Clone ID: PAT_TA_10585.pep
FVAVPLWHQFEQQYPGSNVLLVTVTDDESRRIEQQSDNQTMADAVAVLRKMFPKEDVPDATDILVPSWWSNRFFKGSFSNWPIGVNRYEYDLIRAPVGRVYSTGVHTSEKYNGHVRGAYLAGIDSADILINCAKKKMCKYDVKGKHD

SEQ ID NO: 116168 - protein, 98 aa, Triticum aestivum
  Clone ID: PAT_TA_10586.pep
RPEVCSLPSADVRARHGGRRATWRFARPVSQRSTEEVRPGSPTGDRRRRDDLDSLGRRWNGAYSGQGRRSRYRIYTPVVIGKLEGDGLAFRIGDFFSS

SEQ ID NO: 116169 - protein, 208 aa, Triticum aestivum
  Clone ID: PAT_TA_10587.pep
MARVLRTSLVAPSPAGAALHERSLPLTYLDALWLHATPVERVFFYPDATSDVLSNLTDSLSNALAAFYPLAGRLRLTPGAHNRYELHCQPGDGVTFTVAEYHHVGFDELATDEPTEVAKIVPLVPPLPEGGAVLAVQATVLRGGLAIGVTVHHAACDGVSSTHFLRTWAWAAAACSGASAPVPPFVDRSIIRARDDLYDAFTAPRLSS

SEQ ID NO: 116170 - protein, 40 aa, Triticum aestivum
  Clone ID: PAT_TA_10588.pep
MPEITEQQLHWCEEKMGRLRVDPQQGTMERDPSPLFFPAH

SEQ ID NO: 116171 - protein, 364 aa, Triticum aestivum
  Clone ID: PAT_TA_10589.pep
MREEERNDNTEEGKTTQEKRRLIKEGKAKMVEEKKRQREENKLMKEAIKAQKAEQKKYAKEKDEWESGKHALKSIVAEIDSTIIETGSVGGTLLTRFAEKGLKYRVQANPIKGSILWKMEVPQIGQDPASVAEVPYILFVLQAEEFCDLISSGFFWDHVRLVQDRYPTFTVCFVTNKLMNYINKCERAQYRNAPNFNSWKRPPVEEVLCKLATHHVKVHSRQCADEAEVAEHVVGLTSSLANCRFRKPLSWLSVHANGAVIPKNFIDKDLAKKDTWMKALIAIPKVQPRFALAIWKKYSTMRSLLKVYMDSTKTVREKELLLQDLMCEDRVGEESRRLGPVCSRRVYRTLMAEDGAVEADAAAE

SEQ ID NO: 116172 - protein, 320 aa, Triticum aestivum
  unsure (1)..(320): unsure at all Xaa locations
  Clone ID: PAT_TA_10590.pep
MVPFLSRRLHHRRPWTPPPGPKRRPLTRNLTLTAPLPRRALPTRSRTYNPLLVHLPFGSSPVVGGSXAMINIFLLDVPTTGLSHRPSPSTASRSRYTXTYNYSDITWSPNGANWAPGPQRCASPTSSSAKRLESYEYIRHGRRCSPSSATCTAAGAGAGSXVVLKDYLSTVSLNVITRMVMGKKYLEKEVKDEAGAVITTPEEFKWMIDELFLLNGVLNIGDSIPWLDWMDLQGYIKRMKKLSKMFDRFLEHVVDEHSDRRRREGESFVAKDMVDVLLQLAGDPDLEVQIDRDSVKAFIQVSPCNFPVFSKRIRVQGAFR

SEQ ID NO: 116173 - protein, 73 aa, Triticum aestivum
  Clone ID: PAT_TA_10591.pep
EFGTNSEPAWLGFERGWGPREEYDIGREINRAARILPRAIKERLAQLVNKLLVGEGPTGPKMKGSWRNDERDP

SEQ ID NO: 116174 - protein, 123 aa, Triticum aestivum
  Clone ID: PAT_TA_10592.pep
VNFYPALKMNARQVLTRTTLKNHRKGVLCIVIHKKDDSRKKKKKEEETLAASGFIVRAARGNRRALVMTCNHVAAYFVPPGDKLGIRAPGLDQELECEILYQDTNKDLAIIAVFGMQKKKKKK

SEQ ID NO: 116175 - protein, 139 aa, Triticum aestivum
  Clone ID: PAT_TA_10593.pep
PSFFSGSSVVHGAQAGAGEELRGRSSHGHGGLLLGATVAAAPHGPTMRRLPGPRGAPSIRLLPVPWRWRRSPETHRRCRWRGGAAGGGVHGRPGAVEIDGVSEQPQNRSRSRRTWWDQILINQHVQLHCRFPLMCLYLP

SEQ ID NO: 116176 - protein, 96 aa, Triticum aestivum
  Clone ID: PAT_TA_10594.pep
ANSAFATTNEYGIFSIELPSRLHATPSLENACSVKVLELPPDSACRVGGSHVSSHGLRLSSSDGSVRTYTAGVIRLQHDGTPANKCVQEEDTSDRR

SEQ ID NO: 116177 - protein, 75 aa, Triticum aestivum
  Clone ID: PAT_TA_10595.pep
VGGQAAGALPPSCIAAAHARGYWSVACSFLLVLFSSLCIISLGRLLRVSFNVIYIFSLVDVIYCISSVFESLYIL

SEQ ID NO: 116178 - protein, 483 aa, Triticum aestivum
  unsure (1)..(483): unsure at all Xaa locations
  Clone ID: PAT_TA_10596.pep
MSSFWGAEVKPEKPYTHTHSPRRGRLRLTQATLGAEVGKVEKGKTNLVQLHCTVKNKEPVYLCALIPGQSVTCHLDLEFEEKFVTFSVLGSRSVHLAGYYVGDAYEDIGDSDTGSESLQGSDDDFLASDDDDVVIPVSHGQMNTDSEDDSDYDEDYDSEDDEDLIYNQGRGKSSVVIEEIQEDEKPVDDNSRLQLAVRTPPAESVESEDEDGFPVSESKKSSKGSSKKAKNLNNGTSTEDRKRKSDAINDPHKSSGEVNAENDVVSKKKKKDKLXDSEKVNDEEKEVKLASSADTVAAKQKKKKSKKQSASEGDTDEQADKKTITDNDEEPSKQGAKKKKNKKKTKENNGSENQAQTDVMNSASKEQTSPKARTYGNGLIVQTVALGKPDGKKATPGKKVFVTYTGKLKNGKIFDSKVGPNPFPFMRGVXQVIKGWDIRVNGKRIGDKRKLTIPPSMGYGNQKAGEIPPNSTLLFDVELMNVQ

SEQ ID NO: 116179 - protein, 326 aa, Triticum aestivum
  unsure (1)..(326): unsure at all Xaa locations
  Clone ID: PAT_TA_10597.pep
AAFRAIYRVFYADRLVWKLIVKATGAPGHGSKLFDGAAVENLMDCIETVAGYREAQFEKVKSGKYGPGEVVSVNPXLYMNAGTPSPTGFVMNMQPSEAEVGFDLRLPPTEDIEQIERRIREEWAPAHKNLTYQLMKKGPVSDVTGRPLLTPANESNPWWSVFEQAIISSGGKLAKPEILSSTTDARFVRQMGVPALGIFTQLINTPILLHDHNEFLEDKVFLRGIEVYQHLIRALSSLQRLIRNKHINCTIIVFPSPCKLIVAKITQMAVMPQLSCSKATAQLGRPVQSLLKLFGAVRNLLAVFPPGSLARRVPASFQPAYPFLGC

SEQ ID NO: 116180 - protein, 217 aa, Triticum aestivum
  unsure (1)..(217): unsure at all Xaa locations
  Clone ID: PAT_TA_10598.pep
MSGPPVFSVLQGGNTTHSIKGQQISMIGNGHSFQPGVCVMDPSSFFPGIYAEKQSSFAERANMIQLNNFMADNSSPAGNRCQRLGCNELVEGQTPFCKSHRLGQQCQMIGCPQIPPNGVALCMSHGGGHPGSSAVPLTESEGSMKYEGDGQFRVMENAIGSTVIPNSDGEVVMCKYEGCSXRSQGNTVYCKVHSGGSXXCMVXXCXXXXHXXTPMCI

SEQ ID NO: 116181 - protein, 134 aa, Triticum aestivum
  Clone ID: PAT_TA_10599.pep
PRYFGSRKGKPKNWSDSSVTIQERIQDTYDHNNTNLGQAQRRTSSPKQNSTPWPSSFISAHPLAPQPPGKTPMECTLPAFHAIQATFLTSSSAEHRLCFPRRPGSDLPIAEPAAASPLPQVHLRGASRHGSPGA

SEQ ID NO: 116182 - protein, 112 aa, Triticum aestivum
  Clone ID: PAT_TA_10600.pep
CGYYLNCASLLLLLCVLLLAALGRPFAAAARREPTMAATGDQGDGAQAKLAWMEVAPAEGLKERVITRKEESTDSNRFRSTKFSLDAKNPFDGRVPFTADYHTVRRHPPSHN

SEQ ID NO: 116183 - protein, 158 aa, Triticum aestivum
  Clone ID: PAT_TA_10601.pep
HPRVWRKNPFGHIRSNRCITEQSGGGGGRAGHRRSFSSVVVRYSASSKTSPAPAPPSSSSCSSTSSSSKSSTSSSVRCSSDSDGAGTGAPALRRSSSASSEAENPIQGLIAYCKKSQQLASVRKSASDAGFRFLSSSAASKVAAESEGHDELIEICSG

SEQ ID NO: 116184 - protein, 119 aa, Triticum aestivum
  Clone ID: PAT_TA_10602.pep
MDGGYRSKSYASGRMQIEPYTGGARPDFRSLSYGGGGASYQYQYEYGAGAGQVTTVVEEEVKRSKSKRRWLALGDPDMERKRRVAAYKAYAMEGKVKGSFRKSFRWIKDRYLHLVYGVS

SEQ ID NO: 116185 - protein, 200 aa, Triticum aestivum
  Clone ID: PAT_TA_10603.pep
MMEFGWSSSVAGKPLRTMSRNSSRQESPAKPVQNSRRHMIKGHMASVAHRRMPVPRHSPRGAPPTPRGRTRPGWFWLERFRDAWESCSHKKAVVAAVFTLVWNVSSTVARVWAVFMLVVAMKCYQQRLMEFGWSSSVEEPAENDEPQQQQEESPAKPAQTEKAHDQGSHGFVAARHRRMPVSGDFARERLRARGGIQPRC

SEQ ID NO: 116186 - protein, 66 aa, Triticum aestivum
  Clone ID: PAT_TA_10604.pep
SMNNSRYKRQPVSFTHKTAITKKIHREMVQGPKQNRREDRRTPHHLSDPPALVRAGATPTQAQARV

SEQ ID NO: 116187 - protein, 201 aa, Triticum aestivum
  unsure (1)..(201): unsure at all Xaa locations
  Clone ID: PAT_TA_10605.pep
MAKDLAFVLLVLAALAAFSSATKLTIHNLCPHPVWPLVTPNAGLPSISDNAARLDTNAILSLTFPSTFWAGRVAARTGCDDGTSPPRGCFTGDAPPSTVAQITVHDSGNLDLAAYSVXSLVNGFNVPMVLSPHAGGGQCPALGCAVDLNCNCPPGQPGRRRHRVPRARGVLQEPLPAHQDDADRRGARAAELPRARGAQDR

SEQ ID NO: 116188 - protein, 161 aa, Triticum aestivum
  Clone ID: PAT_TA_10606.pep
MGCWSRLPHPSSCWLVLPRACGILLTRVFTRHWSRPAPRRLPGPSVWISRTPHAACLHSLPVMGSPAARWCQHFVGLAVGSVGSYVRHSPAVGPCPDPRRVYGADRGSAYYSGPPFLPASGGALRSCVCLAFLLRYLEYCKQRGFTSCYIWACPPLKGEDY

SEQ ID NO: 116189 - protein, 157 aa, Triticum aestivum
  Clone ID: PAT_TA_10607.pep
IDPNRALAPGLVYEAGPGDYINLMCAMNYTTAQIKTVTQSSAPVDCVGASLDLNYPSFIAYFDTTGEKTFARTVTNVGDGPARYNATVEGLDGLKVSVLPNRLVFGGKHEKQRYTVVIQVREELMPEVVLHGSLTWVDDNGKYTVRSPIVVTTTSVL

SEQ ID NO: 116190 - protein, 205 aa, Triticum aestivum
  Clone ID: PAT_TA_10608.pep
LDFFHNMYSVAVLRIFLPSNNLPFVPDTTHSRPQLRQDHLPCLGHRPAARSPICSRSWPTNATHHHERDAPSQLQSTPARSGEQPSRPFSHPPESSTTTAQGCCPNRSSPVATAAVAGLAEAGGPRDEALDASSGSTRTDEAARDLGRTRGHSQVAEAVDVRIGPDPRLLAQGSYGSSPTVGCYPGPATTTAACTPGEWPRAEFL

SEQ ID NO: 116191 - protein, 156 aa, Triticum aestivum
  Clone ID: PAT_TA_10609.pep
MAKRNELSLLVLVAMAVVVFLSVQVKSEVAAGSYTTEMQEAVRNEVKAFPDLRPGLIRLLFHDCFVNGCDGSVLLETSRINGTDGKTEMTSAFNGGLRGLEVIQNIKKNLGTKYNITCTDAVIYAAREAVYLLSKGKIAYNVTGPGRMDGVISRSE

SEQ ID NO: 116192 - protein, 166 aa, Triticum aestivum
  Clone ID: PAT_TA_10610.pep
MADGEGGADGLAERLAGAEIAADGGAGGGEEEPRLSKNAQKKEEKRRKQEEQRRLKEEEKKNKAAAAAASSSGAPQQAAAAADDEDMDPTQYYENRLRTLDALKAGGANPYPHKFLASISVPGYIEKYKGLNEGEKLADVTEWLARRIMNKRTSSSKLLFYDPYGD

SEQ ID NO: 116193 - protein, 413 aa, Triticum aestivum
  unsure (1)..(413): unsure at all Xaa locations
  Clone ID: PAT_TA_10611.pep
MLNGRREREVPVHLMLPERAFALTSASSHAPAVGSRLGGACAPGPRECVGISRKYVLRDQETRYRQRYLDLMVNHEVRHIFKTRSKIVSFIRRFLDGLDFLEVEAPMMNMIAGGAAARXPFVTHHNDLNMKLYMRIAPELYLKELVVGGLDRVYEIGKQFRNEGIDLTHNPEFTTVEFYMAYADYNDLMELTEAMISGMVKELTGGYKIKYHANGVDNPPIEIDFTPPFRRIDMIEGLEAMAKLEIPKDISSDETNKYLIDACAKYDVKCPPPQTTTRLLDKLVGHFLEETCVNPTFIINHPEIMSPLAKWHRSRPGLTERFELFVNKHEVCNAYTELNDPVVQRQRFEEQLKDRQSGDDEAMALDETFCTALEYGLPPTGGWGLGIDRLTMMLTDSQNIKEVLLFPAMKPQE

SEQ ID NO: 116194 - protein, 188 aa, Triticum aestivum
  unsure (1)..(188): unsure at all Xaa locations
  Clone ID: PAT_TA_10612.pep
RNSDEATGRTSNLNSTLLLLSLLLLTCFFQQASGHGGVDHGDGDEDDEDGHHGDAGVRGGGLRSRGLIAVKVWCLVILLVFTFLGGVSPYFYRWNEAFLLLGTQFAAGIFLGTAXLMHFLAGSTSTFNALXXKXPYPFSFMPRLPPGFLLTNAQATSPSSPSPTGRGSTRRRPSRKTRRRRASQRRRG

SEQ ID NO: 116195 - protein, 106 aa, Triticum aestivum
  Clone ID: PAT_TA_10613.pep
MRSTDSSRFVQELVLYAASAALSCLVLFAGLRQLDPNRESSKKALQHKKEIAKRLGRPFISTTPYEDGIGCDVINPDENDVEFESVGGLDEVKQALYELGILALRR

SEQ ID NO: 116196 - protein, 373 aa, Triticum aestivum
  unsure (1)..(373): unsure at all Xaa locations
  Clone ID: PAT_TA_10614.pep
QPSSAPATPPLRRSELFAFAKRRSPQNAVPRYAPPRTGKAMLATPSAKQSGAGCHNVRISNLMNPWFGDAQKXLVSAVFSLANKLQPAIIFIDEVDSFLGQRRNTDHEALXNMKTEFMSLWDGFTTDXQNARVMVLAATNRPSELDEAILRRFTQIFEIGVPARSERSKILEVILKGENIESNIDYDYIASLCEGFTGSDILELCKQAAFYPIREILNSEKDGTRANSPRPLRQSDLEKALSTSRKGKKAASSAASGLQSPEWIRPSDPEDDQVQSAIFEISKLMSPNSPEQSIRNRKTIFTLILKTEVFPLLNKIPWSKPGLPNLINICYWFRPLTSGPRFLNLIATKPRTDFWIPSVFGKCNSKFWGLAVL

SEQ ID NO: 116197 - protein, 216 aa, Triticum aestivum
  unsure (1)..(216): unsure at all Xaa locations
  Clone ID: PAT_TA_10615.pep
MGHQHQMFEDPFASSISSLEADIFSVAAGHHHPQWPGLDHDVPLXPAANNGTSSGGYGSPGGGDGSGSHRKISHNAYERDRRKQLNELYSDLRSLLPDTDHTKKLSIPITVSRVLKYIPELQKQVDGLEKKKEELTRANCNPGGRPWRGTRAACAAACRVDRXIMVQVNLVSTWPXXAHFKCIKVLENXXSGHNSFRLPKQTYPTEPTERMPGFLK

SEQ ID NO: 116198 - protein, 183 aa, Triticum aestivum
  unsure (1)..(183): unsure at all Xaa locations
  Clone ID: PAT_TA_10616.pep
MLREPHQVGSRAPMKQCIQVLKNAEVDDVVTINRSWVLLCIALVLSPGTGNMVPLEYIASLVDMDKIDDFAWDEHFLATALKEVKKYQRKREEGRSGFWIGGCLPMFAIIYMDFVDVPRSLVSQHRINYSLPRXCFVCNNDFKLVEEIDKNKLSLDKIEFGKQNVRAHFYCKQIPEHLIPIYE

SEQ ID NO: 116199 - protein, 128 aa, Triticum aestivum
  Clone ID: PAT_TA_10617.pep
MALCWPVCRMSMTSCCWVESPEHAGGSSSGSLRELLEVCKTHASYKEHGRAYALSSESSHGWQRFAGRGGDIDAMRLFATPRMNKYLEQARKFHKEPRMPVPSADDDVEEEITDDPMVNVGSRDINKL

SEQ ID NO: 116200 - protein, 201 aa, Triticum aestivum
  unsure (1)..(201): unsure at all Xaa locations
  Clone ID: PAT_TA_10618.pep
MTVPRKQAKMVELEKEEDPLVHDEPMLDDDDTDEDYVESEDDDSEEELQAEPSKKAVYNKEGLLEKLEDIAWPENVDWMHKLTVDHDQGEKVDVNDDLTRELAFYTQALDGTRQAFEKLQSXKVRFLXRPGDYYAEMVKTDTHMHKIKGNLLFEKKKIEEAEERKKARESKKRSKEVQAEKLKERAKXKKESIESVKKWRK

SEQ ID NO: 116201 - protein, 129 aa, Triticum aestivum
  Clone ID: PAT_TA_10619.pep
HSSATTYALKALARLKDTWKYLQGEMLCPVNPDTLSKTIYACCRLHNIVIEMEDDAAMLSAKQRNRSKEVRQLANEDAVRARDMLSQYFLASRSSELGEEGDEAVVSGSGGEKKKQEAQTGAADEEITV

SEQ ID NO: 116202 - protein, 158 aa, Triticum aestivum
  Clone ID: PAT_TA_10620.pep
IDSRVLDPGHVVIKRLTVSRLVGFERAEQQGQIRQWKTTTTPSPTGGASTARPLWTEIRHRLSRDSILRHEGGADASRGGQGRPKRGSLGVGRRRCICRHRSGLLEGHGGHGDAEGGRDEGAGLRGVPRGFRGRRQEAEDDALFPLLPPEMHLRLAPP

SEQ ID NO: 116203 - protein, 233 aa, Triticum aestivum
  Clone ID: PAT_TA_10621.pep
MELLCEAPAQRRLSVSLWLGTLVPSYIVALAGPPGAGLASLASQVVRRVNMRWSQKHAKDGAPNSNEDIATMLPMDGFHLYRSQLDAMEDPKEAHARRGAPWTFNPALFLKCLQTLKEEGSVYAPSFDHGVGDPVEKDIFVKPQHKIVIVEGNYLLLEEDVWREIRDMFDEKWFIDIDIDVSMQRVLQRHIGTGKEPDVAAWRISYNDRPNAELIMESKRAADLVIRSVDYSS

SEQ ID NO: 116204 - protein, 103 aa, Triticum aestivum
  Clone ID: PAT_TA_10622.pep
EAGYMVVLFWSAQDVCLRLMKSQSHCIHILTHIIYLDIIGMAVLKFDLFFVGFNMLCSYCCFFFPHNTGMVVLKFGMVLVGFEVKHTSMRHWSMAPCLSATRK

SEQ ID NO: 116205 - protein, 135 aa, Triticum aestivum
  Clone ID: PAT_TA_10623.pep
AALHPSSQRLLHVVNMSSIGFSYAQVHVKQERLRRRISDGEKAAATRTMSKAMAGEMEGGRGRRVLWVPAGCGATGCASTARAGHAVRFCPGSPSLGSLVPGTGLGVILSPDPRALPLSGPNSFLWGIMLPVPRE

SEQ ID NO: 116206 - protein, 102 aa, Triticum aestivum
  Clone ID: PAT_TA_10624.pep
RHEGTVYEARLGGERAAAKKPVLSTSDDLDKFHYQLQLLCEMDHPGLAKLIAAHARPPNYLMFFEYFEPPNLADKIHVEEWSPSIQQVITIASYLGPSLLQL

SEQ ID NO: 116207 - protein, 197 aa, Triticum aestivum
  Clone ID: PAT_TA_10625.pep
RAEFGTRLAFKVVVQIALDLARGLSYLHSKKIVHRDVKTENMLLDKTRTVKIADFGVARHEAANPSDMTGETGTLGYMAPEVLNGNAYNRKCDVYSYGICLWEVYCCDMPYADLSFSEVTSAVVCQNLRPEIPRCCPSAFANVMKRCWDANPDKRPEMAEVVTMLDAIDTSKGGGMIPVDQARGIGCLSCLRPRRGP

SEQ ID NO: 116208 - protein, 460 aa, Triticum aestivum
  Clone ID: PAT_TA_10626.pep
MARSSSPLVNKASPTEQPRLLCTRRSSKRVTALSPEALLDATLAGVEQQDDAGVIAAATALKRDATLSDETLAVHAGEKMGKNGAMDTDSIATPIVSGTTHWFKSSGDLVAFKEGRRHGFEYGRYGNPTVKVLEDKISALERAESTLVTSSGMNAIVATLLALVPPGAGHVVTTTECYSEARAFIRDKLSKMGIKVTFVELNDMDTLKAVLDQGDVTLFYTDCPTNPHLKCIDIKLVAELCHRKGALVCIDSTLASPINQKPLTLGADIVVHSATKYIAGHHDVIAGCISGSDALISRIRAWHHDLGGAISPDAAYMIIRGLKTMALRVETQNHTALRMARLLENHPKIERVYYPGLLSSPWHDIAKSQMTGFGGVISFEVASDLHGVMRFVDALEIPFIATSLGGCESLVQQPAVMSFWGQSDEEKAKNGIKDNLVRFSFGIEKFEDLRDDIIQALEKI

SEQ ID NO: 116209 - protein, 114 aa, Triticum aestivum
  unsure (1)..(114): unsure at all Xaa locations
  Clone ID: PAT_TA_10627.pep
MEAADEERPLLNRHRRPALSQGGSSRGTGHGSAGIHRXPALKQSTGNWRACFFILGAEFSECMCFFAVAKNLVTYLTTVLHESNVDAARNVSTWIGSCFLTPGIGAFLADSYWG

SEQ ID NO: 116210 - protein, 111 aa, Triticum aestivum
  Clone ID: PAT_TA_10628.pep
MAEEKHHHHLFHHKEGEDFQPAADGGVDTYGYSTETVVTATGNEGEYERITKEEKHHKHKEHAHKHKIEEEVAAAAAVGAGGFVFHEHHEKKQDHKEAKEASGEKKHHHFG

SEQ ID NO: 116211 - protein, 103 aa, Triticum aestivum
  unsure (1)..(103): unsure at all Xaa locations
  Clone ID: PAT_TA_10629.pep
MSTVTRAYLDQRLAAAKRCSREXKATAVATVVAATVPTLASVRMLPWAKANLNPTGQALIISTVAGMAYFIVADKTILFMARKHSFDDAAPQEQLLPLKKITL

SEQ ID NO: 116212 - protein, 158 aa, Triticum aestivum
  Clone ID: PAT_TA_10630.pep
RDVGVNSFVLFPKVPDGLKTQTGDEAYNDNGLVPRTIHLLKDKYPDIVIYTDVALDPYSSDGHDGIVREDGVIMNDETVHQLCKQAVSQARAGADVVSPSDMMDGRVGAIRAALDAEGFHDVSIMSYTAKYASSFYGPFREALDSNPRFGDKKTYQMN

SEQ ID NO: 116213 - protein, 87 aa, Triticum aestivum
  Clone ID: PAT_TA_10631.pep
RHEGWCHQGRGEEGPHRCQGYQGCHQKDLTLKLLLDNSMADVLVSSLFWRILVYVKCYSWALLHFDSCTCVRAMMCRLNTLFRFQKK

SEQ ID NO: 116214 - protein, 220 aa, Triticum aestivum
  unsure (1)..(220): unsure at all Xaa locations
  Clone ID: PAT_TA_10632.pep
FEGDNMIERSXNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGYVASNSKDDPAKEAVKFAEIQTKIDRRSGKEIEAAPKFLKNGDAGFVKMIPTKPMVVETFAQYPPLGRFAVRDMRQTVAVGVIKAVEKKDPTGAKVTKAAAKKK

SEQ ID NO: 116215 - protein, 124 aa, Triticum aestivum
  Clone ID: PAT_TA_10633.pep
MPRHLISDAHEWINEIPTVPVYYPVLDCHTSHIAVKFAELVTKIDRRSGKELEALPKFLKNGDAGIVKMIPTKPMVVETFATYPPLGRFAVRDMRQTVAVGVIKGVEKKDPTGAKVTKAAIKKK

SEQ ID NO: 116216 - protein, 103 aa, Triticum aestivum
  Clone ID: PAT_TA_10634.pep
MSTVSCAYLDQRLAAANRCSEEAAMAGAKAAAVATIAAAVPTLASVRMLPWARAHLNPTGQALIISTVAGMAYFIVADKTILSMARKHSFQDAPEHLKNTSFH

SEQ ID NO: 116217 - protein, 121 aa, Triticum aestivum
  Clone ID: PAT_TA_10635.pep
KSRAAEQSKETKRDGVQGIPSSGPSGARLQPARGRRPCPALHRRHQGRRRICRRTAATDFHYYPCPLLHHWRIRRDWKAFSRGRRQGLHDQQPAGARPPASCLAVRSLDHEVQPSLGPTAE

SEQ ID NO: 116218 - protein, 60 aa, Triticum aestivum
  Clone ID: PAT_TA_10636.pep
MAEEKHHHHLFHHKEGEDFQPAADGGVDTYGYSTETVVTATGNEGEYERITKEKKHHHFG

SEQ ID NO: 116219 - protein, 111 aa, Triticum aestivum
  Clone ID: PAT_TA_10637.pep
GVPPQVASATATFAMMFSSSMSVVEYYLLNRFPVPYAVYLTILAFFAAIVGQRVVRKLIDLLGRASIIVFILSFMIFISALSLGGVGISNTIHKIERHEYMGFENICKYEA

SEQ ID NO: 116220 - protein, 103 aa, Triticum aestivum
  Clone ID: PAT_TA_10638.pep
MCTVTRAHLDQRLAAAKRCSREAAIAGAKAAAVATVATAVPTLASVRMLPWARAHLNPTGQALIISTVAGMAYFIVADKTIVSMARKHSYEDAPEHLKNTSFH

SEQ ID NO: 116221 - protein, 105 aa, Triticum aestivum
  Clone ID: PAT_TA_10639.pep
RTPLGRLVFKTDDMVQVVEAPDIVRNKVSFSIFGLDGAVSLTGKLNVLDSKWIQVIFEPPELKVGSLGFRYGGESEVKLEITYVDEKIRLGKGSRGSLFVFLRQD

SEQ ID NO: 116222 - protein, 243 aa, Triticum aestivum
  unsure (1)..(243): unsure at all Xaa locations
  Clone ID: PAT_TA_10640.pep
MGRRPARCYRQIKNKPYPKSRYCRGVPDPKIRIYDVGMKKKGVDEFPSCVHLVSWEKENVSSEALEAARIACNKYMTXNAGKDAFHLRVRVHPYHVLRINKMLSCAXADRLQTGMRXAFGKPLGTCARVDIGQVLLSVRCKESNAXHADEALRRAKVKFPGRQKIIRRRKGGFTKVNRAGYIKYKKGGRIRPGGGKGXLVGGHGPHGNRALGRAILVWGHLNHAQTISFVRMNPRSFVFVLTR

SEQ ID NO: 116223 - protein, 54 aa, Triticum aestivum
  Clone ID: PAT_TA_10641.pep
MSMVTRAYLDQRLAAAKRCSREAAVAGAKAAAVATVAAAVPTVSNRSVLQFQSS

SEQ ID NO: 116224 - protein, 117 aa, Triticum aestivum
  Clone ID: PAT_TA_10642.pep
EVIIMNHPGQISNGYAPVLDCHTSHIAVKFAEIQTKIDRRSGKEIEAAPKFLKNGDAGFVKMIPTKPMVVETFAQYPPLGRFAVRDMRQTVAVGVIKAVEKKDPTGAKVTKAAAKKK

SEQ ID NO: 116225 - protein, 103 aa, Triticum aestivum
  Clone ID: PAT_TA_10643.pep
MSTVTRSYLDQRLAAAQRCSKEAAMAGAKAAAVATVAAAVPTLASVKMLPWARAHLNPTGQALIISTVAGMAYFIVADKTILSMARKHSYETAPEHLKNTSFH

SEQ ID NO: 116226 - protein, 223 aa, Triticum aestivum
  unsure (1)..(223): unsure at all Xaa locations
  Clone ID: PAT_TA_10644.pep
MASTVPFSPAKVQMLQATNCHGHAPFGSSFAVPRTGPKQRSLAVRVSSEQEAAAAVRAPSGRSIEECEADAVAGKFPAPAAFVRPKAPDGTPEIRPLDMPKRPRRNRRSPALRAAFQETTISPANLVLPLFIHEGEEDAPIGAMPGCFRLXWQHGLLDEXYXGRDCXVNXXVLFPKXPDALKSSTGIEAYNDHGWFPRTIPPLKXKFPDIXATTGVALGPYSS

SEQ ID NO: 116227 - protein, 72 aa, Triticum aestivum
  Clone ID: PAT_TA_10645.pep
EALPKFLKNGDAGIVKMIPTKPMVVETFATYPPLGRFAVRDMRQTVAVGVIKGVEKKDPTGAKVTKAAIKKK

SEQ ID NO: 116228 - protein, 123 aa, Triticum aestivum
  Clone ID: PAT_TA_10646.pep
MAEEKHHHHLFHHKEGEDFQPAADGGVDTYGYSTETVVTATGNEGEYERITKEEKHHKHKEHLGEMGAAAAGAFALYEKHEAKKDPEHAHKHKIEEEVAAAAAVGAGGFVFHEHHEKKHHHFG

SEQ ID NO: 116229 - protein, 103 aa, Triticum aestivum
  Clone ID: PAT_TA_10647.pep
MPTVTRAYLDQRLAVANRCSKEAAMAGAKAAAVATVAAAVPTLASVRMLPWARAHLNPTGQALIISTVAGMAYFIVADKTILSMARKHSFQNAPDHLKNTSFH

SEQ ID NO: 116230 - protein, 200 aa, Triticum aestivum
  unsure (1)..(200): unsure at all Xaa locations
  Clone ID: PAT_TA_10648.pep
RLLKDKFPDIVIYTDVALDPYSSDGHDGIVREDGVIMNDETVYQLCKQAVSQARAGADVVSPSDMMDGRIGALRSALDAEGFHDVSIMSYTAKYASSFYGPFREALDSNPRXGDKKTTKMNPANYREALIETAADEAEGADILLVKPGLPYLDIIRLLRDNSALPIAAYQVSGEYSMIKAAGALGMDDEQKVMMETLMCL

SEQ ID NO: 116231 - protein, 291 aa, Triticum aestivum
  Clone ID: PAT_TA_10649.pep
TRTKAFLKAVETWKKETIIITETAKQSQQTNEEQVYMPLSAGLDAASQSEILSDDDQNETPSDEAVSIWKNVYWKEVGLLAFVWVAFLALQVTKNYMATCSIWYWVLNLLQIPVSVGVAMYEAVGLVQGRRVISSKKNEHNSLRAHQLLVYCFLGVTAGVVAGLLGVGGGSIMGPLFLELGVPPQVASATATFAMMFSSSMSVVEYYLLNRFPVPYAVYLTILAFFAAIIGQRVVRKLIDLLGRASIIVFILSFMIFISALSLGGVGISNTIHKFARHEYMGFENICKYDA

SEQ ID NO: 116232 - protein, 180 aa, Triticum aestivum
  Clone ID: PAT_TA_10650.pep
MASSSSWKHQATASQPANPSHLTLFTEPFQHKTTAKMSSTATVTRAHLENKLALAKRCSREATFAGAKAAAIATSSSVRELLIFTHVGLVSITEMLIVQLASVRMLPWAKANLNPTGQALVICTVAGMAYFVAADKTVLSLARRHSYETAPDHLKDTSFHGGAAAARPRPRSAGIPQALS

SEQ ID NO: 116233 - protein, 103 aa, Triticum aestivum
  Clone ID: PAT_TA_10651.pep
MSTVTRAYLDQRLAAANRCSREAAMAGAKAAAVAAVAAAVPTLASVRMLPWARAHLNPTGQALIISTVAGMAYFIVADKTILSMARKHSFEDAPDHLKNTSFN

SEQ ID NO: 116234 - protein, 82 aa, Triticum aestivum
  Clone ID: PAT_TA_10652.pep
KSRAIASNLSRAEFGTSSCRIRHEVKMIPTKPMVVETFATYPPLGRFAVRDMRQTVAVGVIKGVEKKDPTGAKVTKAAIKKK

SEQ ID NO: 116235 - protein, 103 aa, Triticum aestivum
  Clone ID: PAT_TA_10653.pep
MSTVTRANLDQRLAAANRCSREAAMAGAKAAAVATVAAAVPTLASVRMLPWARAHLNPSGQALIISTVAGMAYFIVADKTILSMARKHSFDDAPDHLKNTSFH

SEQ ID NO: 116236 - protein, 174 aa, Triticum aestivum
  unsure (1)..(174): unsure at all Xaa locations
  Clone ID: PAT_TA_10654.pep
PRVRQAFELXHARWAMLGAAGFIIPEALNKFGANCGPEAVWFKTGALLLDGNTLNYFGNSIPINLILAVVAEVVLVGGAEYYRITNGLEFDDKLHPGGPFDPLGLATDPDQAALLKVKEIKNGRLAMFSMLGFFIQAYVTGEGPFENLCAHLSDPFGNNLLTVISGAAERVPSL

SEQ ID NO: 116237 - protein, 80 aa, Triticum aestivum
  Clone ID: PAT_TA_10655.pep
SYVQLASVRMLPWAKANLNPTGQALIVCTVAGMAYFVAADKTILSLARRHSYESAPDHLKDTSFAGAAAARPRPPAFFRP

SEQ ID NO: 116238 - protein, 79 aa, Triticum aestivum
  Clone ID: PAT_TA_10656.pep
RAGAQAATIATLAAAVPTLASVSMLPWARAHLNPTGQALIISTVAGMAYFIVADKTMLSMARKHSFEDAPEHLKNTSFQ

SEQ ID NO: 116239 - protein, 151 aa, Triticum aestivum
  unsure (1)..(151): unsure at all Xaa locations
  Clone ID: PAT_TA_10657.pep
VAEKKLNKNKKRGGEEETETLTQNTTPPTPATHHPSHPKSQIRAPGDLPFPGGGIEPRASRVRIPPPPPPPFRRKPFRGDARSGAGFWREQLRFGGGFVGRFAGFRRGFRGXXSCPPGSNSPDGGFRGXEHPGLXSKXKGFCFSKTRPGFX

SEQ ID NO: 116240 - protein, 122 aa, Triticum aestivum
  Clone ID: PAT_TA_10658.pep
RAAARAGTSQADCAVLIIDSTTGGFEAGISKDGQTREHALLAFTLGVKQMICCCNKMDATTPKYKSMLFFDDEDRNIQSVSKMGVTSVLVNNGLNLDMFKLGLSNFATTVAAPEPTPAPEDK

SEQ ID NO: 116241 - protein, 103 aa, Triticum aestivum
  Clone ID: PAT_TA_10659.pep
MSTVTRAYLDQRLAAAKRCSKEAAMAGAKAAAVATVAAAVPTLASVRMLPWAKAHLNPTGQALIISTVAGMAYFIVADKTILSMARKHSFEDAPEHLKNTSFH

SEQ ID NO: 116242 - protein, 83 aa, Triticum aestivum
  Clone ID: PAT_TA_10660.pep
MIHDNSTRRTRPARASGTSTLHLVLRLRGGIIEPSLQALARKYNQEKMICRKCYARLHPRAVNCRKKKCGHSNQLRPKKKIKN

SEQ ID NO: 116243 - protein, 81 aa, Triticum aestivum
  Clone ID: PAT_TA_10661.pep
HEGQQNDNRKPFLCLLVIYPDNEIYERALVLDLLLGPQLVAVATLLLAAVDGPWMQPGVALAADHLLLRLFICLNSAGSPA

SEQ ID NO: 116244 - protein, 95 aa, Triticum aestivum
  Clone ID: PAT_TA_10662.pep
ANPLSSQVYSEQAAMSGRGKGGKGLGKGGAKRHRKVLRDNIQGITKPAIRRLARRGGVKRISGLIYEETRRKTVTAMDVVYALKRQGRTLYGFGG

SEQ ID NO: 116245 - protein, 114 aa, Triticum aestivum
  Clone ID: PAT_TA_10663.pep
ANAPVKDESMSDVNDREGSKAAASGGTQHDKLYTAEGILDPRKKKAEKKRRKGNKFSVLNDMDADYDFKVDYQMKDASPADDEDGDGGKGEGEEPKGEDDKKDAPAAECEPMTS

SEQ ID NO: 116246 - protein, 179 aa, Triticum aestivum
  Clone ID: PAT_TA_10664.pep
AWSRPRYKIGGIGTVPVGRVETGVIKPGMVVTFGPTGLTTEVKSVEMHHESLLEALPGDNVGFNVKNVAVKDLKRGYVASNSKDDPAKEAANFTAQVIIMNHPGQISNGYAPVLDCHTSHIAVKFAEIQTKIDRRSGKEIEAAPKFLKNGDAGFVKMIPTKPMVVETFAQYIYTYSASK

SEQ ID NO: 116247 - protein, 49 aa, Triticum aestivum
  Clone ID: PAT_TA_10665.pep
SSGRPGRSGNGQDTESPCKDARTERVEAYATKANSKKWFCCVTPSPTQS

SEQ ID NO: 116248 - protein, 63 aa, Triticum aestivum
  Clone ID: PAT_TA_10666.pep
ITPQCNHKRCLLFVQLEAQTSKPQYYKYSAYIKLKSITHTQHIHCKPQHPQIANTSDTRNRNP

SEQ ID NO: 116249 - protein, 117 aa, Triticum aestivum
  unsure (1)..(117): unsure at all Xaa locations
  Clone ID: PAT_TA_10667.pep
SSSAERRRTRARVLTCRTXAVDVKXASRRQLGFPSNPAELAHLADAAAGGALQVAVAAAVAHDGPHGGEQVSVGRARLALDCFDEAVRHGANRRIRSRHHVHLGLSVAAATDEHGLA

SEQ ID NO: 116250 - protein, 198 aa, Triticum aestivum
  Clone ID: PAT_TA_10668.pep
REQKLELHRGGGRSRTSGSPGLQEFGTSTLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQVIVLALYLLVYPWSSGWWCPVDRLNCFLVC

SEQ ID NO: 116251 - protein, 128 aa, Triticum aestivum
  Clone ID: PAT_TA_10669.pep
RSSFEDVRAAYRRMARKYHPDVSPPDAAKEHTRRFIQVQEAYETLSDPSRRTTYDRALARGVCRLAFSPAARRHDASAFYHQEQEEKSGWRTSWEGQISELKKRSTVKDAEENLSWGAQMRRRRAEQS

SEQ ID NO: 116252 - protein, 97 aa, Triticum aestivum
  Clone ID: PAT_TA_10670.pep
AFPPCRTFTRKPSPAASSSRAARPPPSTKPKKQKHKHKKVKLAVLQFYKVDDATGKVTRLRKECPNADCGAGTFMANHFDRHYCGKCGLTYVYNQKA

SEQ ID NO: 116253 - protein, 180 aa, Triticum aestivum
  Clone ID: PAT_TA_10671.pep
ELHRPSCAISTTRPQPRRPNHNLRSTAVARRRLLLQRTEIHLCYVQRCPSCPRFAIINCFSNVVTFLSTVVCELCPCSTCALLIAAVCWKASAFLDSYCFLPWRPRKKQSWRSMSMSIREAAHPAYFLGHCTISGGGIGGGAGRGRRRRWKTAVRLLPFSSPRCCSWLPFHGLAHGSMAP

SEQ ID NO: 116254 - protein, 112 aa, Triticum aestivum
  Clone ID: PAT_TA_10672.pep
KKAKPGRLVFKGGEAATLRKPKKQKKNKKPADDVPADADAEAAAAAAATEGAEAGGDYTIDAAKRMKYEELFPVETRKFGYDPSNAARTSRDRTVEQALDDRVRKKADRYCK

SEQ ID NO: 116255 - protein, 147 aa, Triticum aestivum
  Clone ID: PAT_TA_10673.pep
MLLNHNLSNFATRRYTQFSRCYGWLVRMACQRIDVTTVRPFFFASELPRIGSLLRPSPCSASSARIFGLPRKSSIQTSLPAPGGRRRRRRGAVLGKYHSMVLSISKMTGEDSGVTEAYGAIADCYTEVGELEKAGKFYDEYLGRDHA

SEQ ID NO: 116256 - protein, 104 aa, Triticum aestivum
  unsure (1)..(104): unsure at all Xaa locations
  Clone ID: PAT_TA_10674.pep
MSTVTRAHLDQRLAAAKRCSREAAMAGAKAAAVATVAAAVPTLASVRMLPWAKXAHLNPTGQALIIFTIAGMAYFIVADKTILSMARKHSFDDAPDHLKNTSFN

SEQ ID NO: 116257 - protein, 78 aa, Triticum aestivum
  Clone ID: PAT_TA_10675.pep
KEHLGKMGATAAGAFALYEKHEAKKDPEHAHKHKIEEEVAAAATVGAGGFVFHEHHEKKQDHKEAKEANGEKKHHHFG

SEQ ID NO: 116258 - protein, 165 aa, Triticum aestivum
  Clone ID: PAT_TA_10676.pep
GSDPSRRLGRRGSIILHPCRHRTRGRTRGRTRGRTRGRTRGRTRGFTSQVIIMNHPGQIGNGYAPVLDCHTSHIAVKFAELVTKIDRRSGKELEALPKFLKNGDAGILKMIPTKPMVVETFATYPPLGRFAVRDMRQTVAVGVIKGVEKKDPTGAKVTKAAIKKK

SEQ ID NO: 116259 - protein, 131 aa, Triticum aestivum
  Clone ID: PAT_TA_10677.pep
LVKLQKEEKERLLAEGNAALEARRAEAEAESKRKLDLEREKARQALQEMERTVEINDIVHPKDLEMLGTVTTEHIMSSVDETSPEHSQDGLPSFLPGSGSMLEKLGLFMKVDEEEEEEEPCSKGAEDGEIN

SEQ ID NO: 116260 - protein, 211 aa, Triticum aestivum
  Clone ID: PAT_TA_10678.pep
SARGEAVGLVQGRRVISSKRNEQNSLRAHQLFVYCFLGVTAGVVAGLLGVGGGSIMGPLFLELGVPPQVIISLFAHVKNFMFPSWFLLSIYHMFSKCLHSVERPQVASATATFAMMFSSSMSVMEYYLLNRFPVPYAVYLTILAFFAAIVGQRVVRKLIDLLGRASIIVFILSFMIFISALSLGGVGISNTIHKIARHEYMGFENICKYEA

SEQ ID NO: 116261 - protein, 92 aa, Triticum aestivum
  Clone ID: PAT_TA_10679.pep
ERARQALQEMERTVEINDSVDPKDLEMLGTVTTEHIVSSVDETSPFLSQDGMPSFLPGSGSLLEKLGLFMKVDEEEEEEEPCSKDADEGEIN

SEQ ID NO: 116262 - protein, 123 aa, Triticum aestivum
  Clone ID: PAT_TA_10680.pep
SPNVSEDELRKSFAKYGDVASVKIPLGKQCGFVQYVNRTDAEEALQGLNGAVIGKQAVRLSWGRSPSHKQSRGDSGNRRNNNNMYYGTPFYGGYGYASPVPHPNMYAPAYGAYPFYGNQQLVS

SEQ ID NO: 116263 - protein, 134 aa, Triticum aestivum
  Clone ID: PAT_TA_10681.pep
GNITKAAGFGRLTAAKVSVRSGTEPTSDCARVRRNLPEASIRLIHPTTARSIVLIPGQGGILHFRDELHFHLQLDFGGPRSLSSLPFPRACILQAHDLTPPAASNLREFFCAPFGRKCLTCAQLPAISPCASAS

SEQ ID NO: 116264 - protein, 169 aa, Triticum aestivum
  unsure (1)..(169): unsure at all Xaa locations
  Clone ID: PAT_TA_10682.pep
RVETGVIKPGMVVTFGPTXLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMIPTKPMVVETFATYPPLGRFAVPEEGRLQP

SEQ ID NO: 116265 - protein, 144 aa, Triticum aestivum
  Clone ID: PAT_TA_10683.pep
FFFISAFVFVIYMLAIFSRRSGTLSVQQCKIENVGAPLSLIHLLFSERRSRNFGTNYICSLIYIALSSPNFLNSTLLGGASSLYSAFYTPDAREKQSHQANMTTSHKFVLSAGYSVVGLKLGCTSWSSDRKAGQEAGGRAPAGC

SEQ ID NO: 116266 - protein, 238 aa, Triticum aestivum
  unsure (1)..(238): unsure at all Xaa locations
  Clone ID: PAT_TA_10684.pep
NEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGTATPQCWDCHTSHIAVNFADWVTKIDRHLGKDXGLPNSLKNGDPGXVKMIPQTMVWETSQLPPLGAXCXDMRKRALXHKGWRKRPRRKYKVHRIAHHFRMLCLLPHILRLFDHPSTVFY

SEQ ID NO: 116267 - protein, 155 aa, Triticum aestivum
  Clone ID: PAT_TA_10685.pep
MQIFVKTLTGKTITLEVESSDTIDNVKAKIQDKEGIPPDQQRLIFAGKQLEDGRTLADYNIQKESTLHLVLRLRGGAKKRKKKTYTKPKKQKHKHKKVKLAVLQFYKVDDATGKVTRLRKECPNAECGAGTFMANHFDRHYCGKCGLTYVYNQKA

SEQ ID NO: 116268 - protein, 170 aa, Triticum aestivum
  unsure (1)..(170): unsure at all Xaa locations
  Clone ID: PAT_TA_10686.pep
QQAVVIYTEEFGKFTTFIGEVFVNAPFFISAEDAGADSRKNDEYRETIIPAGKTHEVILSVEAVNSYIAWDFSLQQGALSTLLDIGFHVEYISPSREKTLILPYRRYEADQVSSLXCLSSFASKYSTFQGNFCTVFAGSYKLVWDNSYSTFFKKTLRYKVDAVPPVTETE

SEQ ID NO: 116269 - protein, 103 aa, Triticum aestivum
  Clone ID: PAT_TA_10687.pep
MSTVTRAYLDQRLAAAKRCSREAAMAGAKAAAVATVAAAVPTLASVRMLPWAKANLNPTGQALIISTVAGMAYFIVADKTILSMARKHSFDDAPDHLKNTSFQ

SEQ ID NO: 116270 - protein, 110 aa, Triticum aestivum
  Clone ID: PAT_TA_10688.pep
MSSSEVACTLAALILHDDGIPITSEKIATVVKAAGIKVEAYWPALFAKLLEKRSVDDLILSVGSGGGGAPAAAAAAPAAGGAAAAEEKKEEKKEEAKEESDDDMGFSLFD

SEQ ID NO: 116271 - protein, 232 aa, Triticum aestivum
  unsure (1)..(232): unsure at all Xaa locations
  Clone ID: PAT_TA_10689.pep
REQKLELHRGGGRSRTSGSPGLQEFGTRVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGYVASNSKDDPAKEAANFTAQVIIMNHPGQISNGYAPVLDCHTXHIAVKFAEIQTKIDRRSGQEIEAAPKFLKN

SEQ ID NO: 116272 - protein, 114 aa, Triticum aestivum
  unsure (1)..(114): unsure at all Xaa locations
  Clone ID: PAT_TA_10690.pep
LRRTPLTMLRRRVPPXAVPGIMFLSGGQFELEATMNLNAMNQSANPWHVSFSYARALQNSVLKTWQGQPENIEAAQKALLVRAKANSLAQLGSYTGEGESDEAKKGMFQKGYTY

SEQ ID NO: 116273 - protein, 155 aa, Triticum aestivum; identical to SEQ ID NO: 116267
  Clone ID: PAT_TA_10691.pep

SEQ ID NO: 116274 - protein, 152 aa, Triticum aestivum
  unsure (1)..(152): unsure at all Xaa locations
  Clone ID: PAT_TA_10692.pep
SEVFFYLAENNVLFEGILLKPSMVTPGAEHKEKASPEAIAKNTLTMLRRRVPPAVPGIMFLSGGQSELEATMNLNAMNXQSANPWHVSFSYARALQNSVLKTWQGQPENIEAAQKALLVRAKANSLAQLGSYTGEGESDEAKKGMFQKGYTY

SEQ ID NO: 116275 - protein, 105 aa, Triticum aestivum
  Clone ID: PAT_TA_10693.pep
RVRTCPWEGNNNWKRLLIPRRLRSKRRNPPKEATKREYAAESEWKNWVWVSEGDLMVNDAYFTTSGGKIGQKLNGKDLIKPKQGEYVRRLTRFAGPLDCNQGSPC

SEQ ID NO: 116276 - protein, 128 aa, Triticum aestivum
  Clone ID: PAT_TA_10694.pep
KIFVKTLTGKTITLEVESSDTIDNVKAKIQDKEGIPPDQQRLIFAGKQLEDGRTLADYNIQKESTLHLVLRLRGGIIEPSLQALARKYNQEKMICRKCYARLHPRAVNCRKKKCGHSNQLRPKKKIKN

SEQ ID NO: 116277 - protein, 119 aa, Triticum aestivum; identical to SEQ ID NO: 112023
  Clone ID: PAT_TA_10695.pep

SEQ ID NO: 116278 - protein, 53 aa, Triticum aestivum
  Clone ID: PAT_TA_10696.pep
ALHSSYKGSGGTYNQEKMICRKCYARLHPRAVNCRKKKCGHSNQLRPKKKIKN

SEQ ID NO: 116279 - protein, 133 aa, Triticum aestivum
  unsure (1)..(133): unsure at all Xaa locations
  Clone ID: PAT_TA_10697.pep
MHKTTAKMSSTATVTRAHLDNKLALAKRCSREATLAGAKAXAAVATVASAVPTLXASVRMLPWAKANLNPTGQALIVCTVAGMAYFVAADKAILSLXARRHSYESAPDHLKDTSFHGGAAAAARPRPPAFFRP

SEQ ID NO: 116280 - protein, 104 aa, Triticum aestivum
  unsure (1)..(104): unsure at all Xaa locations
  Clone ID: PAT_TA_10698.pep
TAYGTGNRFLSYXVELLSRHCHQXGKTNLSHDGLNPAHVPYWWVNNPTLGEFCFTMIGRADIEGSKXNVAMNAWLPQASYPXCGNFSDTSSFKLRRSKGSIGHA

SEQ ID NO: 116281 - protein, 491 aa, Triticum aestivum
  unsure (1)..(491): unsure at all Xaa locations
  Clone ID: PAT_TA_10699.pep
PRPPTSRAASPYGCCCHRPLLASTSAPTRSRGARLALTLSSSSLPLPAGPRSRSRSRRVACRAADEPGPAASNGDEAVDDAPSPPADSVVQADAAAETDTKDESPNAEPLNSALTSLQNIDRYAKAAADSAAQTKDESPNAEPVSAAVKSLQNIDRFVNAAADSAAQTKDESPNAEPVSASDTVQSIDGDATXAADSAAQEQLLEVDVNVASGSPLPGMKQQLEEAVSIPKATVDILKDQVFSFDTFFVTSHEPYEGGILFKGNLRGVPAKSFEKITTRLENKFGDEFKVFLLMDPEDEKPVAVVVPKQTVEPATGSVPEWAAAGAFGVVTIFTLLLRNVPVLQDNLLSTFDNLELLKDGLPGALVTGLIVGVHEIGHILAAKDAGVKLSVPYFVPSWQIGSFGGITRIVNIVRNRGDLLKVAAAGPVAGFSLGFGLLLLGFTLPPSDGLGIIVDPAAKKTPKKKAADKKTAAADKKKAAADAEEEAAADE

SEQ ID NO: 116282 - protein, 221 aa, Triticum aestivum
  unsure (1)..(221): unsure at all Xaa locations
  Clone ID: PAT_TA_10700.pep
IRMAMHWLVQGCXSGDSLVFQFSGAGVQVLDCSGEERDGMDEAICPLDSFQQGPILDDEINQAIVRPLVHGVKLHAIVDACHSATVLDLPYQCTFSKQYGCLRWRDERPLNGAFKGTSGGQAVLISGSSNGKTQMNMMPGPDATVGAMTHSFIRAVECEPRTTYGHLLTSMRTIMREGGGNCNLQGPAGGCIRKVANFSGLEEPQLSSACKFDIHREPFCM

SEQ ID NO: 116283 - protein, 105 aa, Triticum aestivum
  Clone ID: PAT_TA_10701.pep
MSTVTRAYLDQRLAAAKRCSKEATMAGAKAAAVATVAAAVPTLASVRMLPWAKAHLNPTGQALIISTVAGMAYFIVADKTILSMAMARRHSFEDAPEHLKNTSFH

SEQ ID NO: 116284 - protein, 121 aa, Triticum aestivum
  Clone ID: PAT_TA_10702.pep
MQIFVKTLTGKTITLEVESSDTIDNVKAKIQDKEGIPPDQQRLIFAGKQLEDGRTLADYNIQKESTLHLVLRLRGDATGKVTRLRKECPNADCGAGTFMANHFDRHYCGKCGLTYVYNQKA

SEQ ID NO: 116285 - protein, 122 aa, Triticum aestivum
  Clone ID: PAT_TA_10703.pep
MSTTATVTRAHLENKLALAKRCSREATLAGAKAAAVATVASAVPTLASVRMLPWAKANLNPTGQALIVCTVAGMAYFIAADKAILSLARRHSYESAPDHLKDTSFDGGAAAARPRPPAFFRP

SEQ ID NO: 116286 - protein, 176 aa, Triticum aestivum
  Clone ID: PAT_TA_10704.pep
MGDERVKAEALQILGLFQVLPRLVVFDLDYTLWPFYCECRSKRESPSLYRHAKGIMCALKEKGVDMAIASRSPTSDIARVFIDKLELQPMFVAQEIFSSWTHKTEHFQKIHRKTGVPYKSMLFFDDEDRNIQSVSKMGVTSVLVNNGLNLDMFKLGLSNFATTVAAPEPTPAPEDK

SEQ ID NO: 116287 - protein, 157 aa, Triticum aestivum
  unsure (1)..(157): unsure at all Xaa locations
  Clone ID: PAT_TA_10705.pep
MQIFVKTLTGKTITLEVESSDTIDNVKAKIQDKEGIPPDQQRLIFAGKQLEDGRTLADYNIQKESTLHLXVLRLRGGXAKKRKKKTYTKPKKIKHKHKKVKLSVLQFYKVDDATGKVTRLRKECPNTECGAGVFMANHFDRHYCGKCGLTYVYNQKA

SEQ ID NO: 116288 - protein, 106 aa, Triticum aestivum
  unsure (1)..(106): unsure at all Xaa locations
  Clone ID: PAT_TA_10706.pep
MWTVTRAYLDQXLAAAKRCSREAAMAGAKAXAAVATVAAAVPTLXASVRMLPWARAHLNPTGQALIISTVAXGMAYFIVADKTILSMARKHSFDDAPDHLKNTSFH

SEQ ID NO: 116289 - protein, 127 aa, Triticum aestivum
  unsure (1)..(127): unsure at all Xaa locations
  Clone ID: PAT_TA_10707.pep
WIPRAAGIRHQQYSSSLATSSLSSAPSQDAYLDQRLVAAKRCSKEAAMAGAKXAAAVATIAAAIPTLASARMLPWARAHLNPTGQALIISTVAGMAYFIVADKTILSMARKHSYETAPEHLKNTSFH

SEQ ID NO: 116290 - protein, 117 aa, Triticum aestivum
  Clone ID: PAT_TA_10708.pep
VELRKSFAKYGDVPSVKIPLGKQCGFVQYVNRTDAEEALQGLNGAVIGKQAVRLSWGRSPSHKQSRGDSGNRRNNNNMYYGTPFYGGYGYASPVPHPNMYAPAYGAYPFYGNQQLVS

SEQ ID NO: 116291 - protein, 303 aa, Triticum aestivum
  Clone ID: PAT_TA_10709.pep
RHEGEAEYIVSVYIYMRLIGYPANKISILTTYNGQKLLIRDVISRRCKPWNIEPPCKVTTVDKFQGQQNDFILLSLVRTRFVGHLRDVRRLIVAMSRARLGLYVFCRCSLFEQCYELQPTFQLLLQRPDKLALNLEECTPFTERPLGEAGNIHYITDVEDIGHLVNFRLEHLRQMQSMQYYAPHANADAAPPETGNGDIVLDNAKDGTEKENGEATDAVNNDKIEEDTVESKDDTVQEVNKMDEGNVTREDKMGEESADEAKDKMVETTAEVAIENNIVEVNANVAKDKMDEENALSKGVEQD

SEQ ID NO: 116292 - protein, 226 aa, Triticum aestivum
  unsure (1)..(226): unsure at all Xaa locations
  Clone ID: PAT_TA_10710.pep
RNIQYWDTETGQVISTFSTGKVPYVVKLNPDEDKQHILLAGMSDKKIVQWDMKSGQITQEYDQHLGAVNTITFVDNNRRFVTSSDDKSLRVWEFGIPVVIKYISEPHMHSMPSIAVHPNSNWLAAQXLDNQILIYSTKERFQLNKKKRFAGHIVAGYACQVSFSPDGRFVMSGDGEGSCWFWDWKSCRRFKTLKCHNGVCIGCEWHPLETSKVATCGWDGVIKYWD

SEQ ID NO: 116293 - protein, 155 aa, Triticum aestivum; identical to SEQ ID NO: 116267
  Clone ID: PAT_TA_10711.pep

SEQ ID NO: 116294 - protein, 129 aa, Triticum aestivum
  Clone ID: PAT_TA_10712.pep
PAGLGKNPQTQRTREARTTDTKVRWPPRHSQLWSFWRSSAASLWSTAMPSPTPAAAASGEEEDLLPECSHRLTPPPMPTPPPLENTTELQGLQPWKKTRPSWSTACRHTTVRYLSRLQVTSPSRQRSRA

SEQ ID NO: 116295 - protein, 103 aa, Triticum aestivum
  Clone ID: PAT_TA_10713.pep
MSTVTRAYLDQRLAAANRCSKEAAMAGAKAAAVATVAAAVPTLASVRMLPWAKAHLNPTGQALIISTVAGMAYFIVADKTILSMARKHSFDDAPDHLKNTSFH

SEQ ID NO: 116296 - protein, 103 aa, Triticum aestivum
  Clone ID: PAT_TA_10714.pep
MSTVTRANLDQRLAAANRCSREAAMAGAKAAAVATVAAAVPTLASVRMLPWARAHLNPTGQALIISTVAGMAYFIVADKTILSMARRHSFDDAPEHLKNTSFH

SEQ ID NO: 116297 - protein, 113 aa, Triticum aestivum
  unsure (1)..(113): unsure at all Xaa locations
  Clone ID: PAT_TA_10715.pep
CEKRSDGRSACELRPINSQCGILPRAHGSALSTRGETQVXALAGVTLGDYQMAQRIDTLGDTEESKSFYLQYTFPPSSGGEVGRTGAPNRREHGILYVMPGLESELVVVWSVD

SEQ ID NO: 116298 - protein, 103 aa, Triticum aestivum
  Clone ID: PAT_TA_10716.pep
MSTVTRAYLDQRLALANRCSREAAMAGAKAAAVATVAAAVPTLASVRMLPWARAHLNPTGQALIISTIAGMAYFIVADKTILSMARKHSFDDAPDHLKNTSFN

SEQ ID NO: 116299 - protein, 204 aa, Triticum aestivum
  Clone ID: PAT_TA_10717.pep
VEAAAKIVIHDWNEGKVPYFTLPPKRDVVEDANAVIITEDGSEFNVDEIYKAESSYISGLKSMEEFSHIEIPSNAPPEIDEAMLEDPPTQSAPVKDESMSDANDREGSKAAASGGTQHDKLYTAEGILDPRKKKAEKKRRKGNKFSVLNDMDADYDFKVDYQMKDASPADDEEGDGSKGEGEEPKGEDDKKDAPAAECEPMTTS

SEQ ID NO: 116300 - protein, 188 aa, Triticum aestivum
  Clone ID: PAT_TA_10718.pep
MPHLAASPASAFAVAGFRPPPRAPTRARASATAGGAARTATAVQQQTQQPTFYDLLGISPEGSTFEDVRAAYRRMARKYHPDVSPPDATKEHTRRFIQVQEAYETLSDPSRRTSYDRALARGVCRLAFSPAARRHDASAFYHQEQEERSGWRTSWEGQISELKKRSTVKDAEENLSWGAQMRRRAEQL

SEQ ID NO: 116301 - protein, 89 aa, Triticum aestivum
  Clone ID: PAT_TA_10719.pep
PRTTYGSLLTSMRTTMRAGAGNCNLQGPPSACSIPQGRQLQWRGGSPRCLLLASLTSTVSPSACRTHAGVRRRCCWLLQQTIMYSLIIG

SEQ ID NO: 116302 - protein, 270 aa, Triticum aestivum
  Clone ID: PAT_TA_10720.pep
PTRPPTRPEETLYQSTTDGKTFVDVLKDQNIMPGIKVDKGLVPLPGSNNESWCQGLDGLASRCAEYYKQGARFAKWRTVVSIPCGPTALAVKEAAWGLARYAAIAQDNGLVPIVEPEILLDGDHGIERTLEVAEKVWSEVFFYLAENNVLFEGILLKPSMVTPGAEHKEKASPEAIAKNTLTMLRRRVPPAVPGIMFLSGGQSELEATMNLNAMNQSANPWHVSFSYARALQNSVLVRAKANSLAQLGSYTGEGESDEAKKGMFQKGYTY

SEQ ID NO: 116303 - protein, 255 aa, Triticum aestivum
  Clone ID: PAT_TA_10721.pep
SARGYALLWKQQMDRRVQLAQLGSATGVYKTLVRYLVGVPQVLLDFIRQINDANGPMEVQRERYGPALYTLTKLVLAVRLYLHLSLARYGQKKIGKDDIAVLQQAVVIYTEEFGKFTTFIGEVFVNAPFFISAEDAGADSSRKNDEYRETIIPAGKTHEVILSVEAVNSYIAWDFSLQQGALSTLLDIGFHVEYISPSREKTLILPYRRYEADQGNFCTVFAGSYKLVWDNSYSTFFKKTLRYKVDAVPPVTETE

SEQ ID NO: 116304 - protein, 129 aa, Triticum aestivum
  unsure (1)..(129): unsure at all Xaa locations
  Clone ID: PAT_TA_10722.pep
MCRPSQTPHLTMSSADIEGSKSNVAMNAWLPQASYPCGNFSDTSSFKLRRSKGSXATLSRFVFVLEIRIKRAFTLLFHMRFMLSLSSXLGHLRYLLTDVPPQPNSPPDNVFRPDRPGKTGPWSQKEGTR

SEQ ID NO: 116305 - protein, 119 aa, Triticum aestivum
  Clone ID: PAT_TA_10723.pep
MAKSLRSKREKRLRTLRREIAEPFYDKKEAAKQAAQAAALEAPKLPVRVHPAYEESLAAAAAAAASRASAMEVDGGSKKSTSFLKPMGTISKKKVQLHLKIKKDKRKARKKGNSGKKSY

SEQ ID NO: 116306 - protein, 242 aa, Triticum aestivum
  unsure (1)..(242): unsure at all Xaa locations
  Clone ID: PAT_TA_10724.pep
KKSXLPPFLGLGGGMXXFVKTXPGKTIXFEVXSSDTIDNVKAKIQDKKGIPPXTSSAIFAGKQXKNGRTLADYNIQKESTLHLVLRLRGGMQIFVKTLTGKTITLEVESSDTIDNVKAKIQDKEGIPPDQQRXFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 116307 - protein, 123 aa, Triticum aestivum
  Clone ID: PAT_TA_10725.pep
SAHIGRESRNQTKVRDQERWRPRHSLLWSFWRSSAASLWSTAMPSPTPAAAASGEEDLLPECSHRLTPLHMPTPPPLEKTMEVEGLQPWKKTRPSWSTACRRTTARCLSRLPLTSPSRQRSRA

SEQ ID NO: 116308 - protein, 101 aa, Triticum aestivum
  Clone ID: PAT_TA_10726.pep
HEEHTRRFIQVQEAYETLSDPSRRTTYDRALARGVCRLAFSPAARRHDASAFYHQEQEEKSGWRTSWEGQISELKKRSTVKDAEENLSWGAQMRRRRAEQL

SEQ ID NO: 116309 - protein, 183 aa, Triticum aestivum
  Clone ID: PAT_TA_10727.pep
AAGPVAGFSLGFGLLLLGFTLPPSDGLGIIVDPAVFHQSFLLGGLAKLILGDVLKEGTQLSINPLVLWAWAGLLINAINSIPAGELDGGRIALAMWGRKVSSRLGSVTIALLGLSSLFSDVAFYWAVLIFFLQRGPIAPLSEEITEPENIYIGLGVAILFLGLLVCLPYPFLFDPSQVTDFDF

SEQ ID NO: 116310 - protein, 120 aa, Triticum aestivum
  Clone ID: PAT_TA_10728.pep
MSDVYKKAKPGRLVFKGGEAATLRKPKKQKKNKKPADDVPADADAEAAAAAAAAAATEGAEAGGDYTIDAAKRMKYEELFPVETRKFGYDPSNAARTSRDRTVEQALDDRVRKKADRYCK

SEQ ID NO: 116311 - protein, 190 aa, Triticum aestivum
  Clone ID: PAT_TA_10729.pep
MFKNTFQSGFLSILYSLGTKPLQIWDKEVVDGHIKRPQDEDIKSNVLEIVGTNVQSTYITCPADPAATLGIKLPFLALVVKNLKKYFTFEVQVLDDKNVRRRFRASNFQSVTRVKPYICTMPLKLDDGWNNIQLNLTDLTKRAYGTNYVEALRVQVHANCRLRRVYFSDRLYSEEELPAEFKLYLPIQKS

SEQ ID NO: 116312 - protein, 103 aa, Triticum aestivum
  Clone ID: PAT_TA_10730.pep
MSTVTRSYLDQRLAAAQRCSKEAAMAGAKAAAVATVAAAVPTLASVRMLPWARAHLNPTGQALIISTVAGMAYFIVADKTILSMARKHSYETAPEHLKNTSFH

SEQ ID NO: 116313 - protein, 228 aa, Triticum aestivum
  unsure (1)..(228): unsure at all Xaa locations
  Clone ID: PAT_TA_10731.pep
RHRAKTITXKXGVSDTIDNVKAKIQDKEGIXPPDQQRLIFAGKQLEXDGRTLADYNIQXKESTLHLVLRLRGGMQIFVKTLTGKTITLEVDSSDTIDNVKAKIQDKEGXIPPDQQRLIFAGKQLEDGRTLADYNIQKESTLHLVLRLRGGMQIFVKTLTGXKTITLEVESSDTIDNVKTKIQDKEGIPPDQQRLIFAGKQLEDGRTLADYNIQKESTLHLVLRLRGGQ

SEQ ID NO: 116314 - protein, 155 aa, Triticum aestivum
  Clone ID: PAT_TA_10732.pep
MQIFVKTLTGKTITLEVESSDTIDNVKAKIQDKEGIPPDQQRLIFAGKQLEDGRTLADYNIQKESTLHLVLRLRGGAKKRKKKTYTKPKKQKHKHKKVKLAVLQFYKVDDATGKVTRLRKECPNADCGAGTFMANHFDRHYCGKCGLTYVYNQKA

SEQ ID NO: 116315 - protein, 133 aa, Triticum aestivum
  Clone ID: PAT_TA_10733.pep
PAGFRHTTDRHREERSSQAKNRDQERWLRPRHSQLWSFWRSSAPSSWSAAMPRRTSAAAALGEEDLLPDCSHRLTPLPMATPPPLEGVQPWKKTRPSWSTACRRTTTRFLSRLPVSRPSSAAEHETNNQVAKH

SEQ ID NO: 116316 - protein, 219 aa, Triticum aestivum
  Clone ID: PAT_TA_10734.pep
MGRRPARCYRQIKNKPYPKSRYCRGVPDPKIRIYDVGMKKKGVDEFSHCVHLVSWEKENVSSEALEAARIACNKYMTKHAGKDAFHLRVRVHPFHVLRINKMLSCAGADRLQTGMRGAFGKPQGVCARVAIGQVLLSVRCKPNNAIHATEALRRAKFKFPGRQKIIESRKWGFTKFNRNDYLKFKSEGRILPDGVNAKLLGCHGRLANRAPGQAFLSAA

SEQ ID NO: 116317 - protein, 103 aa, Triticum aestivum; identical to SEQ ID NO: 107316
  Clone ID: PAT_TA_10735.pep

SEQ ID NO: 116318 - protein, 308 aa, Triticum aestivum
  unsure (1)..(308): unsure at all Xaa locations
  Clone ID: PAT_TA_10736.pep
PVAVVVPKQTVEPATGSVPEWAAAGAFGVVTIFTLLLRNVPVLQDNLLSTFDNLELLKDGLPGALVTGLIVGVHEIGHILAARDAGVTLSVPYFXYPSWQIGSFGGITRIVNIVRNRGDLLKVAAAGPVAGFSLGFGLLLLGFTLPPSDGLGIIVDPAIFHQSFLLGGLAKLILGDVLKEGTQLSINPLVLWAWAGLLINAINSIPAGELDGGRIALAMWGRKVSSRLGSVTIALLGLSSLFSDVAFYWAVLIFFLQRGPIAPLSEXEITEPENRYIGLGVTILFLGLLVCLPYPFLFDPSQVTDFDF

SEQ ID NO: 116319 - protein, 125 aa, Triticum aestivum
  Clone ID: PAT_TA_10737.pep
MSSTATVTRAHLENKLALARRCSREATLAGAKAAAIATVASAVPTLASVRMLPWAKANLNPTGQALIVCTVAGMAYFVAADKTILSLARKHSYESAPDHLKDTSFHGAARRQLVPRPPAFFRPLS

SEQ ID NO: 116320 - protein, 103 aa, Triticum aestivum
  Clone ID: PAT_TA_10738.pep
MSTVTPAYLDQRLAAAKRSSREAAMAGAKAAAVATVAAAIPTLASVRMLPWARAHLNPTGQALIISTVAGMAYFIVADKTILSMARKHSFDDAPEHLKNTSFH

SEQ ID NO: 116321 - protein, 103 aa, Triticum aestivum
  Clone ID: PAT_TA_10739.pep
MSTVTGAHLDQRLAAAKRCSREAAMAGAKAAAVATVAAAVPTLASVRMLPWAKTHLNPAGQALIISTVAGMAYFIVADKTILSMARKHSFEDAPDHLKNTSFH

SEQ ID NO: 116322 - protein, 130 aa, Triticum aestivum
  Clone ID: PAT_TA_10740.pep
DTEAEKSRAAKQSERPREMASKAFPALVLVALVCGQLVVDGHAQPYTGGGRIRGGGSADGVQPPTYTTTHGHSSTIGNLSIAENTTVLQGLQPWKKTRPSWSTACRRTTARFLSRLPATSPSRSRQCSRA

SEQ ID NO: 116323 - protein, 320 aa, Triticum aestivum
  Clone ID: PAT_TA_10741.pep
LPMFWSLCKVSFQYLLERTPFCAYLKDLSFALDKIQTVCCNSLGSIFKYHCGPSCIITRIQHALQGQAWQQDGFDKWYKTNPPWSLPDSMRGAPDRVETVAFATAEVATSPDPVFLGDVFFSGLKHEKHFTVRIPQCMCLSTKPPPPCAHHEISNPSAPYNPEDSLHMQWQHGRGVLLPCCKILVTDCHRTHLARRMRSLWMGCDQVGGALSPCLLWRSMCSAKNRISLGFRPQLSSKIRTPAPLKISILWNALDVNAFHHSLNFFICWPHGWYSPRGNGLLPVCVPVVGIVEKKRAPYVICPFNYVAFSRCFIESVVTC

SEQ ID NO: 116324 - protein, 103 aa, Triticum aestivum; identical to SEQ ID NO: 116233
  Clone ID: PAT_TA_10742.pep

SEQ ID NO: 116325 - protein, 103 aa, Triticum aestivum
  unsure (1)..(103): unsure at all Xaa locations
  Clone ID: PAT_TA_10743.pep
MSTVTRAYLDQRLAAAKRCSKEAAMAGVKAAAVATVAAAVPTLASVRMLPWAKSXLNPTGQALIISTVAGMAYFIVADKTILSMARKHSHEMAPEHLKNTSFH

SEQ ID NO: 116326 - protein, 128 aa, Triticum aestivum
  Clone ID: PAT_TA_10744.pep
TVVRQVSFTLLMTALQLVMKKSSAHDGLVKGLREAAKAIEKHAAQICVLAEDCDQPDYVKLVKALCAEHNVHLVTVPSAKTLGEWAGLCKIDSEGKARKVVGCSCVVVKDYGEDSEGLHIVQEYVKSH

SEQ ID NO: 116327 - protein, 404 aa, Triticum aestivum
  Clone ID: PAT_TA_10745.pep
MAEVNLLHGESDTSATGLLPVSFLSCSPRSMVPISVPSSSGLEAILTPNPMYSDVQLKEVMNYNATAMDESTEFLQLILSGNDEGYNTTSELQVWDVLDFYFSESFSDVQFDSIMGFTSDVSTSSHDYMMNIVDLVERPVALLSLNETEEPNNATNKAPVDHSTMDPDDTSLYLQMKPPDSETESTSASQDVIGIEYVDEKLHSKGLPDLMDVDSSSRLRKSPVRTKHVTLVLDLDETLVHSTLDHCDISDFSIQVFFNMKDHTVHVRQRPHLKMFLEKVAQMFELVIFTASQRIYAEQIIDRLDPDGKLISQRIYRESCIFSDGSYTKDLTILGVHLAKVAIIDNTPQVFQLQVDNGIPIKSWFDDPADQELVELLPFLETLVDAEDVRPLISRTFHGTIQQD

SEQ ID NO: 116328 - protein, 103 aa, Triticum aestivum; identical to SEQ ID NO: 116220
  Clone ID: PAT_TA_10746.pep

SEQ ID NO: 116329 - protein, 219 aa, Triticum aestivum
  Clone ID: PAT_TA_10747.pep
MAACAAPLCVRISCSTPSPTALHRPRRRRVTSARCSLAAAPGLRAPAELVDSILSKVKGTDRGVLLPEEGHQEVADVAQQLGKYCIDEPVKSPLIFGDWDVVYCSVPTSPGGIYRTPLGRLVFKTDDMVQVVEAPDIVRNKVSFSIFGLDGAVSLKGKLNVLDSKWIQVIFEPPELKVGPLGFQYGGESEVKLEITYVDEKIRLGKGSRGSLFVFLRQD

SEQ ID NO: 116330 - protein, 189 aa, Triticum aestivum
  Clone ID: PAT_TA_10748.pep
MARKGGERKKAVTRSVKAGLQFPVGRIGRFLKKGRYAQRVGSGAPVYLAAVLEYLAAEVLELAGNAAKDNKKSRIVPRHLLLAIRNDQELGKLLAGVTIAHGGVLPNINPVLLPKKALEKAEKEAQSPKSPKRKAPAPAPAAKKTPKKKAADKKTAAADKKTAAADKKTAAADKKKAAADAEEEAAAEE

SEQ ID NO: 116331 - protein, 126 aa, Triticum aestivum
  Clone ID: PAT_TA_10749.pep
ARGKERLLAEGNAALEARRAEAEAESKRKLDLEREKARQALQEMERTVEINDIVHPKDLEMLGTVTTEHIMSSVDETSPEHSLDGLPSFLPGSGSMLEKLGLFMKVDEEEEEEEPCSKDAEVGEIN

SEQ ID NO: 116332 - protein, 341 aa, Triticum aestivum
  unsure (1)..(341): unsure at all Xaa locations
  Clone ID: PAT_TA_10750.pep
DEAVLIIDSTTGGFEAGISKDGQTREHALLAFTLGVKQMICCCNKMDATTPKYSKARYEEIVKEVSSYLKKVGYNPEKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKXDDPAKEAANFTSQVIIMNHPGQIGNGYAPVLDCHTSHIAVKFAELVTKIDRRSGKEIEAAPKFLKNGDAGIVKMIPTKPMVVETFATYPPLGRFAVRDMRQTVAVGVIKVVEKKDPTGAQGTKAHSEEMRR

SEQ ID NO: 116333 - protein, 136 aa, Triticum aestivum
  unsure (1)..(136): unsure at all Xaa locations
  Clone ID: PAT_TA_10751.pep
ELEKLQKEEKERLLAEGNAAMXARRAEAEAESKRKRDLEREKARQALQEMERTVEINDSVHPKDLEMLGTITTEHIVSSVDETSPEHSQDGMPSFLPGSGSMLEKLGLFMKVDEDEEEDEPCSFPSSKDVEEVEIN

SEQ ID NO: 116334 - protein, 122 aa, Triticum aestivum
  unsure (1)..(122): unsure at all Xaa locations
  Clone ID: PAT_TA_10752.pep
MSSTATVTRAHLENKLALAKRCSREATLAGAKAAAVATVASAVPTLASVRMLPWAKANLNPTXGQALIVCTVAGMAYFVAADKTILSLARRHSYESAPDHLKDTSFAGAAAARPRPPAFFRP

SEQ ID NO: 116335 - protein, 242 aa, Triticum aestivum
  unsure (1)..(242): unsure at all Xaa locations
  Clone ID: PAT_TA_10753.pep
PFLXWXGGMQIXVKTXTGKXTITLEXVESSDTIDNVKGQDPGQGGAFPPDQAAPLSLAGKQAGRMAGTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 116336 - protein, 433 aa, Triticum aestivum
  unsure (1)..(433): unsure at all Xaa locations
  Clone ID: PAT_TA_10754.pep
MTTTEGLVPITRDYLARYYDKYPLPPIPDGVTALSARLRALSAELAAASPFSPEEEHLKQEASGVPAHKIDENMWKNREQMEEILFLLNKSRRPVALQQKSTPEDAEIVSTLDDCETKLKEMLKKLEQFQLKNADNVFNTVMTYMPQDFRGTLIRQQRERSERNKQAEVDAVVSAGGSIHDRYALLWKQQMDRRVQLAQLGSATGVYKTLVRYLVGVPQVLLDFIRQINDANGPMEVQRERYGPALYTLTKLVLAVRLYLHLSLARYGQKKIGKDDIAVLQQAVVIYTXKFGKFTTFIGEVFVNAPFFISAEDAGADSRKNDEYRETIIPAGKTHEVILSVEAVNSYIAWDFSLQQGALSTLLDIGFHVEYISPSREKTLILPYRRYEADQGNFCTVFAGSYKLVWDNSYSTFFKKTLRYKVDAVPPVVTETE

SEQ ID NO: 116337 - protein, 219 aa, Triticum aestivum
  Clone ID: PAT_TA_10755.pep
MAACAAPPCVRISCSTPSPTALRRPRRRRVASARCSLAAAPGLRAPPELVDSILSKVKGTDRGVLLPEEGHQEVADVAQQLGKYCIDEPVKSPLIFGDWDVVYCSVPTSPGGIYRTPLGRLVFKTDDMVQVVEAPDIVRNKVSFSIFGLDGAVSLTGKLNVLDSKWIQVIFEPPELKVGSLGFRYGGESEVKLEITYVDEKIRLGKGSRGSLFVFLRQD

SEQ ID NO: 116338 - protein, 155 aa, Triticum aestivum; identical to SEQ ID NO: 116267
  Clone ID: PAT_TA_10756.pep

SEQ ID NO: 116339 - protein, 176 aa, Triticum aestivum
  Clone ID: PAT_TA_10757.pep
MGDERVKAEALQILGLFQVLPRLVVFDLDYTLWPFYCECRSKRESPSLYRHAKGIMCALKEKGVDMAIASRSPTSDIARVFIDKLELQPMFVAQEIFSSWTHKTEHFQKIHRKTGVPYKSMLFFDDEDRNIQSVSKMGVTSVLVNNGLNLDMFKLGLSNFATTAAAPEPAPAPEDK

SEQ ID NO: 116340 - protein, 216 aa, Triticum aestivum
  unsure (1)..(216): unsure at all Xaa locations
  Clone ID: PAT_TA_10758.pep
MASEPVIGKLSVRVVRGHNLVIADSLTHTSDPYVVLCYGSQKVKTSVQXKKMPIPYGNDVLVLPVTNPTKPVKLEVFDEDKFTSGXDSMGVAEFNVTDIYDGAKLDLKHASDGTRIKTIYPVGTNYLGGESQVSWKNGKVVQDLILKLKNVDSGSVVLQLXEWVHVPWCYPVNCARLNVIATWFDEAAAMVPVPGVRCVSTLWMLWFAVYVLCVRY

SEQ ID NO: 116341 - protein, 125 aa, Triticum aestivum
  Clone ID: PAT_TA_10759.pep
ETKRDGYVQGIPSSGPSGARLQPAHGRRPCPGVHRRHQGRRRICCRTAATDFHHYPWPLLHHWRAFSRGRRQGLHGQQPDGAQPPASCPAFRSVDREVQPSLRPTIKWPVLIIRINLGEVVQFAG

SEQ ID NO: 116342 - protein, 246 aa, Triticum aestivum
  unsure (1)..(246): unsure at all Xaa locations
  Clone ID: PAT_TA_10760.pep
IQKESTLXHLVLRLREGMQIFVKTFTGKTITLKAESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLPLVLRLRGGMQIFVKTLTGKTITLEVESSDTIDNVKAKIQDKEGIPPDQQGLIFAGKQLEDGRTLADYNIQKESTLPLVLRLRGGQ

SEQ ID NO: 116343 - protein, 133 aa, Triticum aestivum
  Clone ID: PAT_TA_10761.pep
RSDPESLPPTNPRSKTPKSPFLSSYSEQAAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 116344 - protein, 169 aa, Triticum aestivum
  unsure (1)..(169): unsure at all Xaa locations
  Clone ID: PAT_TA_10762.pep
MASEPVIGKLSVRVVRGHNLVIADPLTHTSDPYVVLCYGSQKVKTSVQKKNANPLWNDVLVLPVTNPTKPVKLEVFDEDKFTADDSMGVAEFNVTDTYDAAKLDLKHASDGTRIKTIYPXVGTNYLGGESHVSWKNGKVVQDLILKLKNVDSGSVVLQLEWVHVPGVTL

SEQ ID NO: 116345 - protein, 193 aa, Triticum aestivum
  unsure (1)..(193): unsure at all Xaa locations
  Clone ID: PAT_TA_10763.pep
MAGKGGERKKAVTRSTKAGLQFPVGRIGCFLKKGRYAQRVGSGAPVYLAAVLEYLAAEVLELAGNAAKDNKKTRIVPRHLLLAIRNDQELGKLLAGVTIAHGGVIPNINPVLLPKKALXRAEKESQSPKSPKRKAPAPAPAAKKTPKKKAADKKTAADKKTAADKKTAAADKKTAAADKKAAADAEEEAAADE

SEQ ID NO: 116346 - protein, 110 aa, Triticum aestivum; identical to SEQ ID NO: 116270
  Clone ID: PAT_TA_10764.pep

SEQ ID NO: 116347 - protein, 449 aa, Triticum aestivum
  unsure (1)..(449): unsure at all Xaa locations
  Clone ID: PAT_TA_10765.pep
MRPHRLLLIFFSIFHPSDRPWLPPSPSPRPRSRCSRRPTATGTRRSAALSPSQEPGQSSVPWPSGSAASRRRAAAVRAPSGRSIEECEADAVAGKFPAPAAFVRPKAPDGTPEIRPLDMPKRPRRNRRSPALRAAFQETTISPANLVLPLFIHEGEEDAPIGAMPGCFRLGWQHGLLDEVYKARDVGVNSFVLFPKVPDALKSPTGIEAYNDNGLVPRTIRLLKDKFPDIIVYTDVALDPYSSDGHDGIVREDGVILNDETVYQLCKQAVSQARAGADVVSPSDMMDGRVGAIRSALDAEGFNDVSIMSYTAKYASSFYXPFREALDSNPRFGDKKTYQMNPANYREALLETAADEAEGADILLVKPGLPYLDIIRLLRDNSALPIAAYQVSXGEYSMIKAGGXLNMIDEEKVMMESLMCLRRAGADVILTYFARQAAAVLCGMGSAAK

SEQ ID NO: 116348 - protein, 104 aa, Triticum aestivum
  unsure (1)..(104): unsure at all Xaa locations
  Clone ID: PAT_TA_10766.pep
MSTVTRAYLDQRLAAAKRCSKEAAMAGAKAAAVATVAAAVPTLASVRMLPWAKAHLNPTGQALIISTVAGMAYFIVADKTILSMARKHSYETAPXEHLKNTSFN

SEQ ID NO: 116349 - protein, 105 aa, Triticum aestivum
  unsure (1)..(105): unsure at all Xaa locations
  Clone ID: PAT_TA_10767.pep
MSTVTRAYLDQRLAAAKRCSREAAMAGAKAAAVATVAAAVPTLASVRMLPWXAKAHLNPTGQALIISTVAGXWAYFIVADKTILSMARKHSFDDAPDHLKNTSFH

SEQ ID NO: 116350 - protein, 428 aa, Triticum aestivum
  Clone ID: PAT_TA_10768.pep
MASTVPFSPAKVQMLQATNCHGHAPFGSCFAVPRTGPRPRSVAVRVSSEQEAAAAVRAPSGRSIEECEADAVAGRFPAPAAFVKPKAPDGTPEIRPLDMPKRPRRNRRSPALRAAFQETTISPANLVLPLFIHEGEEDAPIGAMPGCFRLGWQHGLLDEVYKARDVGVNSFVLFPKVPDALKSPTGVEAYNDNGLVPRTIRLLKDKFPDIIVYTDVALDPYSSDGHDGIVREDGVILNDETVYQLCKQAVSQARAGADVVSPSDMMDGRVGAIRSALDAEGFNDVSIMSYTAKYASSFYGPFREALDSNPRFGDKKTYQMNPANYREALLETAADEAEGADILLVKPGLPYLDIIRLLRDNSALPIAAYQVSGEYSMIKAGGALNMIDEEKVMMESLMCLRRAGADVILTYFARQAAAVLCGMGSAAK

SEQ ID NO: 116351 - protein, 124 aa, Triticum aestivum
  Clone ID: PAT_TA_10769.pep
AKPRSKIPKSPLFLKLLGAAAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 116352 - protein, 128 aa, Triticum aestivum
  Clone ID: PAT_TA_10770.pep
EIKRDGAQGIPRSGPSGARLRPACGRRPCPALHRRRPHQGRRRICCRTTATDLPSCPCPLLHHWRIQRCCKAFSRGRRQVLHGQQPAGARPPASCPAFRPLVRPGPGSAAELETNGPVASTNIRIKSV

SEQ ID NO: 116353 - protein, 119 aa, Triticum aestivum
  Clone ID: PAT_TA_10771.pep
MAKSLRSKREKRLRTLRREIAEPFYDKKEAAKQAAQAAALEAPKLPVRVHPMYEESLAAAAAAAASRASAMEVDGGSKKSASFLKPMGTISKKKVQLHLKIKKDKRKARKKGNSGKKSY

SEQ ID NO: 116354 - protein, 58 aa, Triticum aestivum
  Clone ID: PAT_TA_10772.pep
RPGRDIRRSGSSTHFRRRLRRREEESEADSAAAMRAKWKKKRMRRLKRKRRKMRQRSK

SEQ ID NO: 116355 - protein, 86 aa, Triticum aestivum
  Clone ID: PAT_TA_10773.pep
AEEKHHKHKEHLGEMGAAAAGAFALYEKHEAKKDPEHAHKHKIEEEVAAAAAVGAGGFVFHEHHEKKQDHKEAKEASGEKKHHHFG

SEQ ID NO: 116356 - protein, 155 aa, Triticum aestivum; identical to SEQ ID NO: 116267
  Clone ID: PAT_TA_10774.pep

SEQ ID NO: 116357 - protein, 428 aa, Triticum aestivum
  Clone ID: PAT_TA_10775.pep
MASTVPFSPAKVQMLKATNCHGHAAFGSCFAVPRTGPKQRSLAVRVSSEQEAAAAVRAPSGRSIEECEADAVAGRFPAPAAFVRPKAPDGTPEIRPLDMAKRPRRNRRSPALRAAFQETTISPANLVLPLFIHEGEEDAPIGAMPGCFRLGWQHGLLDEVYKARDVGVNSFVLFPKVPDALKSPTGVEAYNDNGLVPRTIRLLKDKFPDIIVYTDVALDPYSSDGHDGIVREDGVILNDETVYQLCKQAVSQARAGADVVSPSDMMDGRVGAIRSALDAEGFNDVSIMSYTAKYASSFYGPFREALDSNPRFGDKKTYQMNPANYREALLETAADEAEGADILLVKPGLPYLDIIRLLRDNSALPIAAYQVSGEYSMIKAGGALNMIDEEKVMMESLMCLRRAGADVILTYFARQAAVVLCGMGSAAK

SEQ ID NO: 116358 - protein, 358 aa, Triticum aestivum
  unsure (1)..(358): unsure at all Xaa locations
  Clone ID: PAT_TA_10776.pep
SATLGLRHGPDSYGRQQRLIFAGKQLEDGRTLADYNIQKESTLHLVLRLRGGMQIFVKTLTGKTITLEVESSDTVDNVKAKIQDKEGIPPDQQRLIFAGKQLEDGRTLADYNIQKESTLHLVLRLRGGMQIFVKTLTGKTITLXEVESSDTIDNVKAKIQDKEGIPXDQQRLIFAGKQLKXAGTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 116359 - protein, 155 aa, Triticum aestivum; identical to SEQ ID NO: 116267
  Clone ID: PAT_TA_10777.pep

SEQ ID NO: 116360 - protein, 171 aa, Triticum aestivum
  Clone ID: PAT_TA_10778.pep
MAQRDKKVEEPTEVHLHAAEITLCANSCGFPGNPATKNLCQNCFLASSSSSPSSSAASPPSPSSSPAAAFPLFDKPRPAAAASPAAPVYMAVDRPAAGPADPKASKSSVNRCHNCRKRVGLTGFRCRCGEMFCGAHRYSDRHDCSYDYKSAARDAIARENPVVRAAKIVRF

SEQ ID NO: 116361 - protein, 132 aa, Triticum aestivum
  unsure (1)..(132): unsure at all Xaa locations
  Clone ID: PAT_TA_10779.pep
MAKMSSTATVTRAHLENKLALAKRCSREATLAGAKAAAIATVASAVPTLASVRMLPWAKAHLNPTGQALVVCTVAGMAYFVAADKAILSLXARRHSYESAPDHLKDTSFAGARRRRSVPVRRHSSGLDLASC

SEQ ID NO: 116362 - protein, 218 aa, Triticum aestivum
  unsure (1)..(218): unsure at all Xaa locations
  Clone ID: PAT_TA_10780.pep
MGRRPARCYRQIKNKPYPKSRYCRGVPDPKIRIYDVGMKKKGVDEFPSCVHLVSWEKENVSSEALEAARIACNKYMTKNAGKDAFHLRVRVHTYHVLRINKMLSCAGADRLQTGMRGAFGKPLGTCARVDIGQVLLSVRCKESNAVHADEAXLAVPKFKFPGRQKIIRSRKWGFTKFNKADYIKYKSEGRIVPDGVNAKLLGVHGPIAKRAPGQAILA

SEQ ID NO: 116363 - protein, 388 aa, Triticum aestivum
  unsure (1)..(388): unsure at all Xaa locations
  Clone ID: PAT_TA_10781.pep
MAMVTAKLSSPAAARLAPVRSAQPARRASLVRVRASGGSYADELVSTAKTVASPGRGILAIDESSATCGKRLASIGLDNTEVNRQAYRQLLLTTAGLGEYISGAILFEETLYQSTTDGKTFVDVLKDQNIMPGIKVDKGLVPLPGSNNESWCQGLDGLASRCAEYYKQGARFAKWRTVVSIPCGPTALAVKEAAWGLARYAAIXAQDNGLVPIVEPEILLDGDHGIERTLEVAEKVWSEVFFYLAENNVLFEGILLKPSMVTPGAEHKEKASPEAIAKNTLTMLRRRVPPAVPGIMFLSGGQSELEATMNLNAMNQSANPWHVSFSYARALQNSVLKTWEGQPENIEAAQKALLVRAKANSLAQLGSYTGEGESDEAKKGMFQKGYTY

SEQ ID NO: 116364 - protein, 165 aa, Triticum aestivum
  Clone ID: PAT_TA_10782.pep
MAQRDHKQEEPTELRAPEITLCANSCGFPGNPATQNLCQNCFLAGPASTSPSSSSSSSSSLPGVSAPTPVIDRPRPAPLEAELARPAVDLAPATEAKPARTSVNRCSSCRKRVGLTGFRCRCGDMFCGEHRYSDRHGCSYDYKAAARDAIARDNPVVRAAKIVRF

SEQ ID NO: 116365 - protein, 103 aa, Triticum aestivum; identical to SEQ ID NO: 107316
  Clone ID: PAT_TA_10783.pep

SEQ ID NO: 116366 - protein, 171 aa, Triticum aestivum
  Clone ID: PAT_TA_10784.pep
MAQRDKKVEEPTEVHLHAAEITLCANSCGFPGNPATKNLCQNCFLASSSSPSPSAASPQSPSSSPAAFPLFDKPRPAAAASPLQAAPVYMAVDRPAAGPADPKASKSSVNRCHNCRKRVGLTGFRCRCGEMFCGAHRYSDRHDCSYDYKSAARDAIARENPVVRAAKIVRF

SEQ ID NO: 116367 - protein, 352 aa, Triticum aestivum
  unsure (1)..(352): unsure at all Xaa locations
  Clone ID: PAT_TA_10785.pep
MRRSAAMNCGSGPAPATMVRCRQCSASVAAPAGACAVQCAQCCCVTRVGGAGRQLSVMRPIPNFGGGRGKKRAVLVGIKYTNTRACELRGPINDVKCMRYILTERFGFANDCVLILTDEERDPCRQPTKANIRMAMHWLVQGCSSGDSLVFQFSGAGAQVPDCDGDERDGMDEAICPVDXSKQGPILDDEINHAIVRPLVHGVKLHAIVDACHSATVLDLPYRCTFSKQYGCLRWMDERPLNGACKGTSGGXAVLISGSSNGKTQMSVLPEPNATIGALTHSFIKALECEPGTTYGHLLTSMRTTMRAGAGDCSLQGPVGCSIRKVANFSGVEEPQMSSACKFDINCEPFCM

SEQ ID NO: 116368 - protein, 121 aa, Triticum aestivum
  Clone ID: PAT_TA_10786.pep
ETKRDGYVQGIPSSGPSGAGLRPARGRRPCPGVHRRGRICCRTAATDFHHYPWPLLHHWRIRRSCMAFSHGRRQGLHGQQPAGARPPSTCPVYRSLVRLGNAAELEISRPVASTNNKNKFV

SEQ ID NO: 116369 - protein, 172 aa, Triticum aestivum
  Clone ID: PAT_TA_10787.pep
MAQRDKKVEEPTEVHLHAAEITLCANSCGFPGNPATKNLCQNCFLASSSSPSPSAASPPSPSSSPAAFPLFDKLRPAAVASPLLQAAPVYMAVDRPAAGPADPKASKSSVNRCHNCRKRVGLTGFRCRCGEMFCGAHRYSDRHDCSYDYKSAARDAIARENPVVRAAKIVRF

SEQ ID NO: 116370 - protein, 144 aa, Triticum aestivum
  Clone ID: PAT_TA_10788.pep
MAEENAPVEVAAPVAAPTPVLGEPMDLMTALQLVMKKSSAHDGLVKGLREAAKAIEKHAAQICVLAEDCDQPDYVKLVKALCAEHNVHLVTVPSAKTLGEWAGLCKIDSEGKARKVVGCSCVVVKDYGEDSEGLHIVQEYVKSH

SEQ ID NO: 116371 - protein, 424 aa, Triticum aestivum
  Clone ID: PAT_TA_10789.pep
MQMAATTTEPQVAVPPHHPHAHPHPHPPPHHPHPHHHMPQPRWVVLPYPPPSMVAAPPPPPPQFAKHYAPGPPPPPAAAGRRTPTPPAAGSGGNGCEENKTIWVGDLQYWMDENYLHNCFGPSGEVVTIKVIRNRQTGQSEGYGFVEFFSHASADKALQNFTGHVMPNTDRAFKLNWASYSMGEKRSEVVSDHSIFVGDLAADVTDEMLMELFASKYRSVKGAKVIIDANTGRSRGYGFVRFGDDTDKAHAMTEMNGVYCSTRPIRVGPATPRRTSGDSGSSTPGHSDGDSNNRTVYVGGLDPNVSEDELRKSFAKYGDVASVKIPLGKQCGFVQYVNRTDAEEALQGLNGAVIGKQAVRLSWGRSPSHKQSRGDSGNRRNNNNMYYGTPFYGGYGYASPVPHPNMYAPAYGAYPFYGNQQLVS

SEQ ID NO: 116372 - protein, 544 aa, Triticum aestivum
  Clone ID: PAT_TA_10790.pep
MSLHRFFCRSLVVLPRSSYGFCMICWRCNNILLDHLFTVNRHSILLNHLFTVYRHGLAKIFDLSVYVTCPHDDSLCPLVLIIFFLCRSWVVYLYPPAMGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMIPTKPMVVETFATYPPLGRFAVRDMRQTVAVGVIKGVEKKDPTGAKVTKAAIKKK

SEQ ID NO: 116373 - protein, 52 aa, Triticum aestivum
  Clone ID: PAT_TA_10791.pep
HASAGSSTHSRRHHRREPESEADTAAAMRAKWKKKRMRRLKRKRRKMRQRSK

SEQ ID NO: 116374 - protein, 321 aa, Triticum aestivum
  unsure (1)..(321): unsure at all Xaa locations
  Clone ID: PAT_TA_10792.pep
MRFIVAFLILLMPLLMRLSPPAAAPSPQYRRSHGGSTTRLNAVLPETSERMFLVARHASSSTDAVRPGSDNFDIANGHGHFLIKSTSDLQVXMEAVSSCFGKALVTSSAVMLAMPPSCLAEECDPGYSLPNMPLLFAIAMVGATVGGLLARQRKGELKKLNDQLRQINASLRRQAKIESYAPALSYAPAASKIPESEVIVDPHKQRLLAYLRTGKNYLRNQAPDKAFSEFKAALDLAQSLGDHVEEKKAARGLGPSLQRQGNYKEAIKYHSMVLSISXKMTGEDSGVTEAYGAIADCYTEVGELEKAGKFYDEYIARLEND

SEQ ID NO: 116375 - protein, 229 aa, Triticum aestivum
  unsure (1)..(229): unsure at all Xaa locations
  Clone ID: PAT_TA_10793.pep
LPMFTKEEQEKLASSCDIMGLNYYTSRFSKHVDISSDFTPKLNTDDAYASSETTGSDGNDIGPITGTYWIYMYPKGLTDLLLIMKEKYGNPPVFITXENGIADVDKRPNXMQDPLDDWKXRLDYLQAPHLKPSRDAIDQGADVRGHFTWGLIDNFRMGASGYSSRFXGSVYIDKERTGNKRKLKSXAQWFAQVQSVPKALLKTTNTNNKPAVMLPFPYDGRGGALLCFE

SEQ ID NO: 116376 - protein, 129 aa, Triticum aestivum
  Clone ID: PAT_TA_10794.pep
MQIFVKTLTGKTITLEVESSDTIDNVKAKIQDKEGIPPDQQRLIFAGKQLEDGRTLADYNIQKESTLHLVLRLRGGIIEPSLQALARKYNQEKMICRKCYARLHPRAVNCRKKKCGHSNQLRPKKKIKN

SEQ ID NO: 116377 - protein, 183 aa, Triticum aestivum
  Clone ID: PAT_TA_10795.pep
GMDEALCPVDSFQQGPILDDEINEAIVRPLVHGVKLHAIVDACHSATVLDLPYQCTVSKQTGRWRWRDERPMTGACKGTSGGQAVLISGSSNGKSNMSVLPEPYATIGAMTHSFIRAVECEPRTTYGRLLTSMRAIMRDSGGNCNLQGPIGGSIHKVANFSGVEEPQLSSAYKFDIEREPFCM

SEQ ID NO: 116378 - protein, 135 aa, Triticum aestivum
  Clone ID: PAT_TA_10796.pep
MAEWTKVADYSPPPPTKIPKSPLFPSYSEQAAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 116379 - protein, 170 aa, Triticum aestivum
  unsure (1)..(170): unsure at all Xaa locations
  Clone ID: PAT_TA_10797.pep
SVEMHHESLLEALPGDNVGFNVKNVAVKDLKRGFVASNSKDDPAKEAANFTSQVIIMNHPGQIGNGXYAPVLDCHTSHIAVKFAELVTKIDRRSGKELEALPKFLKNGDAGIVKMIPTKPMVVETFATYPPLGRFAVRDMRQTVAVGVIKGVEKKDPTGAKVTKAAIKKK

SEQ ID NO: 116380 - protein, 275 aa, Triticum aestivum
  unsure (1)..(275): unsure at all Xaa locations
  Clone ID: PAT_TA_10798.pep
PTRPPTRPAFDVMGYEPFQDSFLDDQARERSIDYNLGWFLEPVVRGDYPFSMRSLIGDRLPKFTKEEQEKLASSCDIMGLNYYTSRFSKHIDISSDFTPKLNTDDAYASSETKGSDGNDIGPITGTYWIYMYPKGLTDLLLIMKEKYGNPPIFITENGIADVDSDPTMTDPLDDWKRLDYLQRHISAVXKDAIDQGARTCGANFTWGSDRTNFEWEPGATSSTIPAPLTSEQRKDGNKRKLKKSAKWFAKFNSVPKRLLKTTNNNATVTVTSVSV

SEQ ID NO: 116381 - protein, 229 aa, Triticum aestivum
  Clone ID: PAT_TA_10799.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 116382 - protein, 281 aa, Triticum aestivum
  unsure (1)..(281): unsure at all Xaa locations
  Clone ID: PAT_TA_10800.pep
GNCKEVSSYLKKVGYNPDKVPFVPISGFEGDNMIERSTNLDWYKGPTLLEALDQINEPKRPSDKPLRLPLQDVYKIGGIGTVPVGRVETGXVIKPGMVVTFGXLLGLTTEVKSVEMHHESLLEALPGDNVGFNVKNVAVKDLKRGYVASNSKDDPAKEAANFTAQVIIMNHPGQISNGYAPVLDCHTSHIAVKFAEIQTKIDRRSGKEIEAAPKFLKNGDAGFVKMIPTKPMVVETFAQYPPLGRFAVRDMRQTVAVGVIKAVEKKDPTGAKVTKAAAKKK

SEQ ID NO: 116383 - protein, 250 aa, Triticum aestivum
  Clone ID: PAT_TA_10801.pep
RGRGPRWSTNLDWYKGPTLLEGLDQINEPKRPSDKPLRLPLQDVYKIGGIGTVPVGRVETGVIKPGMVVTFGPTGLTTEVKSVEMHHESLLEALPGDNVGFNVKNVAVKDLKRGYVASNSKDDPAKEAANFTAQVIIMNHPGQISNGYAPVLDCHTSHIAVKFAEIQTKIDRRSGKEIEAAPKFLKNGDAGFVKMIPTKPMVVETFAQYPPLGRFAVRDMRQTVAVGVIKAVEKKDPTGAKVTKAAAKKK

SEQ ID NO: 116384 - protein, 136 aa, Triticum aestivum
  Clone ID: PAT_TA_10802.pep
MSEEKHHHLFHHKEGEDFQPAADGGVDTYGYSTETVVTATGNDGEYERITKEEKHHKHKEHLGEMGAAAAGAFALYEKHEAKKDPEHAHKHKIEEEVAAAAAVGAGGFVFHEHHEKKQDHKEAKEASGEKKHHHFG

SEQ ID NO: 116385 - protein, 280 aa, Triticum aestivum
  Clone ID: PAT_TA_10803.pep
EEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMIPTKPMVVETFATYPPLGRFAVRDMRQTVAVGVIKGVEKKDPTGAKVTKAAIKKK

SEQ ID NO: 116386 - protein, 117 aa, Triticum aestivum
  Clone ID: PAT_TA_10804.pep
MAATASLSAVAAPLSVAGLKKAASFRPLPVARAGRPAARMTAVRASSASVQEKLTAGLTAAAVAAALVLPEVAEAASPGLSPSLKNFLLSIVSGGVVFAGIAGAVVAVSNFDPVKRT

SEQ ID NO: 116387 - protein, 125 aa, Triticum aestivum
  Clone ID: PAT_TA_10805.pep
ETKRDGVQGIPCSGPSGARLRPACGRRPCPALHRRRPHQGRRICSRNAATDLPHCPCPLLHHWRIRWSWKAFSRGRRQGLHGQQPAGARPPAACPAFRSLVRRGNAVELEISGPVASTNNRNKFV

SEQ ID NO: 116388 - protein, 223 aa, Triticum aestivum
  unsure (1)..(223): unsure at all Xaa locations
  Clone ID: PAT_TA_10806.pep
KTITLEVESSDTIDNVKAKIQDKEGHSPXDQQRLIFAGKQLEEXGTLRRTYNIQKESTLXHLVLRMRGGMQIFVKTXSPGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 116389 - protein, 363 aa, Triticum aestivum
  Clone ID: PAT_TA_10807.pep
MNMNYGSMGPGAMVRCRQCSSSITAMPGARAVQCMQCSCVTRVSGRGRQQHGYGQGYGGNGGGMLMPPMRPTPAFGGGRGKKRAVLIGIKYTNRRSCELRGPINDVKCMRYLLTERFGFPNDCVLILTDEERNPCRQPTKDNIRMAMHWLVQGCSYGDSLVFQFSGLGAQVPDDDGDELDGMDEALCPVDSFQQGPILDDEINEAIVRPLVHGVKLHAIVDACHSATVLDLPYQCTVSKQTGRWRWRDERPMTGACKGTSGGQAVLISGSSNGKSNMSVLPEPYATIGAMTHSFIRAVECEPRTTYGRLLTSMRAIMRDSSGNCNLQGPIGGSIRKVANFSGVEEPQLSSAYKFDVEREPFCM

SEQ ID NO: 116390 - protein, 138 aa, Triticum aestivum
  Clone ID: PAT_TA_10808.pep
MAEEKHHHHLFHHKKEGEDFQPAADGGVDMYGYSTETVVTATGNEGEYERITKEEKHHKHKEHLGEMGAAAAGAFALYEKHEAKKDPEHAHKHKIEEEVAAAAAVGAGGFVFHEHHEKKQDHKEAKEASGEKKHHHFG

SEQ ID NO: 116391 - protein, 159 aa, Triticum aestivum
  Clone ID: PAT_TA_10809.pep
MLRARGSVRSSELETWRRRMPQLRLPLRLRPLPQVLGEPMDLMTALQLVMKKSSAHDGLVKGLREAAKAIEKHAAQICVLAEDCDQPDYVKLVKALCAEHNVHLVTVPSAKTLGEWAGLCKIDSEGKARKVVGCSCVVVKDYGEDSEGLHIVQEYVKSH

SEQ ID NO: 116392 - protein, 117 aa, Triticum aestivum
  Clone ID: PAT_TA_10810.pep
MAATASLSAVAAPLSVAGLKKATSFRPLPVVRAGRPAARMTVVRASSASVQEKLTAGLTAAAVAAALVLPEVAEAASPGLSPSLKNFLLSIVSGGVVFAGIAGAVVAVSNFDPVKRT

SEQ ID NO: 116393 - protein, 117 aa, Triticum aestivum
  Clone ID: PAT_TA_10811.pep
MAATASLSAVAAPLSVAGLKKAASFRPLPVVRAGRPAARMTAVRASSASVQEKLTAGLTAAAVAAALVLPEVAEAASPGLSPSLKNFLLSIVSGGVVFAGIAGAVVAVSNFDPVKRT

SEQ ID NO: 116394 - protein, 58 aa, Triticum aestivum
  Clone ID: PAT_TA_10812.pep
AGRVPNLRRSGSSTHSRRHHRREPESEADTAAAMRAKWKKKRMRRLKRKRRKMRQRSK

SEQ ID NO: 116395 - protein, 296 aa, Triticum aestivum
  Clone ID: PAT_TA_10813.pep
RHEMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMIPTKPMVVETFATYPPLGRFAVRDMRQTVAVGVIKGVEKKDPTGAKVTKAAIKKK

SEQ ID NO: 116396 - protein, 143 aa, Triticum aestivum
  Clone ID: PAT_TA_10814.pep
MAEEAPAPVVAPAEAPTPVLGEPMDLMTALQLVMKKSSAHDGLVKGLREAAKSIEKHAAQLCVLAEDCDQPDYVKLVKALCAEHNVHLVTVPSAKTLGEWAGLCKIDSEGKARKVVGCSCVVVKDYGEESEGLNIVQEYVKSH

SEQ ID NO: 116397 - protein, 153 aa, Triticum aestivum; identical to SEQ ID NO: 106678
  Clone ID: PAT_TA_10815.pep

SEQ ID NO: 116398 - protein, 266 aa, Triticum aestivum
  unsure (1)..(266): unsure at all Xaa locations
  Clone ID: PAT_TA_10816.pep
MAALAPTKMLGTRLNFAGSSRYATAAPTAGAQKIVSLFDRFKKKPAPKPKPAPVATSSVGIDDELAKWYGPDRRIYLPNGLLDRSEVPEYLNGEVPGDYGYDPFGLGKKPEDFAKYQAFELIHARWAMLXAPPGFIIPEALNKFGANCGPEAVWFKTGALLLDGNTLNYFGNSIPITNGLEFDDKLHPGGPFDPLGLATDPDQAALLKVKEIKNGRLAMFSMLGFFIQAYVTGEGPFENLCAHLSDPFGNNLLTVISGAAERVPSL

SEQ ID NO: 116399 - protein, 129 aa, Triticum aestivum; identical to SEQ ID NO: 116376
  Clone ID: PAT_TA_10817.pep

SEQ ID NO: 116400 - protein, 137 aa, Triticum aestivum
  Clone ID: PAT_TA_10818.pep
MAEEKHHHHLFHHKEGEDFQPAADGGVDTYGYSTETVVTATGNEGEYERITKEEKHHKHKEHLGEMGAAAAGAFALYEKHEAKKDPEHAHKHKIEEEVAAAAAVGAGGFVFHEHHEKKQDHKEAKEASGEKKHHHFG

SEQ ID NO: 116401 - protein, 272 aa, Triticum aestivum
  unsure (1)..(272): unsure at all Xaa locations
  Clone ID: PAT_TA_10819.pep
YLKKVGYNPDKVPFVPISXGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKEIEAAPKFLKNGDAGIVKMIPTKPMVVETFATYPPLGRFAVRDMRQTVAVGVIKGVEKKDPTGAKVTKAAIKKK

SEQ ID NO: 116402 - protein, 411 aa, Triticum aestivum
  Clone ID: PAT_TA_10820.pep
YFWSFKTSTKVLPSVVDLVESFLKKNSTRDIFTKTSSGQQKLPVSLAVHFRVVQTNGCQSLSTCCTRLVDRKDPTARGSNSFRGGDESSATCGKRLASIGLDNTEVNRQAYRQLLLTTAGLGEYISGAILFEETLYQSTTDGKTFVDVLKDQNIMPGIKGDKGLVPLPGSNNESWCQGLDGLASRCAEYYKQGARFAKWRTVVSIPCGPTALAVKEAAWGLARYAAIAQDNGLVPIVEPEILLDGDHGIERTLEVAEKVWSEVFFYLAENNVLFEGILLKPSMVTPGAEHKEKASPEAIAKNTLTMLRRRVPPAVPGIMFLSGGQSELEATMNLNAMNQSANPWHVSFSYARALQNSVLKTWQGQPENIEAAQKALLVRAKANSLAQLGSYTGEGESDEAKKGMFQKGYTY

SEQ ID NO: 116403 - protein, 144 aa, Triticum aestivum; identical to SEQ ID NO: 116370
  Clone ID: PAT_TA_10821.pep

SEQ ID NO: 116404 - protein, 155 aa, Triticum aestivum; identical to SEQ ID NO: 116314
  Clone ID: PAT_TA_10822.pep

SEQ ID NO: 116405 - protein, 80 aa, Triticum aestivum
  Clone ID: PAT_TA_10823.pep
MSEESGRPLPKFGEWDVNDPASADGFTVIFNKARDEKKAGNGQDTESPGKDARTERVESYATKANSKKWFCCVTPSPTQS

SEQ ID NO: 116406 - protein, 143 aa, Triticum aestivum
  Clone ID: PAT_TA_10824.pep
MAEEAPTPVVAPVEAPTPVLGEPMDLMTALQLVMKKSSAHDGLVKGLREAAKSIEKHAAQLCVLAEDCDQPDYVKLVKALCAEHNVHLVTVPSAKTLGEWAGLCKIDSEGKARKVVGCSCVVVKDYGEESEGLNIVQEYVKSH

SEQ ID NO: 116407 - protein, 143 aa, Triticum aestivum
  Clone ID: PAT_TA_10825.pep
MAEEAPTPVVAPVEAPTLVLGEPMDLMTALQLVMKKSSAHDGLVKGLREAAKSIEKHAAQLCVLAEDCDQPDYVKLVKALCAEHNVHLVTVPSAKTLGEWAGLCKIDSEGKARKVVGCSCVVVKDYGEESEGLNIVQEYVKSH

SEQ ID NO: 116408 - protein, 216 aa, Triticum aestivum
  Clone ID: PAT_TA_10826.pep
KPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKEIEAAPKFLKNGDAGIVKMIPTKPMVVETFATYPPLGRFAVRDMRQTVAVGVIKGVEKKDPTGAKVTKAAIKKK

SEQ ID NO: 116409 - protein, 144 aa, Triticum aestivum; identical to SEQ ID NO: 116370
  Clone ID: PAT_TA_10827.pep

SEQ ID NO: 116410 - protein, 155 aa, Triticum aestivum; identical to SEQ ID NO: 116314
  Clone ID: PAT_TA_10828.pep

SEQ ID NO: 116411 - protein, 129 aa, Triticum aestivum; identical to SEQ ID NO: 116376
  Clone ID: PAT_TA_10829.pep

SEQ ID NO: 116412 - protein, 57 aa, Triticum aestivum
  Clone ID: PAT_TA_10830.pep
VAWADAWAGSSTHFRRRRRRREKESEADSAAAMRAKWKKKRMRRLKRKRRKMRQRSK

SEQ ID NO: 116413 - protein, 279 aa, Triticum aestivum
  unsure (1)..(279): unsure at all Xaa locations
  Clone ID: PAT_TA_10831.pep
IVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGYVASNSKDDPAKXEAANFTAQVIIMNHPGQISNGYAPVLDCHTSHIAVKFAEIQTKIDRRSGKEIEAAPKFLKNGDAGFVKMIPTKPMVVETFAQYPPLGRFAVRDMRQTVAVGVIKAVEKKDPTGAKVTKAAAKKK

SEQ ID NO: 116414 - protein, 358 aa, Triticum aestivum
  Clone ID: PAT_TA_10832.pep
TRPPGHRDFIKNMITGTSQADCAVLIIDSTTGGFEAGISKDGQTREHALLAFTLGVKQMICCCNKMDATTPKYSKARYDEIVKEVSSYLKKVGYNPDKVPFVPISGFEGDNMIERSSNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGYVASNSKDDPAKEAANFTAQVIIMNHPGQISNGYAPVLDCHTSHIAVKFAEIQTKIDRRSGKEIEAAPKFLKNGDAGFVKMIPTKPMVVETFAQYPPLGRFAVRDMRQTVAVGVIKSVEKKDPTGAKVTKAAAKKK

SEQ ID NO: 116415 - protein, 175 aa, Triticum aestivum
  unsure (1)..(175): unsure at all Xaa locations
  Clone ID: PAT_TA_10833.pep
AWSRPRYTDDAYASSETKGSDGXNDIGPITGTYWIYMYPKGLTDLLLIMKEKYGNPPIFITENGIADVDSDPTMTDPLDDWKRLDYLQRHISAVKDAIDQGADVRGHFTWGLIDNFEWSLGYSSRFGLVYIDKKDGNKRKLKKSAKWFAKFNSVPKRLLKTTNNNATVTVTSVSV

SEQ ID NO: 116416 - protein, 269 aa, Triticum aestivum
  Clone ID: PAT_TA_10834.pep
WIPRAAGIRHQFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMIPTKPMVVETFATYPPLGRFAVRDMRQTVAVGVIKGVEKKDPTGAKVTKAAIKKK

SEQ ID NO: 116417 - protein, 383 aa, Triticum aestivum
  unsure (1)..(383): unsure at all Xaa locations
  Clone ID: PAT_TA_10835.pep
SVYVWCEAWCFLNRQIGADYKQFSEVCFKNFGDRVKNWFTFNEPHTYCCFSYGEGIHASGRCFPEMDSAVPEGDSLREPYTAGHHILLAHAEAVQLFKARYNMHGDSKIGMAFDVMGYEPYQDSFLDDQARERSIDYNMGWXFLGAVVVGDYPFSMRSLIRRFVYPCSPRKEQEKLRPHVTSMGLNYYTSRFSKHVDISPDVTPKLNTDDAYASXETTGSDGNDIGPITGTYWIYMYPKGLTDLLLIMKEKYGNPPIFITENGIADVDGDETMPRSVGMTGXRLDYLQXHISTRQRDAIDQGADVRXGHFTWGLIDNFEWGXGYSSRFGLVYIDKNDGFKRKLKKSAKWFAKFNAVPKHLLGTTKPNWASSRVTGEAMLCSNK

SEQ ID NO: 116418 - protein, 286 aa, Triticum aestivum
  Clone ID: PAT_TA_10836.pep
MAALAPTKMLGTRLNFAGSSRYATAAPTAGAQKIVSLFDRFKKKPAPKPKPAPVATSSVGIDDELAKWYGPDRRIYLPNGLLDRSEVPEYLNGEVPGDYGYDPFGLGKKPEDFAKYQAFELIHARWAMLGAAGFIIPEALNKFGANCGPEAVWFKTGALLLDGNTLNYFGNSIPINLILAVVAEVVLVGGAEYYRITNGLEFDDKLHPGGPFDPLGLATDPDQAALLKVKEIKNGRLAMFSMLGFFIQAYVTGEGPFENLCAHLSDPFGNNLLTVISGAAERVPSL

SEQ ID NO: 116419 - protein, 88 aa, Triticum aestivum
  Clone ID: PAT_TA_10837.pep
GRVRQCCLFVVHSHANFQTSPNRWWKLLTKKKKKKKNLRRSGSSTPFRRRRREKESEADSAAAMRAKWKKKRMRRLKRKRRKMRQRSK

SEQ ID NO: 116420 - protein, 110 aa, Triticum aestivum; identical to SEQ ID NO: 116270
  Clone ID: PAT_TA_10838.pep

SEQ ID NO: 116421 - protein, 129 aa, Triticum aestivum; identical to SEQ ID NO: 116376
  Clone ID: PAT_TA_10839.pep

SEQ ID NO: 116422 - protein, 129 aa, Triticum aestivum; identical to SEQ ID NO: 116376
  Clone ID: PAT_TA_10840.pep

SEQ ID NO: 116423 - protein, 286 aa, Triticum aestivum; identical to SEQ ID NO: 116418
  Clone ID: PAT_TA_10841.pep

SEQ ID NO: 116424 - protein, 362 aa, Triticum aestivum
  Clone ID: PAT_TA_10842.pep
MNMNYGSMGPGAMVRCRQCSSSITAMPGARAVQCMQCSCVTRVSGRGRQQHGYGQGYGNGGGMLMPPMRPTPNFGGGRGKKRAVLVGIKYTNRRSCELRGPINDVKCMRYLLTERFGFPNDCVLILTDEERNPCRQPTKDNIRMAMHWLVQGCSYGDSLVFQFSGLGAQVPDDDGDELDGMDEALCPVDSFQQGPILDDEINEAIVRPLVHGVKLHAIVDACHSATVLDLPYQCTVSKQTGRWRWRDERPMTGACKGTSGGQAVLISGSSNGKSNMSVLPEPYATIGAMTHSFIRAVECEPRTTYGRLLTSMRAIMRDSSGNCNLQGPIGGSIRKVANFSGVEEPQLSSAYKFDVEREPFCM

SEQ ID NO: 116425 - protein, 219 aa, Triticum aestivum; identical to SEQ ID NO: 116316
  Clone ID: PAT_TA_10843.pep

SEQ ID NO: 116426 - protein, 576 aa, Triticum aestivum
  unsure (1)..(576): unsure at all Xaa locations
  Clone ID: PAT_TA_10844.pep
MALLAAATLNPTTHLSLRSRAGRNSENLWLRSAASSQKSKGRFCNLTIRAGTPSKPAEPIGPVFTKLKPWQIPKRDWFDKDFLFGASTSAYQIEGAWNEDGKGPSTWDHFCHTYPERISDRTNGDVAANSYHLYEEDVKALKDMGMKVYRFSIAWSRILPDGTGKVNQAGIDYYNKLINSLIDNDIVPYVTIWHWDTPQALEDKYGGFLNRQIVDDYKQFAEVCFKNFGDRVKNWFTFNEPHTYCCFSYGEGIHAPGRCSPGMDCAVPKXDSLREPYTAGHHILLAHAEAVELFKACYNKHGDSKIGMAFDVMGYEPFQDSFLDDQARERSIDYNLGWFLEPVVRGDYPFSMRSLIGDRLPKFTKEEQEKLASSCDIMGLNYYTSRFSKHIDISSDFTPKLNTDDAYASSXETTGSDGNDIGPITGDLXWIYMYPKGLTDLLLIMKXKYGNPPVFHSLRTGIADVXSDPTMTDSLGXDGKRLDYLQAXHSQAVKDAIDQGAGRGGGHFTWGXLIDNFEWSXGYSSRFGLVYIDKNDGNKRKLKKSAKWFSKFNSVPKPLLKTTNNNATMTAASVSV

SEQ ID NO: 116427 - protein, 339 aa, Triticum aestivum
  Clone ID: PAT_TA_10845.pep
ADCAVLIIDSTTGGFEAGISKDGQTREHALLAFTLGVKQMICCCNKMDATTPKYSKARYEEIVKEVSSYLKKVGYNPEKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKEIEAAPKFLKNGDAGIVKMIPTKPMVVETFATYPPLGRFAVRDMRQTVAVGVIKGVEKKDPTGAKVTKAAIKKK

SEQ ID NO: 116428 - protein, 411 aa, Triticum aestivum
  Clone ID: PAT_TA_10846.pep
RVIERFEKEAAEMNKRSFKYAWVLDKLKAERERGITIDIALWKFETTKYSCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGYVASNSKDDPAKEAANFTAQVIIMNHPGQISNGYAPVLDCHTSHIAVKFAEIQTKIDRRSGKEIEAAPKFLKNGDAGFVKMIPTKPMVVETFAQYPPLGRFAVRDMRQTVAVGVIKAVEKKDPTGAKVTKAAAKKK

SEQ ID NO: 116429 - protein, 417 aa, Triticum aestivum
  Clone ID: PAT_TA_10847.pep
EVRACARRGWSVRDREADARRGGEAERRILDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFERDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMIPTKPMVVETFATYPPLGRFAVRDMRQTVAVGVIKGVEKKDPTGAKVTKAAIKKK

SEQ ID NO: 116430 - protein, 110 aa, Triticum aestivum; identical to SEQ ID NO: 116270
  Clone ID: PAT_TA_10848.pep

SEQ ID NO: 116431 - protein, 129 aa, Triticum aestivum
  Clone ID: PAT_TA_10849.pep
MEPSTKLFLVLLGLNLMVTAVHGGCGPHCPTPTPPPPPSTNSGSCPIDTLKLRVCANVLNLLKLGLGVPPSERCCPLLADLADLDAAVCLCTAIRAKVLGVIKLNVPVDLVLLLNHCHKTCPPVFTCPH

SEQ ID NO: 116432 - protein, 123 aa, Triticum aestivum
  Clone ID: PAT_TA_10850.pep
RANFTSQVIIMNHPGQIGNGYAPVLDCHTSHIAVKFAELVTKIDRRSGKEIEAAPKFLKNGDAGIVKMIPTKPMVVETFATYPPLGRFAVRDMRQTVAVGVIKGVEKKDPTGAKVTKAAIKKK

SEQ ID NO: 116433 - protein, 217 aa, Triticum aestivum
  Clone ID: PAT_TA_10851.pep
ICVKLSCGDSVSVIRGVKAEYLNGEVPGDYGYDPFGLGKKPEDFAKYQAFELIHARWAMLGAAGFIIPEALNKFGANCGPEAVWFKTGALLLDGNTLNYFGNSIPINLILAVVAEVVLVGGAEYYRITNGLEFDDKLHPGGPFDPLGLATDPDQAALLKVKEIKNGRLAMFSMLGFFIQAYVTGEGPFENLCAHLSDPFGNNLLTVISGAAERVPSL

SEQ ID NO: 116434 - protein, 398 aa, Triticum aestivum
  unsure (1)..(398): unsure at all Xaa locations
  Clone ID: PAT_TA_10852.pep
GEVFQYAWVLDKLKAERERGITIDIALWKFETTKYSCTVIDALGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGYVASNSKDDPAKEAANFTAQVIIMNHPGQISNGYAPVLDCHTSHIAVKFAEIQTKIDRRSGKEIEAAPKFLKNGDAGFVKMIPTKPMVVETFAQYPPXLGRFAVRDMRQTVAVGVIKAVEKKDPTGAKVTKAAAKKK

SEQ ID NO: 116435 - protein, 219 aa, Triticum aestivum; identical to SEQ ID NO: 116316
  Clone ID: PAT_TA_10853.pep

SEQ ID NO: 116436 - protein, 381 aa, Triticum aestivum
  unsure (1)..(381): unsure at all Xaa locations
  Clone ID: PAT_TA_10854.pep
MLSPSNPEMGTKGTLSGLYPTFFRYDTAFIKNMITGTSQADCAVLIIDSTTGGFEAGISKXDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKXEAANFTSQVIXIMNHPGQIGNGYAPVLDCHTSHIAVKFAELVTKIDRRSGKELEALPKFLKNGDAGIVKMIPTKPMVVETFATYPPLGRFAVRDMRQTVAVGVIKGVEKKDPTGAKVTKAAIKKK

SEQ ID NO: 116437 - protein, 415 aa, Triticum aestivum
  unsure (1)..(415): unsure at all Xaa locations
  Clone ID: PAT_TA_10855.pep
GIDKRVIERFEKEAAEMNKRSFKYAWVLDKLKAERERGITIDIALWKFETTKYYCXVIDAPGHRDFIKNMITGTSQADCAVLIIDSTIXGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKQLEALPKFLKNGDAGIVKMIPTKPMVVETFATYPPLGRFAVRDMRQTVAVGVIKGVEKKDPTGAKVTKAAIKKK

SEQ ID NO: 116438 - protein, 566 aa, Triticum aestivum
  Clone ID: PAT_TA_10856.pep
SADAWGGDNAHTVKRRLQLALNVPTGGTSLTFGDRVLENDLSSVRHDSPLLLTRNSIHRSCSTPCLCPVSEDFEQKDCGGLVEILGSSSGSVRRLVDDVASGIMGGLDPVPIDSGLGGSYYFKNDEGDRVAIVKPTDEEPFAPNNPKGFTGRALGQPGLKKSVKVGETGFREVAAYLLDHENFANVPATALVKITHSVFNINRPMNGGTPAHDHKPQVTSKIASFQQFIAHDFDASDHGTSSFPVAAVHRIGILDIRIFNTDRHGGNVLVRKLDGGTGRFGCQTELFPIDHGLCLPENLEDPYFEWIHWAQASIPFSEEELEYISKLDPMRDAAMLRGELPMIREACLRVLILCTIFLKEAAAFGLCLAEIGEMMTREFRGMEEEPSKLEVVCMEARRKVDEWEPFSPSVEQGEDMDFQFSMDVLGGYSDVIRSPRFNCSGLKGSFRNPLTKLVESMNEDGDDEEDRKEPSMHSSDRFSSADFSTPSLHRTTSSKTSSNSSVHAPNRSADEQLPSSLCFVRLSDMSAEEWHVFVEKFQELLKEALEECKAAAGQRMKQRLGTSCKF

SEQ ID NO: 116439 - protein, 339 aa, Triticum aestivum
  unsure (1)..(339): unsure at all Xaa locations
  Clone ID: PAT_TA_10857.pep
MSTPPSAHAFLVLLLLVLAGAVIASAENNKDCHPSDKAALLAVKSAFGNQSHFASWTPSTPCCDWHDITCNDAGRVIILLFFEDVNLTGTIPDAISGLTELLVLNLYYLPAISGPIPKGIAKLSKLTSLSISLTSVSGPIPSFLGALTKLNDLTLSSNSLTGTIPASLAGLRYLDTIDLRNNRLTGTIPPLFYNSKSPIISYLLLSNNHLSGSIPTEFAAVGFQFIDLSHNALTGDASVFFGRTKELESINLSHNALSFDLSSVEFPEEMQAMDASYNAIRGGIPAQVANVTNLRQFNVXSYNKLCGQGSGRLGRGWDVYNFQHNKCLCGAPLPDPCKK

SEQ ID NO: 116440 - protein, 237 aa, Triticum aestivum
  unsure (1)..(237): unsure at all Xaa locations
  Clone ID: PAT_TA_10858.pep
MVTFTGDGVGALFSHPAHQHGLKLVVTEKLFQCDGCRQIGDMHRYRCEPCDFDLHVCCAQAPARFEHSMFEGRALTFFHSRPTTPPGGLVCCDVCADPVLGFLYHSLEHDLDLHPFCAIMPKRIXEDGGRVLELHKATGHSCGLCGKVGGGYLSYRLQDDDGKLVHLHVACMIEANYTSDSQFVQANSMTTGEVSARRATTGELGTVQNTPRSRGKFRLICKVAFRVAKLSATQSPL

SEQ ID NO: 116441 - protein, 217 aa, Triticum aestivum
  unsure (1)..(217): unsure at all Xaa locations
  Clone ID: PAT_TA_10859.pep
VCTPSPFERAHRVPLFEYWARGPRLCGLVFLAIFHRSVTVISKMVERFDGSDGVXVLVDVGGGTGAALELITARHKHIKGINFDLPYVITQAPSLPGVENIAGNMFENVPTGDAIFLKXILHLQNDDECIKILKNCHRALPANGKVIVVEIVLPTTTEATREAQNMFLLDVIMFNNQQGGKERTEQDFLKMARSSGFDGAFRSTYIFGNFWALEFTK

SEQ ID NO: 116442 - protein, 313 aa, Triticum aestivum
  unsure (1)..(313): unsure at all Xaa locations
  Clone ID: PAT_TA_10860.pep
MAQLQETYACSPATERGRGILLAGDAKTETIAYCSGRSVIFRRLDAPLDAWAYTEHAYPTTVARFSPNGEWVASADASGCVRVWGRNGDRALKAEFRPITGRVDDLRWSPDGMRIVVSGDGKGKSLVRAFMWDSGSTVGEFDGHSKRVLSCDFKPTRPFRIVTCGEDFLANYYEGPPFKFKHSIRDHTNFVNCIRYSPDGTKFITVSSDKKGLIYDGKTGDKIGELSSEGSHTGSIYAVSWSPDSKQVLTVSADKTAKVWDISEDXSGTLNRTLVCTGIGGVDDMLVGCLWQNDNLVTISLGGTFNVFSASNP

SEQ ID NO: 116443 - protein, 177 aa, Triticum aestivum
  Clone ID: PAT_TA_10861.pep
ARGPALLGLVVFFFCLAFLLLQTSCPHTLSNGFRQSLRAHDSRRRPLCCAGPVVHGADRDGRLRLRVRRRVLLHWYVPALHPGSGMHRYLQPRLRPVLKLLGLQGDRQDNVRKRMRHRLLIPIRRRRGVVVACRPAARSLIRGLCFRSLPSCLLVFYCMNKPMQCSRARSCSILHMH

SEQ ID NO: 116444 - protein, 153 aa, Triticum aestivum
  Clone ID: PAT_TA_10862.pep
FGTRLPWLLTPYHLQEKDLSADFPPYQAEFNRRHSSASTITLAALTRLKDTWKILDRAVGSCPPFETIYACCVLHNIVIDKEEEEDGAGMPINQENYIKQVRRVADEDAIRVRDSLSQHLIESGVHTKAAEEEQEAAATVSGSGDGNKEQEAD

SEQ ID NO: 116445 - protein, 190 aa, Triticum aestivum
  Clone ID: PAT_TA_10863.pep
MVVCKCRKATRVYCFVHQVPVCGECICFPEHQLCVVKNYAEWVVNSDYDWPQHCSLCNLVLEAASEETTRLGCLHVMHTKCLISHVQSFPAQTAPAGFVCPSCSIPIWPPSSIKDTGSRLHAKLKEAVVQTVRPRVRGRVGFVTMPKADARTPPAFASDPLKRLSYSGESTDANMLNSSKDATLSSAVLS

SEQ ID NO: 116446 - protein, 253 aa, Triticum aestivum
  Clone ID: PAT_TA_10864.pep
YDGNNYLKQELFGKAEVALKKAEEVMDKAELLSWHFLISLYARSGNSTELKRIWESLKSTFKKCSNKNYLVMLEALSMIDDLESLQQIFQEWESSNEHYDMRITNVMIKAYLDKGMIDEAEAIRQSTMSQGHCNGRTVYMFAEFYLDKSDVTAALEILRDAKKMLTAHKWVPSEKLTSRFLKHYEESKDVDGVESFCECLKKLDCLDAEAYEGMVRTYIAAGRTNPSIAQRIEDDGIHVGPETTKLLESVSGN

SEQ ID NO: 116447 - protein, 215 aa, Triticum aestivum
  unsure (1)..(215): unsure at all Xaa locations
  Clone ID: PAT_TA_10865.pep
TFYNRKKKGGAPQDAGAPSSAAVANIESPEPEAHWHGHGTALAKPDDAEAGQMQLRRNRVVVQVLEMGIVVHSVVIGLGMGASQSVCTIRPLVAXAMCFHQMFEGMGLGGCILQAEYGTKMKAGLVFFFSTTTPFGIALGLALTKVYQDNSPTALIVVGLLNAASAGLLHYMALVELLAADFMGPKLQGSVRLQLICLTAVLLGAGGMSVMAKWA

SEQ ID NO: 116448 - protein, 127 aa, Triticum aestivum
  unsure (1)..(127): unsure at all Xaa locations
  Clone ID: PAT_TA_10866.pep
SLTASLSGSNNLIPAPNDTLPTITAKFRNQGLDVVDLVALSGAHPAAQFRFDNQYYKNILAMNGLLSSDEVLLTQSHETMELVKSYAASNELFFDHFAKSMVKMGNISPLTGHNGEIQXNCRRVNHF

SEQ ID NO: 116449 - protein, 137 aa, Triticum aestivum
  Clone ID: PAT_TA_10867.pep
CSLPVVANKSNQVSSRTSPGSPAATSSNCPHFRLRHPRLLWSLTVQLVVGDEIEVRLVELEHEHEPLALVKLIHVTGVLGPAKHTNGGAYPLTPYSSEMSRAMGESTPPRRTGSLKQARARESISYFVLFSLQSSTC

SEQ ID NO: 116450 - protein, 304 aa, Triticum aestivum
  Clone ID: PAT_TA_10868.pep
MDLWERARSFAGEAAKRSQELSLEAAKRSSVLVSETAKKSKEIFSETAIKSREMAAEATKQADLLAGQIMHLASDIPVPSIPPIPAISPLPSAAESEPDAAELERYGITDDLREFVNGMTISTFRDFPLQDEPEMSDVPTVSNVRQDLNEWQARHATLVLSAVKEISKFRYELCPRYMKERKFWRVYFLLVNNYVTPYETKYFEELKVKAEEEKMVAQKEISQTSQATTSEQKDTKVPSKTSTSSNREQDLDVFLLGDLGSDDEGPDAGDDDELDDDFDKIDGASGLESDGDEDKKAENAKELL

SEQ ID NO: 116451 - protein, 186 aa, Triticum aestivum
  Clone ID: PAT_TA_10869.pep
RSWLSSAPRKSSPLLVPDCCCSFPCPVSPPPPPPPLPSLPLLLAAPLCSGPPPSPAPPPALPCRSSSLNLSSSQRPPAAPSPSLPAAAPQLLLLLLLSVPLLLLLLRLPRCFPASSESLSPSSTLATVLSPSLKFLCIRCEWVPVKFGLVLVCMYSVDLQELEQFMCVCVCAGVCVSAVCFVTRVT

SEQ ID NO: 116452 - protein, 98 aa, Triticum aestivum
  Clone ID: PAT_TA_10870.pep
MQVPGDGGGGGREAGDMRGRHRIQAELKKLEQEARFLEEELEELNKMDKVSTALQEFVVTIESKADPLLPVTTGAAYQSWDRWFEGPQDLRRCKCWFL

SEQ ID NO: 116453 - protein, 102 aa, Triticum aestivum
  Clone ID: PAT_TA_10871.pep
NKKLYLLLPMFILVKRTKKHSSSSLLYISYIYAHIWHTGNNTKHIAVSQLANFHGAHLATHASDDPFPPLPTSMDRRDILYGYAFIEERVQSQLNSTSCLGK

SEQ ID NO: 116454 - protein, 78 aa, Triticum aestivum
  Clone ID: PAT_TA_10872.pep
PWRPSSGRRKARSASGASPPTTDRAQMPASTESFELRASTGHGGHFMLRLVKSPLSNSINTDRLITQLPLRVTKNWSR

SEQ ID NO: 116455 - protein, 147 aa, Triticum aestivum
  Clone ID: PAT_TA_10873.pep
GWGDQLFKFFHSLSSMRLRYQALGEGLAALSRFETDSYSRKGLLYKLILAVLTRFGIPGLEYHSSAVGRLFKSGLGRFGLGQSKPNFGDQSFLIVFVVGGINTLEVREVMKAISESGRPDVELILGGTTLLTPDDMFQLMLGSSSFT

SEQ ID NO: 116456 - protein, 199 aa, Triticum aestivum
  unsure (1)..(199): unsure at all Xaa locations
  Clone ID: PAT_TA_10874.pep
IPIXARDIKSQNILLDGTLXAKVSDFGASRCIPIDETGDATAIQGTFGYLDPMYYYSGQLTEKSDVYSFGVLLMELLTRKKPCSYRSSEEKSLVAYFTALLATGDLASLLDPQVAQEGGKMVEEVALLAAACVRMEGGQRPTMRQVEMALENLRVPHENVAMSDMDAPSYAMIEGGRMEEVSRQYSQEEEYLLSSRYPR

SEQ ID NO: 116457 - protein, 61 aa, Triticum aestivum
  Clone ID: PAT_TA_10875.pep
VIFRFQQCRRLSVRGGFILKNENNFVVAGNGKNRKTEDWDRPRVPQQQKGQASKQASKQRV

SEQ ID NO: 116458 - protein, 157 aa, Triticum aestivum
  Clone ID: PAT_TA_10876.pep
AKVAELVSVCWLGLSGRISSKELSPGTHYAGYLVFKLTHDAHGLSAPRQVSYVEVDGQVVAGSVRTPSFHPCNRAAASCGEAGEPHEHAEEDGVGGVRRYPRQRDDGWLELVIGDYHTGTGDDDVGADIKMELHEWEELKWKKGLIIQGTEFRPKQA

SEQ ID NO: 116459 - protein, 85 aa, Triticum aestivum
  Clone ID: PAT_TA_10877.pep
LLLVSPKVVWVLWDDASIFRASAGFGCNLFYDPQLFKHLYLIIVGFCLIVLVRERTSFRAGFLLVFQLATLFIVFVPPPSPLYHL

SEQ ID NO: 116460 - protein, 113 aa, Triticum aestivum
  unsure (1)..(113): unsure at all Xaa locations
  Clone ID: PAT_TA_10878.pep
XHARTAPRTAALGAPTTSTPKRRPGLHAPPPDPVARRRTRAACSHASPMPPPSARTPGARGSAPPARFPLRSVAKPSTCSSGFARTTARPAARRTVSPPDPPANYSLRPVRLF

SEQ ID NO: 116461 - protein, 45 aa, Triticum aestivum
  Clone ID: PAT_TA_10879.pep
IHYNGQCKPWLDIAFKNLQPFWTKHVNYSNDFIRNCHILEPLYDR

SEQ ID NO: 116462 - protein, 283 aa, Triticum aestivum
  Clone ID: PAT_TA_10880.pep
MALPAPRWLRREVLVGLALGQFVSLLITSTGFSSSELARRGVNAPTSQSLLNYILLALVYGGIMIYKRQHLTVKWYYYLILSIVDVEANYIVVKAYQYTSLTSVMLLDCWAIPCVLFLTWIFLKTKYGLRKLFGVGICVAGVVLVVFSDVHASERKSKGPSPLKGDMLVIAGASLYAVSNVTEEYIVEKSSRIEVMAMLGVFGAIISGIQICPLGRAQPRSALSSAGPLLPCLGCAPAWFLCHSAVPIILKICGATMLNLSLLTSDMWAVLIRIFAYHEKVDW

SEQ ID NO: 116463 - protein, 100 aa, Triticum aestivum
  Clone ID: PAT_TA_10881.pep
ATIKQPFAYLVSESENQWHPGWSCSCRRGCDCGAISPPHPPLQQEPELLLHPPLLLPVPEANLRTGTVTPQETGQTRPGGPARQRNGEPYSLHAEDSLIL

SEQ ID NO: 116464 - protein, 207 aa, Triticum aestivum
  unsure (1)..(207): unsure at all Xaa locations
  Clone ID: PAT_TA_10882.pep
MANCFGEVVDDXRLNKMERYMGKPKSRQDRAREAWNQISKDDKDANATRYVEGLKSMYGNGQSTLCLVYNATGDTLRKVDNHDWYGYIGSAPYPDEIGNGQWAAFHHVHRAGEPSGSVGAVVYRGKNGEGEQKDYLVAWSTPWGMWYRNKAYCEIGAVNCYQNLWAGMYNRVANSDYSSSARSNGCEIDARIETGDSPKFTAKITVR

SEQ ID NO: 116465 - protein, 314 aa, Triticum aestivum
  Clone ID: PAT_TA_10883.pep
MEATAPSVGAGANGSLAAAARAQVGPPTNPMATALLTDQYQFSMAYAYWKAGKHADHAVFDLYFRKNPFGGEFTVFAGLEECIKFIANFKFTEDEISFLQSVMPMCEDAFFDYLRGIDCSDVEVYSIPEGSVVFPKVPLMRVEGPVAVVQLLETPFVNLINYASLVTTNAARHRHVAGKSKVLMEFGLRRAQGPDGAISASKYCFMGGFDATSNVLAGHLFGIPLRGTHSHAYVSSYMSLDEIPDRTLRNKDGSKICMDFVSLVKDWLCKIQAADELRNVFGDTNQSELAAFASALPLQSSFQRSPPSRCLVAS

SEQ ID NO: 116466 - protein, 92 aa, Triticum aestivum
  Clone ID: PAT_TA_10884.pep
ARARRRSSSSTSSSAPSRSCRRPGGRNRPPGASSFARPRPSCWRACARSPTSPSTRWATTPSPRALHRRRRSSTTCKPSTIVLRSKSKKRGR

SEQ ID NO: 116467 - protein, 111 aa, Triticum aestivum
  Clone ID: PAT_TA_10885.pep
IWTMKWSLITHYHINRYACIIIVCTISAVDTQTPVLWLDVGEHMTFGSWCVSLLGDSRLCTGPLRSVKTCSKEHLINMILHVIDEFVIKNRENGVTKATWPVWLKWSVDPI

SEQ ID NO: 116468 - protein, 141 aa, Triticum aestivum
  Clone ID: PAT_TA_10886.pep
HASAPPPGPRPVSSYPLQGLAPSPPIPSRASPRRPLSPARPRPAPSSHHRGLASLPTPRIFPGSTLPPPSYCPRGYRDVSWSTQFGSRHMELDRDPLRHQVALGRSSQLAYVLYRISLISLSPLLLACNRPDYFQRYHKVV

SEQ ID NO: 116469 - protein, 88 aa, Triticum aestivum
  Clone ID: PAT_TA_10887.pep
ARGSILLALLGLLWAYASGCSREWKTSGYVVALAVAVLLYMAIHVALSCHDKKGKKTPQEDGKSPGKQCSSEDGEGKLERVQSEINTV

SEQ ID NO: 116470 - protein, 159 aa, Triticum aestivum
  unsure (1)..(159): unsure at all Xaa locations
  Clone ID: PAT_TA_10888.pep
APTLPRRRXCANLISFAPINGANRAFTASTSTSAFSHHLMKEAADHHPMLFSRFSNHSSSPPAQEGVSSDSPSPACHSKYMQYAGGQFINVTGIRTSPLTVGSAPAEYWPVVEVTGVDSAVAGMDSFPSSPSSLGFMSGSLEGSFGNNVYDDDLFSFDS

SEQ ID NO: 116471 - protein, 221 aa, Triticum aestivum
  Clone ID: PAT_TA_10889.pep
AQARREYNDPGRGLAAFCKKRDKRVVDMALRKKAEEEKKKKEEMERKKAEEKKKKERAMAYQEPEWARVDDIELAFEEEDDEETREKAKEELYCVACNKKFKSEKQWKNHEQSRKHKDKVADLRMAFKEEEAALKEAEEEAGGEWEEVDVGFDFKPANESEESDWSDAAEELAEELDEGLEVADQDNGNKDFNNGEQEVGSYDETSVLEAMLSSRKNKKSG

SEQ ID NO: 116472 - protein, 59 aa, Triticum aestivum
  unsure (1)..(59): unsure at all Xaa locations
  Clone ID: PAT_TA_10890.pep
NGDAFYTLXMTHGSILPPLINTFEXXSLIRMENFTADSQDGKIDHRHRYCTHMTNISCV

SEQ ID NO: 116473 - protein, 241 aa, Triticum aestivum
  unsure (1)..(241): unsure at all Xaa locations
  Clone ID: PAT_TA_10891.pep
MLLGAKVVPRDKQQGGGEEEEMGGDGMRATEVVSKEMEGVRAIVLKPSEPLDESRFMKIAGADFNDAGLGLDGLLGSLASTGFQASNLGDAIDVVNQMLHWSLSHEKPSEDCEEADLDPTYRDSARCKIFLGFTSNLVSSGIRDVIRFLAQHHMVDVIVTTAGGIEEDLIKCLAPTYRGEFSLPGALLRSKGLNRIGNLLVPNDXYCKFENWIMPLFDQMLQEQSAENVWTPSKVIARLGK

SEQ ID NO: 116474 - protein, 117 aa, Triticum aestivum
  Clone ID: PAT_TA_10892.pep
LSSPSLTRVRWQLGHAHESPRQIAFQRGTFPKVETVLFNLSVQKAKDDGNGDFYFGLQNLVSLRQVTMGIDRHGVTLADVKEAVAASRRAVDVHPQRPIIIFDIRPLIQHDEVQSPN

SEQ ID NO: 116475 - protein, 112 aa, Triticum aestivum
  unsure (1)..(112): unsure at all Xaa locations
  Clone ID: PAT_TA_10893.pep
KHVNVKLWLSFYFSFQVVITDKRTAVLEVPWPYLNNQTTTLENATRIWKLIMKQETPLTRSRSEISILYQQVTGGKKKPPGCGVGGGGRSLVPTGPAPRRHPCSPALFPEXX

SEQ ID NO: 116476 - protein, 210 aa, Triticum aestivum
  unsure (1)..(210): unsure at all Xaa locations
  Clone ID: PAT_TA_10894.pep
CRXFGTRXFPLSLRIVRCFSEKRGISAAEGEEAPPQFQKEPPPPLHRPTILSPLVLISVAPIHPSIRPPVLHFLGRRTELNPPQYSCLPAAAASRSVCCPVIPVGVVCSLFSSLQCEEKASAVGGGVVVLAEVSSSSVPVPVRASELLGSGNEAEEGYNGLHGRRLRRRRRRRSREGGGSSPWLRRGSARSGPGREQEKLRRNCRCGLRQ

SEQ ID NO: 116477 - protein, 210 aa, Triticum aestivum
  unsure (1)..(210): unsure at all Xaa locations
  Clone ID: PAT_TA_10895.pep
MAKSFTLLALLSALVVLSLLVSPIACSRKLPRPATKAHKNHTAATPSSSAAYGSGGWLAGGATYYGAPNGDGSDGGACGYQTAVGNRPFSSMIAAGNPSLFREGKGCGACYEVKCTGNQACSGQPATVVITDECPAGAACLGEAAHFDMSGTSMGAMAKPGMADKLRAAGILKGQYKKVPXKYNGVKLPGGQGSNRLQWPIQDGNGTAVN

SEQ ID NO: 116478 - protein, 285 aa, Triticum aestivum
  Clone ID: PAT_TA_10896.pep
MAGLRLLVGALWLLAVLRQGAAAEAGAVSVDGRRAIASTGEDFVCATLDWWPPDKCDYGTCSWGRASLLNLDLSNKILLNAVKAFSPLVLRLGGSLQDKVVYGTADRRGPCAPFTRSKSEMFGFTQGCLPMPRWDELNAFFEKSGAKIVFGLNALNGRVPLQGGAMGGNCVPTNAASFIRYTGGEGYKIYGWELGNELSGTGVGTKVGVAQYVKDAIALKTTVDTIYRGSPEKPLVLAPGGFFDPRWYGEFIAKTKPGMLNVVTHHIYNLGAGTQCELGATSQAR

SEQ ID NO: 116479 - protein, 260 aa, Triticum aestivum
  unsure (1)..(260): unsure at all Xaa locations
  Clone ID: PAT_TA_10897.pep
MATQLRHRILNPKTLDGMAGPFRDLQXGLLKAARTSAVAWVGESGRSLQHVGHHLVTDAFRVQASGSLDQAPACSAKFDXTMSYCRAGASWRRQTERPLAATHPTPSKPNPDYYKALLWHRVMGTKVLEAKCTGSNMVRAYAHCAKHAPGITLLLINLHVNATNHVSVAGRGGAHAGGRKHGGRFAQPPGAAREEYHLTPEGGNIQSQVMLLNGRALAAGADGSIPGMEPVKVDAARPIAVAPRSIVFVHMPDYHAPACA

SEQ ID NO: 116480 - protein, 140 aa, Triticum aestivum
  unsure (1)..(140): unsure at all Xaa locations
  Clone ID: PAT_TA_10898.pep
MEERARQLLLLAAVAGVGAAFGALSTAAVFSFLSRAKRREGYVRKLLESNGGAGGPHAGSTGPGARLHDSSDLLSDEVVAEQLTRNIHFFGVESQKKVTESFVVVIGLGGVGSHAASMLLYLDVAXVVLLNFDQVLLASL

SEQ ID NO: 116481 - protein, 192 aa, Triticum aestivum
  Clone ID: PAT_TA_10899.pep
MKLICDFPSPKSLPDKYVLPPEERPCNHELRDDLSVALPVIDLQGALGDGRRQVIGDIMKAGKEFGFFQAVNHGVGEDVIQGFREAAAEFFRMPAEAKLKHYSNEHNKHCRVFSGSVTSHTDTNDIRYWRDCLKLRCYPVDKLMHHWPSQPETFRERLAKYAVAVQELAQRLLRLIAEGLGLDSRFFEGDLT

SEQ ID NO: 116482 - protein, 147 aa, Triticum aestivum
  unsure (1)..(147): unsure at all Xaa locations
  Clone ID: PAT_TA_10900.pep
MKMVLKVPMVCKKCKSCVLTIVSKVKGVKSMAYDEEKSTLTVVGEVXDVVVXVDALRKGKHPATVVTVGQAQKEAEEKKKKEEEEKKKKEAEEKKKKECMQKHCLKACSPPLYCPKACSPPRHCPPPPHCPPQSYCYVDDSGPCTIM

SEQ ID NO: 116483 - protein, 143 aa, Triticum aestivum
  Clone ID: PAT_TA_10901.pep
ADTRSEQPHIQVAVVLLPRQVATAEIPQPPIVHHHGLEPSSGLACLAPPQRAQPLTSAASSRHSVVAAAVARRVASHDLASSRTRPAAPTSTLTRLALPGRSGHSRLGLRLLQVAVIEPLLAFASNSAEALLKAAWPSRTSPP

SEQ ID NO: 116484 - protein, 184 aa, Triticum aestivum
  Clone ID: PAT_TA_10902.pep
DIDVRMLGSGRPFLIEVLNVRSIPSAIEIQQISDKINSSEKKHVRIRNLKLVDNEIWAMMREGEAEKQKQYAALIWTSSPLTDDDLQKISVINDMEIVQNTPIRVLHRRSPLGRKRIIHWMEIEKVEGSSNYYLLHLCTQAGTYIKEFVHGDLGRTNPSIGSMLRCRAEILQLDVTDVKMDLLQ

SEQ ID NO: 116485 - protein, 284 aa, Triticum aestivum
  unsure (1)..(284): unsure at all Xaa locations
  Clone ID: PAT_TA_10903.pep
AVLLAAFAAAATIGLAGASFRDNCDIKWTPENAAFSDDGHGLTMSLKSNSSGCLLQTKQQFIYGSVSTXHQARPGELRRHRHHVLHIVXGADHDEIDFEFLGNETGQPYTLHTNVFADGVGKKEMQFVPWFDPTTDYHTYTISWTPCMIVWYVDDTPIRVFRNYRDKGIAYPIKRPMFGYSSIWSAEDWCTQGGRVKADWSKAPFVASYRDMILDVCPCDGSDSCVYGCEGAFGHGGQEQNCAGLSDQQRTKMLEKQKYNRIYDYCVDYKDNKKPGPECSLPQY

SEQ ID NO: 116486 - protein, 123 aa, Triticum aestivum
  Clone ID: PAT_TA_10904.pep
ISVGSHSRISCSAGRNRGRPRSGIARGRGGAVMEGKIVIAILLPQVLHLKFKRQRKIFSMSQTLTKPTVTESIHLNRNTLQLCGLKGASLIDPHPSFQRPLLQYNFQSTSTLFFSKVVGLIMI

SEQ ID NO: 116487 - protein, 167 aa, Triticum aestivum
  Clone ID: PAT_TA_10905.pep
DVGAVLWRWSVHSIANGGSCDATPLKHGTAMRLLPLPAPADGTEVGPRPAEQIGGASSSLSAVPPVSPRRRSSGARGVCCKAGYMGHIASSPLFLLFFLYLPSKPNSIFLLAGYGSRAMMINGQRLWLSHLPLDVYVVAGDIAVTNVYVVTLLHGKTFALQKKKKKK

SEQ ID NO: 116488 - protein, 68 aa, Triticum aestivum
  Clone ID: PAT_TA_10906.pep
YCVFFFYSDKCMDDARTRRTYGRTAMKALSIFNLSYAAGSEEPHESKGDGHGGQPAHHHPRARPRHGG

SEQ ID NO: 116489 - protein, 208 aa, Triticum aestivum
  unsure (1)..(208): unsure at all Xaa locations
  Clone ID: PAT_TA_10907.pep
MAFAARXRSLASRFSHHLTRRLHPSVPHLLSRSNDDDPPSQPLPHPLPSLRSPLPPASGAAQTLHHPFPFSLHHSGLPRRSFSSSAPAPAPDPPGEVDAAASVLVDAAEAVASSVPAPFPGEVAAAAADSFFPVAALQHLIDTIHTFTGLNWGASIALTAVLIRTAVIPFTVSHQKSGEKIHAMKPEVDAIKHAVDINNMVEKVPSLK

SEQ ID NO: 116490 - protein, 119 aa, Triticum aestivum
  Clone ID: PAT_TA_10908.pep
SARGFVELGKAVDGKKCIICEAVNSEFNEIVSMCGGPEEKTRASQLLKQLIIVPDSPSARMMDLPTTRKLAMKNKVVFGTGDRWRAPTLTANMGFVRAVSQSGMPLLTIEHRPRALIGL

SEQ ID NO: 116491 - protein, 165 aa, Triticum aestivum
  Clone ID: PAT_TA_10909.pep
SNPNAKRTKINNLSCCCCCCCVSVLFSNGTPRSSTHKHKRTCAKYDDDDLNAMGSQPSVILASCLMSRSGGRKPQKEKEIKDKEQIKATPETNACDAMRSSEARPAYDSLVLMLSCRSPPPPPPPCCCWLDDPPPPPPPWPAAASAACVRYAFSAARIPICPSLP

SEQ ID NO: 116492 - protein, 156 aa, Triticum aestivum
  Clone ID: PAT_TA_10910.pep
FHVRMEVVETRFAEHLPSLSTMLSMEGLFFRSRSTHSRPISMHTVTSWQGIWDLTVYMGRYVPFCPILTWSFHESHCGWIDQFGGTPRQWCGESNNLTVATDWRQTLRKGGGLVRQTASRDPPGSPRKSRKPNAYGYGRDQNSGQECKEHRRTLAR

SEQ ID NO: 116493 - protein, 182 aa, Triticum aestivum
  Clone ID: PAT_TA_10911.pep
LVLRRFTAISRLSDSCVNLVTLRDFSTFRKYPRSTRICPLAHSLIPSSTRTHPSPRSSPSPPRSHPRRRLLLTTLFPLLTVCCTAFSSPCRCRPLPTTTSPPDQFYLPAMNATEVLDPRAPTPEPKRRCMWSCARAAEPRRSSGEALDVELPRRESTERRWMCSRDFYSPDWFLVPSGESSL

SEQ ID NO: 116494 - protein, 100 aa, Triticum aestivum
  Clone ID: PAT_TA_10912.pep
RTSFKLLALDMKKSARPYSVNIIGMLLVILMLCAVNVQPIQVIDKVWAPKWRPHGSWDCQKCGGHIRGPVNEGEKNLPTTSALDKLNQLPTTSALDKLRH

SEQ ID NO: 116495 - protein, 160 aa, Triticum aestivum
  Clone ID: PAT_TA_10913.pep
MDPEKRGYKFQEFVAHDAEVRSLAIGKKSSRVFITGGSDRNVNLWAIGKQTPLLSLSGHTSSVEAVEFDTAEVLVLAGSSNGSIKLWDLEEAKVVRSLTGHRSSCTAVEFHPFGEFFASGSSDTDLKIWDIKKKGCLHTYKGHRGAIKSIRFTPDGRWIV

SEQ ID NO: 116496 - protein, 104 aa, Triticum aestivum
  unsure (1)..(104): unsure at all Xaa locations
  Clone ID: PAT_TA_10914.pep
VXPPLEXIFFXXFFFFXFFFLHRKFTLAKRLINMITPSSAMRIFAPGLRRASCPHFLKDCSLRIQTKCLPQPIANSAIYRTILSVTTHNTADILQTKCLITQNT

SEQ ID NO: 116497 - protein, 326 aa, Triticum aestivum
  unsure (1)..(326): unsure at all Xaa locations
  Clone ID: PAT_TA_10915.pep
MAHTCQASYGYPNPMPPIPSPTPPTAPALTLNYYXYSCPNAEAIVXXAVKNATDNNRGIGAGLIRLFFRACFVWGCDASVLLDATTANPEPEKLGIPNFPSLRGFEVIDAAKANVEKECRGVVPCADIVAFAGRDATFFLSNGVVDFNTPAGPRPRSSLLPPPGPPPSRPPPAAYVTGLDPLFLPEGLDLDDMVTLSGAHTVGISHCSSFADRLPADPSDPTSMEPALASSLQQRCSRGGDPVVVQDVVTPRDLDRQYYQNVLDRKVLFKXDAALLSPQTLKAVEHNAKNPGKWERKFKDAMVKMGNIEVKTKANGEIRKQCRFVN

SEQ ID NO: 116498 - protein, 342 aa, Triticum aestivum
  Clone ID: PAT_TA_10916.pep
LQIRHEGISGRILLEGHIFGRNLFWYTIVFGTIAAISRKVVADELQVIDPEGAMCLVVQQTHYMPKRWRGKESNELVRKEFETLFQYTIVMLLEEMASIFITPYLLIFEVPKRVDDILHFISDFTIYVDGVGDVCSLSMFDFRRHGNRNYGSPFDAPKNLRSSQGKMEKSFLSFQSVYPSLASNAEGKQFLHNLQKFKERQIRQQAVAQYQAMEASGFVDSTGQRDDIFHQLLPSIIRNHAEAFPPAGYNLDPLGIAGLRSKNHPYILDWYYMRHSPHLDRVEAPHFDEAPLEAGPTPSPLAGESSEFKMIIPRSVRKVQIWTTNISRISYKNDIHKQRVDP

SEQ ID NO: 116499 - protein, 246 aa, Triticum aestivum
  Clone ID: PAT_TA_10917.pep
MAYVHVIRTVRLARHVFDCSLPLDALLSPRTTQARGALVPSQLDLLFPRNFRLWGASSSKFILTTVFHPVKITDLFRVFEVRGFNKGDLVALSGAHTIGKATCPSLEFRTGEPAWFVKAIKDNCPRSGDKKHILDVTTPDVFDNKYYGNLLLGLGVLGHRHGAPPTPRKQDFLSESWAQGRASRVVHGALRCRHEEDGRFACGPRRRVPRQLLQAQVLCEEPHRRRFLGLGLRDHRLRWITSRSTA

SEQ ID NO: 116500 - protein, 182 aa, Triticum aestivum
  Clone ID: PAT_TA_10918.pep
MQQSRAWSSLARGIARRLAGGAPSAPISPLQSAAISTGSACLLARQDGGFVHGGFMDSIRIGGVVIPNHKRVEYALQSIHGIGRARARQILSELNLENKVTKDLSKEEIITLREGIAKYMIETDLRRFKSAAVERLEGIRCYRGIRHADALPVRGQRTKTNGRTRKEKRAWVANKSFAASPE

SEQ ID NO: 116501 - protein, 435 aa, Triticum aestivum
  Clone ID: PAT_TA_10919.pep
MAHLVGMMALLLLLAASAETAQARAARGPPAGKYAVILDAGSTGTRMHVFRFDKQMDLVKIGDDIEVFAKVNPGLSSYAGRPKEATAALLPLLQKANSVVPQRLMKTTPVKLGATAGLRLIGDKQAKQILDAVRGAVHTNTKFQYNPKWINVLEGSQEGSYLWVALNYLLDKLGGDYSKTVGVIDLGGGSVQMAYAISPAAAAAAPRVPHGKDPYVTKEYLKGRDYNVYVHSYLRYGALASRVEIFKATEGPFSYCMLRGFSGKYSYNGEEYNATASTGGAQYGKCRRDVVRALKLDSPCPAKKCTFDGVWNGGGGPGQANLYAASSFYYMASQVGLIDNDAPSGTSTPAAFRAVAQKLCRMSLKEVKVKYPKVRDVPYVCMDLVYQYSLLVDGFGLEPTKNITLVEKVKHGEYFIEAAWPLGEAIEAVAPKKGT

SEQ ID NO: 116502 - protein, 78 aa, Triticum aestivum
  unsure (1)..(78): unsure at all Xaa locations
  Clone ID: PAT_TA_10920.pep
FFLGINILIYSLKHNTXTFLLFQGKSVQSCPPINQPSMAKDDIRHTTARGTYVRPASRSPLATHXLAVPELPRAEXPA

SEQ ID NO: 116503 - protein, 82 aa, Triticum aestivum
  Clone ID: PAT_TA_10921.pep
LDSSDSPKSNPYVRGKCDCPEYLSCYPQHTIPKERRKINHDTHFSFPDGPSPSLSVSCRSETFLVGVLSFKPETAHLSFATA

SEQ ID NO: 116504 - protein, 281 aa, Triticum aestivum
  Clone ID: PAT_TA_10922.pep
SAHASAHASELAELLVSEEVPRHRRTLLTEKRDRGVGTEQPGPVLEQKVSFGRGKGKVDTAGRSEVSEPGHSSDKNLVPEKEEPLNGYAVKTVLPFPTEIPSSSYHSTHQDGNERKDTKKSVNADGSGKAAKRQPDEGNRQYYSGKSQSNVDHVADRCFDLQLMGNSQREEFPKLPPVRLKSEDKLVNMNWEEKIDHHGSGSNDPSTDHVFMIGSYLNVPIGQDITSSGGRRMVGSSWLSVSQGIAEDTPDMVFDTLGDDLLEYPNEYWDSDEYDDDDDVG

SEQ ID NO: 116505 - protein, 288 aa, Triticum aestivum
  Clone ID: PAT_TA_10923.pep
FGRGARVYASARGVPVDNTTATAIFQYKNAAAGAGAGAPMFPAMLPANNDTATATAFSNGVRTPGPPSAPPPGSREAPPAVALGLRCCRPGPFCQGPNNTRFGASMNNVSFQLPNTVSLLQAHYHRIPGVFTEDFPARPPVVFDYTSQNVPRALWQPVKGTRLYRVKYGAVVQMVFQDTGIFAAEEHPMHIHGYHFYVLATGFGNYNPRRDEAKFNMVDPPSRNTIGVPVGGWAVVRFLADNPGVWLVHCHIDAHLTGGLAMALVVEDGKTELQTTMPPPLDLPVCGP

SEQ ID NO: 116506 - protein, 89 aa, Triticum aestivum
  Clone ID: PAT_TA_10924.pep
SARGFSTAVYTTGNPYGIAEDLVFSMPCRSKGDGDYELVQHVAMDDFLWDRIKKSEAELIAEKRCVAHLIGEGNALSDLPGDTMLPGEM

SEQ ID NO: 116507 - protein, 198 aa, Triticum aestivum
  Clone ID: PAT_TA_10925.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSGTIDNVKAKIQDKEGIPPDQQRLIFAGKQLEDGRTLADYNIQKESTLHLVLRLRGGMQILVKTLTGKTITLEVESSDTNDNVKGKIQDKEGIPPGQQRLIFA

SEQ ID NO: 116508 - protein, 185 aa, Triticum aestivum
  Clone ID: PAT_TA_10926.pep
AFSLGREGVPAGPPRGPVGAWGPGGPPRPARARGARRGAPPPPALSHRSVAGFVTHCGWNSVLESIAHGVPVLTWPHFADQFLNEQLAVDVLGVGLRIGVTAPVMILNDDAAAPVLRGDIARAVSELMQGGEEAEERRRKAKEYGAKARKAMEKGGDSYETLTQLIESFRHGGGKDNEHCSGVIA

SEQ ID NO: 116509 - protein, 63 aa, Triticum aestivum
  Clone ID: PAT_TA_10927.pep
DQLRTHTQKGTTTLVKQQTHTEPNQIEAELAGTELLAQQRREGRVAHRHGQRQVMPYCCLAAV

SEQ ID NO: 116510 - protein, 384 aa, Triticum aestivum
  Clone ID: PAT_TA_10928.pep
MRDEAGGRSLHRRRRPHPPKPPAVPAHAALRDPPPGTEIFFVVVSYPKFASNMSAANRSQPIKLNRPVVGKARKLKDLMLKSDNRVCADCSAPDPKWASSNIGVFLCLKCGDVHRALGQDISNVLSLTLDDWSDSDIDSMIEVGGNSYANSIYEAFLPKDHPKPKPDSPMEYRTKFIRAKYETQDFLKPSLRISSKAGLESTNSLNSVDNSFSSTSRKHAPEDTREFVGQLNVTVVKGSGLAVRDMLTSDPYVVLSLGEQKAQTTVKASDLNPVWNEVLNLSVPRNYGPLKLEVYDHDTFSADDIMGEAEIDLKPMITAAMAFGDPSRHADMQIGRWFMTRDNCLLSDSIVNISSGKVKQEVYLKLQNVESGEMELELEWARLD

SEQ ID NO: 116511 - protein, 153 aa, Triticum aestivum
  Clone ID: PAT_TA_10929.pep
PKPPSAPPSSASRRISGMARTKQTARKSTGGKAPRKQLATKAARKSAPATGGVKKPHRFRPGTVALREIRKYQKSTELLIRKLPFQRLVREIAHDFKTDLRFQSSAVSALQEAAEAYLVGLFEDTNLCAIHAKRVTIMPKDIQLARRIRGERA

SEQ ID NO: 116512 - protein, 143 aa, Triticum aestivum
  Clone ID: PAT_TA_10930.pep
VVSFTAESLTSFSTVWRHEFTGAEYNHYRRTQSAMDAPDRHTLRLPEHVMKELAAVRRHRRAASLAAEYPDTADQRTPGWLTSFLRSMSWQRQSRGDSDAGEEHGGSKRIHPVSGAPVERPSGSGSGGDEKKESSDVDALNRV

SEQ ID NO: 116513 - protein, 360 aa, Triticum aestivum
  Clone ID: PAT_TA_10931.pep
MDSELSTVFFLLIVFAACCCSSSSATHHDPSVVGYSQEDVALPSRILDLFSSWSVKHSRVYVTPKEKVRRYEVFRQNLKHIVETNRRNGSYWLGLNQFADVAHEEFKAGYLGLSAGGRPRAPTTAFRYEAAVDLTREVDWRKKGAVTPVKNQGKCGSCWAFSTVAAVEGINQIVTGKLESLSEQELMDCDSTFDHGCGGGLMDFAYAYIVGNQGIHTDADYPYLMEEGDCKENQPHSKVVTISGYEDVPENSELSLLKALAHQPVSVGIAAGSRDFQFYKGGVFEGTCGTQLDHALTAVGYGSSNGQDYIIMKNSWGGGWGEQGYFRIKRGTGRPEGVCDIYRIASYPTKNNGTGWGWGA

SEQ ID NO: 116514 - protein, 216 aa, Triticum aestivum
  Clone ID: PAT_TA_10932.pep
ALELIGPAYRTMDSFVGVREKTCIIFVYGLLLMRQHNPQDARVRLASGLRIAHQQLGNIQLVSQYLTILGTLALQLHDTGQAREILKSSLTLAKTLYDIPTQIWILSVFTELYRELEEKENEMENSEYGSKKEIDLQRRLAEARSRAYHQELVEKVRIEVEPLHDLFQKHNDMSGLPANDDLDIPESVGLSTPQPSSVRRLVDSSSVRRSTRRRVS

SEQ ID NO: 116515 - protein, 295 aa, Triticum aestivum
  Clone ID: PAT_TA_10933.pep
MDPATGAMASLLPKLVELLDEKHRLQASIREDVRYLYRELQRMQTILTILLVSQPWHPYQGARKLWADDARKLSYDMDVVLDKLLVLAPDSQGFKGLMEKMSSLLNKGKTSHQIMTSAIRTSKARVRMMADRCQRYGIYAAVDYSLAAMTSVDPRLMALYARVPDLVGIEGEKDEELIKLLSHGDNVSIRNLKIVSIVGFGGSGKTTLVKTVYDKIQKSFDRKAFVPAGQNADVKKVLAGIIVDLTRNYPNKLNQKQLIEKLQEILENKRYTSLSKLHSQSYAGVFPYGRYAVQD

SEQ ID NO: 116516 - protein, 177 aa, Triticum aestivum
  Clone ID: PAT_TA_10934.pep
MGAAVNRAREEEPLSLALALTTDSAASSTTSADWAGGPAAPRKRARRGRVVATSGEGEFVCKTCGRAFPTCQPLGGLRTSHLRGRHGLELGVGVARAIKERKKQEEKQHECHICGLGFEMGQALGGHMRRHREEMALRGGDDGDQWVWRGVGLPDQEAVAHQAAANYEPPVLLELFV

SEQ ID NO: 116517 - protein, 154 aa, Triticum aestivum
  Clone ID: PAT_TA_10935.pep
MPKQRHGKRLGALELEPRPRQDHLYLVFDDWSFGYTIRKVNTSNRFNPPVQRLPRPFFKLEAPHESPEYFASAFGTRILLMHPRDPAGHNLSGSFFPMLDVRSRSLTFGPGLEFPIHPVYLAVGNKLFIIAEASFEMLYLDPQSGSEWSWELLP

SEQ ID NO: 116518 - protein, 235 aa, Triticum aestivum
  unsure (1)..(235): unsure at all Xaa locations
  Clone ID: PAT_TA_10936.pep
MACHLRSVSLPSRPHTKVEEELHSLEASISSPSMTIETISDGLRRLGDIYSTIEEIMCLPSNQICSSQQRKMLEGETECSLELLDLCNAMYEDFTELKAIIQDLXVATRKGDDTVVQVKIQSYTRLVKKAKKHFKKAAKKVTSDKEDCRMVRLLSEAREITTSLLESTVHLLSKQIAVPKWSLVSKAFQKKNSVVCKEEQLQVLECSVGDLEAGAGILFRRLVQSRVTLLNILSS

SEQ ID NO: 116519 - protein, 55 aa, Triticum aestivum
  Clone ID: PAT_TA_10937.pep
KHYVNKGGTTNIAILRMLPIDVRLEGPVACSILVLYFLICIWVQICFMTCGPLGV

SEQ ID NO: 116520 - protein, 131 aa, Triticum aestivum
  Clone ID: PAT_TA_10938.pep
MASGAPGIMLRHLSKTLAVSPAVASGMTSQHHQLQQRAPVGGTSKGKAKLKAGLPLKRSVIAKKGGAPATAGSGGAGRGRREAIERITQIAESCLKSSTPLRHLSPKECLREAKREELGLISKERQRELDI

SEQ ID NO: 116521 - protein, 171 aa, Triticum aestivum
  Clone ID: PAT_TA_10939.pep
MATGSNSQDIRASPELPKQLPFDFLKKITNDFSAERKIGGGPFGSVYKGVVPDDGRVIAVKKLQENAPMPPDKTFNNEVQNIMALKHENIVELVGFCWETQKKLVQFDGRYIQADITESLLCYEYLPNGSLQQNLFGTKTAEAVSSAEPAIDWAARFKIIKGICQGLLFLH

SEQ ID NO: 116522 - protein, 139 aa, Triticum aestivum
  Clone ID: PAT_TA_10940.pep
MATGSNSQEIRPSPELPKQLPFDFLKKITNDFSAERKIGGGPFGSIYKGVVPDDGRVIAVKKLQENAPMPPDKTFNNEVQNIMALKHENIVELHGFCWETQKKLVQFDGRYIHADITESVLCYEYLPNGSLQQNLFGMQ

SEQ ID NO: 116523 - protein, 187 aa, Triticum aestivum
  Clone ID: PAT_TA_10941.pep
MATGSNSQDIRPSPELPKQLPFDFLKKITNDFSAERKIGGGPFGSGYYGVVPGDGNTPAVKKLQDNAPMPPDKTVTDGVQILLALTHENIAESVGFCWEAQKQLVHSDGTDVQADITDSVLCYEYLPNGSLQQNLFGTKTAEAVSSAEPALVWATRFPTIQWLLEDLANLLGLAIPTRRSYPQPVCR

SEQ ID NO: 116524 - protein, 116 aa, Triticum aestivum
  unsure (1)..(116): unsure at all Xaa locations
  Clone ID: PAT_TA_10942.pep
NEHLLEFAWXLANSGYTXLWNVRPDLVKGHDNAVLPPEFSAATEGRSMLSTWCPQEKVLEHEAVGVFLTHSGWNTRRWKASAAVCRWFAGPSSQSSRPTAGTSAPSGASGWRLGKR

SEQ ID NO: 116525 - protein, 212 aa, Triticum aestivum
  Clone ID: PAT_TA_10943.pep
ACIDAITEHQRLNALMKGELIKGLLPQSSVRADYTVHRVQELAEGTCLKNYDYMGYRDGYGKSEKKWTSELPTDSHLLLYLFAAFLEHPKWMLHVDPTSYSGAQSSKNPLFLGILPPKERFPEKYVALISGVPAIIHPGALVLAVGKQSPPIFALYWDKKLQFSLQGRTALWDAILLLCHQIKVGYGGIVRGTHIGSSALNILSVLDSDMES

SEQ ID NO: 116526 - protein, 169 aa, Triticum aestivum
  Clone ID: PAT_TA_10944.pep
GPPAAAPPAAAAAAAAAALPFPGSPFTRSSPPSRVHVASSNPMPGTPAPRSLPVPCRRAPLRRWPPPGRAGPGDAAPAAPAAAPADARLPRRRPRGSLPGPFSGARSEPWTDRVAYGGASVCRPGARRRAGRQVVHKLGLILGLVLRDDLRVDTGADACAGVCLGSRPC

SEQ ID NO: 116527 - protein, 125 aa, Triticum aestivum
  Clone ID: PAT_TA_10945.pep
SADAWGFLQHEHHLGRPINQRVRSLLMDFLYFFGNVFDPRHMRISIQGSGIYLNRERGHSIDPIHIDDPLCPANNVGRNCFRIHQCIKAFADAFAVLENELLQFTAECNVPASSFSLLKKIIPKY

SEQ ID NO: 116528 - protein, 75 aa, Triticum aestivum
  Clone ID: PAT_TA_10946.pep
MVSGHLFHCRKNSWPPEEYVGRTALQLLDLDGGSPPEQAWRRRLNSHANLLKEFSVTFMEAMKMMTLGMRLWSYV

SEQ ID NO: 116529 - protein, 152 aa, Triticum aestivum
  unsure (1)..(152): unsure at all Xaa locations
  Clone ID: PAT_TA_10947.pep
SVYFVAAIDTGVMSGASLYIQKDLEITDVQVEILMGILSIYSIIGTLAAGRTSDWIGRRFTAIFAAFFFFAGALLMGFASGYTMLMLGRFVAGIGVGYAIVIAPVYTAEIAPASARXGFLVSFTGVFINIGILXLGYISNYPLARAWRFNLG

SEQ ID NO: 116530 - protein, 245 aa, Triticum aestivum
  Clone ID: PAT_TA_10948.pep
MASTRDLAIASISAAAGAVAAAAAVLYSYTATNAKPQKPAPPPPFTEPLPVNGCAARHPPAQDPFKTTKREGFISWDDYFMAIAFLSAERSKDPNRQVGACLVSQEGIILGIGYNGFPRGCSDDKLPWAKKSARGDPLETKYPYVVHAEVNAILNTNHASAAGQKLYVTMFPCNECAKIIIQSGVSEVIYFVEKRIDNSDHVYVASHNLIINGWCEGQGASPPWGTFTHLPSGAKGLMNELCALR

SEQ ID NO: 116531 - protein, 443 aa, Triticum aestivum
  Clone ID: PAT_TA_10949.pep
MATASGLSGPLQLLSLRRTPAKNLSPRRAAAGALSGSLIVKRFSLCNGRSHHQFLPLKQRGRLQAAEIPVTPPLIDDEEKRSQLSQDYGFNQIGEQLPDNITLKDVMDTLPKEVFEIDDVKAWASVLISVTSYAFGLFLISKAPWYLLPVAWAWAGTAVTGFFVIGHDCAHKSFSRNKLVEDIVGTLAFLPLIYPYEPWRFKHDRHHAKTNMLVEDTAWQPVWQNEIESSSFLRKAIIFGYGPIRPWMSIAHWLMWHFDLKKFRPNELPRVKISLACVFAFMAIGWPLIILQSGIAGWFKFWFMPWMVYHFWMSTFTMVHHTAPHIPFKSSKEWNAAQAQLNGTVHCSYPRWIEILCHDINVHVPHHISPRIPSYNLRAAHDSIKQNWGKYINEASWNWRLMKTILTTCHVYDKERYYVSFDELVPEESQPIRFLKKFMPDYA

SEQ ID NO: 116532 - protein, 164 aa, Triticum aestivum
  unsure (1)..(164): unsure at all Xaa locations
  Clone ID: PAT_TA_10950.pep
RCTGHMCPIRVHWHVKKSYXKYWRVKLSINNFNRFKNYXDWNIVVQHPXVYRKLTQVFSFAYEPLVQRGTINDTGLFWGLPRFNQMLPQDGTVQTEVLLRKGKDFSFSGGWALPRKIYFDGSECAMPPPDDFPQLPSSSPVQRFSGGHRWLASGAVLVLGLLLT

SEQ ID NO: 116533 - protein, 80 aa, Triticum aestivum
  unsure (1)..(80): unsure at all Xaa locations
  Clone ID: PAT_TA_10951.pep
SLXRSGRLYPALLAARIDQGGQRLVHPRPTCRGWVRPTDLPQPNLPQPPPGRSRGSRRLDREDPSPLSSLCVCFQSIMLG

SEQ ID NO: 116534 - protein, 46 aa, Triticum aestivum
  unsure (1)..(46): unsure at all Xaa locations
  Clone ID: PAT_TA_10952.pep
MSALFNFXSFLIVVLLVICTCTYIKMQFPAILNDRTGFRGFFWKAA

SEQ ID NO: 116535 - protein, 90 aa, Triticum aestivum
  unsure (1)..(90): unsure at all Xaa locations
  Clone ID: PAT_TA_10953.pep
MNCTPRSSTMQRSIASTARSAKNHRLDCSRRPCVVGAALAVECHAHAWCKQRPKPHRPLRVRRWHQVHGIVKKKSXSRSMEPFLLYIQXT

SEQ ID NO: 116536 - protein, 152 aa, Triticum aestivum
  Clone ID: PAT_TA_10954.pep
MVGIPARARLSSYPPPPPSPTPTPPSPSPPPAAPALAIGHYYKTCYKAEQIVRDSVRKAVYANRGIGARLIRLFFHDCFVRGCDASVLLDPTPANAQPEKLGIPNFPSLRGFEVIDAAKAALEEACPGVVSCADIVAFAGRDATFFLSNGRA

SEQ ID NO: 116537 - protein, 128 aa, Triticum aestivum
  Clone ID: PAT_TA_10955.pep
TFPGPQDDRKVRLREDDRRGAVKMVNVPKTKKTYCKNKECKKHTLHKVTQYKKGKDSLSAQGKRRYDRKQSGYGGQTKPVFHKKAKTTKKIVLKLQCQSCKHYSQRAIKRCKHFEIGGDKKGKGTSLF

SEQ ID NO: 116538 - protein, 93 aa, Triticum aestivum
  unsure (1)..(93): unsure at all Xaa locations
  Clone ID: PAT_TA_10956.pep
PRVKRRYDRKQSGYGGQXTKPVFPTKKAKTXKKIYAEECKCQRLQSTXSQRAIKRCKHFEIGGDKKVQGDISFLDCFHLSGVVSVLKNYYYLC

SEQ ID NO: 116539 - protein, 119 aa, Triticum aestivum
  unsure (1)..(119): unsure at all Xaa locations
  Clone ID: PAT_TA_10957.pep
LTRPWLFVMHGGGEQINQRAANITCTFLFLFTTRMYKAMGLGPRRGCSGRLRPVACRCWLPRMTMAPRCRAGSSACSRRRRSRTRRPGPRPTARRRPGGRRFFVVXACASPRRPSSRXG

SEQ ID NO: 116540 - protein, 121 aa, Triticum aestivum
  Clone ID: PAT_TA_10958.pep
STARPTSAPQGWGEPPSQLRSAAASPRSPHFRSPSPLSPSPLSLSPSAPTCSPPSPASPSPPSSLASSRPETPRGLPAAGASPYRLTTPPGMDVYPLPAPPARRRPWEARKGKGKCPGLEE

SEQ ID NO: 116541 - protein, 100 aa, Triticum aestivum
  Clone ID: PAT_TA_10959.pep
PVLAAGSSSFSSAREIKDAVAVAVVAFQRQRSVASTADGEKDVQGSPTPSELSTSSDLLDEHWFGGTDAGSYYSPGMFMEPPERPGNRELGAGEVETLLW

SEQ ID NO: 116542 - protein, 164 aa, Triticum aestivum
  Clone ID: PAT_TA_10960.pep
MDEEIGAAAAPQGQWKYHKALSLLAFQSFGVVYGDLSTSPLYVFKSALSGLDKYSDEATVFGLLSLIFWTLTLIPLLKYVIIVLAADDNGEGGTFALYSLLCRHAKMSLLPNQQAADEELSTYYQPGVDRTAMSSPFKRFLEKHKKLRTCLLLFVLFGACMVIG

SEQ ID NO: 116543 - protein, 104 aa, Triticum aestivum
  Clone ID: PAT_TA_10961.pep
SGRRGLCLKTRNQRNQGAAGEAEVNSLELKELRHSCSIGSRGGVQRRCSDGAERGGMPSNINQAFHTRHVPPALDPPSPKFARCMFCGIFRKEGPSQPSEPSRY

SEQ ID NO: 116544 - protein, 63 aa, Triticum aestivum
  Clone ID: PAT_TA_10962.pep
QQVRERLRKERDRERERILIPCHTHIHTQRHSAARLSATCICMHAAVTRERFNPLHYTDQSKT

SEQ ID NO: 116545 - protein, 127 aa, Triticum aestivum
  Clone ID: PAT_TA_10963.pep
NWHLQQPESRKQRETTAPQSYRGKKSCSQTRYKNSADRDLDRLQIGRMSVSIIHYQTHIQEPVSQFFSVSCRTLRHEPASKPLYRVEMVPSCSLLSLLVSPEFGACRVPANRSIELRWYQAAAYYPY

SEQ ID NO: 116546 - protein, 80 aa, Triticum aestivum
  Clone ID: PAT_TA_10964.pep
INASHANLKARKRMNSDQGSYHYVNPNPLNMDFLAHIEESCKIVTSSYGVFKRKAREQGWIMSDSLLNPGRARLCGVAPQ

SEQ ID NO: 116547 - protein, 511 aa, Triticum aestivum
  unsure (1)..(511): unsure at all Xaa locations
  Clone ID: PAT_TA_10965.pep
GAAAAATATQTITLPPXGVAVRDAVRGAVRDAELPPRAPAMSAPAPAAAVDGVLCFEEAEGRRWSYVVEGAASSAGKTGRVSARARGGSAAPVGATFRAVPLQSPLPPAEEIMSFIRSYVVPEGFPDSVTPSYVPYMTWRALKHFFGGAMSVFTTRALLNSVGVSQSRATSGAVAINWILKDGAGRVGKMLFARQGKKFDYDLKQLRFSGDLMMELGAGIELATAAFPQLFLPLACMANVVKNVAAVTSTSTRTPIYKAYAKGENIGDVTAKGESVGNIADLLGTGMSILMSKRNPSLVASFAVLSCGYLLSSYQEVRSVVLNTLNTARFTVAVDSFIKTGHVPSLKEGNLEETIFNPPWRHQPVAIGSRFGEAFQEPASFVATRPLFEDERYIVTYNPAKDKVYALLKDQAKQDDILKAAFHAHVLLHFINASHANLKARKRMNSDQGSYHYVNPNPLNMDFLAHIEESCKIVTSSYGVFKRKAREQGWIMSDSLLNPGRARLCGVAPVI

SEQ ID NO: 116548 - protein, 288 aa, Triticum aestivum
  unsure (1)..(288): unsure at all Xaa locations
  Clone ID: PAT_TA_10966.pep
MAALITRATSVALVSEMMAQGRKSAAALEALLQVQDHAGMRELTAEILRCCDRALGALHGKPAGRHKRKPARHGGAATQTKPKTRTRASSGETTRXSGSGTGTTGFMWTKYGQKHIRGSDHPRHYFRCAYALHDGGCPASRHVQRSPEHDPPLYVLTYLADHTCCRHGVAAAVVKNVKMQPPLVLDFGSAAAPCSRSPCWLNYGDTVWGETSRSQELRAEVTKVESTPSSDLLPAVPAVVAQMSSSADDARCSSPPAAWDPSAADWEYFVNNSSDYVREFFDLEDVVL

SEQ ID NO: 116549 - protein, 184 aa, Triticum aestivum
  unsure (1)..(184): unsure at all Xaa locations
  Clone ID: PAT_TA_10967.pep
PGPRPAAVAAPGGAARAAPASGARACPASSRSSSAVFPRGGPAPRPPPAPPPPPPPSPPPPPPSXRLPPPPAPPLLPPPPCPPRTQPPCSPAAAPLRPPAPRAPPRTRPPXPALGTPGGVPPPAALPAHVATPPAPGPPGPXPPPPPSPPLTPCPWSHAAPPRSASPPAAPPRTPAPGRRSGLH

SEQ ID NO: 116550 - protein, 160 aa, Triticum aestivum
  Clone ID: PAT_TA_10968.pep
AVRIGIRGLFALCLAKENRQRAVSAGAASALARRVAEGGCVGELERALAAVERLSRTEGGREPAVPGAGGGAAVVIALVRAMSGRAAEHAAGALLAAMGGSEGLQLEAVRAGAMSQLLMMVQGGCSERAKRKAQHLLKLLRSAWPTTDSMANSADFLQPY

SEQ ID NO: 116551 - protein, 266 aa, Triticum aestivum
  unsure (1)..(266): unsure at all Xaa locations
  Clone ID: PAT_TA_10969.pep
MACQLVDLSRELEPYHEYGVSETFYHPQHFGALVFMDRNKIPSGYIKDDMLTLRCTITVLKELPAPTIPAEEVIAQPSTNLHRHLGELLQGEMGADVTFXVCDESFAAHKVXPAARSPVFKAQFFGDMKETCSARVEIKDMEVAAFRAMLHFIYTDTMPEFDRPLEEVTTMAQHLLVAADMYGLERLKLICEIKLSIGITVDTAATTLALAEQHNCSKLKAKCVGFIVSTPAILEAVLPTDGYKHLETSCPLILTELLKSVHVSKS

SEQ ID NO: 116552 - protein, 177 aa, Triticum aestivum
  Clone ID: PAT_TA_10970.pep
VSHNNAVPQSKWKKQWTNRVKLFFDGPAKAKKRQELRIKKAKNVFPRPTEMLRPIVRLSGRRYNRRVALGRGFSVEELKQAGIPLQFAKTVGIAIDTRRKDLSEERLQANVQRLQEYKQRVVLFPRKKGTVKKGPIADSQVAKAESQVKGVVLPIKAEVSVVETREIAKDEKERSRC

SEQ ID NO: 116553 - protein, 269 aa, Triticum aestivum
  Clone ID: PAT_TA_10971.pep
MSRIGDLMPRERSVNSTSHSRKADGDSANVSGTPHDTAKHCHDEELGNIGGQLCKNDGHSFKESCSITNSEVLTRVKWSEEEDKVLTQMINKHGLKNWQTVAHAIPGRSAPQCRQRWRYKIDSAINKEAWSEQEELRLIRAHQIYGTKWREMVKHFPGRSYGAFKEYWRGPMKRKLNSYLSSGLLEQFPDILENLSGTQNNSLDILKGTKVSDILNDTEGSSERNEMSSAVPRISISEVGFTEVGENADVPGGESADFMYARVASAKAP

SEQ ID NO: 116554 - protein, 143 aa, Triticum aestivum
  unsure (1)..(143): unsure at all Xaa locations
  Clone ID: PAT_TA_10972.pep
GGRTGLTALTASLYFTXALFITPLLASIPSWAVGPPLVLVGVMMMRAVAEVDWEDMRQAVPAFMTLALMPLTYSIAYGLIGGIASYMLLHSWDWACEAAGRLGCRPRRKVGGGEATRADTPVSNESASGNGEHGKGVSHVELS

SEQ ID NO: 116555 - protein, 134 aa, Triticum aestivum
  unsure (1)..(134): unsure at all Xaa locations
  Clone ID: PAT_TA_10973.pep
MVGGGRRGGAADEAKLNTGNVFAALETLKKKKKGDKAKGGSSKGGKQGDEPTPQQQKELFWAPAPLNTKSWADVEDDDDDDYFATTAPPAPIWGNDHAAAXTAKEXEEDXVDAXHPACRRKLKVRMSDDAEGTE

SEQ ID NO: 116556 - protein, 242 aa, Triticum aestivum
  unsure (1)..(242): unsure at all Xaa locations
  Clone ID: PAT_TA_10974.pep
MKATVKGRYEGDKATAAATVALAAAGDLRLRASATDAAFAAGPSLDGLTLTLEKPGAFLLDLKPHNQDVRFQFMNSATVLDKRVSLTYTHSTSLAPAAPKPAIPAPAAGAAPAPPPRGPPPGRTALDLSIAFDPANKVSVSHALGGGGCRVKYTYAHGAGRLTTIEPVYDTAKNAWEFAVAQEVXPGDTVRGTYQXSTKQLGLEWTRSSSIGGSFKVATTFDLSDQSKAPKLVAESTWNYEI

SEQ ID NO: 116557 - protein, 78 aa, Triticum aestivum
  unsure (1)..(78): unsure at all Xaa locations
  Clone ID: PAT_TA_10975.pep
GTRAALXSSGGVSLTLGLHQNNRAYIAEPLPAALPLNLAHRFGLEDVSDAYAMAASFGGQDRHFTKEMGGHLLHDFVG

SEQ ID NO: 116558 - protein, 56 aa, Triticum aestivum
  Clone ID: PAT_TA_10976.pep
FVNAWYLILSSANQHQGTFRPAAWICATTYISRILLQLPSCVMVFTILLNDYFEKK

SEQ ID NO: 116559 - protein, 243 aa, Triticum aestivum
  unsure (1)..(243): unsure at all Xaa locations
  Clone ID: PAT_TA_10977.pep
SARGFTVDDRGNIYVADAMNMAIRKISDTGVTTIAGGKSMRGGHMDGPSDDAKFSTDFEIRYVSSSCSLLVIDRGNQAIREIPLQPDDCEYQDEAGFPLGVALLFAAGFFGYMLPTRPYSDLVGSEISTMQEPQTPPRPSNASIPPYQPYQPYQQPFKPSFGPPLIPNEDQAEHXEGFFTSVGKLMGGAKSSVADMFSRKKRPARQHHQQHQQRRANPWPVQESYAIPHGETPPPLDSRGPTP

SEQ ID NO: 116560 - protein, 228 aa, Triticum aestivum
  Clone ID: PAT_TA_10978.pep
MAAMEAAADAMLAAASRAFCSSVAVFFQIQGCCICLLLAFGWAVASLVRKKEIRKMRRKMASGHSFAFLCDDVDELEHSVQQKLPMVSVVMPLKGFGEHNLQNWRTQITSLYGGPLEFLFVVESKDDPAYRAVSRLIVEYKDKLDAKVVVAGFSTTCSQKIHNQLIGVEKMHKDSKYVLFLDDDVRLHPGTVGALTKEMEKNPEIFIQTGYPLDLPSGSLGSYCIYEY

SEQ ID NO: 116561 - protein, 233 aa, Triticum aestivum
  unsure (1)..(233): unsure at all Xaa locations
  Clone ID: PAT_TA_10979.pep
MQAIPHEASVPHYIPMATAVSAPVFTATVRVSNIPPSTAPKMLHAVSLADIADAVEDYIXNDSLGAISTAHLVQSDPHSMKARSPECLQLAALHSMAVDFAKAGAPTEMPRSLRPKEYPDFMERWDKPTYISNGALGKLYRAAASRMQSAPAPSSSAQPSPAFDPDLEVPGFGEFLASAEESYHLYAEQLSTLMSYYGAEHEVEILAGNIGIQYLEHAAGGRRGGLSRPPIID

SEQ ID NO: 116562 - protein, 317 aa, Triticum aestivum
  unsure (1)..(317): unsure at all Xaa locations
  Clone ID: PAT_TA_10980.pep
VIRHRTVKVNGISMHVAEAGPEVDAKGAVLFLHGFPELWYSWRHQMDHLGARGYRCIAPDLRGYGGTTAQPDVASYTAFHXVGDLVALLDTLGLAKVFVVGHDWGALIAWYLCLFRPERVTALANTSVAFMRNIMIRNGPDFVNPIEYFNRAYGPYYETCLSQGHHVSPQAKPRMSPLWAPCVSCGVFAVDAVAAAKYPSSPPRXPTSPLRPWLTEADMGQLVTPLKXGFTGAIVLPHLTTAPSAGAMAHPPTGPTGGLGACTSNLEGSRDSRRGGGVSRDVPLPDEVVVIPGSGHFIQQERAQEVSDHIYDFIIKF

SEQ ID NO: 116563 - protein, 152 aa, Triticum aestivum
  Clone ID: PAT_TA_10981.pep
LRPLTALATTTRESPRRCPVRRTPSRTHLQQGTTGGVQPPTGAYTSIPGPTTHMAPPAQGSDAAASNAPRSSDPSPNCKTSWPCRTGPRTCPAQGSFPAELKILISLIISKFALKLSPLYHHSPALKLIVEPEFGVDLTLTKVQTASTTTTY

SEQ ID NO: 116564 - protein, 93 aa, Triticum aestivum
  Clone ID: PAT_TA_10982.pep
TYCVAGSYSAADDDQCRGDTNTGRDLISILTIAVGFLLAINFKPFRISSCLFRGPSRSHFSLQSVHRPALLMKYARVWARVPPDSPARRLMVV

SEQ ID NO: 116565 - protein, 205 aa, Triticum aestivum
  Clone ID: PAT_TA_10983.pep
MGKSDFLTPKAIANRIKAKGLQKLRWYCQMCQKQCRDENGFKCHCMSESHQRQMAIFGQAPDRVVEGFSDEFLEEFLTLLRRAHRSSRVAATVIYNEFIADRHHVHMNSTRWATLTEFVKFLGREGHAKVEDTPKGWFITYIDRDSEQAIKARLKRKRVKSDLAEDERQELMIARQIERAQKAQANGEEDDDANADDDLGSEDDE

SEQ ID NO: 116566 - protein, 263 aa, Triticum aestivum
  Clone ID: PAT_TA_10984.pep
TRPAENINEDSRSVDQSHQKEEILGHTVEYGHESKGGVEKVETSPRVGNDGWESSGDRRNRDAPPSQIPDTPDRGRDSSWNVKTQEVEGSEQYSRSRQLRDPKEANVSEWRSTQERLDGSSFHGRAGYRQDSRGRSESFRGSSTYGNRYDRSDSIEIRPNSNFDFGREGSVSGRRSDVGAPGTTDDSSTNHPEADQSGGTSMVSPFTQQGPKGDRSSRGRGRPNGRDSQRIGVPVPLMPPPSFGALTLPPGQMQHMGPNIPHS

SEQ ID NO: 116567 - protein, 92 aa, Triticum aestivum
  Clone ID: PAT_TA_10985.pep
MSSRRSRSRQSGSSRITDEQISDLVSKLQDLLPEARLRGNDRVPSSRVLQETCTYIRSLHREVDDLSERLSELLATSDMSSAQAAIIRSLLM

SEQ ID NO: 116568 - protein, 92 aa, Triticum aestivum
  Clone ID: PAT_TA_10986.pep
RVQAAAKKRRRGELEPQVTPAGLDLISSLPDDMLRVIISLLPVKYGARTVLSRRWCPLWNSSPLDLIDTHELCHGYRKILDAFSKILDSHLV

SEQ ID NO: 116569 - protein, 69 aa, Triticum aestivum
  Clone ID: PAT_TA_10987.pep
VCATLGSRLAMSARALYHMDASDTIIYVCQKTQTVPGKGKATPVGIPCVRPQSDMRCYMLDRCGIESGS

SEQ ID NO: 116570 - protein, 87 aa, Triticum aestivum
  Clone ID: PAT_TA_10988.pep
HLTGRHVIHFVHVSVPSGKCHAVTSGVLPSLLQSGFHGVLLAQCYSPDSLADDRHARYDSCMPVPICLCHFGFTTSHVGPDSLSYGC

SEQ ID NO: 116571 - protein, 61 aa, Triticum aestivum
  Clone ID: PAT_TA_10989.pep
CSSSWMSNSIVVLLDGDGLDEIYHVIELILLGIDLYYPLCSEIDFAMTLLCLMLVTRARVP

SEQ ID NO: 116572 - protein, 109 aa, Triticum aestivum
  Clone ID: PAT_TA_10990.pep
NQEIWVEYSTLENCCDPLYMWVITTQPTKYVHYFSTALFISQHDASSDPPVVPEPYSALLRLTTDVEHIPIFSPAIDGADGLAVFSDTPRATNLMLPPSGAHKGKDPAP

SEQ ID NO: 116573 - protein, 93 aa, Triticum aestivum
  Clone ID: PAT_TA_10991.pep
SRFIAYSGSIRRESDRGFHIRPRTMCIGFRDTKRAPDIPGHVPTASQPTPRVSAVHGLHYTTNTLQLLDRGQGWLISRAGSYFRAQCMVVADS

SEQ ID NO: 116574 - protein, 59 aa, Triticum aestivum
  Clone ID: PAT_TA_10992.pep
ISSNPLPSSKPTMELLTHDSEHHEIGDGGWLMMTTATDSPLRSPERTPDQPSRKVLGID

SEQ ID NO: 116575 - protein, 113 aa, Triticum aestivum
  Clone ID: PAT_TA_10993.pep
LGGYPELRLQVTLLRWRTRVHIFTNQYTTMDPLPSPYENAIHSTHAYLAHFKSIHFHLSMNCIGNPEVLFRGHGYSNRSFITPQGCTSSHTLSPLTTMYTSCISTTVGVNSHG

SEQ ID NO: 116576 - protein, 70 aa, Triticum aestivum
  Clone ID: PAT_TA_10994.pep
RPILHNSNVSTFSNAFPFVLDSNLHDLNETNPRLALFSGELPWCCFCAEIKVLGMEQNFARIFYINKENF

SEQ ID NO: 116577 - protein, 59 aa, Triticum aestivum
  Clone ID: PAT_TA_10995.pep
VCEHDLVKVAVRGHVGVHGGLSHCSRPQELSSVFVIHDSATTIHWALKYDPARLIYCPR

SEQ ID NO: 116578 - protein, 113 aa, Triticum aestivum
  Clone ID: PAT_TA_10996.pep
TGFPRYLTCIRYTRPRTYRITAHPYGQRCPRPPVRYKHQKLLATPGQRARVNKKSSGVIFQGPMHGSSCILNHTYRSQCLRSASMKQPTMYSYMASHRYLYQIVFTTPLSLPT

SEQ ID NO: 116579 - protein, 222 aa, Triticum aestivum
  Clone ID: PAT_TA_10997.pep
MAAGAGDDLKLLGMWASPAVLRVRLALSIKGISSYEYQEEDFANKSELLLRSNPVHKMVPVLIHAGKPVCESTIIIQYLDEAFAGDALLPARPYERAVARFWAAFIDDTLLKAMYQASWSKTEEEKAEGKKKVAAALTTLDGALRDVAGGKPFFGGDAPGYVDTVLGGLLPWVRSVDVINGVKTIDPVEMPLLAAWADRFGALGAVEAVMPDVTGWWSSPCP

SEQ ID NO: 116580 - protein, 97 aa, Triticum aestivum
  Clone ID: PAT_TA_10998.pep
KGPPPFFFFFFPFFFFFFFFFFFFFFFFFFFFFFFFFFFFFFFFFQSQNIMDTRDQTLTKLTRLHDKSHPTHHRPASLRWNYSRTAASIMKLVMEEG

SEQ ID NO: 116581 - protein, 166 aa, Triticum aestivum
  unsure (1)..(166): unsure at all Xaa locations
  Clone ID: PAT_TA_10999.pep
MAEAAALEGSEPVDLTKHPSGIIPTLQXRNIVSTVNLDCKLDLKAIALQARNAEYNPKRFAAVIMRIREPKTTALFFFSGKMVCTGAKSEQQSKLAARKYARIIQKLGFPAKFKDFKIQNIVASCDGKFPIRLEGLAYSLIGFLMDSDGLDEIYHVIELVLLGFDP

SEQ ID NO: 116582 - protein, 230 aa, Triticum aestivum
  unsure (1)..(230): unsure at all Xaa locations
  Clone ID: PAT_TA_11000.pep
MAGAANDLKLLGMWASPYVLRVRLALSIKSISYEYAEEDLRHKSELLLRSNPVHNKVPVLIHAGKPVCESLVILQYIDDAFGGAGPALLPADPHERAVARFWAAFIEDTLVKAMNQASWSKTEAEKVEGNKRATAAXNTLEAALRDVSKGKPFFGGDSTGYVDIVLGGLLAGVRAMEAMLGVKAFDPVTMPLLAAWADHFGALDAVAAVMPDVSKLVELFITMHAAVAAN

SEQ ID NO: 116583 - protein, 189 aa, Triticum aestivum
  Clone ID: PAT_TA_11001.pep
MAGAVDDLKLLGAWYSPYVLRVRLALSIKGISYEYAEEDLQHKSELLLRSNPVHNKVPVLIHGGNPVCESLVILQYIDEAFGGAGPALLPADPYERAVARFWAAFIEDTLVKAMNQASWSKTEGEKVEGNKQATAALNTLEAALRDISKGKCQDPDSMSHRSSRGTDLQGQASMTQLRTCRSSASGSGL

SEQ ID NO: 116584 - protein, 221 aa, Triticum aestivum
  unsure (1)..(221): unsure at all Xaa locations
  Clone ID: PAT_TA_11002.pep
PXSPLPDVQRDGSTRLSYPSHIIHFNHTHIMLDISINCRVPHKKCTSQGPHFKSPEWHTKHVHTDRGHMSRHSRQTRIQAHAEASRLFSNPRKKEGFSKPVYLHRALPGQDHNILPKTIVDVEVYTKQIRAPEVSYHGQSLSRRPPKYYLGVVQWTSPVPPFLLLFGRKTSSSRRPAPERLPGVATTGKGRVQEGSVRLPPLVGRARGCRLADSLSHGSSL

SEQ ID NO: 116585 - protein, 464 aa, Triticum aestivum
  unsure (1)..(464): unsure at all Xaa locations
  Clone ID: PAT_TA_11003.pep
MAEDAGDRDQQQQQQPAAAAGPGAGHACGEDGGGRDESSVKLFVGQVPKLMTEAELAAMFRDVAVVDEVTVIRDKATKASRGCCFLICPSREEADKAVNAYHNKRTLPGAPSPLQVKYADGELERLEHKLFIGMLPKNVTDAEMTDLFSQYGNIKDLQILRGSQQTSKAGCAFLKYETKDQAVXAAIEALNGXKHKIEGTSVPLVCXKWADTEKEGQARKAQRAQFPPSKMSNANAMQQSSLFGALQMGYVPPYNGFGYQPQGTYGLMQYPLSPMQNQAGFXNMVQPVNQGSSIRGVNPELSPNSVARSFNSMQLGSPYPAGPGMRTRGSYAGGGINSRPYMNSHNSVNKVPNANATSPTSSSTSSNTGPQLEGPPGANLFIYHIPQEFGDQDLANAFQSFGRVLSAKVFVDKTTGASKCFGFVSYDSPAPAQAAISMMNGFQLGGKKLKVQLKRDNSKHNKLY

SEQ ID NO: 116586 - protein, 163 aa, Triticum aestivum
  Clone ID: PAT_TA_11004.pep
MAMRKNKVHEFEADVPAADLWGLYGTLRAAELLPELLPQVLAKIQLVSGDGDVGTILELTFAPGIPGLETYREKFIKVDNENYIKEAQTIDGDILKLGFLYYMVRFEIIAKGPSSSVIRSTIVYEINYETHPGLEAMVSTGPLAATAEKFAGYLREQKIAQSS

SEQ ID NO: 116587 - protein, 467 aa, Triticum aestivum
  unsure (1)..(467): unsure at all Xaa locations
  Clone ID: PAT_TA_11005.pep
MNLAAPVSTSTSTAVPPHAHGLMPLNLAPPSSSFLPPSLYASLRKKISPMASAPASASAALSTAAPADNGAAKPADQGPVQVAKGLGEVKNNNFFTRRASLSLKHXAIKLGQGLPHFGGPXDFVKEVAIGLIKAGKNHYAGGYGVPELNSAVAERFLKDXGLQIVPEKEVTFKSGCTEEIAETILGRINPGDXEVILFSPLCDSYDATVXAPGADSDITIRPPEFAVPLEELKAAACPKNTTXIMSTTRNXRGSPSPREELEFIADLCKENDVLLFADEVYDKLAFEADHISMASIPGMYERTXVTMNSLGKTFSLTGWKIGWAIAPPHLTWGVRQAHSFLTFATSTPMQSAAAAALRAPDSYFEELKRDYGAKKALLVDGLKAAGFIVYPSSGTYFVMVDHTPFGFDNDIEFCEYLIREVGVVAIPPSVFYLNPEDGKNLVRFTFCKDDDTLRAAVDRMKAKLRKK

SEQ ID NO: 116588 - protein, 536 aa, Triticum aestivum
  unsure (1)..(536): unsure at all Xaa locations
  Clone ID: PAT_TA_11006.pep
MGGGATTMEVRDDGVAVITISNPPVNALSFDVIASLQRNYEEALRRNDVKAIVLTGAKGRFSGGFDINGFGNKPKNEKPGSFSIDFLTGVVEDAQKPSVAAIDGVALGGGLELAMVCHARVSTPSAQLGLPELQLGIIPGMGGTQRLPRLVGLKKALEMMLMSKSIKGVEAHKFGLVDAIVSADKLISTACSCALEIHEHKRPWLKSLLRTDRLTDIVEAKKILKFARVQALKQAANLQHPLVCIDVIEEGILFGPRAALMKEVLSGKMLEQSQTSKSLRHFFFAQRATSKIPNITNLGLTPRRILKAAIVGGGLMGSGIATAFILSDIVVVLKEVNEKFLNTGINRIKANLQSFVKKGRMTQEDYEKKLSLLSGVLDYEQFRDADVVIEAVIEDLLLKQKIFSDLERSCHSNCIFATNTSTIDLQLIGQQTACQDRIVGAHFFSPAHVMPLLEIVRTQQTSSQVIVDLLDVGERXIRKTPIVGWGAALGLLXNRMFFPYGQVAGLPVDYGLDVYHIDRVITQFGMPMGPFPLPAR

SEQ ID NO: 116589 - protein, 138 aa, Triticum aestivum
  unsure (1)..(138): unsure at all Xaa locations
  Clone ID: PAT_TA_11007.pep
SKTRGKXXEAVSARTRLRRSLQNSAATCKTSALAESLGWNLEMAFPRSPDSSMSSYASTLTLSSCPSSYISIGSSNPSSFTAVAIIPTGAGDHSPALAATGAPEFIQGNKLQQHQDPPESEAKFPKQEINGWEHPDLC

SEQ ID NO: 116590 - protein, 121 aa, Triticum aestivum
  Clone ID: PAT_TA_11008.pep
QVKEWRKVHGKVVRELEKKFNGKHVLVVGQRKAVSKPADPTKEHRPRARSLAQVQERLLEDVCYPVEIVGKRTRTRVDGSKVTKIFLENKDKANFDHKIKTFNKVCKRLTGKKVSYEFANL

SEQ ID NO: 116591 - protein, 428 aa, Triticum aestivum
  Clone ID: PAT_TA_11009.pep
MGDWIIGALINIVGSVAINFGTNLLKLGHDQREKLYSSNNQSDGKFVPKSVMYFQTWRIGILFFAVGNCLNFMSFAYAAQSLLAALGSIQFVSNIAFAYVVLNKTISVKVMVATTFIVFGNVFLVSFGNHQSPVYTPEQLIAKYSNLVFVLYCMSLVFVVALSQYLYRSGETILSDNAKDTSTHWRTLLPFSYAIVSGAIGSCSVLFAKSLSNMLRLTMSSRYQFHSWFTYSILLLFLCTAGFWMARLNEGLSLFDAILIVPMFQIAWTFFSICTGFVYFQEYQVFDTLRIIMFVLGMTFVFIGISLLAPDENKADTKDGSNATKDAAIDMNSEAHVSGNCRPRKLPMEETEVDDMDSFSTSVKVKAKCILSRAKSACSMSLGLGEETISASSVLAMPMVSSRTTGFRGIQTDRSKYIPLGSTDWDNL

SEQ ID NO: 116592 - protein, 171 aa, Triticum aestivum
  Clone ID: PAT_TA_11010.pep
MMKLRCPNPKRLFRRSSSKISRSSSSCSSSSSDNGSDASGGIRGGGGSGEIEWEVRPGGMLVQRRDGRGDVEVITVRVATGHSWHEVSIGATCTFGELKVVVSMVTGLEPREQRLLFRGKEREDSDHLHMVGVRDKDKVLLLEDPALKDIKLQAALAAQAVQSPYHTFIKV

SEQ ID NO: 116593 - protein, 224 aa, Triticum aestivum
  Clone ID: PAT_TA_11011.pep
LFFQSQGRESIAAKLVANMITEAGANRVLVCDLHSSQAMGYFDIPVDHVYGQPVILDYLASKTISSNDLVVVSPDVGGVARARAFAKKLSDAPLAIVDKRRHGHNVAEVMNLIGDVRGKVAVMMDDMIDTAGTIAKGAELLHQEGAREVYACCTHAVFSPPAIERLSSGLFQEVIITNTIPLKEEKNFPQLTILSVANLLGETIWRVHDDCSVGHAPYSTLDID

SEQ ID NO: 116594 - protein, 336 aa, Triticum aestivum
  Clone ID: PAT_TA_11012.pep
EFGTRPAVLVPSFSGRWRRLVGSIAASLMRGRILRWYYLLPLHRLSRLMDLHRLHRSSSLCSENSCDLVARYSELEQKHTQVELSLKLVQEKLTKAKEETGGKVREAQQKKDLELAEKIKLADEKLASVTKLEQDNTNLKTALGIANKEVSRLRTDKAALTDQVSKLTEKKTALEAFLSGLAKKLFLMLEEFCQNFEEETSRLEPNLDPVNSPVNDEVAMDVFRLESRVAAVVDYLARLKAATSRIDSTLWPEETLQNDLESLMARLNTIPASSAGVEEVLGSVWCRCRSVSGPSPLQRCTRGEAGGSSGGQYQEARLQVLYGDFPCSCHSDRRRN

SEQ ID NO: 116595 - protein, 73 aa, Triticum aestivum
  Clone ID: PAT_TA_11013.pep
APAYLVAKLGIQCANFHRTNDVVGRSVACLAELGLLRTIHFKFRMFCKVAIWLWCFDVVYFGYSLYVCKRVNF

SEQ ID NO: 116596 - protein, 188 aa, Triticum aestivum
  Clone ID: PAT_TA_11014.pep
DCCAMWVKRPSELIAALGTEQEYILKDAASEGHDVVDYKDWTMTLTRRFRALKMWLVLRCYGVNGLRDHIRSHVRMAEAFEDMVRADERFEVVTDRQFALVCFRLRSPERFGGEKTANELNRGLLEEVNAVGPGPYMSSANVGGVYMLRCAVGSTLTEEYHVADAWKVVQDRASVILRKMEIIYSVLG

SEQ ID NO: 116597 - protein, 157 aa, Triticum aestivum
  unsure (1)..(157): unsure at all Xaa locations
  Clone ID: PAT_TA_11015.pep
MFASRPAVHPVEAPPPTDPVEQPTGVLMKDLPGMPGTAGGLALRLAQFAFAGVALGVMASTNDFPSVSAFCYLVAATILQCLWSFSLAIVDIYALLVKRCLRNRRAVCLFAIGDGITAALIFGAACSSXGITVLIDNDLNICAENHCGSFPKPRRDI

SEQ ID NO: 116598 - protein, 220 aa, Triticum aestivum
  Clone ID: PAT_TA_11016.pep
PLPPPPLRTKPSQRQPVVVFAHGAGAPSSSDWMTRWKEMVKDALDAVEAVTFDYPYMSGAKRRPPPKADKLVDHHLSVVKDAVAEHPGHPLVLMGKSMGSRVSCMVASSDDISVSAVICLGYPLKGVKGALRDEILLKLMVPTMFVQGNKDGLCPLDKLELTRKKMTCKNELHVVDGGDHSFKVSQKYQKSAGISQHDVELEAVKAIAQFVQNSIAESLT

SEQ ID NO: 116599 - protein, 136 aa, Triticum aestivum
  unsure (1)..(136): unsure at all Xaa locations
  Clone ID: PAT_TA_11017.pep
SAGYQLFPRLMVLDLFNCHKLRALPRRLGEDTASLKELRLIGTNNLKALEDFPLLSELLIIQKCESLERISNLPQVTELRVHGCPNLSHVEGVGSLQQLXLGEDMQEISSCWVXGLQEQHQRLHGDDLDIYTLSTS

SEQ ID NO: 116600 - protein, 218 aa, Triticum aestivum
  Clone ID: PAT_TA_11018.pep
DAVKQMKEKHRFKELLIMVDTCQAATLFSQLQSPGVLAIGSSMKGENSYSHHLDSDIGVSVVDRFTFHTLAFFEKLNMYSNASLNSLFNSYDPSMLLSTAYYRMDLYKRALNEVPVTNFFGSVMKTIHTDSAYTGFLAAHDAELPLSAGNNILDHVMLQNEASARRSNIEEMNEAQLMSHGWTEVLLEQLEGKNSDVVVMYGLGTMGILLAISTWLSM

SEQ ID NO: 116601 - protein, 119 aa, Triticum aestivum
  unsure (1)..(119): unsure at all Xaa locations
  Clone ID: PAT_TA_11019.pep
ILMTSQRSLLVGSPCLVIHRKEIQKSQWDTFLGNDTLFRWCSGSASTPGTTAPGSKNSGRCSSNPSAVAAASSLLSIPPPPPPPSWPTDXRXPGSRXFRGXQFSSNPPXXDWTCXTDAL

SEQ ID NO: 116602 - protein, 184 aa, Triticum aestivum
  Clone ID: PAT_TA_11020.pep
LKEIFDAIICDPPYGVRAGGRKSGGRKLLKGIIPPYTVPDEKRENHIPSTAPYSLAECVHDLLHLAARMLVVGGRLVFFYPMLREDDAAGVAKFPEHPCFKLVSSCEQILSLRYSRVLLTMVKVGPYTEEVERMGEERHQEFRENHQKWMEEGNLHTAVFSPAEHDKKPESDRGSKPKYRGKYV

SEQ ID NO: 116603 - protein, 122 aa, Triticum aestivum
  unsure (1)..(122): unsure at all Xaa locations
  Clone ID: PAT_TA_11021.pep
CVDKLHEVGLPTRPLFVCWQEGRTKKKCVVSLDSSSFDFTKLCGSGWLLDSDTLYGLARSLPRSSRRYNAENSVEHGAPINTDNPEPXQPLAFEVWQFVKEQIDPSELIQVKSKTEVPMYLL

SEQ ID NO: 116604 - protein, 64 aa, Triticum aestivum
  Clone ID: PAT_TA_11022.pep
LSLNPVVNISIYSLKHNAEHDFIQREIVPRSTTHPWPRMTTQQNPSHRPASLSSDHSYLTVPEL

SEQ ID NO: 116605 - protein, 362 aa, Triticum aestivum
  Clone ID: PAT_TA_11023.pep
MAGGSRGGFPAWMTAAAARIDLSGGAAATSGSQPPQPGPSPAVVADQELGMAERALSAASAAFISAIIVNPLDVAKTRLQAQAAGVPYYQAPQMAALGPDAILSELRCSPSCTRGIILGSEPICPPDCFQYKGTVDVFLKVVRQEGFGRLWRGTNAGLALAIPTVGIYLPCYDIFRNKIEDFTRSNAPGLTPYAPLVAGSVARSLACIACSPIELARTPMQAYKEFQPGVKPPGMWKTLLGVLSPHASSSQNVQNYRVLWTGVGAQLARDVPFSAICWSTLEPIRRKLLGLVAEDGDAASVLGANFAAGFVAGSLAAGVTCPLDVAKTRRQIEKDAQKAMRMTTRQTLGDILRSEGSKGLFT

SEQ ID NO: 116606 - protein, 179 aa, Triticum aestivum
  unsure (1)..(179): unsure at all Xaa locations
  Clone ID: PAT_TA_11024.pep
VRGSSGRVGGPAARAPSVLFFSAAAAKGERARNPNPNQFRSARPASMAASLRAAATRMLRPAVLPGEGRRLLVHTQQLSKSTRAYEEGNHALNEYRASLIQQRKEQLYVLIAGAEANSRTFLLNKSLLKDLSTQVKPRPEDPQWRKICRTKKVTNFTRSAGILVISGLTYYAXISRPEI

SEQ ID NO: 116607 - protein, 70 aa, Triticum aestivum
  Clone ID: PAT_TA_11025.pep
LSSVKKKKKKKKKKKKKKKKKKKKKGPKWPQTPSPQKNPPPYPNKDFYTYRETSKSSKIHGHPFSMYLLL

SEQ ID NO: 116608 - protein, 114 aa, Triticum aestivum
  Clone ID: PAT_TA_11026.pep
RAEQSDRLLLVVFFSSAAAAKGERARNPNPNPKQLRSARPASMAASLRAAATRMLRPAVLPRGRGVACSVHTQQLSKSTLALVGGTLSASNPAEGPGVPPSFRNPCKEKHPCTS

SEQ ID NO: 116609 - protein, 93 aa, Triticum aestivum
  Clone ID: PAT_TA_11027.pep
AALEELEKERRAAASAADEAMAKIACLRNEKALVEREAKQFREMVQQKQMYDRQVIESLQWMINKFGMQSGEPEFSSEQAVSETSEDDRDKRL

SEQ ID NO: 116610 - protein, 548 aa, Triticum aestivum
  Clone ID: PAT_TA_11028.pep
MGNQNGTPGNDYYNRFPREHPASRYADGIEDDSYSDLKKSDKPWPDADSFRPTAAGILRQGLDPTSISVLGRKTADLREHYILGRKLGQGQFGTTYLCTEISTGCDFACKTILKRKLITKVDVEDVRREIQIMHHLSGHKNVVSIKDVYEDVQAVHIVMELLPGGELFDRIQGNGRYSEMKAAEITRIVVSIVAMCHSLGVMHRDLKPENFLLLDKDNDLSIKAIDFGLSVYFKPGQVFSELVGSPFYVAPEVLHKRYGPESDVWSAGVILYVLLSGVPPFWADTQKGIFDAVLKGHLDLESDPWPKISDSAKDLIRKMLCNCPSERLKAHEVLRHPWICQNGMATDGVLDPSVISRLKRFSAMNNLQKLALRVIAERLSEEEIAGLRELFKTVDIKNRGVITFGELRKGLTRYGNELVDTEICDIMEAADTDTDVTINYEEFIAATMPLNKIEREEHLKAAFTYFDKDGSGYITVDKLQRACAEYNMEGTLLEEIILEADQNNDGQIDYAEFVAMMQGNANGGNIGLGRPTMETSLNVTLRDAAQVH

SEQ ID NO: 116611 - protein, 194 aa, Triticum aestivum
  Clone ID: PAT_TA_11029.pep
AYFGDGNIMVIDPTYKEEAVMGGRMTATINSNGDVCAIQKAGGEGVMSSVIMQCLRIASVKAADITSKIKTKVDKYTTDKALQKVKRTPALVAKEVDVPDVTMKESTHTALENQTSKAPNDGQQISEDSPAVANDEKHEAAEPMVTESNPEVKSVSNSGSAGVSDEVKESRSPESLIDAVKPKHKRKKNHHGKS

SEQ ID NO: 116612 - protein, 337 aa, Triticum aestivum
  Clone ID: PAT_TA_11030.pep
MMDPRWRPTVNEREFIEQALQSDLRVDGRRPFDFRKLKIAFGREDGSAEVELGETRVMGYVTAQLVQPYKDRPNEGTLAIFTEFSPMADPAFEPGRPGEAAIELGRVIDRGLRESRAVDMESLCVVAGKHVWSVRVDLHVLDNGGNLIDAANIAALAALSTFRRPECTVGGDDGQQVTVHDSEVRDPLPLTIHHLPIAVTFAYFGDGNIMVIDPTYKEEAVMGGRMTATINSNGDVCAIQKAGGEGVMSSVIMQCLRIASVKAADITSKIKTKVDKYTTEKALQKVKRTPAIVAKKVNVPDVTMKESTHSAMENQASKAPNDGQQISEGIHTPKEFH

SEQ ID NO: 116613 - protein, 193 aa, Triticum aestivum
  Clone ID: PAT_TA_11031.pep
GSWETRVEVLLGVARAIEYLHRGADPLVIHRNVSSSNVLLDANWTPRLSGFGSAVFQAAGVEEHGGQLVEEVVGTPGYIDPEYSGTHRVSTGSDVYSFGVVVLEALTGRPPDIYGVTLGLLVDSALPSVHNGKLRDVLDGHPALQPTPRQLEALDLVAYTASRCLCPRGQNRRLAMSDVVANLHRALQIIRSN

SEQ ID NO: 116614 - protein, 228 aa, Triticum aestivum
  Clone ID: PAT_TA_11032.pep
TPQPQVAQQQQYHNMQQVPAQMVQLQTSSPQAQSAPHVALFYPPYGSQQPACGNTEALSRGMVVQPAYSTISSSQRKHHEAAPVYVQSSAIAVPIAEHHIQHQQTQQFHSPGNGSFAPQQCKVGPYSVQGGAQAYNTVYGSPPNSAATFVAVLPQQAQQASAPMMLHHLGPQPVQNHPADMADKAARMGYLNDHAENMPRRMVAAGQPVEYNTFHDGLSSVGNAAWSG

SEQ ID NO: 116615 - protein, 172 aa, Triticum aestivum
  Clone ID: PAT_TA_11033.pep
ADGSNDENPGAVEEEKAEPAKDYIHVRARRGQATDSHSLAERVRREKIGERMKLLQSLVPSCNKITGKALMLDEIINYVQSLQRQVEFLSMKLSTMNPQLELDEQQIPSKEMNQMAVPGFSYAGSPVAVAAGHGHGAELEGTFSWEQDLQSMVQMGGASSSHRQDPQAFYGE

SEQ ID NO: 116616 - protein, 196 aa, Triticum aestivum
  unsure (1)..(196): unsure at all Xaa locations
  Clone ID: PAT_TA_11034.pep
XLHDILHNSNNKVALNLDARLSIAAHSADGLAYMHSNTNPRTAHGGGQPANILLDDNFIPKISDFGISRLIACDKEHTASIIGDRNYMDPVYLQEGLLTEKSDVYSFGVVILELISRERAIHSDNNKLVKNFLEAHMKXKKATEFFDKEIAITKDLEILESLASMAVECLSLDVDQRPTMMEVAERLLILSQSCKL

SEQ ID NO: 116617 - protein, 255 aa, Triticum aestivum
  Clone ID: PAT_TA_11035.pep
RKRPSTDFLETIQKDVNPSMRAILIDWLVEVAEEYRLVPDTLYLTVNYIDRYLSGNEINRQRLQLLGVACMLIAAKYEEICAPQVEEFCYITDNTYFKDEVLDMEASVLNYLKFEMTAPTAKCFLRRFVRAAQVCDEDPPLHLEFLANYVAELSLLEYSLLAYPPSLVAASAIFLSKFILQPAKHPWNSTLAHYTQYKPSELCDCVKALHRLFSVGPGSNLPAIREKYSQHKYKFVGKKQCPTSVPAEFFRDAAC

SEQ ID NO: 116618 - protein, 229 aa, Triticum aestivum
  unsure (1)..(229): unsure at all Xaa locations
  Clone ID: PAT_TA_11036.pep
DSRAAPHREVPHPEKSLYKNWPLMSSIIAYCVFTLHDTAYSEIFSLWAVSEKKYGGLNFSSKDVGQVLAVSGAGLLLYQIFVYRHVHKYLGSIISARNAGAQTRPQLARYPFMTHLSGTKLGLAIYXAAVIKGAFATTILTGTCILQNSAVSQNQRGAANGISTTAMSLFKAIAPAGAGVLFSWAQKRQHAAFFPGDQMIFLILNLVEVIGLVLTFKPFLAVPKQYDFK

SEQ ID NO: 116619 - protein, 46 aa, Triticum aestivum
  Clone ID: PAT_TA_11037.pep
DVFFAEIHLIWYKNNIATAMSMHSEAELFFRGFIFYLEECVVLTTF

SEQ ID NO: 116620 - protein, 196 aa, Triticum aestivum
  unsure (1)..(196): unsure at all Xaa locations
  Clone ID: PAT_TA_11038.pep
WRCSFDLERPSYFYCADTGQERYGEDDLISKAGNYGWRIYEGPLVYNPPWAPGXGNTSLKSVNVIPPIMGYSHSDVNKNIGSASIMGXGYVYRGCTDPCLYGRYLYADLYASAMWTGTETPEGSGNHPPSVISFSGCKHSPIRRDNAAGSPLPSLGYIYSFGEDNXNKDISVLASKGVXRVVRPRLGSYTCPTEIT

SEQ ID NO: 116621 - protein, 93 aa, Triticum aestivum
  Clone ID: PAT_TA_11039.pep
MAMRKEVLLVAMMLALLVAAPCGALAACEVGQLTVCMPAITTGAKPSGACCANLRAQQACFCQYAKDPSLGAYIRSPHALETLTSCGLAVPHC

SEQ ID NO: 116622 - protein, 105 aa, Triticum aestivum
  Clone ID: PAT_TA_11040.pep
ARSRPNVRTTTAMPMRKEVLLVAMMLALVVAAPGGARAACEVGQLTVCMPAITTGAKPSGACCGNLRAQQACFCQYAKDPSLARYITSPHARETLVSCGLAVPHC

SEQ ID NO: 116623 - protein, 93 aa, Triticum aestivum
  Clone ID: PAT_TA_11041.pep
MAMRKEVLLAAMMLALVVAAPGGAHAACEVGQLTVCMPAITTGAKPSEACCGSLRAQQACFCQYAKDPSLGAYIRSPHARETLVSCGLAVPHC

SEQ ID NO: 116624 - protein, 354 aa, Triticum aestivum
  Clone ID: PAT_TA_11042.pep
MAAPEYKHETETPAPSGEQPPEPVAAAAAAAGRELQPWEQHAAVINLPRYDYRASGSLLLRSHSGFLITCPIKREKSATKEAISILGEYISDASSHSSENLEPCVTEVASKKRKIFSEASEIEHSEDTNGKGDAPESTGSIEVETNSLHSDTSGNSDRTSNLSLIKLSMSGLLFFSFPTGGVHVVQMLTEVFRSLKSGKLKSPQWCHRIFPIQETCVLSETELHATVSKLFLDFIRNKEDQDEPIKFAVGYSRRGIDETVKTQKNDNNSSIQQGLMDRQQCFKVVAAAVKSVAKDAIVDLKSPEVAVLVEVLPISGVPVGSSVAGVSVLPAELVSAKPRLCVKALVSDTKTKKK

SEQ ID NO: 116625 - protein, 198 aa, Triticum aestivum
  Clone ID: PAT_TA_11043.pep
RDATYFLSNKKVYFNMTAGRYDGLVSFMNETLPNLPPPFGTVDQLKANFASKGLTADEMVTLSGAHTVGISHCSSFNSSFSDRLNPSTSDMDPTLMSSLREQCKSDTGTDNTVVQDIETPNKVDNKYYKNVLSHEVLFSSDAALMTADDTSAAVRANAKDNGVWEEKFKEAMVRMGAIDVKTSLNGEIRRNWGDVTSH

SEQ ID NO: 116626 - protein, 558 aa, Triticum aestivum
  Clone ID: PAT_TA_11044.pep
NSARATTDQTDQACRPRRLPPPRCHAPPSSSRSPPPRSRSRPRRRRARRAACGGRGSGSTGGGGGAGPSGGAGRRRWRRKPARRRTACCSPRRESEAAGRYDWREEWYPLYLSKEVPDDAALPLTVFDRQLVLYRDADGVLRCHEDRCPHRLAKLSEGQLVDGKLECLYHGWQFDGEGKCVKIPQLPEGAKIPRNACARNYEVRDSQGVVGVGGMSPATPPDAKKLPWFEPYARAGFTDLSTVHELPYDHSILLENLMDPAHVPISHDRTDWTAKREDAQPLAFEVAERTARGFAGHWWRERAPHLRNLLRFEAPCVLTNTLEFVDKDGREQCFSAQFLCRPAGQGKSMLLVRFGSTARSPLLRVLPKWYFHQNACKVFEQDMGFLSSQNEVLLREKVPTKELYLNLRSSDTWVAEYRRWMDRAGHGMPYYFGHSTISPPPVPAVVEQAPAGAAAGISASFPAKGGFGTQHAPNPTSRYFRHVVHCKGCRDSVNRYTALKKAFVVLAAVAAAAAVLAATRQWKAVLLGAAAVLAAASYACGSVVSLITTNFIRTHRRL

SEQ ID NO: 116627 - protein, 130 aa, Triticum aestivum
  Clone ID: PAT_TA_11045.pep
RGASLFPHSIRSSAPKGRSARMSDPGHHTSNGEHDAYTDSGSINGHFSGDSIGALSHYGGSSTDSPDRESMGTKETLSELDMYGSSRYEEMLLRAGGKNTDWLHSVDDKSDQSPVFDHRFEPLPEPFGPL

SEQ ID NO: 116628 - protein, 357 aa, Triticum aestivum
  Clone ID: PAT_TA_11046.pep
AATLSGEPDPDSDASESEASSAGRPAAEGSSPRDPEDEEPEEPITPSRGVKDDISELTETLTRRLWGVASFLAPPPPPPEPESSSPRAAPAEADDGEGGDVDVDGDGIAGIRSDLAEIGGRVRSGISMLQSNLAVAEISKIASSLLPFGEEEPDEGEPVAGGTEEVLVFVKHISTRPETWLDFPLFINERYADDFELSNAQYVHALSMEHLVPSLSDLKVQICSTDMSEACFWKIYFVLLHSKLNKQDAELLSTPQILEAREELLQSLQAKNKRGSETTGESSENANESSGPAEEKVIEPSIIQDKEVSISEVRSFEEPTSDITPEIEAEKFPVSTTEVEIIDKSVIEEELLSVKDK

SEQ ID NO: 116629 - protein, 466 aa, Triticum aestivum
  unsure (1)..(466): unsure at all Xaa locations
  Clone ID: PAT_TA_11047.pep
GRVGSWKGTCMAGTDFNSSACNRKLIGARFFNRGYEAAMGPMDTSRESRSPRDDDGHGTHTSSTAAGAAVADADLFGFASGTARGMAPKARVAVYKVCWLGGCFSSDILAGMDAAVADGCGVLSLSLGGGSADYARDSVAIGAFAAMEQNVLVSCSAGNAGPGSATLSNVAPWITTVGAGTLEPAFPAYVPSAAAFCSPWGDASERVLAGLPQRRLXMIVPGPDLQMSXLCFPGLLCRDKVRGKIVLCERGLSARVEKGFGVRDAGGAGMVLANTEANGQVLVADAHLLSAIVVGKKDGNIMKYYITSESTPAATIVLGGTHGELPPSPLVASFSSRGPNSSAPEILKPDIIGPGVNILAAWTGEAGPTGLAVDPRRVPFNIISGTSMSCPHVSGLAALLRXAHPEWSPAAVRSALMTTAYSRDNSGAVSPGPGRPPTRLRRRFGSRRRARRRDPRGRSRPRIRRR

SEQ ID NO: 116630 - protein, 131 aa, Triticum aestivum
  Clone ID: PAT_TA_11048.pep
EAWLIPSEKLHPNNVVGYTFWLENQLHNKKVATLHWWIIALNKCCNGAFVFRFLLTWYQKVGEQGPYISGVYTPKLQYRWCLYSKIAVSVVFRFQNLSRVICHLVFKEIAYLVPHVRFSTSGFKIYSYKYF

SEQ ID NO: 116631 - protein, 121 aa, Triticum aestivum
  unsure (1)..(121): unsure at all Xaa locations
  Clone ID: PAT_TA_11049.pep
AIELRFLFEPRKDISTCMQLTXNQTDGSVAFRVITNQAKYSVQPTKGIMAPCSKRYIYVTLRAQDAAPLNMQCNDMFVVQSTRVNDGRTSDGIADDEVMAGTAVGMVRLPIVYVGCDQVLG

SEQ ID NO: 116632 - protein, 337 aa, Triticum aestivum
  Clone ID: PAT_TA_11050.pep
QGPSSLLGIHGDSDGDGGEDATGPGNDSDSDEEDDDEDREHDSEDDNDNDNDGDEDDDNDSDEDGDEEDEHDSDSENNKLRTYELNRLRYYYAVVVCDSSTTANHLYTTLDGTEFLKTANVFDLQFISDSMEFKHPARDVATEAPPNYKEPDFETRALQHSKVKLTWDDDEPERKKKLRRKFNDEQLDDLGVFLASDSESDDDVDDSGDEPRPNGVAKRKLTNKERLALLLEGDKSDEEQTDDQDMEITFNTELEDLSKRILERKSSEKKTVWEMHQEKMKEKRKARKRSSKDDDDDDDDRNEDGADEDDDFFEDEKSDEDVKPMKKEKVKAKGKKK

SEQ ID NO: 116633 - protein, 175 aa, Triticum aestivum
  unsure (1)..(175): unsure at all Xaa locations
  Clone ID: PAT_TA_11051.pep
LPLTRGELVASETDAYAIADFINRSKAKVYTINLSMAYGQAAMLLSLGMEGKRGVLPNSITXLHLPKVHKSGGAAIDMWIKAKELETNTDYYLELVSQGVGKPKEELAEFLRGPRYLRAQEAIDYGLADTILHSLDGSFKPKDLTAQLAKAQEMRQSGKRAPAGAGRWSTPTAPR

SEQ ID NO: 116634 - protein, 259 aa, Triticum aestivum
  Clone ID: PAT_TA_11052.pep
PRHHRLWERRIRVHRRLSSEPAAATPSSALALRCPAAASPSRAPFPNSSSHSQSAARPARRPAGGCRCHYYHGDGPPRSYDHIPKQFREENLKDGLMDNYKNVPQFLYGLSPSQMEMFTTDDNPYNRQSKKVTEESVAALRSYDEFGMYSLSGTHEGPASYSMGMGMPSMSMGRAGKGYRRMRSSAPDLPSLLLDSRIIFLGMPIVPAVTELIAAQFLWLDYDDRTKPIYLYINSTGSTEEETEKNKTLVDVLVCSDIS

SEQ ID NO: 116635 - protein, 233 aa, Triticum aestivum
  Clone ID: PAT_TA_11053.pep
MTTLGFEDYVDPLKHYLHKFREIEGERAAATSTSTSTTPDMPRNNNNNATGYADAPGGMMMMGQPMYGSPPPPQQQQQHQHQIAMGGRAGFPYLGGGGGSSAPHPPPRDPAPPLPCPPPAPPPAPRPQPPRLARASRPAGGPPPAPAAAGPPAGPGHHAAGPPGAAAPAPQERPGRHREPCPRDLRGPGPHGRPASTPSPTATPETDDRPGNVRTTKGTSQSAGSRRSEAGSP

SEQ ID NO: 116636 - protein, 182 aa, Triticum aestivum
  Clone ID: PAT_TA_11054.pep
MSDEAASPPGGGGGGGGGGSDDGGGGGGFGGVREQDRFLPIANISRIMKKAIPANGKIAKDAKETVQECVSEFISFITSEASDKCQREKRKTINGDDLLWAMATLGFEEYIEPLKVYLQKYRETEGDSKLAGKSGDVSVKKDALGPHGGASGTSAQGMGQQVAYNPGMVYMQPQYHNGDISN

SEQ ID NO: 116637 - protein, 113 aa, Triticum aestivum
  Clone ID: PAT_TA_11055.pep
MLAIYYRNNMLDRLIKLFGALEACGRKCPSKEYIRKVEVAYEMLGLLEEKKDLLEKYKDLYNKPSNSDRKKDRRFKKAEKKAADDGSKQLEMETSENLPVNSCPSDKELVASS

SEQ ID NO: 116638 - protein, 134 aa, Triticum aestivum
  Clone ID: PAT_TA_11056.pep
WMQWCCLLLCVGSIWVSDGVASAWVLMAGVAVSRLGLWMFDLAVMQLMQDSVPDSDRCIVGGVQNSLQSMFDLLTYIMGIIVSDPKDFSELIVLSFLLVTCAALMYTLHVYRVRKHLLHMDKIFAKMGWCATLQ

SEQ ID NO: 116639 - protein, 102 aa, Triticum aestivum
  Clone ID: PAT_TA_11057.pep
VHLCTCASSSYDLPLMATARAAGARAPRKHFKFALAMAPSSMLKMAAVFVLALFAAQLLMATPVAAGICYETAYKWCIGNIGPTFTIVYCEAEALRICQYCQ

SEQ ID NO: 116640 - protein, 478 aa, Triticum aestivum
  unsure (1)..(478): unsure at all Xaa locations
  Clone ID: PAT_TA_11058.pep
MGLAPPLRTTVLLLLFLLAASSQAEAAQAAEDAVPVLSAKKRIDLTGPIVKVFLTLKAQNTAPGADASHVLIAFTPAQAEHLAIVKTTRAEGRRKKKAYIPLPVTPADPATAAPNGARLYSISLPIPLKPAETIXMEVFYVLAHSLAPFPAEITQSESQLVYYRDSAVILSPYHVQEQGTYVKTPSSRXVESFTRADPTSRSGPDVKYGAYSNQLPYAYSPIILHYENNHAFAVVEEFVRKVEISHWGNVQVTEHYKLKHGGAKHKGVFSRLEYQARQSISGASSFKNLLARLPPRVHSVYYRDEIGNISSSHLRSDSYKSELEIEPRYPLFGGWHCTFTIGYGMPLQDFLFESADGRRFANLTFGCPLLNTVVDNLTIKVVLPEGSKSPQAVVPFETEQHLETSYSYLDVVGRTTVVIKKKNVVGEHNVPFQVYXEFRPMFMLAEPLMLVXAVLLLFAACIVYLHTDLSIAKSQASY

SEQ ID NO: 116641 - protein, 238 aa, Triticum aestivum
  Clone ID: PAT_TA_11059.pep
RHEGFNEAGVEVVVKAAQRKEREMATVEPGFKKQLSKEEKFEKKKQRLAAIGEDLLAIAADQPFRFPATFTFVVRAFSVLDGIGKGLDPRFDITEIAKPYAMELLRFNEAGVEVLVKDARKRWDRQSRAFYNVFRQPDRVEKLAQIIERLEQGDLKLRVRALESERSFQRVAAVQKTIGYGVAAGSLVNLATILHLNSIRMPATIGYCLCAFFGLQILLGVLKVKKLDQQERLITGTA

SEQ ID NO: 116642 - protein, 274 aa, Triticum aestivum
  unsure (1)..(274): unsure at all Xaa locations
  Clone ID: PAT_TA_11060.pep
MSPAADSASGSKRQAELLKQEGNTCFKKDRISAAIDAYTGAIALCQNVAVYWTNRALCYKKRNEWAKVEEDCRMAIHYDSHSVKAHYMLGLALLDRQELAGGIKALEKSLELGRGAHPXSYMVEEIWQELSKAKYIEWEGLSKMRSSQLHKLNATCKEALKSYNSLDNPTGDMSEEHLNELDEVFKKAAKADTPTEVPDHLCCKITLDIFRDPVITPSGITYERAVILDHLNRVGKFDPVTREPLEPFQLISNLAVKEAVDVFLKEHGWAYKIR

SEQ ID NO: 116643 - protein, 159 aa, Triticum aestivum
  unsure (1)..(159): unsure at all Xaa locations
  Clone ID: PAT_TA_11061.pep
MADEAKAKGNAAFSAGRFEEAAGHFSDAIALAPANHVLYSNRSAALASIHRYSDALADAEKTVELKPDWAKGYSRLGAAHLGLGDAASAAAAYEKGLALDPSNEGLKAGLADAKKAAGAPPRRAPSGGADAIGQMFQGPELWTKIAXDPATRAYLDQPD

SEQ ID NO: 116644 - protein, 311 aa, Triticum aestivum
  Clone ID: PAT_TA_11062.pep
TANLHYTKSLELDDEDISYLTNRAAVYIEMGKYDECIEDCDKAVERGRELRADFKMVARALTRKGTALAKLAKNSKDYDIAIETFQKALTEHRNPDTLKRLNEAEKAKKDLEQQEYYDPKLADEEREKGNEMFKQQKYPEAIKHYNEAIRRNPKDARVYSNRAACYTKLGAMPEGLKDAEKCIELDPTFTKGYTRKGAVQFFMKEYEKAMETYQAGLKHDPNNQELLDGIRRCVEQINKANRGDISQEDLQEKQSKAMQDPEIQNILTDPIMRQVLMDFQENPRAAQDHLKDPGVAQKIQKLINAGIVQTR

SEQ ID NO: 116645 - protein, 128 aa, Triticum aestivum
  Clone ID: PAT_TA_11063.pep
LGGAREAGGDGGVVHGIVEALRLHHPRPQLPRLLLRQAAHERPPRLLLLLRRHRHRHRRRRCRGLDVVRPPRPAEQWRPPLASLGGYRRADPPGAHGARGGSGAGPESRSRRWAGGEGDGGCRRCHVH

SEQ ID NO: 116646 - protein, 181 aa, Triticum aestivum
  unsure (1)..(181): unsure at all Xaa locations
  Clone ID: PAT_TA_11064.pep
KNIKDSPQQPRGDPERKRYVQRLRVGELVCWWPDLLGGAGEAGGDGGVVHGVVEALRLRHPGPQLPRLLLRQAAHEGPPGLLLLGHRRRRGLDVVGLPGPADQRRPPLASXGVSPREPALLRPRPRRRRRVAGPSRDGRRRRRRTRSVPWPSVSSVGTLRFCCVTLLCFGERLVKCDETVG

SEQ ID NO: 116647 - protein, 166 aa, Triticum aestivum
  unsure (1)..(166): unsure at all Xaa locations
  Clone ID: PAT_TA_11065.pep
NIKDSRQRPRGDPERKHYVQRLRVGELVGWWLVLLGGAGEAGGDGGVVHGVVEALRLRHPGTQLPRLLLRQAANEGPPGLLLLGHHRRRGLDVVGLPRPADQRRPPLASLXAPPREPARLPPRRRRRVAGPSRGGRRRRRRTRSVPWPSVSSVLVRFGRKLLRLGG

SEQ ID NO: 116648 - protein, 142 aa, Triticum aestivum
  unsure (1)..(142): unsure at all Xaa locations
  Clone ID: PAT_TA_11066.pep
EERGEAGGDGGXVVHGVVEALRLRHPGPQLPRLLLPSXAHVRPPGLLLLGHHRRRGLDVVGLPGPADQRRPPLRLPGVVPAGTRPAPGGGXRVAGPWRGARRRRRPTRSRPWPWVSSVGTLRFARKLWLGCWVLCWGGSMRR

SEQ ID NO: 116649 - protein, 165 aa, Triticum aestivum
  Clone ID: PAT_TA_11067.pep
PPLPSGSRFCALLSPKSAMARLALLSVFFFLLIITGLVAAAPSSGKVGKKVTMTVQFPPADSPPGEMITISTHYVREDGVHDSHVHVDCDDHEPQLGSAAKYLVRSLEKIRDEEASPSEAYNMPSQWMDVLFELVSGKIRRDLLYYRSIVSARSSFARANNQSVY

SEQ ID NO: 116650 - protein, 374 aa, Triticum aestivum
  Clone ID: PAT_TA_11068.pep
SNECDELSIPAHLMTGTSQELFDFIAAALAKFVASEGEDFHLLEGRQRELGFTFSFPVKQSSIASGTLIKWTKGFSIDETVGADVVAELSSALDRQGLDMKVTALVNDTIGTLAGGRYDDNDVVAAVILGTGTNAAYVERANAIPKWHGLLPKSGDMVINMEWGNFRSSHLPLTEFDQALDTESLNPGEQIYEKLISGMYLGEIVRRVLLKMTEEASLFGDDIPPKLKIPFILRTPHMSMMHHDTSADLRTVGAKLKDVLGIQGTSLKTRRLVVAVCDIVAKRGARLAAAGIHGVLKKLGRDIPGSDKHRTVIAMDGGLYEHYTIFSETLENTLREMLGEEVSSSVVIKLANDGSGIGAALLAAAHSQYLEAEV

SEQ ID NO: 116651 - protein, 377 aa, Triticum aestivum
  Clone ID: PAT_TA_11069.pep
MATSHFLAAAAATSSSSAAFRPPLRFLSLPPPSLTLSRRRPFPVVCAADADAKETTKPKVPEKAPAAGSSFNQLLGIKGAKQEDNIWKIRLQLTKPVTWPPLVWGVLCGAAASGNFHWTVEDVAKSIVCMLMSGPCLTGYTQTINDWYDRDIDAINEPYRPIPSGAISENEVITQIGVGWVPGLGLGALLDVWAGHDFPIIFYLALGGSLLSYIYSAPPLKLKQYGLGGNFALGASYIGLPWWAGQALFGTLTPDIVVLTTLYSIAGLGIAIVNDFKSIEGDRTLGLQSLPVAFGMETAKWICVGAIDITQLSVAAYLLSTGKLYYALALVGLTIPQVILQFQYFLKDPVKYDVKYQASAQPFFVFGLLVTALATSH

SEQ ID NO: 116652 - protein, 375 aa, Triticum aestivum
  unsure (1)..(375): unsure at all Xaa locations
  Clone ID: PAT_TA_11070.pep
MPSSYAAAAAAASSSRKPAPFTTATATTRKPAPLPAPAPPPSNPSHVSDSDPSSYSSSGEETDLSACDPATASVLSTYLSVAGXGADLSKVGIFLNSAARRRSPPCLICLDPIRPSDPVWSCSASCFALLHLPCIQSWAHQSASAAPSPTWGCPKCRVAYPKSQTPTSYHCFCSKTEDPPADPWILPHSCGDVCGRRLNSNPDSGCEHTCLLLCHPGPCPPCPAVVPNARCFCGAHRRPRRCAHQRYSCKGKCNKRLSCELHRCPVDCHDGPCPPCAVRGNHKCECGETMVERLCSERVFQCKRECSGMLECGKHMCERGCHGGKCGECPLRGQRTCPCGKKDYSRLECYVEAATCGSTCEKVLGCGLHKFPERC

SEQ ID NO: 116653 - protein, 62 aa, Triticum aestivum
  Clone ID: PAT_TA_11071.pep
FGTRVKTDLRFQSSAVSALQEAAEAYLVGLFEDTNLCAIHAKRVTIMPKDIQLARRIRGERA

SEQ ID NO: 116654 - protein, 93 aa, Triticum aestivum
  unsure (1)..(93): unsure at all Xaa locations
  Clone ID: PAT_TA_11072.pep
KATCDLKDMIDCGFCYPSFSIVMKMLLARHSLFYSFRTKFALGLSNIVPARAPGDAVFLLTGGRYGWCPRLGSALGVIFRNIXIIERSNKKNQ

SEQ ID NO: 116655 - protein, 210 aa, Triticum aestivum
  unsure (1)..(210): unsure at all Xaa locations
  Clone ID: PAT_TA_11073.pep
AQHSERGTAEQGRPGGIREGVAVVVAVALEGAGAAAARGRRRVVSSSSDEPCNEMTLYYHDILYNGVNNTXNATSAAATKPTALSTTHWKNGTYFGMLVVFDDPLTEGKTLPVGGEEXAARAQGFYFYDKQESSTTGXGLPLVNPSTAGPGPMGRVGADLMDDKTRDLSVVGGTGDFFMARGIATLRLDASEGAVYFRLQMDIKLYECYV

SEQ ID NO: 116656 - protein, 185 aa, Triticum aestivum
  unsure (1)..(185): unsure at all Xaa locations
  Clone ID: PAT_TA_11074.pep
DLLFFLHVRRTGGRTYFHCFLKKLYTNAQECPRSYDKLRFDPSHPDCTLVVSHDDYSLTSKLPRERTSVVTILRNPVDRVFSTYEFSVEVAARFLVHPNLTSAKTMTSRVLTKSRAVSTLDIWPWKYLVPWMREDLFSRRDARGNDSVPSSKKINAYDVEDMVMPLHQYINDPXVAHEIIHNGAT

SEQ ID NO: 116657 - protein, 141 aa, Triticum aestivum
  Clone ID: PAT_TA_11075.pep
QASKKLDLWRLPEVLVIHLKRFSFSRSTKHKLETFVNFPIHDLDLTNYIANKIPQRQTYELYAVSNHYGSMASGHYTAYIKLLDENRWYNFDDSHVSAINEEEVKSGAAYVLFYRRVGEADGAASNGTQSCVKRSRRSSQR

SEQ ID NO: 116658 - protein, 174 aa, Triticum aestivum
  Clone ID: PAT_TA_11076.pep
MERATPVRSPHTSTADLLTWSATGADASAASPAAPSRPSLKPAGGITPAMFGAPVSEHEAEDLSNSERRLMSGSKMKEMTGSGIFAEKNENSDSESSNPANRTSVRMYQQTVTGVSQISFSADGSVSPKKPSSIPEVAKQRELSGTFETDAEAKINKQLSEAKNKELSGSNIFG

SEQ ID NO: 116659 - protein, 295 aa, Triticum aestivum
  unsure (1)..(295): unsure at all Xaa locations
  Clone ID: PAT_TA_11077.pep
MERATPVRSPHTSTGALTCGRRRAPTPPPASPAAPSRPSLKPAGGITPAMFGAPVSEHEAEDLSNSERRLMSGSKMKEMTGSGIFAEKNENSDSESSNPXTQTVTGVSQLSFSADGSVSPKNPSSIPEVAKQRELSGTFETDAEAKINKQLSEAKNKELSGSNIFGPPPETPARPLAARNMELQGNVDFALPQRRSVHTSVKVSNPAGGPSNITFSEDPVAKTAKKIHNQKFQELTGNNIFNEDAPPGSADKSLSSAKLKEMSGNDIFSDGKASSRDYLGGVRKPPGGESSIALI

SEQ ID NO: 116660 - protein, 178 aa, Triticum aestivum
  Clone ID: PAT_TA_11078.pep
LGNETGQPYTIHTNVFADGVGAKEVQFYPWFDPTADFHNYTIFWNPSMIVWFVDSIPIRVFRNYASKGVPFPTKRPMYGFSSIWSADDWATQGGRVKTDWAKAPFVAEYDNMGLDVCECLSTDAECAARCNKDTPPEPSQLTKEQMRQLRAVQLGYTIYDYCVNGKGPVPPECSMPQY

SEQ ID NO: 116661 - protein, 170 aa, Triticum aestivum
  Clone ID: PAT_TA_11079.pep
GRLPSVSGMALCRKFPSPRHLHLHGRAPLRAAKRVVLARARSRAAQLVRKCGSFSFESSCVCWTRCSMDGDAVQLIGGVRVIRASTRGTPSVTCSGDFGLLPARAAGQRRGPLRAAKRVVLARARSRATQLVRKCSSFSFESSCVCCVVCWTRCSMDGDAVQLIGVVRVI

SEQ ID NO: 116662 - protein, 63 aa, Triticum aestivum
  Clone ID: PAT_TA_11080.pep
KNRFFKFYNFFFFYYFFFFFFLFFFFFFFFFFAIFFDVTFFFFYCLTPEQRSGKNGSSSHLRF

SEQ ID NO: 116663 - protein, 336 aa, Triticum aestivum
  unsure (1)..(336): unsure at all Xaa locations
  Clone ID: PAT_TA_11081.pep
WIPRAFSARAHPSRRGFRLSGLPPHALRLQIDEDYSANTPPSRRFHVPDVLLPDVDSRALHLSKPKTVGGASTVALSADLDVVVKHDPFELVRRRAGSGEPVLSFNFHGLFDFEPLQELKPEGETWEEQFRSHTDTRPRGPQSITFDVSFYGADFVYGLPEHGSTSLALRPTRGPGVEESEPYRLFNLDVFEYLHESPFGLYGSIPFMIAHGXQSASSGFFWLXNRGRCTXDVLGTXGXXGPXXKRXNGKKLXPXXWXEXAWXWLNAVPFLXGSXPXRXXXQASTFSGYKXXPSXPQXIXKWDFXXCXRXNYREPRRXLLEXNPGFDDXEIXYKAF

SEQ ID NO: 116664 - protein, 135 aa, Triticum aestivum
  Clone ID: PAT_TA_11082.pep
SFPCSSTAHRRFGLRRRRQGSGRRKDSEGTSQRCAQGGNDSSRQPSKEPHGEDERLRPLRPDSSVLQASLQAYTSLMDMTAALLLHRVIYMVKLINNIYTYLHIYVYISIEIWWLYQYGSQSSEACNGLLSALLT

SEQ ID NO: 116665 - protein, 104 aa, Triticum aestivum
  unsure (1)..(104): unsure at all Xaa locations
  Clone ID: PAT_TA_11083.pep
WDLKTKVPEQCKVSKIKLPSYFMEWTNLKDIXLTFYXEEQXGMMPMMRELQIPIVGSHHLGIDDAKNITRVVQRMLADGAVIQITARRQPDTSDVKFLFKNRIR

SEQ ID NO: 116666 - protein, 128 aa, Triticum aestivum
  Clone ID: PAT_TA_11084.pep
RNLVLRHLRLAASPASSVALRPAAALQGALSGRRWMSSEDAKGSFLDKDEVTERTIKVVKNFQKIDDPSKVKADAHFKDDLGLDSLDAVEVVMSLEEEFGFEIPDNEADKIDSIKAAVDFIASHPKAK

SEQ ID NO: 116667 - protein, 134 aa, Triticum aestivum
  Clone ID: PAT_TA_11085.pep
MAAAAARNLVLRHLRLAASPASSVALRPAAALQGALSRRRWMSSEDAKGSFLDKDEVTERTIKVVKNFQKIDDPSKVKADAHFKDDLGLDSLDAVEVVMSLEEEFGFEIPDNEADKIDSIKAAVDFIASHPKAK

SEQ ID NO: 116668 - protein, 99 aa, Triticum aestivum
  Clone ID: PAT_TA_11086.pep
HDVNSVWKIADTALKCTAQKPGERPTMTDVVAVLHECLELEAAHDNGNAGFYTPGSGGSMNDYGRYDTGMSTDLSQSSTAFEQEHLGSVSILSTGPAVR

SEQ ID NO: 116669 - protein, 466 aa, Triticum aestivum
  unsure (1)..(466): unsure at all Xaa locations
  Clone ID: PAT_TA_11087.pep
LLPRAATSRKSPPALPFRPAQAAAEAPCRPPLPPRQTPAPARGPAMARRRPSETDPARLMSTEDIVRATRLLDNEVRVLKDELPRNNLESRKRXNRNKENQEKIKLNQQLXPGNIVEMLEMLDGFNTEXEAEDDGNIHLDSQRKGRCVVLXTSTRKTIFLPVIGLGDPEXLRDLAGVSRDNFLILDMIPSVXKYDSRLXAMEGDERGSWNYNAMGGLXEVIHELVEAVVMPMTHKEQFQKLGIRPPKGVLLYGPXGTGXKTLMARACAAQTNATFLKLAGPHLVQMFIGDGANLVRDAFELAKEKAPCIIFIDEIDAIGTKRFDSEVSGDREVQRTMLELLNQLDGFSSDERIKVIAATNRADILDPALLRSGRLDRKIEFPHPTEEARARILQIHSRKMNVHPDVNFEELARSTDDFNGAQLKAVCVEAGMLALRRDATEVIHEDFNEGIIQVQAKKKSSLNYYA

SEQ ID NO: 116670 - protein, 154 aa, Triticum aestivum
  Clone ID: PAT_TA_11088.pep
GSTQEYWGRQDAAQAIALVLWKGLGLEEGNAVGTWLGSGEKVLLGIGGGHYAPRHTDIVIKDGVWVGHLLSGYSLPMDAPPQVNGKSSGEVGGMWKHSIKVSYEATKAGFPGGEVIAHLDQKSFKGWQKNAITSYLQEQNIRIGKPNDFLCTKT

SEQ ID NO: 116671 - protein, 259 aa, Triticum aestivum
  Clone ID: PAT_TA_11089.pep
GGEKQTGGGGESEKMVVLVVATASDPASIGPAAAFLAMPGWSPGPPIPEGMESFTNGNVRLLKHERSIVAEDDLDRRWQEATGEAVSEVIFLSKHTAVSNRPALTVHPIGVPHLREDETPPQGGRPGWAAVPNPRIGPWFRLMQKVAADQGLVPEFEITLEATHHGPLTSTPTMFVEIGSTQEYWGRQDAAQALALVLWKGLGLEEGNPVGTCWGVVKGSLGFGGGTTPLSTDLASKGVGGASLSVLFAWTSPNNEKIL

SEQ ID NO: 116672 - protein, 412 aa, Triticum aestivum
  Clone ID: PAT_TA_11090.pep
VDVAAAAEEDDRRGVVLDGSPPPIVLVHGIFGFGKGRLGGMSYFAGAEKKDDRVLVPDLGSLTSIHDRARELFYYLKGGQVDYGVEHSQVYGHTRFGRIYDTGHYPVWDEQNPVHFVGHSAGAQVVRVLHQMLAEKAFPGHDTSEDWVLSLTSLSGALNGTTRTYYDGMLAEDGRSMKSICLLQLCRLGVIVYDWLDIPWLKNYYNFGFDHFEMSWRKVGFSGLVDLLLGNTGPFSSGDWILPDLTIQGSLKINSTLKTFPNTFYFSYATKRTRKLFGITVPSSVLGVHPMLFLRVLQMCMWRHPQNAPLPYKGYRDEDWEDNDGALNTISMTHPRIPIEHPNRFVVDDSDCNPLQPGIWYHKIIEGDHILFIVNRERAGVQFDLLYDGIFERCRKHAFRKSPPTMPNEASH

SEQ ID NO: 116673 - protein, 143 aa, Triticum aestivum
  Clone ID: PAT_TA_11091.pep
HGVPDYFSLQLLKSNNGMVSTLATTSEVKKDYSYDVQNDDEKVTLVTKVVTSTVTATVGDSEPLAVYAVSKFLKPKELFKVAQAPTPAPSKKGKKEAGDDDDSSDDEDSDDATTDKGDAAPAVYGRWATAAATAGAVLALLMG

SEQ ID NO: 116674 - protein, 235 aa, Triticum aestivum
  unsure (1)..(235): unsure at all Xaa locations
  Clone ID: PAT_TA_11092.pep
MGSRLVLFGALALLLAGSFGAAQAAPAVVVGSVKCLDCSPDDVSAEDALKGLQVAIKCRSGAGETYETQTVGQLDDKGAFSVPLQAGLLREDGELDRDCFAQLHSAPDTPCDGPAPPRIAPAKSTTQSVADAPHTYLAVREDTFFSPLVCXERRKRSFMVSPPPPPPPRPEPSYGPPTPTPTPTPTPSYGPPSTPKPPAPEDDPKPFFHKHPKMKKMMHKKKPCPPLGEEDKPKN

SEQ ID NO: 116675 - protein, 246 aa, Triticum aestivum
  Clone ID: PAT_TA_11093.pep
GGRFEARPVPGRSVRGRVGFRHIAAALLFLVTAASTAGASTYYASDPNLGSARVIFQLNHGDIEFGFFPRVAPKTVEHIFKLVQLVCYNTNHFFRVDKGFVAQVADVMGGRKAPMNKEQEQQAEKSIVGEFSTVKHVRGILSMGRYSDPDSASSSFSILLGDAPHLDGQYAVFGRVTKGDDTLRKLERLPTHKEGIFVMPIERIEILSTYYYDIDVESCEAEKSILKRRLSESASEVERWRRKCFA

SEQ ID NO: 116676 - protein, 146 aa, Triticum aestivum
  Clone ID: PAT_TA_11094.pep
VRKKVRSGGIEPGIRAEVWPFLLGVYDLNSSEEERNTIRAKKRKEYEKLRRQCQHILNGYRGSGLKSINEVNNEECSAQGSGAEGSESPCFEDVNVEKASRSLEEPKPEHSEAEQLEITMCDDVIESMEEDTSELIDAYPCIVELE

SEQ ID NO: 116677 - protein, 199 aa, Triticum aestivum
  Clone ID: PAT_TA_11095.pep
SRVDKLIKLRGELNPLQEASGGKKISINDLVIKAAALALRKVPECNSSWMNDFIRQYHNVNINVAVQTEHGLFVPVVRDADKKGLGTIGEEVKQLAQRARDNSLKPQDYEGGTFTVSNLGGPFGIKQFCAIINPPQSAILAIGSAEKRVIPGSADGQYEFGSYMSVTMSCDHRVIDGAIGAEFLKAFKGYIENPTTMLL

SEQ ID NO: 116678 - protein, 225 aa, Triticum aestivum
  Clone ID: PAT_TA_11096.pep
MQILVSVFSVSPPFHAPPEATLPLPLRSNRPPMAFASSLLPAPASGVRASHAPELAFPPVNRKGGVSLRRRGARHGVRAEVNESASALAIDALSQVKHVLLPITDRNPYLSEGTRQAAATTTSLAKKYGANITVVVIDDKPKESFPEHDTQMSSIRWHLSEGGFTEFGLMERLGEGKKPTAIIAEVADDLELDLVVLSMEAIHSKQVDGNLLAEFIPCPILMLPL

SEQ ID NO: 116679 - protein, 160 aa, Triticum aestivum
  Clone ID: PAT_TA_11097.pep
MVSHLKMLLVLIVVTLAVHRHCEAQHAFDPADPWYNPRRDIYLDVGTASVRDYQTALYHLNFYLLDGCRNFVDGHGVLARQEGEDMPPPFWIFFHLTGRDQDTVIFAIRSDNLYLAGFTNNLDVWHVFSNRARFNLIRPAQVLRFRDDFGSLVGGTQNFS

SEQ ID NO: 116680 - protein, 53 aa, Triticum aestivum
  Clone ID: PAT_TA_11098.pep
RPRTRGRITAAKTKTGTTILTSKVSCGLRHGENRSTSSAATLHSPDHGASVRG

SEQ ID NO: 116681 - protein, 106 aa, Triticum aestivum
  unsure (1)..(106): unsure at all Xaa locations
  Clone ID: PAT_TA_11099.pep
MRQSRFKRICVFCGSSQGKKRSYHDAAIELGNELVARGVDLVYGGGSIGLMGMVSQAVHDGGRHVIGVIPKTLMTPEISGETVGEVRAVADMHQRKXEMARHSDPS

SEQ ID NO: 116682 - protein, 105 aa, Triticum aestivum
  unsure (1)..(105): unsure at all Xaa locations
  Clone ID: PAT_TA_11100.pep
EDTRXPRAPXXTTRTVAPLXRTTPTDVEPRAADLPRALGSSRSSSASRPCSSAAPRRRRTPTWSSAPSSPTTRARSSVSSFSLCRTSTPCTIRAYVLFKIRVSER

SEQ ID NO: 116683 - protein, 201 aa, Triticum aestivum
  Clone ID: PAT_TA_11101.pep
MGSGTEPAKGLLPYLQRADELQKHEPLVAYYCRLYAMEKGLVIPQKERTKMTNSILVSLINQLEKDKKSLTLGPDDHLHLEGFASSVFAKADKQDRAGRADINTAKTFYAASIFFEILSQFGELQPDLEQKQKYAIWKAAEIRKALKEGRKPEAGPPGGDKDEAPASTTTIDHDMGQSPSSRLQPKTCQLPWSTRGARCIP

SEQ ID NO: 116684 - protein, 188 aa, Triticum aestivum
  unsure (1)..(188): unsure at all Xaa locations
  Clone ID: PAT_TA_11102.pep
FTAASCRVRTAPLLFVLAFCPTSLACSSLHSSCFCTTLALHHPGPSSYLLGGHVVGVLPVAPGRSPLLHATPDPPGASSAGSSVVRRGGPPCSATRRATRARRPGRPPPVLSCAGPGPERRPGRALGPPAFVLQHLDALGHGQNAPRAPPRAARRPGRPPAAAPPAPARSRVPLHGQHAGLAAGARQX

SEQ ID NO: 116685 - protein, 103 aa, Triticum aestivum
  unsure (1)..(103): unsure at all Xaa locations
  Clone ID: PAT_TA_11103.pep
AGHSDEFLIIPRNSIPAGPANCFRKLKPEQXTKAGGGFSPSSASNLQGPAALRXPKGKQSLSRLXVPNTLASVNQSXLFLSVPPVQFKGFPLXGLRFSXXAGP

SEQ ID NO: 116686 - protein, 199 aa, Triticum aestivum
  unsure (1)..(199): unsure at all Xaa locations
  Clone ID: PAT_TA_11104.pep
VRSRCISSLSARSAPRRAPSPGEEGTRSTKPPPLRYSRSTPLRSPSPPPPPPPLQRQEAEEMKPKSLPFIAFEHKRDAYGFAVRPQHLQRYKEYAGIYKEEEEERSDRWKNFLERRSESSGHDAKVALSADKVESAVEENSENGSSELLHERSAQGTRKVEXWEPIXSSLGXXXHVMGLXXXKKFILLARLKKSTFIQP

SEQ ID NO: 116687 - protein, 269 aa, Triticum aestivum
  unsure (1)..(269): unsure at all Xaa locations
  Clone ID: PAT_TA_11105.pep
MDTNAGSFVAVRRLAGSDRAAGAVAFHHSSSXEVVTGSTAWIGRGLSCVCVQSRDSDARLSFDLTPVQEECLLRLQNRIEIQYDSSNIEHQEELKALWCASFPGTELRGLISEQWKEMGWQGKDPSTDFRGGGFISLENLLFFARNYPKSFQELLRKQNGDRAIWEYPFAVAGVNITFMLIQMLDLQAVKPRSLLGAVFLKLLSENDRAFDILYCITFKLMDQQWLDMHATYMDFNTVMKSTRRQLERELVIEDIQRVEDMPSYKLLAR

SEQ ID NO: 116688 - protein, 213 aa, Triticum aestivum
  Clone ID: PAT_TA_11106.pep
MEADGAASAEAKPLTPEEEALRRNTDCVYFLASPLTCKKGNQCDFRHSEGARMNPRDCYYWLNGNCLNPKCSFRHPPIDGMFGASTPGIPAVSSHYAAYNSGKQMVPCYYFQKGNCIKGDKCPFSHGPQPAGNNPPEQVAKVSSFPLEHPQTQKNEFLGVKEFAQTNHLIQQGGPIIGDRSKSVNRAAANFARTAAAAIPADLASSAVKSLPK

SEQ ID NO: 116689 - protein, 320 aa, Triticum aestivum
  unsure (1)..(320): unsure at all Xaa locations
  Clone ID: PAT_TA_11107.pep
MVGWLKALVYGAGGMAVVGLAALVALQERLVYVPVLPGLPRAYPINPSRFRLIYEDVWLRAADGVRLHSWFLRHSATCRGPTILFFQENAGNIAHRLECVRQLMQXLMPLLLCNVFKLSXYRAYGDLLRLSFPKVAPQALHHLLLIIXIDTSRIVIFGRSFFGDVGAVLAKNNPDKVSALILENTFTSILDMAGIMLPFLRWFIGGSSDKGPKLLNCVVRSPWSTLDVMAXVKHPILFLSGLQDELVPPSHMRMLYDKAVEHNRNCRFVDFLNGMHMDTWISGGDRYWXTIEGFLDRYSPEVQSSDASCTSEIADDDNAA

SEQ ID NO: 116690 - protein, 88 aa, Triticum aestivum
  Clone ID: PAT_TA_11108.pep
QCDAETYKNSKSCILAMCVEMTKKLQWPITSGRKPRWTIKTISLQGLKVILNTDHITCNVRIKGNAFSMFSMHHRSANPTRPPTRPRT

SEQ ID NO: 116691 - protein, 315 aa, Triticum aestivum
  Clone ID: PAT_TA_11109.pep
SDRPGVCAGVSAVSLRAPPPASPSGLPPPRRRRPWWPALGGMEVWILGLVVCECLSLANKVELRFGSCLGGCSTLPWGHAGGEKAEARMIPGSGSFGGFPQPDPWRSLGPSGFVPTSPPFSCCNKFQYGAPDALLPRSVLTTMVVGREIEQQEMYMPTTCRRPRCYLPPLDAAKVVDEEGWGSTELKIDGRVRAHQQRILWWSYGACSRLPVFIDPLLLLVEGRPTPFLLACMPYGRQFQFSFRGYGMHVLHPWRSRRPKWFVPGDGEVQSEQRLPRTRLRFNLSARGSPCKSLGLCCNLSFSFGPDVKCALKLI

SEQ ID NO: 116692 - protein, 126 aa, Triticum aestivum
  unsure (1)..(126): unsure at all Xaa locations
  Clone ID: PAT_TA_11110.pep
LQRISSLHPDDASTTPYKLKFKRGKIVELTPDSNGPRRLIFRRRAANEVANGEGQLVRRIFKRNTRNNGVPTEPDLESPSVKLRHQDTQDKKDAQGLFNNVIEETASKLVEXRKSKVKALGGCFKQ

SEQ ID NO: 116693 - protein, 158 aa, Triticum aestivum
  Clone ID: PAT_TA_11111.pep
GDAPKAIVFSQWTGMLNVLELSLNSNFINFRRLDGSMSLDDREEAVQEFKADPAVRVMLMSLKAGNLGLNMIAASHVIMLDPWWNPYAEDQAVDRAHRIGQTRPVTVTRFTVNDTVEDRILALQAKKREMVASAFGDEKTGGIATRLTVEDLGYLFNI

SEQ ID NO: 116694 - protein, 97 aa, Triticum aestivum
  Clone ID: PAT_TA_11112.pep
DDAYRVDYLSSYMGSTLDAIRNGVNVRGYFAWALMDLFELLAGYESKYGLYRVDFDDERRPRQARLSARWYSSFLKKNGSSIRVPRVQEDLRLTTIF

SEQ ID NO: 116695 - protein, 226 aa, Triticum aestivum
  Clone ID: PAT_TA_11113.pep
AVPTATMKPEIGTEVTDHVVLEGSIAKEVGPAVESGHDPVAASAAPHPPAPATSRGRKTQAVETPRRRGRKPKSLFSSSAGDININPVVAIGSGPASVGSPYPQGDMPASLMSRFQKDLVTGRPVTSLPEGVKGISAPESTTPVAEDKHTGTAISSDNANLLMPKIIHNENVGFVQASSEQVFSASVPTLTAVSGGILKASHILLADKPAEKQSASRRRRKKAPGG

SEQ ID NO: 116696 - protein, 256 aa, Triticum aestivum
  unsure (1)..(256): unsure at all Xaa locations
  Clone ID: PAT_TA_11114.pep
FMSLQAHKEERFLYPIYPLICVAAASVIDSFPYFFHDKYANEQSIFEKIAKGLRPLILGFILCTSHSRTFSMLNGYGAPLQIYQHLEYHEDTGPGSILCVGSEWHRYPSSFFVPSYISEVRWIDDGFRGLLPFPFNETLGGTTAAPSYFNTKNKXASDKQYLKDIGSKQTYWMGXLDLRGPYPSRGNDLSTWETLASLPFLDRQLSPALYRSFFIPYQWEHKNVFGLYKLLRRLPTDQGQLKANSSGGHAAFASVS

SEQ ID NO: 116697 - protein, 292 aa, Triticum aestivum
  unsure (1)..(292): unsure at all Xaa locations
  Clone ID: PAT_TA_11115.pep
MSAARTVRGHVGAAPPGMGEPSAKKKRGRPRKYGPDAAMSLALVTVPTAAGSPAVTQGASGRPFSPTLPGNFVPSASPDGGKKRGRPKGSTNKPRVDGAGPAGVGFTPHVLTVQAGEDVSSKIMSFSQNGTRAVCVLSANGSISNVTLRQTGTSGGTVTYEGRFEILPLSGSIFVTDNGQKRTRTGGLLVSLAGAAGGLLGXSLNAGLLIAASPIQIVVGSFNACGKKEPKPQAPSEPVPLKVVPSTGMAANSPPSRGTLSESSGGTASPRHQGYASNNNNQPPILSSMPWK

SEQ ID NO: 116698 - protein, 179 aa, Triticum aestivum
  Clone ID: PAT_TA_11116.pep
VWVRAAISSPSVSTMATTRVDHLDCILRPQRPSSLQQRRRGAHGGAVLPTAACSSTKQAFVVRSTPSNADGGPRDPPPTPAATRFAPANHHILLTPLFLALQFQRHILLTPSPFLCAARWRVRCSTVARQVQCGGAGWQNDDGLCLVVRRLTKKTKKSHTHFIMEFSMQFCVRLRSGSV

SEQ ID NO: 116699 - protein, 95 aa, Triticum aestivum
  Clone ID: PAT_TA_11117.pep
EKLRFAKSLYQSLSQFGHKIYHNMLVPCHDTMPSFMIFKRALDLDELRNQLNIFGRAITPRCLNFILISCMGPRNSPKDTHVIFQPYGVHWSMCL

SEQ ID NO: 116700 - protein, 238 aa, Triticum aestivum
  unsure (1)..(238): unsure at all Xaa locations
  Clone ID: PAT_TA_11118.pep
MAEICCQEAKSPPATAATVATVSASAAAAAVASSVMDRRRRRLELKRFRLASDLEQSAAEYAGARKRPRVPRTVSGPCPDAASASENMDRCPRFGFSSVCGRRREMEDAVSIRPGFLPGSGKSHFFGVFDGHGXCSHVATTCQELMXEAVAEEHEKAGSGKGPVWKEVMERSFARLDERAANWATTRSSEEPACRCEQKMPSRCDHVGSTAVVAVVSPIQIVVANACDSRAVLSRAGV

SEQ ID NO: 116701 - protein, 146 aa, Triticum aestivum
  Clone ID: PAT_TA_11119.pep
GSTRGGRSGTKRGRRRRASKKGQDEGSYADSGHGMKNEGPRGESVHDNGEKDADGKAEGPPSSNDDGTSASVGDQQNEKTDNPKNHQKNQKGAEKKTTVSADLKITSKGKKQKEVSKARNDCETCGDTFESRSQVVFSFGRNRVML

SEQ ID NO: 116702 - protein, 124 aa, Triticum aestivum
  Clone ID: PAT_TA_11120.pep
SAHASGRVGLARSPPHPRTQPLLSALLRAPPPPLAASNPSSSPTSLSYSSVPRRGGQAGAHTKGGCGCGSDAGAVEVESELQQKEVDGRDNSFSFDEFHHLHCYLSPAAIANSFPGVMMWRRVG

SEQ ID NO: 116703 - protein, 162 aa, Triticum aestivum
  Clone ID: PAT_TA_11121.pep
DQTYDRSRVMYNPSLPNNFGSRGGAEPHGHHGGYDHGTGGGHGGGECSTGQKEDSGEIDALMSSGDGEEEDDVLSTGRTSGSRGEGSPDSTCSPGYVVSVSPSGGGGGERKKNRMKKMMKTLKGIIPGGDRMDTPAALDEAVKYLKSLKVEAKKHGVRGSRS

SEQ ID NO: 116704 - protein, 222 aa, Triticum aestivum
  unsure (1)..(222): unsure at all Xaa locations
  Clone ID: PAT_TA_11122.pep
HTIRNTAGPAKHQAVALRSSADLSTFYSCSFXAYQDTLYTHSLRQFYRGCEVHGTVDYVFGNAAVVFQDCTFYSRLPMQGQSNTVTAQGRTNPEQNTGTSIQGCTLLPSPELAANAAFDTRTFLGRPWKNYSRTVVMESYIGGLVDAAGWMPWSGDFALDTLYYAEYNNSGPGADTGRRVSWPGYHVLGDGADAGNFTVDSMVLGGNWLPQTGVPFTSGLKY

SEQ ID NO: 116705 - protein, 72 aa, Triticum aestivum
  Clone ID: PAT_TA_11123.pep
MEASSCLLYQVRGFGSFRIWLCLLLLLVLQNCSPVLSDSPYLVGMGSYDITGPAADVNMMGYANTEQIASGI

SEQ ID NO: 116706 - protein, 98 aa, Triticum aestivum
  unsure (1)..(98): unsure at all Xaa locations
  Clone ID: PAT_TA_11124.pep
MEASSFLRYQVRGFGSFRIWQCLLLLLVLQNCSLVLSDSPYLVGMGSYDITGPAADVNMMGYANTEQVASGIHYMLNXWAFTVAGPNGRRVXFVNLDA

SEQ ID NO: 116707 - protein, 195 aa, Triticum aestivum
  Clone ID: PAT_TA_11125.pep
TGVLNGLEGRSDAVEMASCAPLFVNDNDRRWSPDAIVFNSWQHYGCPNYWMLHFFKESSGAALHPSTIQVSNYNQLVASAITWQNSKDGNTYLKIKVLNFGNKAVDLSISITGLENEIQTFGSIKTVLTSGSLRDENSFQQPDKVVPVESPISNAREEMSLVLDPYSLTSFDLLLDPSNSTMMHSVPESSLHSSM

SEQ ID NO: 116708 - protein, 196 aa, Triticum aestivum
  unsure (1)..(196): unsure at all Xaa locations
  Clone ID: PAT_TA_11126.pep
CYIDPXYQRTGAVSAKSDVYALGVVVLQLLTGRTSPLGLAHAVETALEEDGGDSFAEMLDATAGQWPPEEARELAALALRCAEMRRRDRPGLREHILPALERIKDIAARAARETKALLRTASSSAAPGHFLCPILQEIMEDPCVAADGYTYDRKAIETWVSMKDKSPMTNLRLPSKSLIPNHSLRSAIMEWSSKNR

SEQ ID NO: 116709 - protein, 230 aa, Triticum aestivum
  unsure (1)..(230): unsure at all Xaa locations
  Clone ID: PAT_TA_11127.pep
MPPYHTTTCPPPSSLSLSLSLSPSLQTYKQGKEEEEEEEEANMSSPSKRREMDLMKLMMSDYKVDMINDGMHEFFVHFHGPKDSIYQGGVWKVRVELTEAYPYKSPSIGFTNKIYHPNVDEMSGSVCLDVINQTWSPMFDLVNIFEXFLPQLLLYPNPSDPLNGEAASLMMRDKNAXYENKVKEYCERYAKPEDISPEEEEEEEEESDEELSDAEGYDSGDEAIMGHADP

SEQ ID NO: 116710 - protein, 203 aa, Triticum aestivum
  Clone ID: PAT_TA_11128.pep
MSSPSKRREMDLMKLMMSDYKVDMINDGMQEFFVHFHGPKDSIYQGGVWKVRVELTEAYPYKSPSIGFTNKIYHPNVDEMSGSVCLDVINQTWSPMFDLVNIFEVFLPQLLLYPNPSDPLNGEAASLMMRDKNAYENKVKEYCERYAKPEDISPEEEEEGERSNVELSDAEGYDSGDEAMTVMGHADQVDGWMHGWLAQSETQ

SEQ ID NO: 116711 - protein, 115 aa, Triticum aestivum
  Clone ID: PAT_TA_11129.pep
MPMMARQYNKASSMDYVANGAAHAFKPKDFTPRAYSGSNTSSESPEEIKAKINRLSQTLSNTTLVSRLPDRGEKLKKQIHDLDEKLTVIESSPESSSMMSRGRAPEVICLDDQSL

SEQ ID NO: 116712 - protein, 153 aa, Triticum aestivum
  Clone ID: PAT_TA_11130.pep
HLRPPNYAPRLPDGLDSYPPRPPSPPPRLADCCTTNPSTSLAPPHPPVQLRATSPVSSPCCPRPPPQPLGGTASVFGPPAPAQSPSAGSSIWPLEACPLEALSSAASVNISSPGGLPNPSGGAPSGGAPSLTIIHPAEGGLEKPSKMTFLPGD

SEQ ID NO: 116713 - protein, 232 aa, Triticum aestivum
  Clone ID: PAT_TA_11131.pep
EAYMLSEEAKSKGIELNIILYSSLIDGFGKAGRIDEAYLILEEMLKKGLTPNAYTWNSLMDALVKAEEINEALICFQSMKEMKCPPNTYTYSILINGLCRVQKYNKAFVFWQEMQKQGLIPNVVTYTTMISGLAKGGNITDAYNLFVGFKTNGGVPDSACFNALIEGMSNANRAMEAYHIFEETRLRACRVNVTTCVSLLDALNKSECLEQAAVVGAVLSEISKSQHASRSL

SEQ ID NO: 116714 - protein, 197 aa, Triticum aestivum
  Clone ID: PAT_TA_11132.pep
PSPTSPWPVMAGSSPPNRTRARRGSISPDEVRRRYEPTGRGRKGGTCGGGGGARRPSGSDSAASGSYSMSGRSDSIASDTESGSDRGSSRSKKTRMSKRLQGEEIQANCARKRSRPSDQKHLYLVLDDWKDGFSIHKIDADDDDADLGQPPVLRLVLPAPGFPMRFAVVGSNIVIVTYPRCGQAPTLFYDTKRTGLA

SEQ ID NO: 116715 - protein, 105 aa, Triticum aestivum
  Clone ID: PAT_TA_11133.pep
MVSDSELVERLREVLRESDLTTTTTGALRRRLEEDFGVDLSDKKTFVREQVDLLLSEFADKAEPEDAPVEEEDPVEVTPEAGEGGEEKGEGDEEGAEQQEGEVEE

SEQ ID NO: 116716 - protein, 217 aa, Triticum aestivum
  unsure (1)..(217): unsure at all Xaa locations
  Clone ID: PAT_TA_11134.pep
VFFMITAQMSSTVIEQGMAMDNRVGSFTVPPASLASFNVVTTLVLIPIYDVVLVPLARRATGXDRGLTQXKRLGRPGLALSTLAMAYLALLEEGTVSRAGGRXSIGWQAPGRAGKGASGGLTGVGTVERNYERAPGGVRSKSTAFAQLAIAAGSYLNSAALGVVASATMWIPEDLDDGHLDYFFWTIAALSALNLLQFVFYSMRYNDNVACRQCHPY

SEQ ID NO: 116717 - protein, 286 aa, Triticum aestivum
  Clone ID: PAT_TA_11135.pep
TEGERVIRPTIIEDTWGLREMQVGKDVDGVLTCDPNIHANAVAVPCLTFDEAAELAYFGAQVLHPQSMRPAREGGIPVRVKNSYNRHAPGTVITKTRDMRKSILTSIVLKSNITMLDIVSTRMLGQYGFLAKVFSIFEDLGISVDSVATSEVSISLTLDPSKLWSRELIQQELDHVVEELEKIAVVHLLQHRSIISLIGNVQRSSLILEKAFNVLRRNGVNVQMISQGASKVNISLVVNDSEAKQCVQALHSAFFENGFLSEVEEADLAQNMAPVLVSSNGAINGN

SEQ ID NO: 116718 - protein, 98 aa, Triticum aestivum
  Clone ID: PAT_TA_11136.pep
TREEDEHRAYRDCCRWLKEVEPGCVCESLLHLPMFLVKPQHKYTLRVGKTCEVTYRCGGGRATRARGRGRRGGAKPQTGWLSTATYVHRSYFRILTGK

SEQ ID NO: 116719 - protein, 398 aa, Triticum aestivum
  unsure (1)..(398): unsure at all Xaa locations
  Clone ID: PAT_TA_11137.pep
MAAEQSAEHFRGQARLPGFAAPRRYDLRLTPDLAACTFAGSVSVSVDVAAPTRFLVLNAADLDVAPGDVHFAPKGSGQVLLPVEVTSALEDEILIIRFNEVLPLGEGTLVIAFQGTLNDKMKGFYRSVYELNGEKKNMAVTQFEPADARRCFPCWDEPSFKAVFKITLEVPSETVALSNMPVVEEKVNGPTKTVYFQESPIMSTYLVAVIVGMFDYVEAFTADGTSVRVYTQVGKSAQGKFALEVAVKTLILFKEYFAVPYPLPKMDMIAIPDFASGAMENYGLVTYRETALLFDERHSAAANKQRVAVVVAHELAHQWFGNLVTMEWWTHLWLNEGFATWVSYLAADRFFPEWNVWIQFLEESTTGFRLDALAGSHPIEXDVNQVDERXETFGAXKL

SEQ ID NO: 116720 - protein, 107 aa, Triticum aestivum
  Clone ID: PAT_TA_11138.pep
RYEGVVHTTGYNSARASINYFLSVFFPFSSLHWVTASRYYPYGKASRHAVIRISCYSRSFIGEMKTQPILDVGVVHIPRLGQGLGISPAPGAAASVVALLQISLASL

SEQ ID NO: 116721 - protein, 140 aa, Triticum aestivum
  Clone ID: PAT_TA_11139.pep
MAGEEAAEGSGNRRRMDLNLYLGLPPLPRPPGRLGVAMDRPPPPNSAIPVPESPRTDEPAVLPAPEEMPPLPVVYSPSNALSTPELSLIDPMLFDWLDGLSTDSEEALDAGEPAVVRDTPSHDANVSPPPPAPLSLPGLE

SEQ ID NO: 116722 - protein, 146 aa, Triticum aestivum
  Clone ID: PAT_TA_11140.pep
VRGRVGGDSILAAAPRPLQSNPIPPPGHQLDGKNRIPLYPIAKGGRQSHHEDAYAAAAPTSFFLLPPSSSSLEDGRMLRQEEKNLTPSPGLISNPFLVCSLLAGGSFLDCDLQIISMLRQPGRVGGPTLTGVEAEGLRSCVHRLGF

SEQ ID NO: 116723 - protein, 166 aa, Triticum aestivum
  Clone ID: PAT_TA_11141.pep
ISYSLFDGTCYSDNRSNSRANTCNKPRLLGGAHLLDKRLTRALLADPMIHDNSTDRTARGPAGQPAPPPPSPGSHHRERKGIVRWMMVVKLQTFKAWRKDGGLFSDGSARSGWGWMGIVSFFQFFLSSPVPMIDCSSLYKEKQRRREAIATFVLILIKDKGGGGHY

SEQ ID NO: 116724 - protein, 193 aa, Triticum aestivum
  Clone ID: PAT_TA_11142.pep
PLHRTGGFTVRRSISAAGPCPLYCRCSGPLASCHCPSLRPRLRPIPHALRGRTIGHPSSHQPHHLAVDRLRCSSGSLPTRLCYLLYSLYWLYHHKHPCDRIEPVRCSRGGKEKCRSRCRTDAVFCFQLLRCCLLLIIHHCSDCCSAFNCTEAVFCFQVQEQVRHRDIFMTCCKKTILSRQRSSYMQYSKGQMQ

SEQ ID NO: 116725 - protein, 77 aa, Triticum aestivum
  Clone ID: PAT_TA_11143.pep
NKHRVTLMFQPVYTAAYCRRHLCYAPLAILDRVSTYVSLEVRSTRSCTWSLVKLRRIYQTRNPCVNLPAEVSNFVCN

SEQ ID NO: 116726 - protein, 157 aa, Triticum aestivum
  Clone ID: PAT_TA_11144.pep
PLVRLPQVIISRPRPRGFGLSTTADDAKNYLRVIILLQYVPRIIRFVPLLGGRQSATGFIFESAWANFVINLLMFVLAGHVVGSCWYLFGLQRVNQCLQNACAASNISSCKVFRDCGLNFDIGGQNEQISQQWFNEPASTACFDTGNDTNFQYGIYQ

SEQ ID NO: 116727 - protein, 425 aa, Triticum aestivum
  unsure (1)..(425): unsure at all Xaa locations
  Clone ID: PAT_TA_11145.pep
PTRPPTRPVGNLYKEGLRLKLGLQEHLFQKIPFVQKIQESSEGMLRYDTPSILSKDKFAWLRDDEFARQTIAGINPVSIERLKVFPPVSKLDPAMYGPPESSITERHISGQLNGLTVQEAIDMEKLFIVDHHDVYMPFLDRINAIEGRKAYATRAIFFLTQGGTLKPVAIELSLPPAQSGEPQPSKVLTPACDATSNWIWMLGKAHVSSNDAGVHQLVNHWLRTHAIMEPFILAAHRRVSAMHPIFKVLHPHMRYTLEINALARQSLINAEGVIESCFTPGPVSXEISSAYYGNHWRFDLEGLPADLLRRGVAGGGGPQAHGIRLLIEDYPHANDGLLLWSAIGNWVESYVQLYYPDAGTVQSDDELQEWYHESIHVGHADLRDXAXWGPPLSTPRDLANILTTLVWLASAQHAALNFGQYPLGG

SEQ ID NO: 116728 - protein, 170 aa, Triticum aestivum
  Clone ID: PAT_TA_11146.pep
MSYAYLFKYIIIGDTGVGKSCLLLQFTDKRFQPVHDLTIGVEFGARMITIDNKPIKLQIWDTAGQESFRSITRSYYRGAAGALLVYDITRRETFNHLASWLEDARQHANANMTVMLIGNKCDLSHRRAVSYEEGEQFAKEHGLVFMEASAKTAQNVEEAFIKTAGTIYKN

SEQ ID NO: 116729 - protein, 210 aa, Triticum aestivum
  Clone ID: PAT_TA_11147.pep
MSYAYLFKYIIIGDTGVGKSCLLLQFTDKRSQPVHDLTIGVEFGARMITIDNKPIKLQIWDTAGQESFRSITRSYYRGAAGALLVYDITRRETFNHLASWLEDARQHANANMTVMLIGNKCDLSHRRAVSYEEGEQFAKEHGLVFMEASAKTAQNVEEAFIKTAGTIYKKIQDGVFDVSNESYGIKVGYAVPNASGGGAGSSSQAGGCCS

SEQ ID NO: 116730 - protein, 233 aa, Triticum aestivum
  unsure (1)..(233): unsure at all Xaa locations
  Clone ID: PAT_TA_11148.pep
VRANLTVYLVKRYNIGRLAAANITNIFYGTLNFAPLLGAFISDAYLGRFRTLAYGSFFSLLGMLGLTLSASVPALKPPGCSQTAQLGGHCDSPSTLQLSVLYISLAFLTIGGGAIRPCSLPFGVDQFDMTDEKSRKGLNSYYNWYYGTTTAALVFSMTILIYIQNSISWPIGFGIPTFFMLMSIIILFMGTRLYVHVPPEGSIFTGIAQVLVAXSFKRRRLKLPHPXXINQQE

SEQ ID NO: 116731 - protein, 134 aa, Triticum aestivum
  Clone ID: PAT_TA_11149.pep
DGTETIEAALRRYAGIRRWRKRAGDSGVLHGGACAAERARRGEICAGQAAVRGARQGAPHDAGLRLWHALTASARGLVLAEAICNGVWYAPSGAGRRRVCRRVTARGPQLSEKGFQAQAHGIGQKKKKKKKKKK

SEQ ID NO: 116732 - protein, 125 aa, Triticum aestivum
  Clone ID: PAT_TA_11150.pep
QQGDGTKAQVTWDDQQNINRFGRLNNRLHELADEIRLAKEANENLEDAGNELILSDEDVVRFQIGEVFAHMPVDDVEARLEQMKEDAAKKLEKLEEEKESILAQMAELKKILYGKFGDAINLEED

SEQ ID NO: 116733 - protein, 126 aa, Triticum aestivum
  Clone ID: PAT_TA_11151.pep
MQQGDGTEAQVTWDDQQNINRFGRLNNRLHELADEIRLAKEANENLEDAGNELILSDEDVVRFQIGEVFAHMPVDDVEARLEQMKEDAAKKLEKLEEEKESILAQMAELKKILKAKFGDAINLEED

SEQ ID NO: 116734 - protein, 107 aa, Triticum aestivum
  Clone ID: PAT_TA_11152.pep
VVEAGGFYLPLIDDATCRRTAAPSGRRRRPATTARSTCRPRRGGRRRRLPRTGPMLSAPARRAAGGGMAIASNSLTSLARSPWDRRTAVSWMRTSRRAHASAHASAD

SEQ ID NO: 116735 - protein, 224 aa, Triticum aestivum
  Clone ID: PAT_TA_11153.pep
MKLLEYTPFDCVNVFLDQLNLGDCTIRGSLEAFSCKHAGNDRRLSISLEHEILDYLGKSSDSDPPSPVEHLSCRSSRKTLIYLVLTLGHMYPDYDFSAVRAHLFFKEEDMESFKQMVDNYLSEASRLWAARNEGSSLLDSMTKAIDEVIKIRECDIYSYNPDSDGDPFLEKGAIWSVNFFFYNRKLKRVVSFRCCCTSKFAGDDFLAGALSDGEEEDALIDMDI

SEQ ID NO: 116736 - protein, 825 aa, Triticum aestivum
  unsure (1)..(825): unsure at all Xaa locations
  Clone ID: PAT_TA_11154.pep
MKKPGANRSSVAGGEPPVPSTTAGQAIWTICIHCRTRYQYYSGVLNHRIRCQNCSKYFVASKLNGQDVPSVFTSNSIRGVGQQSGFPSQPDCSTKFSPSRLNGDAKPSVNGAQTAEHMKSARAAGEEKVNHAGAAGKSGVEFSTGNMSKSSAPSANDKAGGRMASDPAGPDVAYSKNPCSRVVDTPAEPGATGSPSPRRSARRKANHDASTPVPPSKKRRTLKDWFSNADTSCKKMFDDNVARADGKTGEAHVPSKAHNEERGSTAKEGNQESVKKEFTCDASAAKDPCDSAQLTYPDPEFFDFDKGRDVNLFAVDQIWAVYDDRDGMPRYYARIKHVDATKSTIRYTWLEHKAVNDEEDRWTDKELPVACGKFHPGKTEVSQGALMFSHTVVPWVMGKRGCAYEIYPRKGEVWALYKGWSMQWCSDADNHKTYEYDVVEVLSDFTMEAGAAVFPLVKIKGFVSLFGKAIDRSSSVIPSSELLRFSHNIPFYRTKGNEKVGVAGGFLELDTVSLPSNLDASFPSVAINKTISSGFIDASDISTPGPGNEPSAXKETQPSGGKRIDDSLEQTPRQKQKGGTASVPGSSSQLFRSSPSTIATYPDSEFYNFEEGRSYNKFERGQIWALYSDLDKFPKYYGWVTKVDMEPFRLHLTWLEACPQLEQEKMWLKRDIPVSCGTFKLRNWRIKYDSNDAFSHLVETSQVNGQRFEIHPRVGEIWAIYNNNWAPDWVPSSDDACEYAVGEITERTEASTKFSFLTPVDGYTALFRFDNERGILEIPANENLRFSHHIPSYRLTEEKSGTLRGFYELDPASVPDAFLVRGGTC

SEQ ID NO: 116737 - protein, 463 aa, Triticum aestivum
  unsure (1)..(463): unsure at all Xaa locations
  Clone ID: PAT_TA_11155.pep
EGHTFVISQHYYGCLFHELLTFQIGDRHPQQEREHEEVLSKEMLAFLNRAMPTXEGGEPSVPVSKESGVIHMDLDRSFLPXVPSAVNASIFPVFFRXNITDASTHVGLQFQHLLLNSSLVSAYGCPKXIFGKASIALLKKLVLCCLQEQGTLLLPVRTNXGHYVIVAGLVHAEAITYSALGNILASTNXSKFSILTHYDKASQPWXQLSGPTIYPTRFRNTVDDIADLFSGCAKYGAWVVIDTSSSGLEFQAAGCSQWNLEKCLSNVKSSKPSFSVVLLGEFSFELSXAELDFRFLIMSDSSXLVDTFYXFPSLSRPPSTLKYTLRKLLGLKNQKDQHFSDLIVEQKETLKNRANQLIKTLESCGWDAAGCHGGISMLAXPTAYIGKSLKVDGFEGNLDSHNIREALRKSARRCMSCSACTRVQDFSRSSFALDSGEFDRAMECITRFKELVLGGSAKVNGSN

SEQ ID NO: 116738 - protein, 164 aa, Triticum aestivum
  Clone ID: PAT_TA_11156.pep
QRPPTTHFVATVDDLTDMLDFHSEYIDGMDADAGDDQEPAHIGHWKATSSYDIYMVDTPKEGNGDGTTEDDPSKKQPKRRHQWRRSKSCQSKNGDSGTGDNNTPDSAEDNPLQQDSAQEDGEASPHERAADREVEDDNCMPPSEDEASLDDDEFVVSKDPVDRR

SEQ ID NO: 116739 - protein, 49 aa, Triticum aestivum
  Clone ID: PAT_TA_11157.pep
VCTILQFYYASVLGPFPLIDPVQELIISRAANYHTANDYPVHLCSSKCA

SEQ ID NO: 116740 - protein, 149 aa, Triticum aestivum
  Clone ID: PAT_TA_11158.pep
AWSRPRYFMHGIINEKTDVFAYGVLLLELATGRKAVDSSRQSLVIWAKPLLESNNMKGLVDPSLDVGYDPEEMALTLAVASMCIHHSANLRPSMKSVVRFMKGDRESLELMGKPKPTKPPMFDSCDSEDYTRTSYLNDLDKHKQLALEQ

SEQ ID NO: 116741 - protein, 135 aa, Triticum aestivum
  unsure (1)..(135): unsure at all Xaa locations
  Clone ID: PAT_TA_11159.pep
MXXXXMSSIXXXXITXAXFXFRLGFIYMXELPGEDECNDYSXEMLQNLLAAADLYALDRLKVICAQKLWNKVSVDXXATMLACAETYNCQELRNNCIDFFAVEANFKEAMFTDGYALLVLKFPLITAELKKRVRA

SEQ ID NO: 116742 - protein, 195 aa, Triticum aestivum
  Clone ID: PAT_TA_11160.pep
MALHTVSGIKLPPFSLPPPHLHLGANPGGGGISSGLYASSAFPRRRCGALAAVVRCARRTGKRRYPSEKKRLDRRHKEQLRQTAPEEGGVAREAGFWRLSKLAVPASDDPGKDFLGVSPPLLQAIAKALKFPVASMLPEEAFSVIRKSFDARKILKEPQFVYTVDVDAKKLLDMEPRTWDFIARLEPGWNCRIYR

SEQ ID NO: 116743 - protein, 306 aa, Triticum aestivum
  Clone ID: PAT_TA_11161.pep
MDTDEFFNPGCAGTAGDGCDCGDCEERRHDHGRTKHFVLFASDNKDFLCIPWEVTRQLRNMIAHSEPIKLETPDGHVYSVEFVKFGLITLTTGWRHFVDANHIRQGDPITFVYCGRSTFICHLKGTSSGHKCSLPSSQQPPNIFSAKPPRDHHVLNEQVVPDPAHVPLSTDLGYTMLKKVLELADSSMRSEIPLHVAAMIKRNANEDCYVYIPLKLLDNFKEGVTEAAIQLEAHGNDMVYSVGTSKHSDDQVILQSGLSHFVASLRIQDNDLLVFRNKWKDRLEVLVLDPSGCEKTCFAMGNSSNA

SEQ ID NO: 116744 - protein, 78 aa, Triticum aestivum
  Clone ID: PAT_TA_11162.pep
GSALLTGNGGPNMDGRQLPVTAKTWYSYSCAVRQNRIGRWYSVLTVCYWGFDGTEILLVFVILKITPGRGVDGGGIPL

SEQ ID NO: 116745 - protein, 117 aa, Triticum aestivum
  Clone ID: PAT_TA_11163.pep
AESSEFAAQCHDLKQELCSRAPGHQPKPMEVKPMASTDLHITKEKELARAAGKLADCQKTIASLSAQLKTLSDFDEFIIPDPGVENHDIALAESWDGDLKLFDSASYPAQLGCLAVT

SEQ ID NO: 116746 - protein, 352 aa, Triticum aestivum
  Clone ID: PAT_TA_11164.pep
MADPPSPRLDEDDTFGRDFNASPSRNAAPARSGEKRQFGDLDDDEDDVFASKKGKTKVEESAPGAATGMILSLRESLQTCKENLESNQVELEAAKSEIQKWHSAFQNIPAVPAGTNPEPVSVVTYLNNLKSSEESLKEQLEKAKKREAAFIVTFAKREQEIAELKSAVRDLKTQLRPPSMQTRRLLLDPAIHEEFTRLKNLAEEKEKKIKELQENVAAVNFTPSSKHGKMLMAKCRTLQEENEEIGAMASEGKIHELGMKIAVLKTQNNELRNQFDGLYKHMDGLTNDVERSNEMVSILQEELEAKDVELARLKEMLCQKEATEDDTVVEEREEAANDMNASSDPQPIKVES

SEQ ID NO: 116747 - protein, 165 aa, Triticum aestivum
  Clone ID: PAT_TA_11165.pep
ASETLPNLPPPFATLQTLKDMFASKGLTADEMVTLSGAHSVGVSHCSSFSDRLPPNPSDPSAMDATLAASVQVKCNRTGDPVVVQDFRTPGDLDNQYYKNVLDKKVLFKSDAALRSSETGAQVLLNAWIPGQWEQKFKAAMVRMGSIEVKTRANGEIRKQCRFVN

SEQ ID NO: 116748 - protein, 145 aa, Triticum aestivum
  unsure (1)..(145): unsure at all Xaa locations
  Clone ID: PAT_TA_11166.pep
MTGRPVFVLFGSSIVQYSFSTRRLGAATLTDVYARTXLVLRSPAWLCCQWTLKGRGTFQRHSPKVFPKESAVQRSLVTVYVGGNDSIAPNPAGPGPHLPLVGYMDNMRKIGEHLKSLSDXTRVIFLSCPPLNEELLKKSTSTALS

SEQ ID NO: 116749 - protein, 174 aa, Triticum aestivum
  Clone ID: PAT_TA_11167.pep
HASATDAAYGGSGEQYRAAAPKPYQYNPGSAAAAAAAAAASYNNGRGAKVGAGGRGAAEAGWGSSSRSLLLPPAAPRAPAAGSGGALRSGGGGGERPPPRQATARAGTAHFALWNHPPDLRGVVELFTIHPSIHPLGHLVGAVTCFFFFPSLVAASQAGERSEEERGGATSHNQ

SEQ ID NO: 116750 - protein, 199 aa, Triticum aestivum
  Clone ID: PAT_TA_11168.pep
MLAKFRPLMAAAPTTKAAPAVAFSTAAERDGYAQYNHTDACQHLRWTARESYEYMYARPWSRVVDFYAELVRTGAGAAGLAELFGKDEKDHLRDTNGEEPLASSEKQMSVKSSKARGGRWERANFKIVLSYHGGSFDGWQKQPDLNTVQGLVEKHLGQFVDERKAKQLQERSLPIEGCATVAGRTDKGVTALQQVCSFC

SEQ ID NO: 116751 - protein, 207 aa, Triticum aestivum
  unsure (1)..(207): unsure at all Xaa locations
  Clone ID: PAT_TA_11169.pep
MNGASAECDTKAEAGTAEYLIELEXRRSIKVFGSSTFIGLGIFFFSGXCFSLFSPAINLATNDQWHTPKDGVPHLVVYTAFFYFSISCFVXGIGLNILFLYRPMAGVPKSSFKAYLNDWEGRQWALLAGFLCGFGNGFQFMGGQAAGYAAADAVQALPLVSTFWGSGRPGGYRKSSKKTYTLLVFMLLMFIAAVATLMASAGHRSTK

SEQ ID NO: 116752 - protein, 119 aa, Triticum aestivum
  unsure (1)..(119): unsure at all Xaa locations
  Clone ID: PAT_TA_11170.pep
HQRHRPPRTLGGRVRPRPGAGQCGRRRRLGGSPPAAFAAAAPSFRPRPPPPXAARGGARRAGPPPPPPPPAPPAPPPPCPPAAARPPPAPACRTRRAAAAAPAAPPPGAPPRPWRLPWC

SEQ ID NO: 116753 - protein, 131 aa, Triticum aestivum
  Clone ID: PAT_TA_11171.pep
GTTGEFIRCKKRGRRASAAPSGAGGHWNSSGRPGRYHFNLTSRGYRALVFSGDHDLVIPFLSTHAWVRSFNFSVVDDWRAWHLDGQAAGFTITYANYITFATIKGGGHVSIEHRPKECLAMARRWLDNEPL

SEQ ID NO: 116754 - protein, 245 aa, Triticum aestivum
  unsure (1)..(245): unsure at all Xaa locations
  Clone ID: PAT_TA_11172.pep
MAQHSAGGGGGGGSQHMVQHNAGGGADGGMDIGMGVVAVSGDGKGDQGGEAGQDEQVKKKRGRPRKYKPDGSVTLGLSPSPSTPHSSSPGMGAMVTTPGSGFGPEPGSGXHLIMTHSRRDVAAGVKSGSQRCSRGICFISAIGAVSTATLHHXSDSGAVTYEGRFEILCLSGSYLVVGRTAVPALSSGGLCIALCGXPDHTVIGGSDSGFLTAAGIVQVVGGSCMCGGGSRKAMGDPDHGVDGGE

SEQ ID NO: 116755 - protein, 347 aa, Triticum aestivum
  unsure (1)..(347): unsure at all Xaa locations
  Clone ID: PAT_TA_11173.pep
DLVIDSAISCSHFPEERELERWAPDGXIQTALNWEKFDRKGHRSWDQFETNAALFGVKSTFNEDLYTTKLERGTHMRELEKHASRIAREIEGEDTEDLHLAEERGLYLDEDLEHDEEIKYSAVRRDTDTTVKPFTNVPSRPVSIDTKDLPVCSSTMDDKSSSPLSGGTHLSATAEYQSNKLLPADANRLDGKRNKDSSXTKTTGSCNPAIPAAEGGRPLSPSSSMGSLSSDKSSLNPNAKEFKLNPNAKSFTPLTSPRPHHPPAPDATYYYPNNMGATGPGLPVGMGFPQAYGGQPVVYNAQPGSSPQGYMHPSGQQYGQQMMMGQTRPVYYYAPEMQQQQYRGRNF

SEQ ID NO: 116756 - protein, 310 aa, Triticum aestivum
  Clone ID: PAT_TA_11174.pep
MASTYHYRPYPLPLTAAPPAFASRCRFPMASTGPLGVTVSTSESVGQNDLLIVGPGVLGRIVAEKWRQEHPDCKIYGQTATTDHHSELTKIGIIPSLKGPRVDQKVPYVIFCAPPYRTDDYPGDLRVAASNWSGEGSFLFTSSTAVYDCNDNGFCGEDSPCVPIGRSPRTDVLLKAENVVLEAGGCALRLAGLYKKDQGPHVFWLSKGTVDARPDLIISMIHYEDAASLGIAIMKRRLRGRVFVGCDNQPLSRQEIMDRVNRSGKFDGKFEGFTGTDGPLGKRMDNSKTRAEIGWEPKYPSFTEFLGLSN

SEQ ID NO: 116757 - protein, 176 aa, Triticum aestivum
  unsure (1)..(176): unsure at all Xaa locations
  Clone ID: PAT_TA_11175.pep
SSSQAAKVVRSSSFSSSSTESVCCNSSPATSSSSSSAETAPSICSSAAASTSSFAVAWAWSRARSTSPTFASWSAAALRSAAAXSAGPPAAASSSSASVATARCSSVAPCMAACCSGAAPTGMSSAFAAPAARSSRGECAWSPARAGSSVSLGSTASWASSSLTSPVVSSMWRCAS

SEQ ID NO: 116758 - protein, 77 aa, Triticum aestivum
  unsure (1)..(77): unsure at all Xaa locations
  Clone ID: PAT_TA_11176.pep
RIVCGCTPRFVGWXRVVFLGVENNTPSVSKYKTFFDTYILRQRECVLQVVYLQNLYMVHTTTTTQLLEPQVQFNLNI

SEQ ID NO: 116759 - protein, 81 aa, Triticum aestivum
  Clone ID: PAT_TA_11177.pep
LGLGGGRGGRSVTSVTEFTDQPSGPPYCVVVESYVVDVPEGNTEEDTRMFTDTVVKLNLQKLAAIATTTTTSSPPPSDEQS

SEQ ID NO: 116760 - protein, 186 aa, Triticum aestivum
  Clone ID: PAT_TA_11178.pep
MARVRSNGRRAGGSGGGGGRGGKGKGKGKGPGKWKMPLSVARKQQAVLANVDQVTGERIPKSFVFSRGKLPSTLRHLQQDLRKLMLPYTALKLKEKKRNNLKDFVNVASPLGVTHFLILSNPKSLPHLRFAKSPQGPTYTCQILEYALAADIANSQKRPRCPAEIFKNSPLVVLSGFNRLAVRPCC

SEQ ID NO: 116761 - protein, 70 aa, Triticum aestivum
  unsure (1)..(70): unsure at all Xaa locations
  Clone ID: PAT_TA_11179.pep
MNEVIPAHDVXRAXKTFMQPGGPGDAARSRVMGLAAKVHAAVAEGGSSDRDLHRLIDDLMEAAGAGKTTM

SEQ ID NO: 116762 - protein, 123 aa, Triticum aestivum
  Clone ID: PAT_TA_11180.pep
TEDTREMVQGHRPNLKNSSCTSETSQSACLGNAQYSDTRQVPEQSFLQECKPVSCLNLFDEETSRNQERRPESSKSVEGESWSVSMEGDLDLKLSIAPSSNATKAPHWLFSDSRERNPSGQHR

SEQ ID NO: 116763 - protein, 197 aa, Triticum aestivum
  unsure (1)..(197): unsure at all Xaa locations
  Clone ID: PAT_TA_11181.pep
MMAQPQPPRSAPPRPRPPLRPRTRFRVASLLAASGAMMAQPQLEKKAPPRAKPPLTGKAVAALCVASFAVGLLLSGWVPLLSAPISTXNKTSAPGCDDNRVSKELAGERHDPKGIMSEVSRTHHAIQSLDKAVSSLEMELAVERARSGVAGAGAAGSSKDLQKAFVVIGINTAFSSKKRRDSLRETWVPSGEKLRRL

SEQ ID NO: 116764 - protein, 282 aa, Triticum aestivum
  unsure (1)..(282): unsure at all Xaa locations
  Clone ID: PAT_TA_11182.pep
MAAAYKAANSGSVDLTPAARRNKKRKLPEKQLPDRVXALLPESALYTXLRRVGGRVGAALARKKVDIQEALKTPPSLQRTLRIYVFNTFANQAPRTIPPPKNGDPPTWSLKIIGRVLEDGAELDPASVVPKHNPVYPKFSSFFKRVTIALDSSLYPENPLIVWENARSAAPQEGFEVKRKGDKEFLANIRLEMNYNPEKFKLSQPLMEVLGVEVDTRARVIAALWQYIKAKKLQNPSDPSYFMCDPQLKXGIWGKDKMRFAMLVPKRYXKXPSPPTAHQTLG

SEQ ID NO: 116765 - protein, 194 aa, Triticum aestivum
  unsure (1)..(194): unsure at all Xaa locations
  Clone ID: PAT_TA_11183.pep
LPQASLNNKVKNLTHYTDELRWIXKSKSEIKLMRESAFIVSQSLLQTMLLSRTHREESQLAAKIEYECKMRGAQRMAFHPVVGGGVNGSVVHYSRNDKKIKSGDLVLMDVGCEYHGYLSDLTRTWPPCGRFSAAQEELYSLILETNKECIKLCKPGTSIREIHHHSVKMLISGFQELGIIGKGKSIQYNYLNPT

SEQ ID NO: 116766 - protein, 137 aa, Triticum aestivum
  unsure (1)..(137): unsure at all Xaa locations
  Clone ID: PAT_TA_11184.pep
SIGVDIIYYRSHTEGMPRAHADVVDELEQLALRKYXGIPHWGKSRNFAFDGAITKYPKVHEFLRVKDRYDPEGLFSNEWTDKVLGINGSPNIIKKRCAIEGLCVCSNNSHCAPEQGYFCRPGKXYKEARVCSLFKDY

SEQ ID NO: 116767 - protein, 330 aa, Triticum aestivum
  Clone ID: PAT_TA_11185.pep
MDPAGAGKATAAAAAVCVTGAGGFIASWLVERLLAGGDYAVHGTVRDPSDPKNKHLRALDGAGERLRLFKADVLDYASVASTVAGCAGVFHVASPCPAAQPTNPEVELLAPAVAGTLNVLRACREAGVRRVVVVSSVGAVFMNPNPPEGPTMDEHCWSNEEYCRATENWYCLSKTLAEREAWAYAEKAGLDVVTVCPPLVFGPLLQPTVNTSSLFLIRYLKCDGVNAMDDRVRNMVDVRDVADALVLAYESPEAAGRYICSAHARKVSEMVSVVRSLHPSLNCANKFVQLVGDEKVFSTEKLQRLGWKFRTLEETLKDSVESYMSAGILS

SEQ ID NO: 116768 - protein, 169 aa, Triticum aestivum
  Clone ID: PAT_TA_11186.pep
MAAPPSQASLLLQKQLRDLAKNPVDGFSAGLVDDGNVFEWQVTIIGPPETLYDGGYFNAVMTFPQDYPNSPPSVRFTSEMWHPNVYPDGRVCISILHPPGDDPNGYELASERWTPVHTVESIVLSIISMLSSPNDESPANIEAAKDWREKRAEFKKKVRSLVRKSQEML

SEQ ID NO: 116769 - protein, 221 aa, Triticum aestivum
  Clone ID: PAT_TA_11187.pep
MVKKKSSWSQVLSGRPTNLFVPARNLPVQDLGAVIFGCTNNTIAECHSRQLFGLPKAHLSYVHNIKEGLPLFLFNYDDRRLHGVYEAASNGKFCPESNAWANNGYEKTSYPAQVAMRIRVWCVPLEESKFRNAIIGNYYQKTPTVYGQKPHFFRFELDHAQTRALMAMFTPSPSPIKFWTPPVSQPGAQHVSEPTPPPVWVQKFEGNNELKAEKVLVSYAD

SEQ ID NO: 116770 - protein, 39 aa, Triticum aestivum
  Clone ID: PAT_TA_11188.pep
ENFLVETRKNPRTREPNTTIVILPHYIKAWAPLGCRPSR

SEQ ID NO: 116771 - protein, 137 aa, Triticum aestivum
  unsure (1)..(137): unsure at all Xaa locations
  Clone ID: PAT_TA_11189.pep
QRRRAPSPSGGRAQTDLSHQSGGEERRSCRRHRRPSRSGRPSGGEERRSCRRHRRPSRSGRPPRAGRLRGARASRRQRKWRRGPESRGRQRYGSGRQRSMSXARRSNRAGTPSRGRRVGESEPRRRGVHGGERTASE

SEQ ID NO: 116772 - protein, 141 aa, Triticum aestivum
  Clone ID: PAT_TA_11190.pep
MKGFTLARVLVALLLAAGELHCAATAPPPPPAKASAPPPQHPATPPPHAPPSPPQRHRPSHRRAPPVPRKQDPPSSPPPPPPPSPPPPPPQDPPSPPPIQVVPPIQDPDVAPAAPPRGGNRFPVCATLLVFGDSTVDPGTT

SEQ ID NO: 116773 - protein, 139 aa, Triticum aestivum
  Clone ID: PAT_TA_11191.pep
QEEVKTPLFQMYPSKAPGPDGFPAHFFQHHWDNCGEDVTKAVLRIVEGTESAECINDTVLVLIPKVKRSAPPGQVRGNGRSSGWSAKAWKEGCRGLDFRDINSQQTTLVSPPAPGLLLLVDISLIQNSKQLQGFEYKTL

SEQ ID NO: 116774 - protein, 267 aa, Triticum aestivum
  Clone ID: PAT_TA_11192.pep
MAGYVRNGLRQMVTRSASANSRSEYADSKHLSLGEFLRASESTGLSLRGARLRLSPYRAWPSMHDNRFALYKLTTQVPMPGREYAGLWRGTFGWPPGRPDDERKPGKALFFLLLSYEEDSEGKLLLIATKVLEGTHYVVHPNGSSMFVVRVGESSTEAFPFPTDEDSRSVSIERCFAGEGIATGYGFRYPGSKPGSLFVLRDGRLAFVWRDNKSVLTLQRLNLEELLRKGERVPTLPPIPNFAYLTKSYSNVFVAIHGSPSCSSSPR

SEQ ID NO: 116775 - protein, 95 aa, Triticum aestivum
  unsure (1)..(95): unsure at all Xaa locations
  Clone ID: PAT_TA_11193.pep
MTKGTSSFGKRHNKTHTLCRRCGQRSLHIQKHTCASCGYPAAKTRKFNWGGKAKRRKTTGXTGRMRYLKTVNRKFSNGFQTGAPKGSKGPTVKSS

SEQ ID NO: 116776 - protein, 80 aa, Triticum aestivum
  Clone ID: PAT_TA_11194.pep
HQVSFSTPYKSEPTFIIAFLQRSTLGHRLPPIVASAPISSPDSPRLLSAPSSNHTTFSKYHVHIIRDQIISSKYHLHQFR

SEQ ID NO: 116777 - protein, 332 aa, Triticum aestivum
  unsure (1)..(332): unsure at all Xaa locations
  Clone ID: PAT_TA_11195.pep
MEVAAAAAAVAVPRHKVKKQINLFYCAECEELALKVAAASDAIQLQSINWRNFPDGFPNLFINNAHDIRGQHVAFLASFSSPAIIFEQISVIFALPKLFIASFTLVLPFFPTGTFERVEEEGDVATAFTLARILSMIPKSRGGPSRCIIYDIHALQERVYFXGRHVVPCFETGIPLLLQRLSQLPDADNVTIAFPDDGAWKRFHKSLANFPVVCCAKVREGDRRIVRIKEGNPEGRQVLCVHEIVQSGGTLRECQKVLAAHGATKVSAYVTHAVFPNQSYERFMTANSAGPGDQFAYFWITDSCPQTVKAISQQPPFEVLSLASSIADALQI

SEQ ID NO: 116778 - protein, 114 aa, Triticum aestivum
  unsure (1)..(114): unsure at all Xaa locations
  Clone ID: PAT_TA_11196.pep
RTGWILRVTVKCSSKEYYFFFCPAAIQGEEREKRDRRNGSYPTPGEEGSPSVRTARRRLRGGAPLRQPIVEVARSLEYAGEGAEEERLLRRRLLLLRPLLLEDRRSSASCRIXC

SEQ ID NO: 116779 - protein, 92 aa, Triticum aestivum
  Clone ID: PAT_TA_11197.pep
MAPAGKQKKKWSKGKVKDKAVHAVIFDKALQERLNKDVQSYRLITVAVLVDRLKINGSLARKALNDLEAQGTIKKVVGHNTCNIYTRTVADA

SEQ ID NO: 116780 - protein, 177 aa, Triticum aestivum
  unsure (1)..(177): unsure at all Xaa locations
  Clone ID: PAT_TA_11198.pep
ISWVGRKSQVVFVLGGPGSGKGTQCSNIVEHFGFTHLSAGEQFGXIKSGSENGTMIDKHFKGRDKIVPTERTVKILQEAMPHCGIAKVPIDPSPRYQGYRLSSGDGXKISPEFVLFFDCSEERMLGRRLGRNQGRADDNVETIRKRFXVFEESSLPVVQYYDSXGKVKXINAAKPIP

SEQ ID NO: 116781 - protein, 152 aa, Triticum aestivum
  Clone ID: PAT_TA_11199.pep
SSLHLSSPLLVGPPLPAPRRPRVMDHGLALDGGGSTPGICIWWTGTAATGLAGSCNRWTEELRWVGDHDHGQATGWMAVPRQVLQPWQLDVRTSACLCYYRRFDLMEPSSSNFQFFATAVICICWNHQHFFCYHHFFDFVGIMPNLLFLLPP

SEQ ID NO: 116782 - protein, 92 aa, Triticum aestivum
  unsure (1)..(92): unsure at all Xaa locations
  Clone ID: PAT_TA_11200.pep
MRRGFVHCNLDLGGAPGRSSGSSRRRRSSQRGVIRRMFNNMFACFGRTHSTNVTRASSSRSEWSSAXFTRGLRSRSTSWEIPKIASADAIAR

SEQ ID NO: 116783 - protein, 85 aa, Triticum aestivum
  unsure (1)..(85): unsure at all Xaa locations
  Clone ID: PAT_TA_11201.pep
AARSLARWAHASRLCDVISIANKPLLCTVCVMTYQRVLFNFALGVETRTLYVCIDGCVRPCWLLFPFARCPAXVSESKSRIFKKK

SEQ ID NO: 116784 - protein, 124 aa, Triticum aestivum
  Clone ID: PAT_TA_11202.pep
IHCSGRARQYCSRSAARPYPCTTAASLWSSDGRIWHSADGRPRGEDGGRRGAMGKDYVCRLLAQKVRTMRCQMWWVHAAARGRSHLACKKEVLEQSLKEKEVLEQSLWFSCNHVCNGWEVLMHE

SEQ ID NO: 116785 - protein, 92 aa, Triticum aestivum
  Clone ID: PAT_TA_11203.pep
MASTTAEGVKLISITTSDGVEMKVERPVAERSILIKNLLEDLGGESEESIPIPNVNEAVMKKVVEWCGHHKNDFTPEEEEQIRRENEWAEDR

SEQ ID NO: 116786 - protein, 263 aa, Triticum aestivum
  unsure (1)..(263): unsure at all Xaa locations
  Clone ID: PAT_TA_11204.pep
TARWSSEPTAMAAQEAPVQPPSTVEPSSSPSPPPLPVLPPTGSAPPLLGSVHPCRYEPRLPSRPSHASCTAAEEQRLVQFVRYQDFGVMYASDIRADECAVGIAQMTVKEGRQLSIVAEADELDSSNGSTEQHVSTVLDAEHGSKSWTPNLIDVERENRGWVRRHQFSTRWKKDLERPTPCVQRNGVWGSVRGFPVWRARSQVGSCECRCPGPRRPSQRKREMMSWNLTISLLQFKIREVIVCIFVXIIKRIRSAYYVSFVTR

SEQ ID NO: 116787 - protein, 104 aa, Triticum aestivum
  Clone ID: PAT_TA_11205.pep
PIFCLGLALVEDAVMNRGITSGTQKMGLANGDVVRTQSMDARNPSLRSETRSSYEINSSAAATCCTPWSGLAGVAAAAASPCMRADQLHANYSDQCIRYMQNQR

SEQ ID NO: 116788 - protein, 60 aa, Triticum aestivum
  unsure (1)..(60): unsure at all Xaa locations
  Clone ID: PAT_TA_11206.pep
RSRRSSWSSRTASASPRSPGPAPAPPPSPVXRTAWASPRSPAPAPAPPPAPGPPCRTPPP

SEQ ID NO: 116789 - protein, 201 aa, Triticum aestivum
  Clone ID: PAT_TA_11207.pep
MAEQFYTVASDSETTGDDKAPQSFPDVAIGIDIGTSRCSGAIWNGHQVELMKNTRSQKGMRSYVMFKDDTLSAGVTGGATKEHAHEERDILSGSAIFNMKRLIGRMDTDEVVQASKTLPFLVQTLGIGVRPFIAALVNNMWRSTTPEEVLAIFLLELKALVEMHLKHPVRNAVLTIPVAFSRFQQTRIERACAMAGLHVLR

SEQ ID NO: 116790 - protein, 131 aa, Triticum aestivum
  Clone ID: PAT_TA_11208.pep
AALGMLYRLDGIQGGDPMIREGKHAVSRELGRILEFVDKVLLKEQEEMGMDGAFDDYPEGCHGMNRPTVNRKVGFRGNEDNTEADESSESSSSTEAAETKAANSKKSANGKPGLAAPVPVHMESRRTGGEM

SEQ ID NO: 116791 - protein, 367 aa, Triticum aestivum
  Clone ID: PAT_TA_11209.pep
MALLMEPGSEPLTEGEKADLDAIAAIKESAAREYREEGNQFVKKGRKHYPDAVDCYTKAIAQMGALSPPNPDASVLFANRAHVNLLLGNHRRALDDAEQAVRLSPSNLKAHYRAAKAALALDLLPQAASFCRRGLEQDPANEELKKFLAQVEAQQRERDLKRAKVAQAISAAKDLAAAIEKRGLRLGKAAYQELTGVKKPKLDEQGVLHWPVLLLYPEVMSSDFIEDFPETDMFSDHLDLMFSESSPPLPWDENHAYTRDAIELYCQAGDGTPFSKSEMLKYLLEGTVDSGSLTESLDGEDGEHDTVKGSTAISPSQGKWIKVREGKTLQEALQHKDYIIPAVPVFFVVSRKSAFHSKFKAGNWSLP

SEQ ID NO: 116792 - protein, 321 aa, Triticum aestivum
  unsure (1)..(321): unsure at all Xaa locations
  Clone ID: PAT_TA_11210.pep
GIRHEDLFFVXXYVKCVRMTGALTDKEINXTYVKVLSQMSYFRXSGGRDHIFVFPSGAGAHLFRSWATFLNRSIILTPEGDRTDKRGISAFNTWKDIIIPGNVDDSMVKPDARAVQPIPLTKRKYLANFLGRAQGKVGRLKLVELAKQYPDKLESPELKLSGPDKLGRVDYFKHLRNAKFCLAPRGESSWTLRFYESFFVECVPVLLSDEVELPFQNVIDYTEISIKWPSSKIGPELFQYLESIPEERIEEMIARGREVRCMWVYALDTEPCSAMTAIMWELQRKVRRFHQSAETFWLHNRSIVNRDLVEFRQWGTPVPLP

SEQ ID NO: 116793 - protein, 228 aa, Triticum aestivum
  unsure (1)..(228): unsure at all Xaa locations
  Clone ID: PAT_TA_11211.pep
MPPKSDSVEGIVLNFVNEQNRPLNSQNVADALQKFSLKKTAVQKGLDALADSGQISFKEYGKQKIYLARQDQFDIPNGEELEEMKKANSKLQEELAEQKKITSEVESEIKGLQSNLTLEEIRSKEARLQSEVQEMEEKLKKLQSGVILXVKPEDKKIIEETFSEKANQWRKRKRMFKELWDNITENSPKDQKEFKEELGLEYDEDVDVNFHPYSEMLASLNKRRKVSR

SEQ ID NO: 116794 - protein, 174 aa, Triticum aestivum
  Clone ID: PAT_TA_11212.pep
GSRAGSSLRDGRAGAGTTGRGDGSVATSRGGRSVGGISRGAGSLESWGRGLDVWDRGDNGGCGGGGLGGLYGSSRANDRDGRADDGSSRADNGHGRAGSSRGLGAVSAVVGAVAVATTVAVGAVAVSSTVGVGGTVLATGLAVAASLSGIGGSESGQEGNGKLHHDESSKNPSS

SEQ ID NO: 116795 - protein, 247 aa, Triticum aestivum
  unsure (1)..(247): unsure at all Xaa locations
  Clone ID: PAT_TA_11213.pep
DCRFKRDEPGKHIVERIEYDPNRSAHLALVENVANKRKSYIIAAEGMRAGDTIESFRAGIPKSLLASMGGVVDPGMLAAKTAFRGNCLPMKMVPMGTQVYNVGSTTNKGAVFCRSAGTHATVIAKNDVDGVIRDVTVRLQSGEVRRVSAEACATIGVASNPAXQFRQLGKAGRSRHLNIRPTVRGLAMNAADHAHGGGRGKSKGNVNPVSIWGTPAKGGYKTRQKRNPNKHVVQERVRNQGKRRSTN

SEQ ID NO: 116796 - protein, 136 aa, Triticum aestivum
  Clone ID: PAT_TA_11214.pep
RRSTPSCPFSAAQRRPASPLPAQRLPALSPGGRLSPRPHPAQLPPPPWPDLPHVHHESTRSGGGDLDRGSVRLGKGIDAAEGKDYSGGGERGAPGGGKRVDVPVDKAPHALLFSGSPICCVLLPASLIVRSFMAAI

SEQ ID NO: 116797 - protein, 202 aa, Triticum aestivum
  unsure (1)..(202): unsure at all Xaa locations
  Clone ID: PAT_TA_11215.pep
RNTARPVTTGXKHIXXEDAPNLEAPLPSSRVSAADLNPFGRIVGRRRAWSRSASTMVQLGAACRSCPRTSVASHSRSPQGSGTASAAASPSLPTLRTARRSSSHKMLSVLTVSSDPGLLAATITWTPQATQLDSRHVHCRGAATLGWTKDLYTVAPSWTCVVLRSRPLPAAAAIQPAIVQAGARRKPDNLAHLHGSTSSFMS

SEQ ID NO: 116798 - protein, 121 aa, Triticum aestivum
  unsure (1)..(121): unsure at all Xaa locations
  Clone ID: PAT_TA_11216.pep
LPAAEFXRICRDLGALSESVXIECTKEGVKFACSGDIGSGSVILKQDPSLEKESEAVLIEMNEPVSLTFSLKYLTNFCKASGLSDSVKLCLSSEVPLLVEYALQDQSYLRFYLAPKIGDEE

SEQ ID NO: 116799 - protein, 120 aa, Triticum aestivum
  unsure (1)..(120): unsure at all Xaa locations
  Clone ID: PAT_TA_11217.pep
NLTSSKIRRGHHACDAGEKMVFLATRLRRSPASKFDCTPTHNLWQVITATITMPXDHSHFHGPCLVLRPCTCSGCSGDTLGAASAAGQRHAGLGTGQVRARPLHPCGSSGDRFXSASSEF

SEQ ID NO: 116800 - protein, 131 aa, Triticum aestivum
  Clone ID: PAT_TA_11218.pep
EEFGRGRPAFCAVGMLANNDFQAIPGEARQSELGQAGYYLLLVGTAAVYQCFCLGIIGAIYYGSALLAGVIITVLLPVTEVLAVVFFHEPFSGTKGVALGLSLWGLASYFYGEVRNKAPEAEHRTSPVCGS

SEQ ID NO: 116801 - protein, 334 aa, Triticum aestivum
  Clone ID: PAT_TA_11219.pep
MSQRAALLIGKLSHAQKEWQQCSEVASKLHEYPDGNREDFLSKCKSGEFDGIYALYRSNDSNPITGDFNAELLDALPKSLKYVCHNGAGYNNIDVAACTKRGISVSSTPIAVNDATADVAIWLMLGALRNIKQSYMAVNNGKWRGNFSLGHDPKNKTLGILGMGGIGSAVAHRAKAFGMKIQYHNRHQLPASEENGAKYVTFDELLKTSDVLSLNLALNPSTTHIIGKEQFNTMKDGVIIVNTARGALIDEAALVDALKSGKVWTCGLDVFEEEPKIHPGLLECENAVLLPHVGTATYETQRDMEILVLDNLKSAIKSDKLLTQVPEQKGKANL

SEQ ID NO: 116802 - protein, 92 aa, Triticum aestivum
  Clone ID: PAT_TA_11220.pep
MHPRSAATVRLCLVCLALLLLTRDVCSRNLVGAVVQKERHKQSHGGHGGATPEPPVEEGSDAGAKRGQLQRDLTRWEEIHTDYIYTQDVKHP

SEQ ID NO: 116803 - protein, 83 aa, Triticum aestivum
  Clone ID: PAT_TA_11221.pep
TFKAHAMVDSCKMAIFTLYHINSIRVTKHRKFFMLALQKRRGILFSRHSTSADPSGRSSHVLYKILTPSFPSPIPLPAVKKFV

SEQ ID NO: 116804 - protein, 208 aa, Triticum aestivum
  Clone ID: PAT_TA_11222.pep
SARGQLQQEQHQRQLQQEQHQRQLQQRQAQLLQQQQQQQQQLILEQMLQQQLQSSNFGQANMVDQVLLREQLLNDLHHQPHHFQRQHDAAIEQLIQAKFGHGHHREQHNDMLDVLSRSNQRQALPLEQQILLGLHHDQLQTQQLAHAIRQHAGREEERHLSGGWPMDDPSPFIRTGTSPNQSHASRLGQFDLLQSLQRSSSVEHHDHL

SEQ ID NO: 116805 - protein, 206 aa, Triticum aestivum
  Clone ID: PAT_TA_11223.pep
AAPAAASPPRRPLPRPRRPSRAAPPGLRWRRRGPCGCRCSTPPHGAARRRSPAAASAPTAAPCPPASRFPQLLVVPPPVQSAVAGRPAMPSLSLVAGPIQTLSGGQKQRVAIAGALAEASKVLLLDELTTFLDEYDQMGVVKAVRNSVTASGEVAALWVTHRLEELRYADGAIYMEDGRTIIQGDVSSISRFIKRKQARYFGHFEL

SEQ ID NO: 116806 - protein, 87 aa, Triticum aestivum
  Clone ID: PAT_TA_11224.pep
ARGIDFNPWGGYTLPLMFTWEELEDEKRGEDKLEFRVVMEQGAVRPGLMTAVPYDMMDWGEGSGWDVFLKKADNELNRQMASLAMDS

SEQ ID NO: 116807 - protein, 52 aa, Triticum aestivum
  Clone ID: PAT_TA_11225.pep
TTICTQERVLLLKDAAACCCYLFTRYLCCNSNSASAHKGIRLVPCPVLNKKK

SEQ ID NO: 116808 - protein, 145 aa, Triticum aestivum
  unsure (1)..(145): unsure at all Xaa locations
  Clone ID: PAT_TA_11226.pep
KHCENIDRYKXPLLASKIQYGQNKGKLYNEECDRFLLCMVHKLGYGNWEELKSAFRMSPLFRFDWFVKSRTSHELARRCDTLIRLVEKENQECDERDRQARKDKKNMTPTKRPSSSSPAMDSPMQTPSKRGRRDGSAPLGKRRRR

SEQ ID NO: 116809 - protein, 143 aa, Triticum aestivum
  Clone ID: PAT_TA_11227.pep
GIRHEGYLAEFASGDKRKTAATAAHEAYKSATDVAQTELTPTHPIRLGLALNFSVFYYEILNSPDRACHLAKQAFDDAIAELDSLSEESYRDSTLIMQLLRDNLTLWTSSDGNEPEPAAASDAPKAEESKTAESVEEPKAEAS

SEQ ID NO: 116810 - protein, 203 aa, Triticum aestivum
  unsure (1)..(203): unsure at all Xaa locations
  Clone ID: PAT_TA_11228.pep
MAVRTASVAAKAWTVSMFRTSTSPCAMTSSPQTSNSQTALSETLLLEHTAPEVLKSTSSAETTPRMARVPTFTPTTXAEKPNTSTLSIPAQYTGTGVGGAIPVTELGSIIVYTTTIPAVTYSAPTTVAETVEVATVSGVKVSTTVPATTITQATTIAAKTNVVTQTNTASAAPQSTGAAGQMSVDTTKSFGMSVVGALLYALL

SEQ ID NO: 116811 - protein, 150 aa, Triticum aestivum
  Clone ID: PAT_TA_11229.pep
FFFGIQSFFFLFWSGYLIPLLGSTTPRDEHSTGYATRAAQRTARHDTPSRAARPGRGPRRPGRACRGPARRRGPGRPAAWRPRPSSIFTGNPCSSLLERSSVLARLLLLALLRAVGSCRRPVRGRRARCQLPWAVRPWAPDMAIRGCGAA

SEQ ID NO: 116812 - protein, 225 aa, Triticum aestivum
  Clone ID: PAT_TA_11230.pep
RPAPAPAPKRKAPAAAIPATDAAGKKKPRVDERKTTNRRASPTTVDAPKSGDKFSKFREAWEFETAYTKLVVTMRRTKKALEELKPKPEKKSPEEVKPSSPCHRMRPRTFEELYPGRECREVLREMYGDRLGPMREALEDGARTELALRTIKRRLEKLEQAAVKMTRERRDPARVVRPMCELVVDRVAVLRGRAEAESAAALNRDGPCESPAGMSETKIAGEQWA

SEQ ID NO: 116813 - protein, 118 aa, Triticum aestivum
  Clone ID: PAT_TA_11231.pep
SSSPTSRRHPCLLPSRRTSSFPPAGRPPPLASHPHRTLETDEEAEPPSAAGRRHLLFDHIEGAPDYRPCVRAPPGRRRPKETNELGSDVAGRRLSATGMLPCHDFLTGPSFRIFKLPS

SEQ ID NO: 116814 - protein, 203 aa, Triticum aestivum
  unsure (1)..(203): unsure at all Xaa locations
  Clone ID: PAT_TA_11232.pep
MSLAVAPADGAILPWFGSGGGRRGSRDDAVASPLQDVALLADPFRILEHVPFGFDRDDVAMVSMARVDWRETSDSHEIVVDVPGXRKEDLKVEIEENRVLRISGERRREVEERKGDHWHREERSYGKFWRQMRLPDNADLDSIAASLDAGVLTVRFRKLAPEQIKGPRVVGIAGGDDSSAAKKTIGDAGAAGGEERQTKKVEL

SEQ ID NO: 116815 - protein, 89 aa, Triticum aestivum
  Clone ID: PAT_TA_11233.pep
SSAWALWAPISAGPRRAPPAAGRRRPAPPASSSRPPRPPPSPPAPPCPPTPRAPPRPPPPLPPRRPRPPWLPCQVRRTTLGPCLGRCAG

SEQ ID NO: 116816 - protein, 300 aa, Triticum aestivum
  unsure (1)..(300): unsure at all Xaa locations
  Clone ID: PAT_TA_11234.pep
DLLVAAAPKFCSGDLDFGRVGYDIVSFYAQGNDEAVIIHDALDFGHCRLSLAVPKEGVFDSINTLDDLLHMPQXTDERPMPVGTAFGYVGIERLKENRFKHASLXLVMVALEPYLDIGMVDAIVDLVSSGTTLRENNLKEIEGGVILESQAAWVAPLMSLHSIGXGSGMLGVCCLCVPDLAPFVGAALNXLGLPDMRTIMNPIGVLSQTSLCGLQGPTISPVYCTQDGNVAVDYYAINVVVPQKSLYKSIQQLRSIGGSGVLVSXLTYIFXKETPRWRQTSVRELGNVETCCKVRPPPPS

SEQ ID NO: 116817 - protein, 77 aa, Triticum aestivum
  Clone ID: PAT_TA_11235.pep
THSLGLTNKSQHIALGTVQNRRFTHGGHTSSSNPSSLQNFAYFFLPHVPKALLPQATPLPEETLLSLSDREVSTARY

SEQ ID NO: 116818 - protein, 177 aa, Triticum aestivum
  Clone ID: PAT_TA_11236.pep
HIRNGSLPEYQVIGRHLPSEANPTPKIYRMRIFAPNDVVAKSRFWYFLGKLRKIKKANGEIISLNQITEKRPQKVKNFGIWIRYDSRSGTHNMYKEYREMSRVAAVDALYQDMAARHRSRFRDVQILKVVEIEKTDDIRRPYIKQLLVKGLKFPLPHRINKKAGKKVFASKRPSTFF

SEQ ID NO: 116819 - protein, 143 aa, Triticum aestivum
  unsure (1)..(143): unsure at all Xaa locations
  Clone ID: PAT_TA_11237.pep
QATAHPRAATPHDTTVRSPHCSGQLHADHERRTTSGAAAPTCRPTAPAGTRRPSRQPCHPRSSRSSPKPCRQTALPPGAIAAPLPKAAASALNXKIPEPPPRHTPPMKTEEPAQQPKAGPPKRRLQEGYNVKRRRRPLPKTGV

SEQ ID NO: 116820 - protein, 171 aa, Triticum aestivum
  unsure (1)..(171): unsure at all Xaa locations
  Clone ID: PAT_TA_11238.pep
MKAPLVACTAEGEGTTGAQGKPVKLGPKEFATAVDMFDYFFALLHSWXEPNLEFNKYEQMVLEDLVXKGHAEPTKKIGSGVEAFEIRNHPVWQSRCFFIRRVDGSADDFSFRKCVDNILPLPEDLKAGNKNSNGKKGHHHKNGGGRGGRGGGGGRGGGGFRGGRGRGRRGN

SEQ ID NO: 116821 - protein, 322 aa, Triticum aestivum
  Clone ID: PAT_TA_11239.pep
EFGTRRENAFTPCRNSKRLKLLDQRGAEAHKVDATRNLLRKLSTKIRIAVRVIAKVSRKINKVRDEELVPQVNTLIQGFAKMWQDKLHSYQIQLQVISEAKNLASVTSGGTNGRDLAMELELELIKWIINFSSWVSAHRNFVKSLNGWLALCLNYEPQEAPTYSPRRIGAPVIFVICNKWSQAMDRISEKDVVNAMQALVSSVRHLWEQQNLDQSERSVAVREREKWIKMLERKALEINKEADELNRKLALVPGQQQSFQRCPTIRTYEAHHIEASSVHVNLRLVVQALEDFASNSLEAFQEIPRLDEEPTRPSRGSSRVPR

SEQ ID NO: 116822 - protein, 64 aa, Triticum aestivum
  Clone ID: PAT_TA_11240.pep
SWIMSSPVEMWYSLGALSHHPTFPLCLLRLLILSMPFVLQQIRFLYATIIYLVLNLTPYFILGL

SEQ ID NO: 116823 - protein, 103 aa, Triticum aestivum
  Clone ID: PAT_TA_11241.pep
RNTARISKAKTIGVLRCTGMRQHPVFIEVRMAQIKSVISTNRGERWMMSKKSAPIECHISAGDDMIHDYLRLLDGLQIFYYEVGYFICCAIDSEVHLLGFPGL

SEQ ID NO: 116824 - protein, 174 aa, Triticum aestivum
  unsure (1)..(174): unsure at all Xaa locations
  Clone ID: PAT_TA_11242.pep
MDRMAXTLGGRVSEELHFDTVTSGASDDFRKVTQMATAMVSKWGMSKKIGYIYFEDGEGQQLTKPFSEDTAKNIDMEVKRIVDEAYKQCKDLLTEKKHEVGLVAEELLKKEMLGREDMIRLLGPRPYEDSQDFHKYFSGEYGKAPGYVEPAGDGVKGPLVPPSPATFKDLDSRR

SEQ ID NO: 116825 - protein, 234 aa, Triticum aestivum
  Clone ID: PAT_TA_11243.pep
EEFGTRGGTKAAPGRVSVLNDGSIVVEVGGVEVGQGLWTKVQQMTVFALGQLWPDGSECLLDRVRLLQADTLNLIQGGLTAGSTSSESSCAATLEACNMLVDRLKPVMKKLRQQSAGAVSWDALIAQAITDNVNLSSSAYWVPAQESSTYLNYGAAISEVEIDVLTGAITLLRSDLVYDCGKSLNPAVDLGQIEGSFIQGIGFFINEEHETNADGLVVSDSTWVYKIPSVDTIP

SEQ ID NO: 116826 - protein, 188 aa, Triticum aestivum
  Clone ID: PAT_TA_11244.pep
RHSNCKNRRARPPVLAPCSTPPGEPGAVVVSRDEQYLLLLLLQRGGTARALVGPAPERGVLGAQHGVLAAEAGDLAVAPLGGVALAPPRLPRQRLGGAPARRLGGVGLDELGEVGHPEDEVQRAEVVHPVGREVGGQLAVGLALAPLVLAHRARPAAAASASAVAVHAAGHVARRRRPRTRGRTRGRT

SEQ ID NO: 116827 - protein, 158 aa, Triticum aestivum
  Clone ID: PAT_TA_11245.pep
VLDKMYAPAKDSSVPVLEDPAVLEEFDGILFGIPTRYGNFPAQFKTFWDKTGKQWQQGAFWGKYAGVFVSTGTLGGGQETTAITSMSTLVHHGFIYVPLGYKTAFSMLANLDEVHGGSPWGAGTFSAGDGSRQPSELELNIAQAQGKAFYEAVAKAHQ

SEQ ID NO: 116828 - protein, 210 aa, Triticum aestivum
  Clone ID: PAT_TA_11246.pep
MKVAEADRVGPRRRGAATSATKKNQHSTATTTGRLWRGATYRARLRGRTPPRPARPSAPATAGCRSTTAACAPSAPPCRAGDASPSPGAGARSRRAAPTAPSTGRSPSGPSRGRGSGATSTSWRGASGRAPGGDDGHGGRAADGGRPPRGPAARRARPPAAARAAAATAAGGGVPGGRAQAATAAGLPGGRGGRGRPARAATGAPRLDDP

SEQ ID NO: 116829 - protein, 112 aa, Triticum aestivum
  Clone ID: PAT_TA_11247.pep
GIRHEVDPSPSSSAPAAAPPPPETVVLRLKRRAKKKVSWKEGTVDNESLGRKSSKKCCIFHKEVPFDEDCSDDEADGGRRNPHGDAGEGTSGGKGGCSSSSHGHDHGHRHHH

SEQ ID NO: 116830 - protein, 307 aa, Triticum aestivum
  Clone ID: PAT_TA_11248.pep
SLARAFGALKVQLEAVDRKIDGEVGAARGELAALLEGMRLAIEGQLNLLDARTDELNDALGGLRRMEFLRKDQFEAFLDEFKESLGSNSGTEVDLDQVRALAREIVMREIEKHAADGVGRVDYAVGSAGGRVVRYSEAYDAGKRGGLLSALPFGGGDNGDQSQKILQPSFGEPGQCFPLKGSSGFVEIQLRKGIIPEAITLEHVSKDVAYDMSTAPKDCRLSGWYQGTHTETPPNHAAEMYALTEFTYDLAKNNIQTFDITAPDVGVVNMVRLDFTSNHGSSALTCIYRIRVHGHEPVTPVIASPLP

SEQ ID NO: 116831 - protein, 75 aa, Triticum aestivum
  Clone ID: PAT_TA_11249.pep
AAGSAVEDSEVAPVDSAVASVTAAAAASIRDRDRRVDRRACSTYVACMRSVNGQGPKKGQRCMHARLSVGSVSTC

SEQ ID NO: 116832 - protein, 77 aa, Triticum aestivum
  Clone ID: PAT_TA_11250.pep
LHHGSAICLITMHPFQTISTAHVCSCSFFVLCLFDHAYECPSVRFVHCLLITVVYTLMPTVFPAFFLYYANCLPFDY

SEQ ID NO: 116833 - protein, 135 aa, Triticum aestivum
  Clone ID: PAT_TA_11251.pep
MTKVQSMVASSRRKSRKAHFSAPSSVRRVIMSAPLSKELREKHGVRSIPIRKDDEITVVRGSNKGREGKVSSVYRLKYCLHVNGIVREKSNGQSVPIPIAPSKVVITKLKLDKDREQILERKSAGREEKKKQREA

SEQ ID NO: 116834 - protein, 254 aa, Triticum aestivum
  unsure (1)..(254): unsure at all Xaa locations
  Clone ID: PAT_TA_11252.pep
LNPTGNKSWSSTAVAAALELVDPPGCRNSAPAAXDAAARPDLLCAVLRQAADLRSAELLAALRCFLCPASDRAYAPPRPLKTRWKEAALAVANMAVDEPPTGAQVARRAAILLMMGHVGFASPEVCLHYLFASRNVEDPLVLAAAVSELDGGEVASLLRYLAKWVGKYSRFPEAQPCPEAVEIHKLEQCDSVPSLVAVARAMGLVLDQHFSHLVLNAELRQDLLAAGVMAKELAAEAEASGPILDLLRRMPQAV

SEQ ID NO: 116835 - protein, 91 aa, Triticum aestivum
  Clone ID: PAT_TA_11253.pep
MDCSAWMQPSYCYSTAEAPEDFEAYVTRLPKAEDFGLEGFQEVPLEVLAEAGGGVSIWDLSIAPEMAAAAASSAAASACTVPQQPLQQPSC

SEQ ID NO: 116836 - protein, 236 aa, Triticum aestivum
  Clone ID: PAT_TA_11254.pep
AFAIDAVVPNVVEHVLGLHNYHDGSYADDLVNYHERSLADDWFGTEAMDVLVGWTKNLCSSKDLPGCSVLDIGTGSGRLLQQLAKQGFSDLTGIDYSEAAIELARNLAIRDGFEHINFLVDDVLESKLERRFELVMDEGTLDAIGLHPDGPVKRMMYWQSVASLVSPGGILVITSCSRTKDELVQEVENFNQRKLGATLSEGALASDAVVFKYLDHVQAYPNVDGVCIATVAFLHT

SEQ ID NO: 116837 - protein, 191 aa, Triticum aestivum
  Clone ID: PAT_TA_11255.pep
LARPSNLHSSPPFRFRYTSYLGESHPASNKVVVEFSPDDLSNTHSLTPTQVSKLIKLAGPRYNPSTSIIKLSCEKFDTQSQNKRFLGDTISSLIKECKEGKDSFEDVPFDFRHHTPKKRAEFPKEWVLTKERKQYLEEKRQKTAYLEDQRAGNGLLVDGKKVLETSLPFMSESQPAPETVMVGGARGKPLR

SEQ ID NO: 116838 - protein, 186 aa, Triticum aestivum
  Clone ID: PAT_TA_11256.pep
MRTAFFVSALASTAFAGVVTQISDGQIQAPTTETAPAVVASSAVESVSSVIASSVVASVSSAVESSVEVSPIATSSALSTRMPVPIVNATVTSGASLTTIPAAVVPSAGLSTVVAGGNSTGNATISSHSLKASSTVTSSTKGGASGTSAGSSASASASGNAASSFYQSNAGMFGAVVLGAMGYLAL

SEQ ID NO: 116839 - protein, 66 aa, Triticum aestivum
  Clone ID: PAT_TA_11257.pep
GIRRERFASSSIGDVFRTIIKRDGYVGLMRGWKPRMLFHAPAAAICWSTYEASKSFFERFNEKRRK

SEQ ID NO: 116840 - protein, 151 aa, Triticum aestivum
  Clone ID: PAT_TA_11258.pep
MPGVSVRDVQADKFINAYAAFLKRQGKLPIPGWSDTVKTGHLKELPPQSIDWYYIRAAAVARHIYMRKTVGIGRLRKVHGGTKNRGSRPSHHVDASGSVDRKVCQSLAKIGVLENDDDKGGRRITQSGQRDLDRIAQTTVEAEEEEDEDDE

SEQ ID NO: 116841 - protein, 160 aa, Triticum aestivum
  Clone ID: PAT_TA_11259.pep
MVSELCPVYAPFFGAMGCTSAIVFACFGAAYGTAKAGVGVSAMGVLRPDLIVKNIIPVVMAGIIGIYGLVVSVLISNGLTQESSLFANFIQLGAGLAVGLSGMAAGFAIGIVGDAGVRGTAQQPRLFVGMILILIFAEVLGLYGLIVALLMNSKASDAKC

SEQ ID NO: 116842 - protein, 215 aa, Triticum aestivum
  Clone ID: PAT_TA_11260.pep
ARTPSLDHLLFPRSPPPSRCRRRGEEERRPAPVLLCPTGEPLLCLASCFPVLLAHSSWPPQAPQEATPRVSGLDSDEIRASPRWSRQSRTGATPSRSVLPRAPPPRTCCCLHASTSVLSVSLLPGQRSSCLSRPLQPSPRPLLHQGRRAPPAGVLAGAAAKSRRRSSPSSRLRRVQALCRDLHPAADRDHCRPLCLHPAAAGHSGPCTSGLTRGD

SEQ ID NO: 116843 - protein, 255 aa, Triticum aestivum
  Clone ID: PAT_TA_11261.pep
MANGKNVVAMLFLTTIVAVAATRPADTYGAAEENTLKMATPSRKGVDATLAATRVVAAEKSIKKAESATTSEEAAAAKQDGAKSASAALKYNAISQQATGKGSSISPGRKEAAGTLAATQYATTEKSIKKAETATTPEKAVAAKRDAAKSADDALKYGAISRKAAGTSSSTSPNRKEATTDLAAMHTAAGKMITKKAETATTPEEAVAAKRAAAKSTAAASKYGVISQQAAGTSSSTSPTRKEAVGTFGDARIAA

SEQ ID NO: 116844 - protein, 343 aa, Triticum aestivum
  Clone ID: PAT_TA_11262.pep
MANRKNVMAMLFLTTIVAVAATRPAETYGAAEENTLKMATPSRKGVDATLAATRVVAAEKSIKKAESATTPEEAAAAKQDGAKSASAALKYNAISQQANGKGSSTSLGRKEAAGTLAAAHYVTAEKSIKKAETAKTPAKAVAAKRDAAKSVDDALKYGAISRKAAGTSSSTSPNRKEGTTVAAKMFTKKAETATTPEEAAAAKQAAAKSTAAASKYGVISQQVAGTSSSTSPSRKEAAGTLADARIAAAEKSIKKAETATRPEEAASAKKDAAKSEADAMKYGAISQQAAGKIRQVPAAHPTAPPSASTASSLGGRAASCLGKHRSFPCRAQLLEGIPHKERE

SEQ ID NO: 116845 - protein, 128 aa, Triticum aestivum
  unsure (1)..(128): unsure at all Xaa locations
  Clone ID: PAT_TA_11263.pep
FFFRTYKSSSXLLYREVLSSSKTSISTHAAHRHTHAAAGKRTQAKHTATRTHTSRGHLGRPGRVGHGRGGEGGRGWSRSAGPPAAGMYTVRRSSHGSRQRLIERKPSPESGSCRSRPDSATVERGGAP

SEQ ID NO: 116846 - protein, 134 aa, Triticum aestivum
  Clone ID: PAT_TA_11264.pep
PGRPPWSVRERRGKVARMLHHRSTIPDFLAFDDLRGFPERWGADAEGHLVVAGDDEVVKNACGKSFATFPKGFFFTTSGGLQSYEHPLNEVKPVPRVDSKGEVCGTTYAVDEQAKKDTAGIPRVGSAADWSSQY

SEQ ID NO: 116847 - protein, 73 aa, Triticum aestivum
  Clone ID: PAT_TA_11265.pep
RVREITRNRFESGVLIRVCRCYTGEGLEHHATLQQVISEGRNRTEGKTNFVGEARAAPNHRKNLLLLVSRSGL

SEQ ID NO: 116848 - protein, 275 aa, Triticum aestivum
  Clone ID: PAT_TA_11266.pep
MNRSLSVRSKKGSGSGSGEKSAPKHRFTMASLRGTQQPELSKKLFKIIKSENHAIGAYEAAARERVGIAQQLSEWGEATEDETISEISDKLGVLLAEIAEQEDIYAQALEEYRGVLKQIRNTESSVQPSRDHKTKVSDEIAKLKYKEPQSTKIVQLEQELVRAEAQSLVAEAQLSNITRQKFKEAYDHHFAATIERAEKQIILAKHARRLLNLVDDTPIVPGDVHPPFAEVEAARQVLTDAEDDLRHYQLEREKQVEPLFQNLLRTRVQYEMRVP

SEQ ID NO: 116849 - protein, 110 aa, Triticum aestivum
  Clone ID: PAT_TA_11267.pep
MGKPTASVSGLKHKNPQAVALSMQEERDRKLADEREKRAAAAERRLAALAVQSGPSTAAGSSTQTTTAANDAACSCCFSSLAGKVPFHRYSYKYCSTTCMHLHSEMLEDD

SEQ ID NO: 116850 - protein, 254 aa, Triticum aestivum
  unsure (1)..(254): unsure at all Xaa locations
  Clone ID: PAT_TA_11268.pep
RYLXSYGDSEQTVPKTYAERVCRQFAQVGARGTTLFFSSGDRGLGGTDTCYTNDGRNKYQFLPNFPASCPYVTTVGATMNFEPEESAYRPSRNTSAGFRDLYSSGSGFSNYFPRPWYQDSVVPQYVDSLGDTYEGLYNKTGRGYPDLAAQGLYFAYFWNGTEGTISGTSASCPLTAGIFSLVNDALLASGKPTLGFLNPWLYKKGYKGLTDITKGFSYGCNVQGFPVTEGWDPITGFGTPDFPKLVKLAGAHVH

SEQ ID NO: 116851 - protein, 112 aa, Triticum aestivum
  Clone ID: PAT_TA_11269.pep
PPQSDRFMCVDPSWRKPKGIDNRVRRRFKGQAAMPKIGYGSNRKTRHMMPSGHKAFVVNNVADVDLLLMHNATFAAEIAHAVSARKRIEIIARAKQIGVKVTNGKARVKTES

SEQ ID NO: 116852 - protein, 516 aa, Triticum aestivum
  Clone ID: PAT_TA_11270.pep
PVRKSGSTHASAQPGSATSSPSLGGFETPPPPGRRTPSGAGAARQRQNWTGRFPPTPSTPMSTDDVPLSSEAGEEDTPETDGGGVGADATPVFVWGTNISVQDVNAAILRFLRHFRDPRDAGRVDPVMDEGKYMRAIPRILELQGGESLDVDAHDVFDHDPGLVAAEVRYPLEVLAIFDIVLMDLVARMEPLFEKHIQTRIYNLKSSICLRNLNPSDIEKMVSIKGMIIRCSSVIPELKEAVFRCLVCGFYSEPVMVDRGRVTEPHICQKEQCKASNSMTLVHNRCRFADKQIIKLQETPDEIPEGGTPHTVSVLMHDKLVDAGKPGDRVEITGIYRAMSIRIGPSQRTVKSIFKTYIDCLHIKKTDKSRLHIEDSMDTDNTNASKSSEDGHVTDKIDKLKELSKLPDIYDRLTRSLAPNIWELDDVKRGLLCQLFGGNALRLPSGANFRGDINILLVGDPGTSKSQLLQYMHKLSPRGIYTSGRGSSAVGLTAYVAKDPETGETVLESGALVLSD

SEQ ID NO: 116853 - protein, 128 aa, Triticum aestivum
  Clone ID: PAT_TA_11271.pep
QCIIAFHDRLLEPLELAGNPRKRNAPYRPHEARGLHGGRKSPQNPHQRRRKRQPRCGNPTSNSRPQEGQTEDEGGDRGGIPGHPAAHTGGEAEEEEAGGGEIGAQAAAATRQQVLKLRSCSRKCGGIP

SEQ ID NO: 116854 - protein, 237 aa, Triticum aestivum
  Clone ID: PAT_TA_11272.pep
MDGLALSEVNGLVPLTDISVGYLLTEASKAANLDCEVTSIAKNPLFDENLCSYDSFDAAVALHASRYQAAEQPAHTSNSTIWGAEETCDEFSFMLATARKQQGLNTSASSPPDSDNEVHSSNSEGFQGFLQDLAGGDTPGNPCADDVKAMEELCARSPPQSDNDFGLKDQPLDDAFWPESLGPLDLDIPPIRSLADEFILGDSQNSWSRMMENSMDAFRNMSFFVSDNNDSVLPPIM

SEQ ID NO: 116855 - protein, 329 aa, Triticum aestivum
  unsure (1)..(329): unsure at all Xaa locations
  Clone ID: PAT_TA_11273.pep
EFRGFVDACPVAFGGLTRLKLEHLTLAQXDFPEIFGICKRLEFLHLFNCDVEISSSLQVEHPQLSQLEIINCRFENGVDLKWLPKLALLTFKGWFSQEDPFCVGHAPLLQSVSITNIGLSYHKMLKLSEILGKATISDLHLNFRCEKIWIKPEGPRQLWQVFRTLKVVTLDNISEECDLTWTLFILQGAPFLKELCIQVWDNVCDMMGDEEERKKHAFSEERKDKGTEWEGLASDFKHHNLAVLRIYGFQAECKFFEFIRSVMEAAVDLEGIYLHNRVLCKRRNIMVPSTSKYPKTYKQKMSVRNKIYKGNCWMVGIHFPGWSAEVLQG

SEQ ID NO: 116856 - protein, 177 aa, Triticum aestivum
  unsure (1)..(177): unsure at all Xaa locations
  Clone ID: PAT_TA_11274.pep
MRCSADRTPRRWRPWTLPPHALRDHHGGGGRGGVLAGPTHCGAPSTTGPPAAPXGAPMTSGTPSTSGRRAHAPGQSRAPRAGAPAKQPGPTDARPTDEGRGGVACASGASLGREGAAGGRGLDRGHGHVSAASASRPYSRRQRPPAPVVVRARGPAGGGGDRGMGAAGGGGAVGRSG

SEQ ID NO: 116857 - protein, 152 aa, Triticum aestivum
  Clone ID: PAT_TA_11275.pep
INHPKQKKSRNMTTHQARPEPEPPPTSNAAQLATHPTEQRKRRHRTCHSQTYLRITTAEETSVGFLEVRVLLARGRRSTKSCCASSSAGAGETSWAHPRRGRRERRHAPAKSCCASSSAWVRFISASLRPGLRLGGELAPAPVRPRDPRAAG

SEQ ID NO: 116858 - protein, 41 aa, Triticum aestivum
  Clone ID: PAT_TA_11276.pep
ARLNPSVTQKSQLSEGSEVIFTDDVCLQVFIEHLQELAVQG

SEQ ID NO: 116859 - protein, 157 aa, Triticum aestivum
  Clone ID: PAT_TA_11277.pep
KFFQLIIKPHSPTFHVQRRAAVRHVRVVYLWCIAYGESCLGAYIHGAGDGDGAGTRCGGVGEDAVHGGGAKDAHPRAAQEAALYVVSTRTTEEAIRIFTEGLKPVRGVRKMGSSMTDSSDDDVELGSSEDSTPRGGGGTGCRPHGRSIKRDIATAPF

SEQ ID NO: 116860 - protein, 122 aa, Triticum aestivum
  Clone ID: PAT_TA_11278.pep
MAGVRSLVLLLLVLAVALSASASSIAGGDHLQLGLLSGGAGRGECRGTVAECGGEDAEGELGSASAEAHRRVLQGRGYISYGALRRGTVPCNRRGASYYNCRPGAQANPYHRGCSRITRCRG

SEQ ID NO: 116861 - protein, 199 aa, Triticum aestivum
  Clone ID: PAT_TA_11279.pep
CAGSRIYVQEGIYDQFLAALQKKVQALKVGDPFSADTFQGPQTSQLQHDRIMEHIKSGKEEGATVYEGGERHGKDGFFIQPTIFTDVKPHMRIVKEEIFGPVVVVSKFKDEADIVAQANDSMYGLAAAVFSKDVTTAISTAHKLKAGTVWVNCYNQLHSQTPFGGYKQSGIGRELGEYALANYTSVKAVHVNISQPSPI

SEQ ID NO: 116862 - protein, 63 aa, Triticum aestivum
  Clone ID: PAT_TA_11280.pep
FFLINRDVHSLILEVQASTPSCIALLANGQIDRLGLQDKSSLLGCSHAGSLYIIGVATNIGQH

SEQ ID NO: 116863 - protein, 95 aa, Triticum aestivum
  Clone ID: PAT_TA_11281.pep
KMNKADQPPTPMGAWRQHYRYHHHHYAYGLPHDVRRSPAETSCSRTFLSSFAHCWGCHLSGCGPTLFSKRQQIFLALEPSVFCSSFTGGCGAGSG

SEQ ID NO: 116864 - protein, 262 aa, Triticum aestivum
  unsure (1)..(262): unsure at all Xaa locations
  Clone ID: PAT_TA_11282.pep
ILAELPXDCFGAYIISMATAPSDVLAVELLQRECHIKKPLRVVPLFEKLADLEAAPAAVARLFSVDWYMDRINGKQEVMIGYSDSGKDAGRLSAAWQMYKAQEELIKVAKHYGVKLTMFHGRGGTVGRGGGPSHLAILSQPPDTIHGSLRVTVQGEVIEHSFGEEHLCFRTLQRFTAATLEHGMHPPISPKPEWRALMDEMAXVVATXEYXRSIASKXPRFVEILXRRXTPETEYXRVDFGNRHPXXXXRGGXXKPPGIGFF

SEQ ID NO: 116865 - protein, 111 aa, Triticum aestivum
  Clone ID: PAT_TA_11283.pep
GKNGSLLRHLVGHLVLSKSIPGKRVVVAVEIAQSVRQMFWKCLITRHGVNRLGGVSPKKGVVSVRWDLFMTAENMYGVCQSRRSKWLGTASAKGRARVGWFRVVHDTKPVA

SEQ ID NO: 116866 - protein, 386 aa, Triticum aestivum
  Clone ID: PAT_TA_11284.pep
MAGVLDALASYVTNMLTEMAKEEVSMLIGVSDGIRDLSIKLGDLKNFLADADRRNITDESVRGWVGELKRAMYLATDIVDLCQLKAMEQRPSKDMGCLNPLLFCMRNPLHSHDIGTRIKALNKELDSICERGNKFKFAKLEVYQDMKMTRSLATDRKTDSLLERSGIVGEKIEEDTRALVEVLTSEEGSDKTGRHMVVAIVGVGGIGKTTLGKKVFNDEAIKAITAAGGDQPGGGGTRDRALLVDSLKNAIEDKKFFLVLDDMWGADAWNKLLMTPFGYGGLGSRVLITTRSETVARNMKAAHCHHVDKLGREDAWSLLKNQVLTTEENGHEVDVLKEIGLQIVENCDGLPLAIKVMGGLLCSKEKSQFAWEDVLNDTSISISNVR

SEQ ID NO: 116867 - protein, 211 aa, Triticum aestivum
  Clone ID: PAT_TA_11285.pep
IRHEAYAYWKGNAAVATSRQELVKCNVSSTQDWNARIYTQDWFKESKEGYKTSDLGSQCTHRSLMPLQHYWPVRDNNKCASIQYAVNWGNSHKQLAQRIGKEASNFVEQEVNMDHVYDYMLHLLREYAKLLSFKPTKPPEAVEVCPDSLVCQAEGTERKFLMESMVKSAHDSGPCDLPPPFSRRELTMLKRRKENSIRQVEMWERRASITR

SEQ ID NO: 116868 - protein, 118 aa, Triticum aestivum
  unsure (1)..(118): unsure at all Xaa locations
  Clone ID: PAT_TA_11286.pep
SXLLVVXPRYIQNERKIPPPPARNKTTHTRYQQDHEPETPILFQNSSTVEPVLSCVRHFDHSSFTASSRWVATSSLNSVDRLHVSADTSANHLPRTTSRYLKQCNLMVQIHRKPSWMW

SEQ ID NO: 116869 - protein, 232 aa, Triticum aestivum
  unsure (1)..(232): unsure at all Xaa locations
  Clone ID: PAT_TA_11287.pep
GTGGRGGATXWGEAPPDPFNCIHVADTPTLDALKKGAPERWRLIKAHGTAVGLPTDDDMGNSEVGHNALGAGQIYAQGAKLVDLALASGKIYEGEGFKYIQQSFETGTLHLIGLLSDGGVHSRIDQLQLLLKGASEHGAKRIRVHILTDGRDVLDGSSVTFVETLENDLAKLREKGVDARIASGGGRMYVTMDRYENDWQVVKRGWDAQVLGETPHKFPSALEAVKKLRDDP

SEQ ID NO: 116870 - protein, 241 aa, Triticum aestivum
  Clone ID: PAT_TA_11288.pep
GIRTRPPRTIVADVLSVKQFPRNLLLELNLPSSILPPEFGIVCTHPMFGPESGKHGWSNLPFVYDKVRVAEEGAQKAKCDRFLSIFEQEGCRMVEMSCAEHDRHAAGSQFITHTIGRVLAQLNLQSTPINTKGYETLLQLTENTVSDSFDLYYGLFMYNVNATEQMDKLDRAFEEVKQMLYGRLHGVLRKQIVERVPMPGAPSSRSREARDSPAASTQETKPLSPSPCHTFSTVAFSTAKC

SEQ ID NO: 116871 - protein, 273 aa, Triticum aestivum
  unsure (1)..(273): unsure at all Xaa locations
  Clone ID: PAT_TA_11289.pep
VRPRGSKKLDPEPWRCRRTPGQKWRCSKEAHPDSWYXRGWLDPGRRRSRKPVERKSASPAHQSQQPPLSAVTFATRDAEPLPSLPAGANTHGLSLGGAGSSQMHVDAFSYGAKYFLGAQSDVGELSXFFSGASGNNNRGFTIDSPTDSSWHSMGSSLPPYQLSKPRXDSGLMQGGFSYSHYEPSQELGQVTIASLSHSQEQDCRSLGGGGGGGGGGGGGLMGNVKQENQPLRPFFDEWPGRRDSWSEMDDERSNGTSFSTTQLSISIPMPRCD

SEQ ID NO: 116872 - protein, 251 aa, Triticum aestivum
  unsure (1)..(251): unsure at all Xaa locations
  Clone ID: PAT_TA_11290.pep
VTPFLIVFTFTGVFLVNYILLSSAAAEATHNVIHTFHDAVELMNEIFTSSMAPLVLLAVLLFSSHIIALTSVIASHVVTEHFFGVNLSLFAHHVLLKLLSMIPAIYSAKVAGSEGVYQLIILCPVIQAFTLPSAVIPVFRIASSSWIMGNYRVSLRVEILAFLAFCLTLFINIIFAAEILFGDSAWTNSLKGNTETPILXPHTVLILMSCASIAFALFLAATPLKSSSREAETQELCVHSQREAPEEIQRS

SEQ ID NO: 116873 - protein, 313 aa, Triticum aestivum
  Clone ID: PAT_TA_11291.pep
AFVPYFLDEETGWGLEVDELKKQVDEARSKGITVRALVVINPGNPTGQVLAEENQKKIVEFCKNEGLVLLADEVYQENIYVEDKQFHSGRSSARSPGGTVPELPLVSVRSVSKGYYGECGKRGGYMEVTGFNADVREQIYKVASVNLCSNISGQILSSLIMNPPKVGDESYESFMVERDGIISSLARRAKALEEAFNSLEGITCNKAEGAMYLFPRLHLPQKAIGAAQAAGAAPDAYYALRLLQATGIVVVPGSGFGQAPGTYHFRCTILPQEDKIPAIISRFKEFHEKFMDEFRDVSRDEAPTGATIESGGD

SEQ ID NO: 116874 - protein, 319 aa, Triticum aestivum
  unsure (1)..(319): unsure at all Xaa locations
  Clone ID: PAT_TA_11292.pep
KTKTVCVTGAGGFVGSWLVKRLLSTGEYTVHGTVREPXGDRRTGHLRALDGAGEXLRLFKADVLDYASVAYAVSGCGGVFHVASPVPADKPQNPEVEVLAPAVXGTQNVLKACHQAKVGRVVVVSSAAAVAMNPGFPRDAVLDEDAWSDEDHCRTTGMWYALSKTLAEREALAYAEKTGLDVVTVCPPLVLGPLLQRVANTSSLVLVNLLKGDCDTVEDKARNAVDVRDLADALVLAYETPEASGRYICGAYRKKLSEMVDIVKSFYPDLTRPMKFVEGEEERMMSSKRLQALGWKLRAVEECLRDSVESYKAAGLLPE

SEQ ID NO: 116875 - protein, 142 aa, Triticum aestivum
  Clone ID: PAT_TA_11293.pep
LKQVGTCRTARDVTHRQKGRSRTADAGRQTGSRGPAPVTAAQGARKRGPGAPAGCPARRGGHRGQAAAEPGFARRAHGRAAAGPSGQSRKAPGPAPPRPSGRPPKYPPPAAPGGRALPPPAVQAAAADGRALLAPAGPEPSP

SEQ ID NO: 116876 - protein, 46 aa, Triticum aestivum
  Clone ID: PAT_TA_11294.pep
RKNRYTAQRNIASGLFSPLRILLCKLIACHPNSLQLDALQTLLLLL

SEQ ID NO: 116877 - protein, 51 aa, Triticum aestivum
  unsure (1)..(51): unsure at all Xaa locations
  Clone ID: PAT_TA_11295.pep
RHEAPPGSASCTRXCGDFSCTLPGHHLLEHASARIFLNLLKLPNRPCRKKK

SEQ ID NO: 116878 - protein, 268 aa, Triticum aestivum
  Clone ID: PAT_TA_11296.pep
GKDCQCGMLFSCCSSNCKCENDCANKSFQLRPLFKTKLIKTEKCGFGLIAEDEIKKGEFVIEYVGEVIDDRTCEERLWKMKRQRYTNFYLCEVSSNMVIDATNKGNKSRFINHSCEPNTEMQKWTVDGETRVGIFALRDIERGEELTYDYKFVQFGADQDCHCGSSNCRKMVGTSKSVNSFVLHNGNSASSQDQHDMKKRKTTSDNCIGEIIRLWDRRDKMYVPAVVHDYDEYTGMHTLLLDEETTENFDMREEDWDFLPRPEDPEED

SEQ ID NO: 116879 - protein, 97 aa, Triticum aestivum
  unsure (1)..(97): unsure at all Xaa locations
  Clone ID: PAT_TA_11297.pep
LQAIRHEVQKGGKXREAQXNIVRLYLANIRLKNAATDVVITAYEPLLINPLSESAQAIAAGPAVPAEQAGCLPMSEVFRLAVMNFDVHDWNLFNGSG

SEQ ID NO: 116880 - protein, 106 aa, Triticum aestivum
  Clone ID: PAT_TA_11298.pep
VGNRLGFDRCEQVCNLECDGTHAQNLLTVISAALFPEGVTWAHTPSRLRTWRLHHRVHLNRQCQHTSCSNNRARSLLPSHTLLLIISVCPSSAHTLMCLTVSVCCG

SEQ ID NO: 116881 - protein, 69 aa, Triticum aestivum
  Clone ID: PAT_TA_11299.pep
GRSGLRRPPEIRGAVVGRRRGRAAPMAEGAIGGRLPDDQLVHGGRHPAGSAPAGATAQSSSAGELRRRR

SEQ ID NO: 116882 - protein, 129 aa, Triticum aestivum
  Clone ID: PAT_TA_11300.pep
RGRGEFSACTTSMADRKVVLLDSGSEKEVEVGADGMIQLSRCVASVEFTGELKVCVVAWWQGEVKPKKAWKVFKPKKAGRNYGTFNLGRACKVKVTVAWSLLSYYPVNRPNSPYGSLALLREAEGQSTV

SEQ ID NO: 116883 - protein, 313 aa, Triticum aestivum
  Clone ID: PAT_TA_11301.pep
PPNSSARENIIATGRTGTMYRAVLPDGSFLAVKTLQDSQHSESQFTSEMKTLGQVRNRNLVPLLGFCIAKKEKLLVYKHTPKGSLYDQLHEEGKDCKMDWPLRLRIGIGAAKGLAYLHHTCNPRILHRNISSKCILLDDDYEPKISDFGLARLMNPLDTHLSTFVNGEFGDIGYVAPEYGSTLVATPKGDVYSFGVVLLELITGERPTQVSTAPDNFRGNLVEWITYLSNNSILQDSIDKSLIGKDNDSELMQFLKVACSCTVTTAKERPTMFEVYQLLRAIGEKYHFSAGDDMMLPPLSTDGETPDELIVAM

SEQ ID NO: 116884 - protein, 57 aa, Triticum aestivum
  Clone ID: PAT_TA_11302.pep
FFFSAFGICGTNNRHLQDTHRPLRALTSNANGPATTTQSALGHFARQLSHEDCPGKN

SEQ ID NO: 116885 - protein, 209 aa, Triticum aestivum
  Clone ID: PAT_TA_11303.pep
MRIETCYFCSSPVYPSKGITFVRNDAKAFRFCKSKCHKNFKMKRNPRKLAWTKSFRRAHNKEMTVDSTLTFAQRRNVPVRYNRDLIQTTLKAMGRVSEIRQRRERAFYKARMRGNKQRQREEDRKLVEENQHLLPPSERFAKEEVEQEDMEVDVQKVKEKVAARRKELEAEESELSELEETTPKTRSKTKKMMMKRKVGGGVEAMDVDE

SEQ ID NO: 116886 - protein, 317 aa, Triticum aestivum
  unsure (1)..(317): unsure at all Xaa locations
  Clone ID: PAT_TA_11304.pep
RSWRRRTPTPFGCGRSSSSPPSPSPRTGPGSAPRSGPGSRAAGAGGRGSTASLHRRRRGLAGARIAAVPWRLDAAASLPRFDPGSPGCHCDYKENGNGADHATKIRDIDATGSCQLXEKLQSSQVXINNLERWLEVAAILSEEHSRLLEQNKGLEAEIVSLKEEMTSARRRFNDKISESDAEISQYRQELATASEKLLQEKSTNSTEVGKLQEMNRITSLKLXEKVSEENXLVEDQVKELEEANXEAERQSRLVHAAEMLSEDKFRHEAEILTMQHSTEDLKPKLESIAREKSLLKLWFADLGRVVERGRSVVIPPG

SEQ ID NO: 116887 - protein, 210 aa, Triticum aestivum
  Clone ID: PAT_TA_11305.pep
YNQHLAKRLLSGKTSSDEAERNMLVKLKTECGYQFTSKLESMFTDLRTSQDTMQSFYANLAGDSDGPTISVQILTTGSWPTQPCATCNLSPEILGVSEQFRAHYLGTHNGRRLTWQTNMGNADIKATFGERKHELNVSTYQMCVLMLFNSTDSLTYKEIEQATAIPPVDLKRCLQSLACVKGKNVLRKEPMSKDIFDSDAFHFNDKFNSK

SEQ ID NO: 116888 - protein, 195 aa, Triticum aestivum
  Clone ID: PAT_TA_11306.pep
NHLISQNADLKATVGERKHELNVSTYQMCVLMLFNSTDSLTYKEIEQATAIPPVDLKSCLQSLACVKGKNVLRKEPMSKDISDSDAFHFNDKFSSKLVKVKIGTVVAQKESEPEKQETRHRVEEDRKPQIEAAIVRIMKSRRVLDHNSIVTEVTKQLQARFLPNPVVIKKRIESLIEREFLERDKVDRKLYRYLA

SEQ ID NO: 116889 - protein, 76 aa, Triticum aestivum
  Clone ID: PAT_TA_11307.pep
KSVQYAVDYNTNREVRYVRICVVEVELRSTRYLQCHARSSASLSLPRARHPPLIHLGGRGHRIGDALASSTTSRRS

SEQ ID NO: 116890 - protein, 239 aa, Triticum aestivum
  unsure (1)..(239): unsure at all Xaa locations
  Clone ID: PAT_TA_11308.pep
TVVIFAAARATHGTGDGSTIVISCSEATDIKIWHXQSGKELGTVDTNQLKNNMADISPNGRFIAAAAFTADVKVWEIVYSKDSSVKEVNRVMQLKGHKSAVTSLCFTPDSEKIITASKDGTIRVWNINVRYHLDEDPKTLRVLPVPLHDSKGSTCLYEHMGISPDGKVLAVTSGSTLQWLCAETGAVLDTAEKAHEGAISGIAWAPRTIPNGGAPAYILATCGDDKKVKLWLAPEVSST

SEQ ID NO: 116891 - protein, 78 aa, Triticum aestivum
  unsure (1)..(78): unsure at all Xaa locations
  Clone ID: PAT_TA_11309.pep
CQMCPCCPKSRLALSMGKLACMEISPPMPQLVGCRCLSCQLLLGVKSLSRLWXLVLQIMPELQKXLWGDHFAYFDGAS

SEQ ID NO: 116892 - protein, 220 aa, Triticum aestivum
  Clone ID: PAT_TA_11310.pep
SSQHLGFKYYTLPPTQPDKQNNMRPSVATVILSFALTILAAPVSSAEASLESISSASASHRRNAIPVALIEPLGARSQRVNTGTGRGGRSIVVEDEEIEARSQRVNTGTGRGGRSVVVENEALEARTQRVNTGTGRGGRSVVVEAPVEARSQRVNTGTGRGGRSVEIEAPVEARGQRINTGTGRGRSIAVEAPVEARGQRVNTSTGRGRRLAKAEAEAFE

SEQ ID NO: 116893 - protein, 285 aa, Triticum aestivum
  unsure (1)..(285): unsure at all Xaa locations
  Clone ID: PAT_TA_11311.pep
ASKNSFQXVVSIGRLQHRNLAPLLGYCRRRGELFLVYKYMPNGSVDKYLHGREGKPILNWAQRWHIVKGIASCLVYLHEEWEKVVIHRDIKASNVLLDGDMNGRLGDFGLARLYDHDTDPQTTHMVGTIGYLAPELGHTSKATPLTDVFAFGVFILEVTCGQRPVNPNLEDSQVLLVESVLDQWNKGSLLDPVDKQLGGNYNADEACVALKLGLLCSHPFANARPTMRQVMQYLDGDMPLPEMSPTDLSFQMMTIMQNGGFDQFIMTYPSSTARIDSTSVLTVGR

SEQ ID NO: 116894 - protein, 296 aa, Triticum aestivum
  Clone ID: PAT_TA_11312.pep
GIRHEAEIFNREEAALVLPMFEGASETGKIKRSALKNWVVSAYLDRKSLAHSLNDTKTAVSQLHSLIRILVLIIIIIITLLLMGIATTKILVVISSQLLVVVFIFGNACKTVFEALIFVFIMHPFDVGDRCVIDGIQMVVEEMNILTTVFLKNDNEKVYYPNSALSTMPISNFYRSPDMYDTIDFAIDVKTSMESIAALKARIKGYLESKPTRWHPIHTVNLKDILDVNKINMALCAQHTMNFQNIREKSIRRSELVMELKKIFEEMSVSYQLLPQKVELSYVGTNPLPVNVSQGR

SEQ ID NO: 116895 - protein, 106 aa, Triticum aestivum
  Clone ID: PAT_TA_11313.pep
AAARRPIPSPALPPRGLALAPAASPTAPPRGSSGRAGGPAARGQPCSSPVLAPGADADLHAPTPPPSPRVRSGRVEGAPPPRALGPDLPAWVMARLPDGRCILASD

SEQ ID NO: 116896 - protein, 226 aa, Triticum aestivum
  unsure (1)..(226): unsure at all Xaa locations
  Clone ID: PAT_TA_11314.pep
STHASGLRKNVLQVFNXSPRQFPEEIPGMSYNHSERQHEFFWGEQQSSSYMKAVCEVQHPATPSPRSAVVDSKMPQQVLESLFKIPERRTYEPSKMDWKKVVKKLQSYNHPITASNQERPKNGDGYREFRGVSARHYDTMKGYYQKAAVAYSKGDKSYASYLAEEGKHYRELGHKEDEKASREIFEARNKHITNTXTIDLHXQHVKQAMKLLXXHMLXXXCMPSTL

SEQ ID NO: 116897 - protein, 71 aa, Triticum aestivum
  Clone ID: PAT_TA_11315.pep
GRVGTRASCRADIGMASSELSVSHQIRTRQRQLCDGVYECIAWLSCGGGGGPGVRRAERGRKAEGMMLLTL

SEQ ID NO: 116898 - protein, 277 aa, Triticum aestivum
  Clone ID: PAT_TA_11316.pep
MLLACEALKDVLPLIEKLPSSESGDCLSNILHNMREAFRRLMDHTKHHIESNMKTHQDDIIHPMTCFLICSVRSLRSHRNLVQSTLAPGDDSNSFGHLLHDVITCWKSGLTEYANIYHADVQQRCIFLLNNRDHFNRKTDGLLNELLSDWQIVEQYDNEFKLLLIKRYTDEACAPAKSCLNRSCWWWWGSQRPSLDAFTSKFNETFDSQRTWKVPDVALRQDLRDSIEECILSDYTRCLENCSSSGLFCSCLQIDSAGEIYTTENLQTTVQSLFEGC

SEQ ID NO: 116899 - protein, 210 aa, Triticum aestivum
  Clone ID: PAT_TA_11317.pep
MLVLFSLLTLLGTLSSFTSATALTYKLTPNEKECFYTHVVKQGAKVAFYFAVQSGGSFDIDYSVTGPSKEAGKEKVILEGEKERQGDYVFTANFPGEYRFCFDNSVSTFTDKLVDFEISVEDEPRANLPQKSGASPEQLSGVEETILKVSSQISTLTRQQKYFRTRENRNFSTVRSTEKRVFNFSLLEGAVMVGMACLQVFVVRMFFTAV

SEQ ID NO: 116900 - protein, 188 aa, Triticum aestivum
  unsure (1)..(188): unsure at all Xaa locations
  Clone ID: PAT_TA_11318.pep
FGSTHFVSKRLQPDLSXTELFTLLWFILSGCIHIFFEGYYVMNVLDIGTHQTWIGQMWKEYAFSDSRYLTQNAFVLCMESITAIAWGPGCLLVAAMVLTRHPLRFPLQGLVSLGQVYGDVLYYGTAYFEHIVYGLSYSRPEPFYFYFYFIFMNAIWXVIPGALIYQSVARSASALATVQRLEASKKMK

SEQ ID NO: 116901 - protein, 209 aa, Triticum aestivum
  Clone ID: PAT_TA_11319.pep
TVSGDLSAIRSSRGGPRPRICQKYIECPALFQGRKFDLRYIVLVRSICPLDILLCDVFWVRLANNQYTLEKTSLFEYETHFTVMNYNGRMNHMNTPEFVKAFEKEHQVKWLEIHESIRIMIRRVFESASAVHPEMQNSFCRAIYGVDVMLDDKFKPKILEVTYCPDCTRACQYDTQALVGSQGPIKGSDFFNTVFGCLFLDDLTNVSPL

SEQ ID NO: 116902 - protein, 65 aa, Triticum aestivum
  Clone ID: PAT_TA_11320.pep
AELVKEVVGFQGKLVWDSTKPDGTPRKLMDSSKIHGMGWKPKVPLKEGLVETYKWYVENVIADKK

SEQ ID NO: 116903 - protein, 157 aa, Triticum aestivum
  Clone ID: PAT_TA_11321.pep
GSALEPLPRLTLPPACMPPPGPHISVGTPSPLRVADVRSHAGVWKVVRLGRDGVSFPSPLAWALARGLGGAVVEGTTPEWEGHGPVLWATARAALAGRDTAQAFGAAAGCAARTSSLAAGRWHSATGAEACEEQDGNTAGRLGPHRSRPPRHPGVRS

SEQ ID NO: 116904 - protein, 115 aa, Triticum aestivum
  unsure (1)..(115): unsure at all Xaa locations
  Clone ID: PAT_TA_11322.pep
AGRSAIADVVAREYTIHLHKRVHGVSFKXKRAPRAIKXDQGFRXNAMGTRDVRLDPQLNKKVWECGIKGVPFRLRVRISRKRNDEEGAKEKLYSYVQAVNVKDPKGLQTTVVEDA

SEQ ID NO: 116905 - protein, 81 aa, Triticum aestivum
  unsure (1)..(81): unsure at all Xaa locations
  Clone ID: PAT_TA_11323.pep
ILPXYTXNDXTSXSKKEKKKRLDEHTILFVQSTNQEPLPATSGVRSLYESRWRGRRGATPTGAXWLSRAAVVTASATPPGV

SEQ ID NO: 116906 - protein, 98 aa, Triticum aestivum
  Clone ID: PAT_TA_11324.pep
GNTTATKYTTAIMGVPFEALLPYAIMTGFFAFSAVSVGKLKEMQNGGKKTRRGIDAWDRQMMERDRRLTGFMRGQTDKPVAPEGFELNNPWRCEQRFI

SEQ ID NO: 116907 - protein, 208 aa, Triticum aestivum
  unsure (1)..(208): unsure at all Xaa locations
  Clone ID: PAT_TA_11325.pep
TFLLSYTQHPGFLVLLFQNLCKRKSINYRLFSSFPCSHSSLPQSTSTTSSKEQTSYYVQYTYVSVKHPLIQPNSVAGVHRESVRQVVGHRHVAETVASGVETSEVDPGFSHEGLLPVDAAGQPVAVDAHLLLAHLDLPVEKQPRPLGLRALAGEQSAAAARVAYEAAQHVGVSDDLEEEGEHQLGPTLGVLHPAPHRRQAVPAGPLLX

SEQ ID NO: 116908 - protein, 133 aa, Triticum aestivum
  Clone ID: PAT_TA_11326.pep
SGYRSRASTLTPPDAIIVAKRSQHLSKARGQEAAASRRYNGSKFPSEAVAAMGEGRSTTSEDMDVRRGKEHSFRTMLPGKSTTPARVAVAFAGSGLRPERGFLPETSTNRPTTNRRLTTTTEPQPGQHHGVRR

SEQ ID NO: 116909 - protein, 153 aa, Triticum aestivum
  unsure (1)..(153): unsure at all Xaa locations
  Clone ID: PAT_TA_11327.pep
MGPKAVSKTPTKTGKQANAAAKAALRGSYANKKRAIRKNTSFHRPKTLELSRAGKYPRKSVPHAPRMDAEKVLIHPLNTESAMKKIEENNTLVFICNVKANKRQIAAALKEXYDVSCVKINTLIRPDGSKKAFCRLTADVDALDIAATKLAIV

SEQ ID NO: 116910 - protein, 141 aa, Triticum aestivum
  unsure (1)..(141): unsure at all Xaa locations
  Clone ID: PAT_TA_11328.pep
GEVDGRRAHPLAVLARPRVGLLRPSGWRRGALTRRLRLQLRLGLDGRRRWRWRHEEPGCGRSPPPPTGQGLAPAHPSARPPRGGXPPARAAGPPRGRLGTPPPPPCPPALPAPAAVGHVKFGRHRGEVCGGGTDCAASKKK

SEQ ID NO: 116911 - protein, 72 aa, Triticum aestivum
  Clone ID: PAT_TA_11329.pep
MALALRLLLALLAIGSCIAADHVDLWPMPKSVSHGTQRLYVSNNATMSMAGSKYSDGKAILKDAFQRMLDLM

SEQ ID NO: 116912 - protein, 442 aa, Triticum aestivum
  unsure (1)..(442): unsure at all Xaa locations
  Clone ID: PAT_TA_11330.pep
KVADQDELWPMPNSVFHATHRLHVSNNATMSIAGSNNSDGKAILQDAFQRMLDLMKLNHNADGANPSSFPLTGINIVALPTQDDPRFXVLDVYNLTIPSMAEPLYAQIKAQIMYWSTSSLTFIKRIPXTLRSHPILIPSYPKLWSCSYSYSERYTMPDAIDIVRYAEKRGVNVLAEIDVPGHARSWGVGYPELWPSDSCREPLDVSNNFTFKVIDGILSDFSKVFKFKFVHLGGDEVNTSCWTETPHIKEWLNNNHMNVSDAYRYFVLRAQKIAISHGYEVINWEETFNNFGDKLDRKTVVHNWLGGDVAPKVVAAGLRCIVSNQDKWYLDHLDATWEGFYLNEPLKGINNTEQQRLVIGGEVCMWGEQIDASDIEQTIWPRAAAAAERLWSPLEQISEDTRSATSRLSRFRCLLNQRGVAAAPLAGDGRTAPYEPGPCVRQ

SEQ ID NO: 116913 - protein, 144 aa, Triticum aestivum
  Clone ID: PAT_TA_11331.pep
MTPGLRDWDLWGPLIFCLLLSMLLSFNAGVDQRDEVFSGVFAMVWIGEAVVTLQIKLLGGNISFAQSVCIIGYTLFPIVIAALLSALHLPQIPRIPVYLVLVAWSMAAGVSILGGSGVVKNRVGLAVYPLFVFYLGLGCLCFIS

SEQ ID NO: 116914 - protein, 202 aa, Triticum aestivum
  Clone ID: PAT_TA_11332.pep
GSGDVGSSLACCAAPSARPPGRAACAPASAAPAPSPSSPRAPARPGGSAPASASRRGLLGLPPGALPGRQGARQWIASQPARPPPWGPAVPAVRASLGPPSPGGAGPLRTLRAGGPSLARRSGAPRPHRGSVPVGICALPGQGLRTSALASVLGGGRYLPAPGPQPGLLRSGLCSVVKLKPTSLFYTHVLLLYVHYMSFRRS

SEQ ID NO: 116915 - protein, 265 aa, Triticum aestivum
  Clone ID: PAT_TA_11333.pep
FGTRVPWLDTWAEWVMHGLPRTKFGGFQHETYNSFNKDELWDDTLMMSALPLAKIGLTLNRPEYVEEAKRQFILHCQYLCDTSTGLFFHGWKWEDKGGLEVGHNFARARWARGNSWLTIAIPDFIELLDLKETDPLRQFLIGILESQCQALLKLQGENGMWRTLLDIPVSEGSYEEASATAGFAYGMLKACRKRYISGDVYLQSAVKAIKAVMGCISAEGELEQTSFGTGMGHDLQHYKDIAITSMPYGQAMAIMALGEFMRTFI

SEQ ID NO: 116916 - protein, 107 aa, Triticum aestivum
  Clone ID: PAT_TA_11334.pep
AASASNARRCCKCDQPGHWARDCPWQATSYGSSASKAHLCSKCNQPGHWSRDCAVQAALHGSSAGNGNGSLGFCFRCNQFGHCPSDCPAPYSSAGGNGGRGWSGLQK

SEQ ID NO: 116917 - protein, 131 aa, Triticum aestivum
  unsure (1)..(131): unsure at all Xaa locations
  Clone ID: PAT_TA_11335.pep
MSWQEYVDTSLVGTGNIXDKALICDVEGATAWAASADFSLSAEERAAIARSFGDKSEPKKVISEGVKVNGVKYMTIEASDDSLKAKKGKEGVVAFKTTQAVIIAHHPDTIQTPNAFNSVVELGEYLKKHGM

SEQ ID NO: 116918 - protein, 252 aa, Triticum aestivum
  unsure (1)..(252): unsure at all Xaa locations
  Clone ID: PAT_TA_11336.pep
MSTDVAADVPAPEVEVTADPVVETTAEAAAGDAKPAKETKAKAAKAKKPSAPRKPRATPAHPTYAEMVSEAITALKERTGSSQYAIAKFVEDKHKAHLPGNFRKILSVQLKKLVASGKLTKVKASYKLSAAAAKPKPAAKKKPAAKKKAPAKKTATKTKAKAPAKKAAAKPKAKAPAKTKAAAKPKAAAKPKAKAPAKTKAAAKPKAAAKPKARPAKXAAKTSAKDAPGEKAPAAAAPKKPARRDGAPPREP

SEQ ID NO: 116919 - protein, 48 aa, Triticum aestivum
  Clone ID: PAT_TA_11337.pep
FFFWQEESMPRTKVSTAVLSFIDHSPQGGKLGLILNKRTTANQLAVQS

SEQ ID NO: 116920 - protein, 97 aa, Triticum aestivum
  unsure (1)..(97): unsure at all Xaa locations
  Clone ID: PAT_TA_11338.pep
QTRCPCTSWRCQIGGWWAQFQHYQDGVYNAHPGTRLNHGSTXSGYGEDEVTGESYWIVKNSWGEKWGDSGYLRMKKGIIDKPEGICGIAIRPSFPFM

SEQ ID NO: 116921 - protein, 292 aa, Triticum aestivum
  Clone ID: PAT_TA_11339.pep
MLRIASRSGLLGGRRCYSAAPKGGLSISGVSDIIAVASGKGGVGKSTTAVNIAVALAKEFKLKVGLLDADIYGPSIPTMMHLHEKPEVSEDMRMIPVENHGVRCMSIGFLVDKDAPIVWRGPMVMSALEKMTRGVAWGNLDVLVVDMPPGTGDAQLSMSQRLRLSGALIVSTPQDIALIDARRGANMFRKVQVPILGLVENMSCFKCPKCGEKSYIFGEGGAQRTAEDMDMKFLGEIPLEIDIRTGSDEGKPIVVSSPDSASAQAYLRVAEKVTQRLKELAVERLMGPEISL

SEQ ID NO: 116922 - protein, 49 aa, Triticum aestivum
  Clone ID: PAT_TA_11340.pep
DDWFIEIAQDNISRISGKARAGNSEREVHSPTASVSAQSVSSARSHGSS

SEQ ID NO: 116923 - protein, 118 aa, Triticum aestivum
  Clone ID: PAT_TA_11341.pep
CKVYCKKNRSRRRNTIKWHRVTLNRSQAPKKQEEIKHRDTTAMGFFNVLIRWYRPAKPEMETFQALLIAGSGDASPLSSSAPRPHEPCGCTRACSRCTFWLLQSSQENSGSGRTAGTG

SEQ ID NO: 116924 - protein, 152 aa, Triticum aestivum
  Clone ID: PAT_TA_11342.pep
MSTPSRKRLMRDFKRLQHDPPAGISGAPHDNNIMLWNAVIFGPDDTPWDGGTFKLTLQFTEDYPNKPPTVRFVSRMFHPNIYADGSICLDILQNQWSPIYDVAAILTSIQSLLCDPNPNSPANSEAARMFSENKREYNRKVREIVEQSWTAD

SEQ ID NO: 116925 - protein, 126 aa, Triticum aestivum
  Clone ID: PAT_TA_11343.pep
LLLWTGGINPPGGQGTRKHRERDEGRDASRDRKVEPKDDRSAFTGRRLDDDDDGRGHSRDRRTDRDDRSGASREARSGRDDDRHDSKGKRSDPDRKGGSREQRTDQSPRRDSVGDRMADRDESNGG

SEQ ID NO: 116926 - protein, 171 aa, Triticum aestivum
  Clone ID: PAT_TA_11344.pep
QVYLKLWNGDRIAQASDILQSVSSQVNAALENRPISIQLRGLFQTCKKGSPARARVVYAPVLEVGGEGRLVRACKVITEAFVKSGLVLERDARQELRLHATIMNVRHRKSKKSNRRNDSFDARNIFRQYGEQDWGEYPVPAVHLSQRFKFDKGGYYHCCCSIPLPEVAQTE

SEQ ID NO: 116927 - protein, 152 aa, Triticum aestivum
  Clone ID: PAT_TA_11345.pep
MSTPARKRLMRDFKRLQQDPPAGISGAPHDNNITLWNAVIFGPDDTPWDGGTFKLTLQFTEDYPNKPPTVRFVSRMFHPNIYADGSICLDILQNQWSPIYDVAAILTSIQSLLCDPNPNSPANSEAARMYSENKREYNRKVREVVEQSWTAD

SEQ ID NO: 116928 - protein, 191 aa, Triticum aestivum
  unsure (1)..(191): unsure at all Xaa locations
  Clone ID: PAT_TA_11346.pep
MSTPSRKRLMRDFKRLQHDPPAGISGAPHDNNIMLWXNAVIFXGPDDTPWXGGHVRRLTLSQLYRRDYPNKACQLFCFVSYGCFHPKVFNAGXGRICLAYSYTNLSGSPIYDVXMPYLTFYSVLSADVDPNPPISSSKIPEAARMFSRRTSESTNAKYREIVQQIWGLLTKGRARRPLLGSCNKQPWHLCL

SEQ ID NO: 116929 - protein, 280 aa, Triticum aestivum
  unsure (1)..(280): unsure at all Xaa locations
  Clone ID: PAT_TA_11347.pep
FLAQKISEDIEVGAKPLINLKGYLVGNPATGENNIDYGSRVPYLHGMGIISDQLYETIMEHCQGEEYSNPKNALCAQALDRVQXLWNEISHPHILYKKCVYASSRPNDGSTERKILKEEVGVLKHPPPRPPMGCQTYGNYLSYYWANNNITRKALGIKKGSKDEWMRCHKRDLPYSLDIKSTIKYHRNMTLKGYRALVYSGDHDAIIPFLGTQSWVRSLNFPIVDEWRAWHLDGQSAGFTIAYTNNLTFATVKNGGHTAPEFEPERCLAMFARWVSHEPL

SEQ ID NO: 116930 - protein, 54 aa, Triticum aestivum
  Clone ID: PAT_TA_11348.pep
FFLTDPLPRLIIIYLLLHTCMVLVSRAQTKRRSTRHTRTHTISSYFWWSCSWRS

SEQ ID NO: 116931 - protein, 282 aa, Triticum aestivum
  unsure (1)..(282): unsure at all Xaa locations
  Clone ID: PAT_TA_11349.pep
YHTHQPSKCTPRPPSSPSSPALPLPRSTLPLASPLVTPSPVLXTRLSPPASSSPSPGSQLPPTLSLFSSSRDPPPTSSSSVLLSLRESPTAVASPGPLPPLSRPPTAPTDTASRSLTMSPASTSTPPSSVSPRATARRPSPAPXSSPAASLSLAPPLPPAAPTLPATVPQPPLLATPPSLSHLLSTPARLLTPPPXMTSAMVPAYSTXSLPTAPSPCPLLAVTLPPAVSLRLPPTPPLASRLRSALPVPPPLSLSCYKRIFPVSPGLCYYVMTSFAFPSLLR

SEQ ID NO: 116932 - protein, 167 aa, Triticum aestivum
  unsure (1)..(167): unsure at all Xaa locations
  Clone ID: PAT_TA_11350.pep
VRSLLPPNRATMSGRGKGGKGLGKGGAKRHRKVLRDNIHGITKPAIRRLARRGGVKRISGLIYEETRGVLKIFLENVIRDAVTYTEHARRKTVTAMDVVYALKRQGRTLYGXRRLDSCSPPAVGQLPRLLSVMCAVVDEIYWFACVVFWSWGSISSVTLCSMQSVRF

SEQ ID NO: 116933 - protein, 159 aa, Triticum aestivum
  unsure (1)..(159): unsure at all Xaa locations
  Clone ID: PAT_TA_11351.pep
AHWPXIWAGRXRCVRFAYCQPSXRKLVCXPDLASEHTWEKKKKKRRGCSPDRRNPLPRCPRPRSRRSPASPAAPPRPPPSSSTAAPRFSSQLEVEVVVRPPHLVVVPTPRLARCNSEQKSVHQITQPIIARRRHLRLATVVDLHHLFPVKKKHLRFQQK

SEQ ID NO: 116934 - protein, 158 aa, Triticum aestivum
  unsure (1)..(158): unsure at all Xaa locations
  Clone ID: PAT_TA_11352.pep
TPIHTFSPWSLSSKSVSELSVSVPSNLKAEEPLRWARVDRQDLNRIPRSHSNAAMAPSRTTPTTMIPNPSTSPSRKQSSVKSRCEDRVPCAIKLVLSCGYLLWQTCFRDQGSWSSLDVGRGPMMLSKSSLQTVFDRRSSLDGSGLLRYASSVXWRELG

SEQ ID NO: 116935 - protein, 142 aa, Triticum aestivum
  unsure (1)..(142): unsure at all Xaa locations
  Clone ID: PAT_TA_11353.pep
CNNHHPLPGHRPVPRRSLNRQVPSLLPAPPLYALRVARLMAGEAARGGHAMKGLSAAARSLQIPVTTVANPNSCRYTPIGHGHRLRRRLEALLLGWWRLPWRHGRWWDKQRRRDGGPGGFRFVWLLPGAYLRCPXWGSSGRH

SEQ ID NO: 116936 - protein, 65 aa, Triticum aestivum
  unsure (1)..(65): unsure at all Xaa locations
  Clone ID: PAT_TA_11354.pep
MAKSKNSSQHNQAKKAHXNGIKKPKTHRYPSLKGTDPKFRRNHRHALHGTMRALKEVKEGKRESA

SEQ ID NO: 116937 - protein, 231 aa, Triticum aestivum
  unsure (1)..(231): unsure at all Xaa locations
  Clone ID: PAT_TA_11355.pep
WTQKRQMYAAAGGPRKEAAAGGGPWVVPTVGFPPPGTMAHAGMAHHPGQPPPFCRPLHVWGHPTGVDAPLPLSPPSMLPVWPRHLAPPPAWAHQPPMDPVYWHQQYNAARKWGPQAVTQCVPPTMPPAPMMQRFAAPPMPGMMPHPMYRPIPPPPSPVPQSNKVAGLQLQLDAHPSKESIDAAIGDVLXVKPWLPLPLGAQPPSLDSVMSXELHKQAYPXPAGGDNLRRAA

SEQ ID NO: 116938 - protein, 174 aa, Triticum aestivum
  Clone ID: PAT_TA_11356.pep
AATRTRKFVDEVRGLEKNWMLDLGHPLLNRVADSFVKAAGIGAIQAVTRDSYFMAIEGESGGTGAVSGATGSSKRTFPDLNGGTSNSKSAEAMVKSVSKESFQWGLAAGMHSGLTYGLAEVRGTHDWKNSALAGAVTGAAVALTSDNASHEQVVQCAITGAALSAAANVLSDIV

SEQ ID NO: 116939 - protein, 136 aa, Triticum aestivum
  unsure (1)..(136): unsure at all Xaa locations
  Clone ID: PAT_TA_11357.pep
XIRHEGAIQAQRRPRSSSGCSGRPPSEGRAPWAHGHGREEHRCGCVLWRGDPVPGVVSTTGASPSATMVASSGTTDSLATEPPESTQSMETATVASAILVDQTEEEGDEARHLTGGECSFPPFLLSFCSSLVVLRA

SEQ ID NO: 116940 - protein, 297 aa, Triticum aestivum
  Clone ID: PAT_TA_11358.pep
LFQAKGKKYFGTCGDQGTLGNAQTAAIVKADFGQLTPENSMKWDATESSQGNFNFAGGDYLVNFASQNGDLVRGHTLVWYSQLPQWVQNINDKTTLTNVMKNHITKVMTHFKGKIYAWDVVNEAFNEDGTLRNNVFMKVLGEDYIRIAFETARAADPNAKLYINDYNLDSATYAKTTGFISHVKKWIAAGIPIDGVGSQTHLGKSGSFNNPDNVPAAFKAVCAAAPECAMTELDLAGADSTSYVKVVNACVNTKNCVGITEWGVSDSQSWRSSDSPLLFNGSFQKKAAYTAIVNALK

SEQ ID NO: 116941 - protein, 43 aa, Triticum aestivum
  Clone ID: PAT_TA_11359.pep
VNKVDVLVNFPPLYVPHRVSASLVVSKKWDRELASSISIDKKK

SEQ ID NO: 116942 - protein, 222 aa, Triticum aestivum
  unsure (1)..(222): unsure at all Xaa locations
  Clone ID: PAT_TA_11360.pep
GIRHEGWAEFYYRSFLRVHGYKSKVSAADVVYGVTALLECMSAESNDSKECSAAEQFWVAYSALSPSNVDQLQKGMQSAIEIQRXAILRQGSSAITKSGFIRSAKKFRWVKLDDPVDTSKLCHPQALTKFCFFLMDALKERGARTKPLVCACLGREPEKVLVVGVWGKPRLGAVQGNSFGNAFRSAAGEIGADYFHDMFESSWIVLDVVAVSSFMIRLTEKL

SEQ ID NO: 116943 - protein, 367 aa, Triticum aestivum
  Clone ID: PAT_TA_11361.pep
DCTIIAAEDGPNYVSSVIDTTSQQKRPLEPDSYQNALQNRVSGTTRARHAPARKLQTPGHVMSTQEPQAHSGMGELVTIAATSPLLSPDQDQPLAEATPERWSHMGAKKSMWEPFKALPRDLSTTTGCAQFRPSIDTVDLTYTDVAGANRYYPTRQPVISTLDHYTNRAVNSVQARSFPSSVSTMEAGNLCDGRNVGHSGFYPRETMPATQPLRLTESPMLASFNYEGSSRNQMEFQLRNSHCPQDQSIGSASTPYGAHNQYIGSASTLCEAHNHYMGLTSSLCGAHNQYIGSASTPYGSNLNGMGSASTQYGSNLNGMVSGSTSYGSNLNGRIPLTLEDLSRHPLQPNIDRRVLSLSRVGVLRFLG

SEQ ID NO: 116944 - protein, 146 aa, Triticum aestivum
  Clone ID: PAT_TA_11362.pep
RSAAPARRGVAGGGGDRGPDDGAVPCQGAGRRASPARAAPARKGCAQGDDGNAVPDVGGAPRVAGRRPAPARRAAPGRGGGAKDVDVVVPPDGARRQLGSSRRVAPGRRGFTKDEDDVLPYEGARKHMVSRRATPSQRRFTAARGE

SEQ ID NO: 116945 - protein, 110 aa, Triticum aestivum
  Clone ID: PAT_TA_11363.pep
TLMGSSFPVKNIQGTMIVHQLVHRSRDILHLIEAMNTSEAPTDDSRLCRDPHSMRIIHSLNFRTYRYRTHGAIRSVSDRRLQSFMYDSRLPDYLYVSLQCSQYSRSVQVI

SEQ ID NO: 116946 - protein, 245 aa, Triticum aestivum
  Clone ID: PAT_TA_11364.pep
SLLNRLLDTNPETRITMAEVMQSRWFQKGFRPVRFYVEDDQLHSLGDSESEELGLVEPTEPPPPPPLPPPLPPPPQQEDDDSGWESDSSVASCPATLSSEERQRPAGRLTRPASLNAFDIISFSKGFDLSGLFEERGSEVRFISAQPMETIVTKLEEIAKMKSFSIRRKDWRVSIEGTREGEKGPLTIGAEIFELTPSLLVLEVKKKAGDKAEYDDFCNKELKPGMEPLVHHQPGSARNVPSDTE

SEQ ID NO: 116947 - protein, 415 aa, Triticum aestivum
  unsure (1)..(415): unsure at all Xaa locations
  Clone ID: PAT_TA_11365.pep
KSLVITGMWQDSVCVSDVXPYYNRLVAGESGVDPIDRFDASKFPTRFAGQIRGFSSDGYNDVTYGSRLDDCHRYSFVCXRKALASAVLALGSDAMGKIDXACAGLLVGTGMCGLHVFSDGVQXLFDKGYRVITPFFIPXAITNMGSALLGMDIGFMGPNYSISTACATSNYCFYAAANHIRKGEADVMIAGGTEAAIIPIGVGGFVACRALSQRNDDPKTASRPWDKERDGFVMGEGAGVLVMESLEHAMKRGAPIVAEYLGGAVNCDAYHMTDPRADGLGVSSCIRQSLQDAGVAPEEVNYINRHATSTLAGDLAEMNAIKQVFKDPSGIKVNATKSMIGHCLGAAGGLEAIATIKAINTGLVHPSINQFEREPAVEFDTVPNVKVEHEINVGISNSFGFGGHNSVVVFAPFKP

SEQ ID NO: 116948 - protein, 217 aa, Triticum aestivum
  Clone ID: PAT_TA_11366.pep
TRPPVSWTWVQCSSEAAPRVLSITLSEKNITGSIPEELTKLSALVELRLDGNSFSGGIPDFSGCRNLQYIHLENNQLNGALPSSLGDLPNLKELYIQNNRLSGHIPRALSKKSIIFNSSGNNLQGPSDSISHGTIIIIVCAVVGAILLLAVAIGCCLCTHKRKKKPSRETVVLAAPAKKLGSYFSEVATETAHRFALSEIEDATDKFERRIGSGGFG

SEQ ID NO: 116949 - protein, 73 aa, Triticum aestivum
  Clone ID: PAT_TA_11367.pep
DPTYRNNCTSILLILHLLAPGAVLSILLELYLPIYIYIYIYIYIYIYIYIYTIFRCNHCSSITRFPRYNDPHK

SEQ ID NO: 116950 - protein, 162 aa, Triticum aestivum
  Clone ID: PAT_TA_11368.pep
GKLKSVFLPDDLTSWNWDIHTVLANENSFWWVDLCCGILSYDLDQHQSALGFIPIPTACLEDGYRQDRFVSISTGELRFVHIFRKDDLFCDYGIKSQQCEDYVKTWSWRDGRWIEEYEMKFADFWEGTSYSSSRLPKFVPAYSTVDPCNHNLVLLLTNWPTF

SEQ ID NO: 116951 - protein, 285 aa, Triticum aestivum
  unsure (1)..(285): unsure at all Xaa locations
  Clone ID: PAT_TA_11369.pep
EPDRRNRGGQGWRAIMWDTTVISRXWSQRFRVDVDNISVDRSYSGLLPQLWNDETRELELKRLILYTPTLSVHDDNLLYVMAKMNSEDDKAWVITVDMKCEAVEAIAPYSTRGRKLTSWHSPCTFPEYLDPATPGDHVAMHSRRICAADCVLQMLLTRDWFREIGERFEFERPTHVECLSLIQCCPVSSVLSDIQEVVKYAFSTGEGEAAPKAVDLCSRAFEDFDVLLRELLHDPASSTEGMSCKISVALRALDSILDIVPPTLRALADACHQKGGKHIDLVRTW

SEQ ID NO: 116952 - protein, 206 aa, Triticum aestivum
  unsure (1)..(206): unsure at all Xaa locations
  Clone ID: PAT_TA_11370.pep
DHLANCKKWLLLVVGLPAMLSSSEAYVFYAGGRDGWVVDPAESYNHWAERNRFQINDTIVFARGEGEGAGALRPAADPAGLPRVPRAPPRPPAGARRRPARRSGPSGPVPSSSAAAARSRAGRXVVRRRVGAAPPALGARPAPAPRAPPRRPPAPGRAEAPDMSPGHEGMSRSSLQAPPPTASAARLDLDVIAVGVVVGVLGALVL

SEQ ID NO: 116953 - protein, 247 aa, Triticum aestivum
  Clone ID: PAT_TA_11371.pep
RRRSATRHPNLLPLRAYYLGPKGEKLLVFDYMPNGSLSAFLHARAPNTPVEWATRMTIAKGTARGLAYLHDDATIVHGNLTASNVLLDDGSSPKIADIGLSRLMTAAANSNVLAAAGALGYRAPELSKLKKANAKTDIYSLGVIILELLTGRSPADTTNGMDLPQWVSSIVKEEWTSEVFDVELMRDATTGPDGDELMDTLKLALQCVDPSPSARPEAREVLRQLEQIRPGQEGPGDEAHVASASNE

SEQ ID NO: 116954 - protein, 172 aa, Triticum aestivum
  unsure (1)..(172): unsure at all Xaa locations
  Clone ID: PAT_TA_11372.pep
QPKNFWNKXVTQKRRQRGIDPAPHKPMASGAVTAASPGVEGGHRKPRAAAAGGSLARTRRPGVPPLPGCPEYRRPLALRRRAAQPAARRGAAVGXGGGAAAAPGAGAADVSSALPRSEXLARGGAXSGTSTWNYDGVLRSVLVGXVLHWSLSELEHQYDYPSVHDLTLPCQD

SEQ ID NO: 116955 - protein, 296 aa, Triticum aestivum
  Clone ID: PAT_TA_11373.pep
GLMKYHPVVAAGVHPLMQHVPLRVLRSRGLLDKIPFTTVITDLSTCHPTWFHKLVTRCYCPSAEVTKRALKAGLKPSQIKVYGLPVRPSFAKPVPPKDELRRELGMDEYLPAVLLMGGGEGMGPIEATARALDNALYDESLGEPRGQILIICGRNKKLTNRLQSINWKIPVQVKGFVTKMEECMGACDCIITKAGPGTIAEAMIRGLPIILNGYIAGQEAGNVPYVVENGCGKFSKSPEHIAKIVADWFGPRSDELQIMSQNALKLARPDAVLKIVHDLHELVRQKSFVPEYACAT

SEQ ID NO: 116956 - protein, 182 aa, Triticum aestivum
  Clone ID: PAT_TA_11374.pep
GAAHTWPRPTKAPARRTPLRQRRTVPSPRHNRIQGNGMSVAGGTIATGTDRAATQTMGQSASPGVDALSTHHHHHHHGCLDCSRHDYFSNNLHHSSATIFSDEKRGCTPSNMTMIFLYRGSTHHIHACVQTWSNQAQELLIPGVSRPNLPARNTHQDNNTVRFQAHATTKSKPIERQWLAAL

SEQ ID NO: 116957 - protein, 94 aa, Triticum aestivum
  Clone ID: PAT_TA_11375.pep
DDRDYSKQHSRSRNMDDGEEDYKRRSGAGRYDRDDKPNGDRRHRGDDDRGKGDRHRRDERDRRVRSPDADRHRREDAGHREASRHREKRHQDDR

SEQ ID NO: 116958 - protein, 80 aa, Triticum aestivum
  Clone ID: PAT_TA_11376.pep
MSYPAPQQPGYYGPPPQQGYGQYPPPQQQMYYQQGPPPPQEEPKKDRGCLTACLATLCCCWLCGETCECCLDCLDCCDCC

SEQ ID NO: 116959 - protein, 152 aa, Triticum aestivum
  Clone ID: PAT_TA_11377.pep
GRFEQSGGWIRALLEEAENERMHLMTFMEVANPKWYERALVLAVQGVFFNAYFLGYIVSPKFAHRVVGYLEEEAIHSYTEFLRDLEAGRIENVPAPRIAIDYWRLPADARLKDVVTVVRADEAHHRDVNHFAADIHFQGLELNKTPAPLGYH

SEQ ID NO: 116960 - protein, 192 aa, Triticum aestivum
  Clone ID: PAT_TA_11378.pep
MAALARRAGGSPAAALWAAARGFASVGSDIVSAAPGVSLQKARSWDEGVATKFSTTPLKDIFHGKKVVIFGLPGAYTGVCSQSHVPSYKNNIDKLKAKGIDSVICVAVNDPYVLNGWAEKLQAKDAIEFYGDLDGSFHKSLDLEIDLSAALLGRRSHRWSAFVDDGKIKAFNVEKAPSDFKVSGAEVILDQI

SEQ ID NO: 116961 - protein, 150 aa, Triticum aestivum
  Clone ID: PAT_TA_11379.pep
GSIPTSTSVSESAVIDASFSDVWHLIKLQDFSKFWSKLDKSEFVKGTSDETDIVKWTFKDGAELEVKQEEHSSIDHFITYSVITSKPELSYSSVVSTIRVYPVTSGTHENKTFITWSGNFSSDADASVIQDAKFKRREALADLAKVVSKK

SEQ ID NO: 116962 - protein, 195 aa, Triticum aestivum
  Clone ID: PAT_TA_11380.pep
MGRPRDERGRHGWPVSRSGKTAATTAAGGEGSLQWFVSSGKERKIMAVESLLKVEERKKGEAGKKIRIGRGGCARPITYTRLARGLFSWTLGPAWRANRPNVRPVPRPQTFTFFLCLLVSISSSLHHRAISHHYRWSKEEHSAVLSTATDSTAQELSEWNAKYWDKFGFVFMICASKRTAPEVLAELKFCICPFE

SEQ ID NO: 116963 - protein, 60 aa, Triticum aestivum
  Clone ID: PAT_TA_11381.pep
FFFSTIMNNEHVDLGIVAAKQKKNFHQKACYPSVATPIPSFWVSGVHGASKLCWNQILKP

SEQ ID NO: 116964 - protein, 294 aa, Triticum aestivum
  unsure (1)..(294): unsure at all Xaa locations
  Clone ID: PAT_TA_11382.pep
MIRDKFSGNAGYCFVDFASPDAASKALSLNGQLIPNSNRPFKLNWASGGGLADRSRDERGPEFSIFVGDLGPEVTEFVLVQLFQNKYQSTKSAKIMSDXHQQKALTEMQGVYCGNRPMRISTATPKNKSGGPGGXAAWACHKAAAAPEWACTPWALPQWAATTGAPQPMNQFTDPNNTTVFVGGLSGYVTEDELRSFFQGFGEITYVKIPPGKGCGFVQFVQRHAAEMAINQMQGYPIGNSRVRLSWGRSQNNSGPAGTPYRPAPPPPVPFGPGMGMPPQHPYGGGGGYGPMMK

SEQ ID NO: 116965 - protein, 95 aa, Triticum aestivum
  Clone ID: PAT_TA_11383.pep
SADAWVRMKPQAIPPPALTLTVTKARSITCRTARSRRRPSRGPLPVILSRLLSRRSPPPRSTGCNAAYNGGINGNGARNGDPLNHHLLAPAFYLP

SEQ ID NO: 116966 - protein, 199 aa, Triticum aestivum
  Clone ID: PAT_TA_11384.pep
FVRDLAVCDPLSRRYILLPSIPDDLAALVQPPDVLRFEPFLAPPAAEDEDGLSFRVICLVQCKTKLVLLIFSSGSGAEQWRAVTFDNWISLLTGSGNQPESYRRSVIRHYAHGYFCWVLSPASKLLMLDTRSMGFSVVDLPDGTGENEAQVAILEAANGRIKMFINEHFTTELRYYVLQNDGSWCKPVAVRGNVQFTRK

SEQ ID NO: 116967 - protein, 155 aa, Triticum aestivum
  Clone ID: PAT_TA_11385.pep
EEELDKMNLLQAAMKETLRLHPAVPLLIPRESIQDAQLHGYDIPAKTRVMVNTWAIGRDKESWENAEEFRPERFLGGTIDYNGKDPRFLPFGAGRRGCPGMAFGTRLAELTLANMMIHFDWELPSGQDPESFEVVEASGVSPGLKSPLILAIKPL

SEQ ID NO: 116968 - protein, 235 aa, Triticum aestivum
  Clone ID: PAT_TA_11386.pep
MAANVGESAAVGGSSSDAAGGSFECNICFELPQEPIVTLCGHLFCWPCLYRWLHMHANTPECPVCKAIVEEDKLVPLYGRGKDRVDPRSKNTPGVDIPQRPAGQRPATAQQADPNNNFGNAHANPWFMGMGGAGAGAGVPLANGRWGNYAFSAAFGGLFPMLSFQMHGFPDPAAYAQPAGFHYGFGHGHGFHGGQHAHGVPRQGPLGQQQQQADVYLKALLIMVGVLVIASLLAA

SEQ ID NO: 116969 - protein, 152 aa, Triticum aestivum
  unsure (1)..(152): unsure at all Xaa locations
  Clone ID: PAT_TA_11387.pep
TDRENTPTPNPAFHYQSFRPRADQNLSLACLRSRPSTHIPLQIYELEGAGSPDVRPPAVGPLTGGSGPTRQCVGRRAASELEALSRSGGKETGRTSGLLPELDGGDSGQRHGWASXICGATLRPERGRRRCLARRRGNSKERERRDXPRAEF

SEQ ID NO: 116970 - protein, 166 aa, Triticum aestivum
  unsure (1)..(166): unsure at all Xaa locations
  Clone ID: PAT_TA_11388.pep
GIRHEGFFFFLLALFGFSTLTSLTTFAPERLLFVRERAKGYYNPLAYYLAKVVFDIVPLRIIPPAIMGCIVYPMTGLVPTAPEFGKFMLFLVLFNLAAAMICLFLGIVVRNQGVANLLGVLVMLFSLLFGGFLLNHETIPKGLLWLQSLSIFHFGFEGLIVNEXRY

SEQ ID NO: 116971 - protein, 76 aa, Triticum aestivum
  Clone ID: PAT_TA_11389.pep
LAVELERGRSLGARHRSYCWIRIMSGRSKGVRISREYTCELLLEPEMGRRRGCQHRLAAVEMLERGRRSGPPTGRP

SEQ ID NO: 116972 - protein, 749 aa, Triticum aestivum
  Clone ID: PAT_TA_11390.pep
RHAEGVEVQHEPLGGYVSSYKRQLEVPASETTIDATAQGIASLLCAHGPDVEWRICTIWEAAYGLLPLNSSAVDLPEIVVAAPLQPPTLSWSLYLPLLKVFEYLPRGSPSEACLMRIFVATVEAILRRTFPSEESSKRPRSQSKNLAVAELRTMIHSLFVESCASMNLASRLLFVVLTVCVSHQALPGGSKRPTGSENHSSEEATEDPRLTNGRNRVKKNRGPVGTFDSYVLAAVCALSCELQLFPILCKSATNSNVKDSIKILKPGKNNGISNELQNSISSAILHTRRILGILEALFSLKPSSVGTSWNYSSNEIVAAAMVAAHVSELFRRSRPCLNALSSLKRCKWDAEISTRASSLYHLIDLHGKTVSSIVNKAEPLEAHLTFTSVKRDDQQHIEENGTSSSGSGNLEKKNASASHMKNGFSRPLLKCSEEARRNGNVASTSGKVPATLQAEASDLANFLTMDRNGGYRGSQTLLRSVISEKQELCFSVVSLLWHKLIASPDPPAAPAGTSAHQGWRKVVDALCDVVSASPAKASTAIVLQAEKDLQPWIARDDEEGLVPWSARQRIVKLIAELMRNHDSPEALIILASASDLLLRATDGMLVDGEACTLPQLELLEVTARAIHLIVEWGDPGVAVADGLSNLLKCRLSPTIRCLSHASAHVRALSMSVLRDILNSGPLGSTKIIQGEQRNGIQSPNYQCAAANTVNWQADVERCIDWEARSRRATGMTLAFLTAAANELGCTLPC

SEQ ID NO: 116973 - protein, 257 aa, Triticum aestivum
  Clone ID: PAT_TA_11391.pep
MLCHHRRRHRKRRPPMEQPEAGDGAPQQRHKKSSAAKKAKKGGATGSGSGAAWPAVKPKKDLLVNRLKGTQLLTVPDFLTSAEAKAFVDVAESMGFTHQGSLGPLKGEAYRDNDRISVTDPLLAQTLWESGINRVFMDINISGKVATGLNPNIRLYRYVEGQRFGRHIDESVNLGDGSRTQYTLLVYLSGKGSAKDSQALVGGETVFYDHRGGIVAEVAPVQGMALLHLHGARCMLHEARVVKKNVKYVLRSDVVFA

SEQ ID NO: 116974 - protein, 118 aa, Triticum aestivum
  unsure (1)..(118): unsure at all Xaa locations
  Clone ID: PAT_TA_11392.pep
MTSNGSSSFQGFYRNLHTPAVLIGAGFVLVALLISLWLILQHLRSYRNPSEQKWIIAVLFMVPVYASESIISLWHSEFSLACDILRNCYEAFXLYAFGRYLVACLGGERQVVGLLEKK

SEQ ID NO: 116975 - protein, 200 aa, Triticum aestivum
  Clone ID: PAT_TA_11393.pep
MAASNDAGVVVVFDFDKTIIDCDSDNWVVDALGATQRFDELLLHLPWNSAIDAMMGELHSQGKTIDEIAGSIRTAPLSHHVVAAIKAAQALGCELRILSDANAFFIDTVLAHHGLAGYFSEISTNPASVDAGGRLRITPHHDFRHGSCSSHGCALATCPPNMCKGKVMEAMLQELSAAAAAGTRRPSRVVYLGDGRGDYC

SEQ ID NO: 116976 - protein, 198 aa, Triticum aestivum
  Clone ID: PAT_TA_11394.pep
MTAPRRWRFAMVCSSNMNRSMEAHAVLGRAALDVESYGTGSQVKLPGPSMHEPNVYDFGTPYGGIYDDLRRKDPDLYKRNGLLPMLKRNISVKLAPQRWQDNAGDGVFDMILTFEERVFDLVVEDMNNREQRLLKSVLIINMDVKDNHEEAAIGAKLALDLCHKLEAVAGDWEEIIDDLIAAFEKQHKRKLTYYISFY

SEQ ID NO: 116977 - protein, 268 aa, Triticum aestivum
  unsure (1)..(268): unsure at all Xaa locations
  Clone ID: PAT_TA_11395.pep
GYSDKAPPSDQFASHEVKVDYEYKSILEPDTVIPPDQRIQGYLYGPXQVVPISSAEWEAVKFKPEKGXEKLLGFADRSSIPRSYFMKDVNSFVPEPGNTKAMVAVSALARAMQETNKVAILRCVWRQNQANVAFGVLTPNISSVNNVPDSFYFNILPFAEDIRDFPFRSFSSLPPSSQPTEEQQEAADNLVKMLDLAPPGREEILRPDFTPNPMLERFYSYLDLKSKHPDANPPPLDSCLRRITEPDPDVINYRAPLIQNLGKSFELK

SEQ ID NO: 116978 - protein, 109 aa, Triticum aestivum
  Clone ID: PAT_TA_11396.pep
MATQFLRAAARAGVRSPMAASRGFQTSAVLRQDAVIAPVRKPVGAFRGGLFGFLLGATTSGAGMYYYVIDEYRVSNQLLTEDIYALQSAVQRIEGYVRTLEDKVDAKKR

SEQ ID NO: 116979 - protein, 229 aa, Triticum aestivum
  unsure (1)..(229): unsure at all Xaa locations
  Clone ID: PAT_TA_11397.pep
MLRGAVAAGARRRISLAPARLAHELAQPQAESVVPERRGLEPSWVPLYKRISKVSHGRPPGIVAAEMDEWLRQRLRLSQDQVLAYVRELTKFQKNEGALELLDWMEAHGAKLRLGHHALRLDLISKVRGIQAAEKYFWSLPDICNSVKTYSCFLNCYGKHGLAYKGLELYEKMKAKNIVPDKLVYNNLMVLYQKAGHQRKFXLPFEEMRGSGVSANKFTYFTLIESXSQ

SEQ ID NO: 116980 - protein, 247 aa, Triticum aestivum
  Clone ID: PAT_TA_11398.pep
MLPTTASKGRGAARSAPPLFGPYLRRIVKWQQMDIEYTFWQMVHLCTSPKVVYQHTKYHKQTKNQWARDDPAFIVILILFLVFATSAYCAAFGESAPHAALTIISVVFVHFLFAGLVLATLCWFLTNSYLREEPNSHVVEQRVEWLYAFDVHCNSFFPAFVILYVLQYFLSPLLIAHGFLPALLSNLLFMVAISYYHYLNFLGYDVLPFLDRTTFFLYPIGLVIILSPLMILIGFNPTRYFLSLYFR

SEQ ID NO: 116981 - protein, 84 aa, Triticum aestivum
  Clone ID: PAT_TA_11399.pep
GIRHEAEPVVYRILLGAARTHGDLGVAEVAAERLRELDGGNGGDYTLMSNAYAGADRWSDAMEVRQRMEDRRVRKLPACSVVDC

SEQ ID NO: 116982 - protein, 212 aa, Triticum aestivum
  unsure (1)..(212): unsure at all Xaa locations
  Clone ID: PAT_TA_11400.pep
PLPCSCDPVGGEPVVHLTYVAPAGSSVAGIAEEYGTTEETLLALNRMPDAKSLLAGQVLDVPLRACSSAISSSAIDRNLRRPEXSYILTANNCIMCGCSSTTWQLDCQPTQGLTPSCPAAKCGDLFLGNTSTSATSTCESTTCSYAXGYTNSSSFTILANLTTSSVCNAAGISPAAQPSHSLASRLGSPARWSELIVGLHVALLCLGFLRRD

SEQ ID NO: 116983 - protein, 140 aa, Triticum aestivum
  unsure (1)..(140): unsure at all Xaa locations
  Clone ID: PAT_TA_11401.pep
MPAEGIICSSYGDAWRQLRMICTVXIVLCPRHVQSFRPARQEELDRLLRSVEAASASSSPENLRMLQEGLRRGGSLGQEGALLLGGVSERGLVVGIHDGGGGTSACEAPGRERRGRLPSGLLGHGRRWETGHRIGRRASD

SEQ ID NO: 116984 - protein, 203 aa, Triticum aestivum
  unsure (1)..(203): unsure at all Xaa locations
  Clone ID: PAT_TA_11402.pep
MVFIFLMKKICCANRSLSMHLCLFFHHCELVHPICDSSSQMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGXRTLADYNXQXESTLHLXLRLRXGMQIFVXTLTG

SEQ ID NO: 116985 - protein, 162 aa, Triticum aestivum
  Clone ID: PAT_TA_11403.pep
RAANSRGKPRASLQPGAVLILLAGRFRGKRVVLLKTLDQGVLLVTGPFKVNGVPLRRVNARYVIATRTTVPINGLDSKTLEKVSDANYFARDKKADKKGSEEAFFQQGEKPQKKEVAASRAEDQKAVDKAILESIKKEHYLQSYLASNFSLRKGDRPHEMVF

SEQ ID NO: 116986 - protein, 171 aa, Triticum aestivum
  Clone ID: PAT_TA_11404.pep
GVRLTSKRKCKRTHPQVRLSTSIPHPLQVAPELKIEPTLPEVSRVDEKEFQKRLDAAGLLTKEERKALATVDGVSGSVQIGKKAAKARLKKYCSDNLVEELIERNRISRGEEHLFAVEMQMAKAYKQAKRKLIKSDLKKPEKLQTKPNPQPGHASYTDYAALWESSESDQH

SEQ ID NO: 116987 - protein, 212 aa, Triticum aestivum
  Clone ID: PAT_TA_11405.pep
MGLEMAPVEEERSPEQPELQIYPLCRYYFGARDARPCAGETAADRALRLKANFAARGLRTCVHGVLLVELSGHPHVLLLQVRNSSFLLPGGRLRPAEQDVQGLKRKLSSKLAAADPNGDHHWQIGECMGMSARAEFEARPFPYPPPNTRAPKECVKLFLVRLPMARQFVVPRNLKLLAVPLSQIHDNPQVYGPIISGVPNLLSKFSFNLVRD

SEQ ID NO: 116988 - protein, 196 aa, Triticum aestivum
  Clone ID: PAT_TA_11406.pep
REPGVSVLDLPGLGCGNCLLGTPGFNFQSPLDGVMRFEIMSGNKGLGTGGIRLCVPENLKEGIDSPVFMVPFKHIEQSIIIDEPSLDNSTPPTEKAHRVIIVPTAAVGASALKRAYPKVISFTLPNQEAGSDFQGKAGEDIDDPSETYRSLVTRVFNAQLSPFHKGVVDVSSAAAASEEEDARLMCHAVLKQDNSP

SEQ ID NO: 116989 - protein, 105 aa, Triticum aestivum
  unsure (1)..(105): unsure at all Xaa locations
  Clone ID: PAT_TA_11407.pep
LPDSELRCQEVDRPRRCRXPGGLIIYGANLTFVDMEQXDLYGLEIXKGQRPAHVEYGXDGVGEEGAVLVQPDADGRGRVVTAVLPKDEAEALRAALGSTLLQPAP

SEQ ID NO: 116990 - protein, 201 aa, Triticum aestivum
  unsure (1)..(201): unsure at all Xaa locations
  Clone ID: PAT_TA_11408.pep
XAXNSARGTPVSERAAVQRVVWCSAPAKELQRNTPVLLWSVVRPPMLYWIIAGGLSCCDEASSGRRCCIGASPAIRCRAVLQWSFAGCPSVLHWAVSRGAAMELQWCSAGCRRCCFGALPRSVLPWSSSSRSPRCDVAVTAGSRSCDAALGGVVECFVGDASVARLPEQVPRWVMHHRRLLQREELCGLMSMEDAIQRRNT

SEQ ID NO: 116991 - protein, 109 aa, Triticum aestivum
  unsure (1)..(109): unsure at all Xaa locations
  Clone ID: PAT_TA_11409.pep
MGEKIGMTKLWALSLVVLVLAAAPGVPAVPITLITSAXTKGAVCMDGTPAGLPHGIRGSGAGKNTWIVNLEGXAGWCQSRDRXCMFPEGSRLGSSNLMERQLEFHGILS

SEQ ID NO: 116992 - protein, 168 aa, Triticum aestivum
  Clone ID: PAT_TA_11410.pep
NMALHRSLQTSEAEQFEPPDGKLKTSYCHEANTYSTHYLASKLGGVLVVLETARLLLLHLRGVMVRRRRMARMRLGSWTAGRRPVVVPRVHPAEAFLVRPRGVGHPERVARLVLFGVVHVVARVLHARSGRDAPPSTSCGRQPRGGEPAEYRAAATSRQPERVHERKQ

SEQ ID NO: 116993 - protein, 448 aa, Triticum aestivum
  unsure (1)..(448): unsure at all Xaa locations
  Clone ID: PAT_TA_11411.pep
GNGDDEKVEGLHHARQPPHGESSSSSRHATKRRRAHGAAAAMADRFFPNDLPDFVAEAPDSGDPPAAGLRGLLSLPYPRFSDRLLRAALRLKDKVVQETWTRTGGQVTDYTLYTGPLGTALLLFKSFQVTGDRRDLNLASDIVQACDAASLGLPFLTFICGRAGVCALGAVIAKHCNDQLMETNFLSSFDEIIITEKVPNELLYGRAGYLWACLFLNEHLSDKXTIPAEHISSVAKDIIMEGRKLSNKGSCPLMYEWHGKKYWGAAHGLAGIMHVLMHTELKLDEQDDVKNTLRYMISNRFPSGNYPSSEDSESDRLVHWCHGAPGVALALAKAYQVFQDDHFKQSAAEAAEVVWNRGLLKRVGICHGISGNAYVFLSLYRLTGNVEYLYRAKAFACFLLENADRLIAEEAMHGGDRPFSLFEGKAGMAYLLLDMVNPSESRFPAYEL

SEQ ID NO: 116994 - protein, 266 aa, Triticum aestivum
  Clone ID: PAT_TA_11412.pep
MALHAVSPAAAASPPCALSSARLPQRPGCGCLSNRSSLLSSSTNFMKFQSGAVGFFGVPLVLQHSDKRAVLRHATNEEIEEEKMIVEEQAKEKMEKAIETVQSNFNTVRTGRANPSMLDRIEVEYYGTPVNLKTIAQINTPDATSLLIQPYDKSCLKLIEKAIVAANIGVTPSNDGEVIRVTVPPLTSDRRKEMTKTVAKLSEEGKVAIRNIRRDAIKAYDKLEKEKKLSEDNVKDLSADLQKITDEYMKKVEAIQKQKEQELSKV

SEQ ID NO: 116995 - protein, 467 aa, Triticum aestivum
  unsure (1)..(467): unsure at all Xaa locations
  Clone ID: PAT_TA_11413.pep
GIRHEGEGEESAAAVKEDAETAEDGNAEQKAGEGEVESAAAKKKKKKKEKEKEKKAAAKGTEARPEEEKDPEAPKGKVDMKKLPKHVREMQEPLAKRQEAEERRKKEEEERLRKEEEERLRKEEEEKKAEEAKRRKKEREKEKLLKKKQEGKLLTGKQKEEAKRLEAMRRQFLGESEVPVADGAAPEIKKRPKYDSKKKKAQTKASEAQKAAEEQQQEVNEANIDEEEYVMVDQESQSPVAESETKTEPDQEVEEAKQEEEEEDEDDWDAKSWDDIDVGLSKTSAFEEEEEKEDKPVATKQETSKPQPAAPAVKNVAPPVDNSKKSETENVRANNGIAKKKGKKGSSKDDDADNASDLRSPICCILGHVDTGKTKLLDCIRRTNVQEGEAGGITQQIGATYFPTENIRERSRELKADATLKVPGLLXVIDTPGHESFSNLRSXGSRLCDIAILGCDIMYWLEPHTIV

SEQ ID NO: 116996 - protein, 260 aa, Triticum aestivum
  Clone ID: PAT_TA_11414.pep
MAAEGGSREDRWTLAGATALVTGGSKGIGYAIVEELAGFGARVHACSRNAAELEQCRRRWEEKGLHVTVSACDVSVRADREGLMSTVRQTFNGKLDILVNNAGQLLVKPTVECTADEYSKVMATNLESSFHLCQLARPLLVHAGGGSIINMSSIGGSIGFVGSAIYAITKGAMNQLTRSLAAEWAPNKIRVNGVAPGFITTDMIKDMDTESLEREHSKSPLLRSGKPVEIASAVAFLCMPAASFITGQVICVDGGRTISA

SEQ ID NO: 116997 - protein, 157 aa, Triticum aestivum
  Clone ID: PAT_TA_11415.pep
MSSSSTIEGKDGEFTEVVVVRHGETSWNASRIIQGHLDAELNEIGRQQAVAVAHRLSKEAKPAAIYSSDLKRAAETARTIAKICNLPNVVFDPALRERHIGDVQGLTLQDAVKEKPEAYKAFMSHKRNQQIPGGGESLDHLSERWVFCLYNKGEKHR

SEQ ID NO: 116998 - protein, 85 aa, Triticum aestivum
  Clone ID: PAT_TA_11416.pep
NHSQSVDMRQALTLLKKSIQLIQTRGSIRSRATLLTDILLEEMEKESKLPVSAHVASYQVLSFLPLSQKMPGGQQCGSLAHVWTT

SEQ ID NO: 116999 - protein, 221 aa, Triticum aestivum
  unsure (1)..(221): unsure at all Xaa locations
  Clone ID: PAT_TA_11417.pep
GLWLPTIQQEVQQRKLLYMGLYLLIWGEAANLRFMPECLCYIYHHMAFELYGMLAGNVXPMTGENVKPAYGGDEEAFLMKVVTPIYKVIEEEAHRSKTMKSKHSHWRNYDDLNEYFWKVDCFRLGWPMRADADFFKTPKFAYPNRLNGEERSAGSVHWMGKINFVEIRSFWHIFRSFDRMWIFLILSLQAMIIIAWNGGTPSDIFDAEXFQTSXSIFITAA

SEQ ID NO: 117000 - protein, 155 aa, Triticum aestivum
  Clone ID: PAT_TA_11418.pep
PNPVYGLPRRRPVPAKTLDRLLPCVRGGGAHRRDGTRKVLMEVTTEIGPHLAGNRLCARREVANFHCWLTYPARPMEVDSHWEVTVVARGWVEAQQGFNVLASGRPGRSSVAFMVPLPGGVRHRARSALLPLLLSMAAEMDMANCGLCRILAAVR

SEQ ID NO: 117001 - protein, 122 aa, Triticum aestivum
  unsure (1)..(122): unsure at all Xaa locations
  Clone ID: PAT_TA_11419.pep
MEASAAGAVPKAMKYVVGRKLGGGPRKKAVARFVKAGLQFPVGRIGRFLKKGRYAQRVGMGAPVYLAFVLDSXEYLAAELLELAGNAAKDNKKSRIIPRHLLLAIRNDQELGRLLAGVTIAH

SEQ ID NO: 117002 - protein, 96 aa, Triticum aestivum
  Clone ID: PAT_TA_11420.pep
RAPPSRPTWWRTWRSWRRGGRTCGPPARRSRPAAPTTGTPAPRTSPAAARSSPSPGSPTASRRSPAAPPPPSLDPSLAGSRLRRPVADSAAPPSHD

SEQ ID NO: 117003 - protein, 109 aa, Triticum aestivum
  Clone ID: PAT_TA_11421.pep
LSRPKTQNQHASKPHEPLDLLPPMAGKNQEPHIYDGSTTAGSTDPREQATTTDPHETRGHKRAAQTKIRRRKEGGVCDSGRLPDGAEAGDEERRRRRREQGSYAPLFIE

SEQ ID NO: 117004 - protein, 233 aa, Triticum aestivum
  unsure (1)..(233): unsure at all Xaa locations
  Clone ID: PAT_TA_11422.pep
PCSGSAAAGARSRSTPAARAASAPAPAEPPGSGARLGRRPAALAVAQGCRMRGAKQIIGVDLNPEKRDIGKRLGITDFVNPNDTGEKAVSEVLKEMTGGGADYCFECIGSTSAMAEAFQSSRKGWGKTVVLGVSSGGAPMSIPPHDILXGERSVVGSLFGGLKPKADIPILAQKYVDKELELDEFVTHEMGFHDINAAFELLTQGKCLRCIIWMDGAKANGVEALDNGRACKA

SEQ ID NO: 117005 - protein, 110 aa, Triticum aestivum
  Clone ID: PAT_TA_11423.pep
FFTNGLTDHRTDSRIIERTHGSPPVSRGSELSDPHTAGHRPPKFARRCRPKKATQSTASAVAGSFPAARPARMTGTNAARGNLPPRLSVSIFISTDDSVLGSDGVCSGLA

SEQ ID NO: 117006 - protein, 142 aa, Triticum aestivum
  Clone ID: PAT_TA_11424.pep
MNAPTNSTEWVELIVKEMSAASDLADARNRAFRILEMFGKSTANCSTPDEEQKLREENKILKQMLGALLQQASILKRAVVIQDNRLKDYQNMVQERSQFNEIVAKYQQQIKELQDVNYALSTHIRQANQPRVISGRRNPDVF

SEQ ID NO: 117007 - protein, 336 aa, Triticum aestivum
  Clone ID: PAT_TA_11425.pep
MARESSPEIDDELFNEVYGKAYSGPVASAANSVIPKANDEKKPLTCEKSDDEDEPRDPNAVPTDFTSREARVWEAKAKATERNWKKRKEEEMICKICGESGHFTQGCPPPLGPYGGNADFFERVPARDKQVRDLFTERTINQIEKDVGCKIRMDEKFLFVSGKDRLVLAKGVDAVHKLIQESKGKHSSSSPKRDRSRSPVRKSVDFRPRHSDSQWSHSPRNVSRSQSKGHYNERPVDGRLHDDIPKYPKGSPQAYTSYGAKDHPVQSKSPFRPSYLDEPLRSHGGNSQYAVAHMPNNCSTERHGTDAHLDLKFDLPSYPQTLEELEIEFKREAMEL

SEQ ID NO: 117008 - protein, 142 aa, Triticum aestivum
  Clone ID: PAT_TA_11426.pep
GVDMVLFIRKTALPLAIESFMTFSRCGSALELLKVCTNILEEVEKSYTSRMQDWNRGSLSWRKKLQPNHRVDEFIWQEVTLLKATLLETRAKLLLRGGLFDTGEELCRTCISIRTVMLGHGDAQTVAAQETLAKLVRYRSKV

SEQ ID NO: 117009 - protein, 117 aa, Triticum aestivum
  Clone ID: PAT_TA_11427.pep
MSGTSNVGNSAVYESQDQVTRSNAEIEQEKKENRFHEGKDNSHKAQDSKDERSIANKLEREEKREKEGEEKSLEDRQREQDATLPARAHGNEPSKGAKIDQELREEDEAMLKKKGAN

SEQ ID NO: 117010 - protein, 177 aa, Triticum aestivum
  Clone ID: PAT_TA_11428.pep
TLTRDFVPSAYSGQAALLLASNEADASASIFALKNLGIGPIYTIGFRSHGPLSTDVSPVRSVDDVKRLQQPFVIISALPAEKSLLVVPLLKHYRVAGRNGSTNGHGATGTKAAGKVFVDLASGPRKADPLAIATSAGWTAYGIADVSAWTTVETIRKLVGQNVCYDFVRLASGRGHF

SEQ ID NO: 117011 - protein, 226 aa, Triticum aestivum
  Clone ID: PAT_TA_11429.pep
MVRGKTQMKRIENPTSRQVTFSKRRGGLLKKAFELSVLCDAEVALVVFSPRGRLYEFTSSSMKNTIERYKTVTKDNMSRQTVQQDMEKIKADAEGLSKKLDALEACKSACLGQNLEECSIEEPNEELQSLEVKIEKSLLGIRAMKTRRFEEQLSTLRQKEMTLRQHNEELYSQCQKEQHLASEAAAPPAPATLAALPAPVTLEEQGQQMVDVETDLFLGLPGTGRS

SEQ ID NO: 117012 - protein, 153 aa, Triticum aestivum
  unsure (1)..(153): unsure at all Xaa locations
  Clone ID: PAT_TA_11430.pep
KVAKRAEXRRPGKSATLDEFIATELSGAPIAEPSIGSTITNGGRHTKSERERREENERREYEEANFTRLAPDSKKEAAKKKARQQRDGGFGGEEWRTLGAGIDRIERLTQKKGGNLGSLEKSRKRPVGDGPRGSGSAAGDAFEKRRKVVGRYK

SEQ ID NO: 117013 - protein, 90 aa, Triticum aestivum
  unsure (1)..(90): unsure at all Xaa locations
  Clone ID: PAT_TA_11431.pep
GPPLSFEVLQTKCKHWSRGGTNKTFVGSWHSNKLRTDSGTDLYSDRMWFTSLSTLSRDDPPSATAAAAMLRSSRARPLIPSPLVPNXLQX

SEQ ID NO: 117014 - protein, 190 aa, Triticum aestivum
  Clone ID: PAT_TA_11432.pep
CTSAAGQGPACVQNPSTHHVFYGFVFPASISSMTSSTIFFVCKLSSLVDLERKELQISKGGTGYIHRHKIWKGGTGRRRQRDPVQTRCPPPKPLLNCFSCSNLTQAPSQLGTLMWRPETEGSRVHGGRQHMGRGHIVVFLPGLQTWMGVDFSQAIVDRACSRSSRRCEILPIVRPIIQGSDSHWKHGSTN

SEQ ID NO: 117015 - protein, 277 aa, Triticum aestivum
  Clone ID: PAT_TA_11433.pep
GAIRALQSPAYQKARAKNPLLPEVNDRASAENCFKLLPLSLLALRVTKVDENAHEGHNHAKPKRVKGLWTVKIEQHQDANDDNYYIWLYEGSQWKQKLYAAGALLLVIAIVLFPLWPLFLRQGVWYLSMGMLGLIGLFFAMAIVRLIIFMITIFAVPPGLWLYPNLFEDVGFFDSFRPVWAWQETPEDVKAKKAAKKEKKAAKLAAKAAGGKPKKGAIDTVPAQAAQAAPAPAPAPAAAPASAPVDSAPQPTGSEAAPEGAVTQRAPRATVEEAEDE

SEQ ID NO: 117016 - protein, 211 aa, Triticum aestivum
  Clone ID: PAT_TA_11434.pep
ELPCPRVVSDPCASSSSLRSNNSSSRPPCHSSFSLSPSSPGSSSCLSLSHQLTLSLLPTGGRRRTASSRRLEVLRQPEPSSSPPTSPASILVGSGSAGTPCASAASPSPSAEAASVRCLLDPLPRPHPCACARAATPSSASRRPCAGASRGRRRRAGSGARRRSHGGGHGAELLHPPCADEHGGAQVLGNGDAPTGGWRCRRRRRGAGTFR

SEQ ID NO: 117017 - protein, 86 aa, Triticum aestivum
  unsure (1)..(86): unsure at all Xaa locations
  Clone ID: PAT_TA_11435.pep
XLQXIRHEAEXVWVEKVDKIRYVYKPVTRPSVSPNPRPATVTKNLAAANVAISRKNSGTTLVRGVASPEDIDDYIARKKREFALGL

SEQ ID NO: 117018 - protein, 236 aa, Triticum aestivum
  Clone ID: PAT_TA_11436.pep
MPELPEVEAARLALEEHCVGKRIVRCSAAEDTKVIDGVAPSRLEAALVRRTIAAARRKGKNLWLVLDSPPSPSFQFGMAGAIYIKGVELSKYKRSAVSPTEEWPSKYSKLFVELDDGLEFSFTDKRRFAKIRLLDNPEAVPPISELGPDALCEPMQLDDFVQSFGRKNAPIKSLLLDQSFMSGIGNWMADEVLYQARIHPMQTSSKISKEKCKALHRCIKEVIEKSVEVGADSNEF

SEQ ID NO: 117019 - protein, 140 aa, Triticum aestivum
  Clone ID: PAT_TA_11437.pep
MSTEPEVVHSGGCHCRRVRWQVEAPASVVAWICNCSDCSMRGNTHFVVPKDKFALQAGAGDFLTTYTFGTHTAKHTFCKVCGITSFYIPRSNPDGVAVTAACVGAGTLAHVEYRKADGRNWEQWIEASGISEFSKPKAAE

SEQ ID NO: 117020 - protein, 145 aa, Triticum aestivum
  unsure (1)..(145): unsure at all Xaa locations
  Clone ID: PAT_TA_11438.pep
RHEGEAVLEVVFVVDVNGILKVTATEKXTSGRSANITISNAVGKLSSADIENMINDAQKFKSSDEAXXPRKFESRQQLESYISRVEEMISDPTTSIRLKRGQKEKIESALSDAMAQLEVEDAPADDLKKKELALKRTVTKAFSTR

SEQ ID NO: 117021 - protein, 70 aa, Triticum aestivum
  Clone ID: PAT_TA_11439.pep
FFFTEVNHTIVFPDRNSRSLSANERPSTLNVILPQRPENAVPSLFTPNLINNPPHLRRLSRLNKQCLCLR

SEQ ID NO: 117022 - protein, 370 aa, Triticum aestivum
  unsure (1)..(370): unsure at all Xaa locations
  Clone ID: PAT_TA_11440.pep
PGAVAGARRLPALCLVLRPLSPXQRRLCDRVFDGLAPFGDLAFIAAVRTQALHMVSFGDAISSSSRSPERPPSVVDMYEAVRDILPDLDPVFSDPYMGALRAEVSAVCKALGSGFSGISMGLENLIRRDPARVATPGGGIHPITRYVMNYLRAACGSRQTLEEVMEGDLGAGGRASAAVDPDRPTSSLAVHIAWXSWDVLHKNLDAKSKIYRDPSLACIFLMNNGKYIIQKVNDSELGVLLGDDWIKQLSTRVRRWSMDYQRSTWGKVTTVLQIGGSGVGALPAKAMLQKLRMFNTYFEEIYAVQSEWVIADDQLRMDVRAAVEDSVMPAYAALIARLKSAPETGRDLYIKYTPEDVEAHIHHLFEGAAK

SEQ ID NO: 117023 - protein, 140 aa, Triticum aestivum
  unsure (1)..(140): unsure at all Xaa locations
  Clone ID: PAT_TA_11441.pep
MEQGSKIPDDPGQLPLPCASGCGFFGSPDTDGLCSKCFRDSLRRAEGPGPAARVRRSPGGGGVVLGGGARXPRRANASGRCASCGREVGLMGFECRCGGGFCGEHRYSDRHDCCYDYRGAGRDAISQANPVVRADKVDKF

SEQ ID NO: 117024 - protein, 128 aa, Triticum aestivum
  Clone ID: PAT_TA_11442.pep
CLIGLNLFAQMHNVLLLQGIRELRQLYPSTTIAYADYFSAYVQMLRGASKMGFDAAAATKACCGAGGGAYNFDMDRICGAPGTAVCARPEEYLSWDGVHLTQHAYKVMTELLYHRGLASPAPVNFPRM

SEQ ID NO: 117025 - protein, 157 aa, Triticum aestivum
  unsure (1)..(157): unsure at all Xaa locations
  Clone ID: PAT_TA_11443.pep
MSSWEDEDSAAASAAATTDVELLKRAWRNEKAAPEILHFDSALVSRAREQIQLLEETLDDFTDNGVDDLVVSLYQMDLDRTLFLLRSYLRLRLQKIEKYMSHIANSEDLLSRLFQQEHRFPKSCKEIMEKHLEQSVLLKLPXGNNSVFKXSLFSTXD

SEQ ID NO: 117026 - protein, 161 aa, Triticum aestivum
  Clone ID: PAT_TA_11444.pep
MEAEDDQPAAGYRHGPPWVFKGSALYQLHLVKAATARAFVPKELRLVEAFGYTLGGMFLARYHDSPAGQFDELVVIAGIVWNPPTSCAWAARVLVNSAEACRHGRKEVGLPSHVAAFSQTEDSTLRNEPNNCLNILGMGAGCSKQGIARALGSRRPRAHHQ

SEQ ID NO: 117027 - protein, 154 aa, Triticum aestivum
  Clone ID: PAT_TA_11445.pep
SAFVISERPKWQCTQRNLSLSSPVLNTILQEIRPEICIHSADSHKAQLDFINQRVELSAEYICGKSKKKSIIQTIQPKTLQTLNRAKDQLTAGTIKPGGLPALMELDPLLFRTLCSSINLLTFNTSSHRPPMAYRSDIRVYNPAFSSDISIANT

SEQ ID NO: 117028 - protein, 113 aa, Triticum aestivum
  unsure (1)..(113): unsure at all Xaa locations
  Clone ID: PAT_TA_11446.pep
MEPRIGNKFRVGRKLGSGSFGEIYLGTNVQTNEEVAIKLENVKTKHPQLLYESKLYRILQGGTGXPNVKWFGVEVITCFGDGLLGQARGGPVPVAYVIVYRLTASFKLGRKPA

SEQ ID NO: 117029 - protein, 75 aa, Triticum aestivum
  Clone ID: PAT_TA_11447.pep
WRNELIQLQLTLTIASFGIAVNTFIAGAFAMNIPCHFYDTDGSFFWPFVGGTSSGCFVISVVLLGYAWWKKLLGP

SEQ ID NO: 117030 - protein, 141 aa, Triticum aestivum
  Clone ID: PAT_TA_11448.pep
MSDSSEPSKEGSSANGSSALQKTGAWSSILSTLVQQASVYGLAAGYCLSASLLSIINKWAIMKFPYPGALTALQYLTSVVGVLLCGQAKLIEHDGLNFATMWKFLPAAVMFYISIFTNSELLLHANVDTFIVFRSAVPIFV

SEQ ID NO: 117031 - protein, 314 aa, Triticum aestivum
  unsure (1)..(314): unsure at all Xaa locations
  Clone ID: PAT_TA_11449.pep
NNXSTVHVQNISAQTSEKEVRDFFSFCGKISNISVTPESNEADSVKSASVTFEKESAAKTALLLDNTQLGANQVHVAATASLDELSGGKLSAADNDTSDKDNLSQEDKPRSRIVAEYLAHGYTISDKAIERALALDQQHGVSARFTSTLQQFDAKYQATAKAQGIDQKLGVTDKGAAAWSGLNSYFEKALGTPTGQRLRGFYNQGSKQVLDVHNEARHLANLKTGKNDVHSVGNDKTQCSCASDAGACPCAPGHCACSGCAKNSEKSTGATAESANMKVVSEEPRKTKCNCGGAEGSCPCPAGQCTCNGCAKAS

SEQ ID NO: 117032 - protein, 219 aa, Triticum aestivum
  Clone ID: PAT_TA_11450.pep
FVLLHRPPTLSPQLRLRLPVRRLRLASPVAAIATVTAAVPPDDISQLNNRLRALVRRRGVSSAATSPMDPAQADAYLHMIREQQRLGLRQLRRHAAEPEYERDVGSNAEDEEEGAGRRKGLAARSSLGHRVDPRELEPGEYVVHKKVGVGKFVCISGEDGEDYVFIQYADAMAKLAVDQAARMLYRYNLPHEKKRPRNLSKLNDPSTWEKRRLKGKLAV

SEQ ID NO: 117033 - protein, 185 aa, Triticum aestivum
  Clone ID: PAT_TA_11451.pep
SSRSSAAHTPYLPGRPQIEDALGRKWQCSTVQVDFNLPERFDITYVDSHTEKKRPIMIHRAILGSLERFFGILIENYAGDFPLWLAPTQARILPVTNNELQYCNEVASELKSRGIRAEVCHGERLPKLIRNAETQKVPLMAVVGPKEVEARTLTIRSRHNGEMGTMPVDDFISKIQSAVAEKSSL

SEQ ID NO: 117034 - protein, 185 aa, Triticum aestivum
  Clone ID: PAT_TA_11452.pep
AKAPYRRPPPRSNPKDTFCPLLLRGPFATMAAEGEDKKDANSVGGGGGGGENTLEAAEEAILQAVGQEPGQELEGEVEESADREGNGDDAGKEDSGCKDLVLVEDPVLVEDPEEAVATAALQEEMRALFASVPEGAGASFTAMQLQELEQQSRVYQYMAVCLCLPISSVPVLLWRSHPRTCSVHC

SEQ ID NO: 117035 - protein, 101 aa, Triticum aestivum
  Clone ID: PAT_TA_11453.pep
VTLCLYSERRQNPEPVRCRRTDGKRWRCWTKTIPNEKYCERHMHRGRKRPVQVIVEDDEPDSASGSKSSSGKVTEGGKKTDDKSSSSKKLAVAAPAAVEFT

SEQ ID NO: 117036 - protein, 115 aa, Triticum aestivum
  Clone ID: PAT_TA_11454.pep
RPKHVPERNGDRYEAIYSIYFGDYGHITVQGPYLTYEESYLAVTGGSGVFEGVYGQVKLNQIVFPFKIFYTFYLKGIPDLPRELLCTPVPPSPTVEPTPAAKATEPHACLNNFTD

SEQ ID NO: 117037 - protein, 249 aa, Triticum aestivum
  Clone ID: PAT_TA_11455.pep
PSPPPPVQHHGSAPLLRVRSGAGASVSAKLTPRQAARAGFGGRVSVSSGRKCGGPVRASLFSPKPAVAMDARPTKVQELHVYELNERDRESPAYLRLSAKQSQNALGDLVPFTNKVYNGSLDKRIGITAGICILIQHVPERNGDRYEAIYSIYFGDYGHIAVQGPYLTYEESYLAVTGGSGVFEGAYGQVKLNQIVFPFKIFYTFYLKGIPDLPKELLCAAPVPPSPTVEPTPAAKATEPHACLSNFTD

SEQ ID NO: 117038 - protein, 492 aa, Triticum aestivum
  unsure (1)..(492): unsure at all Xaa locations
  Clone ID: PAT_TA_11456.pep
MDLADIPQQQRLMAGLALVVATVIFLKLLLSFRSGGGKKRPPPTIPGAPVVGGLLRFLRGPIPLIRAEYARLGPVFTVPILTRRITFLIGPDVSAHFFKSNESDMSQQEVYRFNVPTFGPGVVFDVDYQVRQEQFRFFTEALRANKLRSYVDQMVAEAEEYFSKWGXESGTVDLKYELEHLIILTASRCLGREVREKLFDDVSALFHDLDNGMQPISVIFPYLPIPAHRRRDQARTRLAEIFATIIKSRKASGQSEEDMLQCFIDSKYKNGRQTTESEVTGLLIAALFAGQHTSSITSTWTGAYLLKFQQYFAEAVEEQKEVMKRHGDKIDHDILAEMDVLYRCIKEALRLHPPLIMLLRQSHSDFSVTTREGKEFDIPKGHIVATSPAFANRLPHIFKNPDSYDPDRFAAGREEDKVAGAFSYISFGGGRHGCLGEPFAYLQIKAIWTHLLRNFEFELVSPFPENDWNAMVVGIKGEVMVSYKRRKLVVDN

SEQ ID NO: 117039 - protein, 284 aa, Triticum aestivum
  unsure (1)..(284): unsure at all Xaa locations
  Clone ID: PAT_TA_11457.pep
MTRSTTSRATSPTCARSRTTAPPASSSAPGTRSSTTTTAAGGRPAAVPSCSVAQGRAATPQRSEATGMLTAALLAGLQNRTITSNWIRAYLRKFPKSFREGMKEQSGGQKEVVKRHGDKIDHDILAEMDVLYRCIKEALRLHPPLIMLLRQSHSDFSVTTREGKEFDIPKGHIVATSPAFANRLPHIFKNPDSYDPDRFAAGXERVRTKVVGXFSYISFGGGRHGCLGEPFAYLQIKAIWTHLLRNFEFELVSPFPENDWNAMVVGIKGEVMVNYKRRKLIVDN

SEQ ID NO: 117040 - protein, 160 aa, Triticum aestivum
  Clone ID: PAT_TA_11458.pep
MPHSFGYRARTRHMFSRDFRNKGVIPMSTYLTTYKVGDIVDIKANAAEQKGMPHKFYHGKTGVVYNVSPRGVGVIVFKVVGNRYMEKRVNLRIEHVKHSKCRQEFVARVKRNAALKKEAKEKGEKVQLKRIPAQPREAHHLSLKGNAPQTVAPLAYETYI

SEQ ID NO: 117041 - protein, 191 aa, Triticum aestivum
  unsure (1)..(191): unsure at all Xaa locations
  Clone ID: PAT_TA_11459.pep
MGIDITDHKHKTNGHRKXAPKSNNDYKLLLHKLYSFLARRTDSAFNQVVLRRLRMSKMHRAPVSLSKIASLNKRPSSNKEYEGKIMATVAKVTDDVRMIECPKLSICALGFTAAARARIVAAGGECITFDQLALRAPTGANVILIRGPKASREANKHFGFGPHTDKKPFVQSKGRKFERARGRRRSKGFKV

SEQ ID NO: 117042 - protein, 270 aa, Triticum aestivum
  Clone ID: PAT_TA_11460.pep
SAPLKVNGGIHTPVNTHVPDSEEVTNENCTRSCSHNSHEGLNSSRDLEHCGVYREDPCQPDISDEDLKGAKNNSPDLVETSISDECSLFQNSEGSVSSYNKTSDNTSFVEKCQATDVTVHASRNKVITTNSGSDVEFPSLSQWLKPPSSSKAIRDESYTSDTFNSAKSSDEDRPIIGMVAAHWKSEEPDNFTPKWWDGNGIPNSTNKYKEDQKVSWHAMSFEERLEKALSEEKLLSQRKCSTGNTSHFSGVEGEESDTAASNHLRVAAFT

SEQ ID NO: 117043 - protein, 150 aa, Triticum aestivum
  Clone ID: PAT_TA_11461.pep
MSAGDGAAVSAVEGKLAELSTSCDLRTLPKRGKSASARTLNTAQIQLVASHPEVYEPCDDSFALVDALLSDKAQLLTLQPSLCMEVGCGSGYVITSLAIMLRQLGPGTPYLATDINQHAVETTQATLEAHGVHADVIATDIVSGLEKRLA

SEQ ID NO: 117044 - protein, 119 aa, Triticum aestivum
  Clone ID: PAT_TA_11462.pep
MVLLDCLLLIVFLLILFYLQTESDLVEAVDSDLRKMLINPRAADPLALGVRVWPQAIPQFLIGHLDRLAAAKSALGRGGYDGLFLGGNYVAGVALGRCIEGAYESASQVSDFLTKYAYK

SEQ ID NO: 117045 - protein, 94 aa, Triticum aestivum
  Clone ID: PAT_TA_11463.pep
PQPGIPTYRRCHQTTPALISVTEHERHVSYSRWIHKVELPLLEVYAREATICKDHRERPHFEEHFWLRRDFCDYFPHVPPCRRRPSSGASANVP

SEQ ID NO: 117046 - protein, 230 aa, Triticum aestivum
  Clone ID: PAT_TA_11464.pep
MCGILAVLGCGDESQGKRVHVLELSRRLKHRGPDWSGLHQVADNYLCHQRLAIIDPASGDQPLYNEDKSIAVAVNGEVYNHEELRARLSGHRFRTGSDCEVIAHLYEEYGESFIDMLDGVFSFVLLDARDNSFIAARDAIGVTPLYIGWGIDGSVWISSEMKGLNDDCEHFEIFPPGNLYSSKEKSFKRWYNPPWFSEVIPSVPYDPLRLRSAFEKAVIKRLMTDVPFGV

SEQ ID NO: 117047 - protein, 213 aa, Triticum aestivum
  Clone ID: PAT_TA_11465.pep
RRAGSPRTRRAAGGAHKRRHGAQRHWRPVLQHLPPRAPAWWLQRPPPLLQLLPLVWWVVSPGRGRRRLHASPSAGSRELGRPWRGPPPAAVALFVAGALARARRGPARREPSRGRDGRLRGVAPEGPPSVPRRPPAPVPRFLLRSSCRPYWPVPASPPRHPAGRFCCISRRGRANDVIVTSKTFMDVHCRSASLFVSLLKQGKLLLIHLIIDA

SEQ ID NO: 117048 - protein, 100 aa, Triticum aestivum
  Clone ID: PAT_TA_11466.pep
PKLPGLDILNVTRMTAQRKDGHLSVFRSPLSSRQALTSKTSEVKEVEDCSHWCLPGVPDVWNELLYALFMKRQIMLDQNVSISGSRTLITDGQSTGDIST

SEQ ID NO: 117049 - protein, 314 aa, Triticum aestivum
  Clone ID: PAT_TA_11467.pep
TRPGILADEMGLGKTVQAMAFVPRVRQDKNIWGPFLVVAPASVVNNWAEEVIRFCPDLKILPYWGPERVVLRKNINPKRLYRRDASFHILITNYQILVNEEKLLRRVKWQYMVLDEAQAIKSSSSQRWKTLLSFNCRNRLLLTGTPIQNNMAELWALLPFIMPTLFDSHEQFNEWFSKGIEGHAEHGGTLNEHQLSRLHAILKPFMLRRVKIDVIAEMTEKKEEIVPCRLSSRQQIFYQAIKNKISLNELLDGSRGNLNDKKLLSLMNIVMQLRKVCNHPELFERNDGSYYFYFAEIPNSLHPPPFGELQDKHY

SEQ ID NO: 117050 - protein, 139 aa, Triticum aestivum
  Clone ID: PAT_TA_11468.pep
KKNTEAYKRREKHHTRCGKNKEGYNTAPNSSSSDSSRQGKEARYKVSRARHDQCRAPSSHNHDFTTDRINVPPTYAPRRSASGVQDLARLEGEAMERAPSRPYIAPRIPTPRGAAQTSKASKIFGSNTKHTTSNKTAPS

SEQ ID NO: 117051 - protein, 145 aa, Triticum aestivum
  unsure (1)..(145): unsure at all Xaa locations
  Clone ID: PAT_TA_11469.pep
GGRAAXEVIFGEPEVTTGAAGDLQQVTQVARQMVTTFGMSEIGPWALTEQAAQSGDVVLRMLARNSMSEKLAADIDRTVKAIVDEAYEVAKAHVRRTRPAIDQLVDVLMEKETLTGDEFRAILSGYVDIGREQRDTAARTDMVTA

SEQ ID NO: 117052 - protein, 170 aa, Triticum aestivum
  Clone ID: PAT_TA_11470.pep
ASFGLLIFRPWMRPRTAVVPVLRCADSHGPAARVGARHGGCHGCGRELLPPLNCSRAAPAVCPYPGHEADAAQCCRWGVLLLASPVRWCLPLGRRTRPTGRHCVRSSCCSSRLVSRDHCWTRRSRRLRASRGGQCGRWSSSTVHQHQANTKSGKAARGSTGKTRHRRRKG

SEQ ID NO: 117053 - protein, 125 aa, Triticum aestivum
  unsure (1)..(125): unsure at all Xaa locations
  Clone ID: PAT_TA_11471.pep
IRXLFTKTPTSIRIQMRSSDLSYPDVAPLRPRPPPRVLSGHLRRNLLNLPCRDLVPPRSSASTSINLYTQATMPHQKSRSLRGEQNEGINPARGKVERRELQIRQAQRCIEAKSQWRALVRRRQF

SEQ ID NO: 117054 - protein, 193 aa, Triticum aestivum
  Clone ID: PAT_TA_11472.pep
KNVQIEEDESSDESEGEEGEVSVPAGSSVAVHSRNEKKARKAIAKLGLKHIDGITRVTLRRPKNILFVINQPDVYKSPSSNTWIIFGEAKIEDLNSQAQASAAQQLAQAEAASHDHAGHDHGDEASKGKGKAVEDKKDEEEEEDDDEEIDDSGLEAKDIELVMQQASVSRKKAVKALKENDNDIVNSIMALSI

SEQ ID NO: 117055 - protein, 147 aa, Triticum aestivum
  unsure (1)..(147): unsure at all Xaa locations
  Clone ID: PAT_TA_11473.pep
MVSSARLSPPGFNPVSLKTTPKFSTGSTAAAAAAASSSYSRRLVSTIHPPSSSSSAAGTTGHSREPRLPGPAATPSLLLGASSSSSASXAARDPSWPRSSRTTSTASTSSSPPRRSSSPSYSTATSMTTMDTTAPQLKQVAGQLGIP

SEQ ID NO: 117056 - protein, 134 aa, Triticum aestivum
  Clone ID: PAT_TA_11474.pep
RIALAAAEQRSKEINVPMNIAIMDNACHLLAFARMEGAKLTSINIAIDKAFTAAGHRAPTSVYKDNVYPGGPAYGINHSNQGRFMTIAGGVPIVKDGVVVGAVGCSTGLPSQDEDVAKKGVEAVEKSFGLKAKL

SEQ ID NO: 117057 - protein, 73 aa, Triticum aestivum
  Clone ID: PAT_TA_11475.pep
LQLPFPTPRIFTVNFNPQCNVSCKVIACPWTRSIECYDIYKKKAAKAPTPATKPPTLRAEAAPVNSAGVEGLT

SEQ ID NO: 117058 - protein, 76 aa, Triticum aestivum
  Clone ID: PAT_TA_11476.pep
MLRTSVDPDKHFKENRETVVNLPEMSAVVLEKVVEYLLYWYRYQDKEDVPDMEIPVDMCLELLTAADYLQMDNQFR

SEQ ID NO: 117059 - protein, 90 aa, Triticum aestivum
  Clone ID: PAT_TA_11477.pep
AGIHYDTIALVPRGVSPQDPSQDIKLFDAKDDVILEAARELCGQLQKAHYFTDTQKFDIKCNKCGWKGAGERGAIQHATETGHSDFGEAD

SEQ ID NO: 117060 - protein, 387 aa, Triticum aestivum
  Clone ID: PAT_TA_11478.pep
HASAQLEGLEEVHFEVELVQFTQVRDMLGDGRLIKRRVVDGSGEFPMDCPLHDSLLRVHYKGMLLDEPKSVFYDTQIDNDGEPLEFCSGEGLVPEGFEMCVRLMLPGEKSIVTCPPDFAYDKFPRPVNVPEGAHVRWEIELLGFEVPKDWTGLTFKEIMEEADKIKNTGNRLFKEGKFELAKAKYEKLLREYNHVHPQDDEEGKIFANSRSSLHLNVAACYQKMGEYRKSIEACNKVLDANPVHVKALYRRGMSYMLGGDFGDAKNDFEKMVTVDKSSEPDATAALVKLKQKEQEIEKKARKQFKGLFDKKPGEISEVGVESKNGGDTAGSGEAVTSRDRNGSGKSSPPSAESDHAFDEERPGLIGRIWPSARRIFSSLGLNRCTIL

SEQ ID NO: 117061 - protein, 180 aa, Triticum aestivum
  Clone ID: PAT_TA_11479.pep
DHLIMFRFPEGACPSLLCTGRAARGRAKGKVTSLIAKKDVGLATRIEDAMKKNESLESLTTSSLSAESAVALAPSTEGATSASAAWGSQAPSNVKRDSANSQNPGTKGRASARPPRTPLPPRKRSSTKRPAIFVHGSTHRLRTRPKARPAEARNAKPAAASWQPRLRQEPAVLLHEARAR

SEQ ID NO: 117062 - protein, 75 aa, Triticum aestivum
  unsure (1)..(75): unsure at all Xaa locations
  Clone ID: PAT_TA_11480.pep
ASKXKECWKARDHFVQCTXDYKSEEDQEKHCATLKTAFENACPKVWVKHFVRQQSWKDYKQDVLQQRANQQSNPQ

SEQ ID NO: 117063 - protein, 113 aa, Triticum aestivum
  Clone ID: PAT_TA_11481.pep
FFFFFFFLFFFYPGGNWSLAKPVSYTTKQSTPMFAPFYTHPNRGLWERFNRYCTFGHLGSNSKLYPNRVRGLSHQAHFGVRNGLPSFIFDQNHLKSPLIWHGLALAAEPRHPL

SEQ ID NO: 117064 - protein, 221 aa, Triticum aestivum
  unsure (1)..(221): unsure at all Xaa locations
  Clone ID: PAT_TA_11482.pep
SSTRQCCTCDTSAVYAGADSGYHLLMVXXYSRTKLQLPTGESATTGLFTVGEYDWYIEYYPNGENPNCRDFVSLYVTRHTLYDCEGEEDVEAKFSFSLVDQLEKHKPVYIHGTNKTCTFSSSAPSWGSDRFVRRDALERSAHLKGDCLTIRCDIMVVCKDHKIEDAAGAISDINQHFAHLLQNKVGADVTFEVGGETFAAHRCVLAARSKVFMAQLFGPMK

SEQ ID NO: 117065 - protein, 135 aa, Triticum aestivum
  Clone ID: PAT_TA_11483.pep
LFSTTFMCTLTYMDNLLSGQHRGRWPRQSQQGRWLSPADDAHRLLTFVAIVGGAHLRGAAGEEMRIHRWTPSSLYGRIFPVCVQFIPLLDSVSVSTKPNMSVRNSAMFSGHVCLISPHWTRLDFSVYKPSCQLLR

SEQ ID NO: 117066 - protein, 154 aa, Triticum aestivum
  Clone ID: PAT_TA_11484.pep
REFGTRVEVNAAAGMKGMEELTADEFQEEDSGRLDKTCHDFMASDNDANIFDVHVVDDICFSTEVKGLIGRSFSDATMQADKLQNRAAADDLLGKSLNAIEGAQNKMRLAASGRRQSLQLQLLEDIADQLQEIKDVADAGRHLHCISPKISKKS

SEQ ID NO: 117067 - protein, 58 aa, Triticum aestivum
  Clone ID: PAT_TA_11485.pep
QASSLAEERACHCNKLYCVVPLSPRTYGTYVVMYFSIRAVIYSVLYAFFISITSLSVL

SEQ ID NO: 117068 - protein, 57 aa, Triticum aestivum
  Clone ID: PAT_TA_11486.pep
PAPGEAKKLMKEEPWTWQEKLKEQDRPLPLPLPAWYYRQPSLLRLIGNADTILKLSD

SEQ ID NO: 117069 - protein, 86 aa, Triticum aestivum
  Clone ID: PAT_TA_11487.pep
RHEGETESDEEEDYRRQEDGAHKYDVFAIHPEHNVIFLTDWKEVNLSYDMDSRQVHPMCTTGDFLGGLPFIPCFADLARPLQKSLF

SEQ ID NO: 117070 - protein, 47 aa, Triticum aestivum
  unsure (1)..(47): unsure at all Xaa locations
  Clone ID: PAT_TA_11488.pep
HNFLSLNKKLRLHTPPASRLVLGVKTLVTLGRVGGDXPRSRARARQG

SEQ ID NO: 117071 - protein, 61 aa, Triticum aestivum
  Clone ID: PAT_TA_11489.pep
NSSQSIKETKNPWTQVIRKIYKVGASFAMQGYKTHKRQRNAYLQQRKKDLRINRLMFPINT

SEQ ID NO: 117072 - protein, 347 aa, Triticum aestivum
  Clone ID: PAT_TA_11490.pep
MGYDGAPSPASAAARDAKKKRGNRSSAKLKQCKLDARREQWLSQVKDGKEATAKPLPAGAGSGAGSNAGSPILASPHPPLPRRRADARSRGGVLEDDKEDAGATGQEVGGSDLDSPMHSPCSDNSRGGGCAQSKRCSSNGGGPSLSSVSSLWSSSRSVSDAEDDDTGSGPEEENGVLDDWEAVADALSVDDNSHCHQSLGTTMPPAATSQSAPLANTSKRTEPIRSNARAWTPDDTFRPQSLPSISKQSSFPARIGNCWGMGMSAAHQSILSMPLSCPICYEDLDPTDSSFLPCPCGFHLCLFCHKRILEADARCPGCRKLYNSGSAGEGAPTPVRLSRSCSMGPRH

SEQ ID NO: 117073 - protein, 432 aa, Triticum aestivum
  Clone ID: PAT_TA_11491.pep
HASGGTNFGRTAGGPFITTSYDYDAPLDEYGLAREPKYGHLKELHRAIKLCEPALVSVDPTVTSLGSMQEAHVYRSPSGCAAFLANYNSNSHAKVVFDNEHYSLPPWSISSPPASETVVYNTATVGVQTSQMQMWSDGASSMMWERYDEEVGSLAAAPLLTTTGLLEQLNVTRDTSDYLWYMTSVDVSPSEKFLQGGKPLSLSVQSAGHALHIFINGQLQGSASGTREDKRISYKGNVNLRAGTNKISLLSVACGLPNIGVHYETWNTGVNGPVVLHGLDEGSRDLTWQTWTYQVGLKGEQMNLNSLEGASSVEWMQGSLIAQNQMPLAWYRAYFDTPSGDEPLALDMGSMGKGQIWINGQSIGRYSLAYATGDCKDYSYTGSFRATKCQAGFGQPTQRWYHVPKPWLQPSRNPLIVFQELGGDTPKFACEK

SEQ ID NO: 117074 - protein, 102 aa, Triticum aestivum
  Clone ID: PAT_TA_11492.pep
EEFGTRPVFTLDEWERRKAGGSMSTAERHIQDTSRDEELARQLQEQLDLEDSHAMPVTSEAERLRMNMFSFNGPEEMGGGRRDFRGRGRGRGRGRGRGRGRF

SEQ ID NO: 117075 - protein, 167 aa, Triticum aestivum
  Clone ID: PAT_TA_11493.pep
QNVLPPVLVEHYQMVSFYTIRLITPERNRPRHVVRKHVETDTITPFVNARHQTKEIQRSTMSALVGLCCSHSSSCIRAIATRSACSPTHLISMTFSIFQGPVANCSSWSWTRESQRNRSPFQMGVPGGCMVFKPGFRLSGEGSRHRLRDSRTNSKGPVDDGSDIADS

SEQ ID NO: 117076 - protein, 228 aa, Triticum aestivum
  Clone ID: PAT_TA_11494.pep
LVLICGRLVSGWVIRIAGFSARRHFVLRKRVLYFVYGVRGAVQNALWLGLVLASWHFLFVENVQTNTAVLPYVTKVLLCLLVATLVRLVKTLLLKVLASSFHVSTYFDRIQEALFNQYVIDTLSGPPLVDEDYVLAEVRELQRAGAAIPKELRAALPAKNLSGQKSIRISGLISKGDQSSRQLSKEKKQREIDEGITIDKLHRLNQKNVSAWNMKRLMKIVRFGTLTT

SEQ ID NO: 117077 - protein, 411 aa, Triticum aestivum
  Clone ID: PAT_TA_11495.pep
GQGDLKGGWQIEGSQGWWHFRLLKRLGCGNIGSFNLSELNGTKCYFAMKIMDQASLAGRKKLLSAQTEREILQCLDHPFLPTLYTHFETDKFSCLVMEFCPGGDLHTLRQKQPGKYFPEQAAKFYVAEVLLALEYLHMLGIIYRDLKPENVLVREDGHIMLSDFDLSLRCDVNPTLLKSSNPGVDPNQKGNQAYCVQPVCIEPACIQPACVTTTTCFSPRFFSSKSKREKKEKKAKADMATQVRPLPELVAEPTDARSMSFVGTHEYLAPEIIKGEGHGSAVDWWTFGIFLYELLFGKTPFKGSGNRATLFNVVGQPLRFPESPVVGFAARDLIRGLLIKEPQHRLAYKRGATEIKQHPFFEGVNWALIRCATPPDIPKPVEIPRPGASTSQKATPSAEKGPDNYLEFDFF

SEQ ID NO: 117078 - protein, 228 aa, Triticum aestivum
  unsure (1)..(228): unsure at all Xaa locations
  Clone ID: PAT_TA_11496.pep
SVVAAMVADGLCRERRIEDAWRALEDMRLRGWKPDFVAYRIVSEGFRLAERAEEEGRILKQKRKLGVAPRKVDYREVLLALVSGRQISDAKEMAEAIVLGDFPIDDDVLNLLVCSVSEVDADAAIMFCKFMIGKERLPSTQMLXQLCESLCKNGKGDEMWEMFKSAFXDKGYCTSVEGVSFWWVSFLGXEARKVKRAYDVXKEIKKEEXDPGIQQYIPSRVALMILAC

SEQ ID NO: 117079 - protein, 176 aa, Triticum aestivum
  Clone ID: PAT_TA_11497.pep
LRRGFNPHPTATLLLVKVARRSLKLVVNVVLLEYVVALLLEELAITELLLPGSWPRAPSFQRERQWHMTTAMAGSHTHRTTGAIGHSRERRGPPLGQLLGRRRSTWVRGECPGTRRPASCQRGARRRWRPRRRAAQPRATQPRPPPRSGPPRGRRGPPLEWLLEGGCTRAHGESRE

SEQ ID NO: 117080 - protein, 156 aa, Triticum aestivum
  unsure (1)..(156): unsure at all Xaa locations
  Clone ID: PAT_TA_11498.pep
EEWLRRSAGRAPRRRPPPSPPPPPPPPQPLRPQTPPXVVALLPAVGREPPDEPPGLLRPPRRLPHLPGSHPAVAGQPRLPGSAPPLPPHGLCLGSPVSRPPPPHPPLPPPLHPPRSPXPNSTPSASAFPPRTAPAMTPXPRAPYPPPPHRRASPPA

SEQ ID NO: 117081 - protein, 124 aa, Triticum aestivum
  Clone ID: PAT_TA_11499.pep
TSSRASPCTHRVPQLPLLPAAPPTCPAAAERRSNAAATFETMVPGASVPIIARSLRAHTQSRWQPPAPDRLNDSEQHHDALDVEAPPPQAVATACLAARPVRPARLDGFEQVGHDGLTRQRPRA

SEQ ID NO: 117082 - protein, 112 aa, Triticum aestivum
  Clone ID: PAT_TA_11500.pep
MELKLAFPQDSPPLSIISAAKIAGVPLIIDPTLASGSVPTLHFSSGDFIHGVNTILRYIARAASLSSFYGQDDIQAAHVDQWLEYAPLILSGSEFEAACLFLDGYLASRTFL

SEQ ID NO: 117083 - protein, 307 aa, Triticum aestivum
  Clone ID: PAT_TA_11501.pep
DAPVVKFKKRGAKAAPRKVAPPPPQSDSDFSSGSDAEGEDGHVVKRRKTNGNALKASTADQKATTAVEGTTQYAANRSAVIEASNDATKQSNWYDENADDALSSKNLLGSTRTKPQTFIEKNPDAPSRQVGPMKASTNIRTITVTDYTPDVCKDYKQTGFCGFGDNCKFLHAREDYAAGWKLDREWEMSTKGKKPGGTVVASANRDEKEKDEDGVDLALLEKIPFACIICKKPYKNPIITKCGHYFCEACALKRYRKDPTCAACSAKTYGVFNGAKNLQKLLEKKQKWEDKKKAEAEEKAKEEEGGD

SEQ ID NO: 117084 - protein, 139 aa, Triticum aestivum
  Clone ID: PAT_TA_11502.pep
FVLVCTMAASLRAAATRILRPAGQGLRRLVHTQEQSRSTPSLEGGDRAAQIQQKKEELYDLIARAQSKKVGLFYTAAQGDRLVLRILSTQIKPRPNDPQWRWITTAKKVTMCSSAAIVLGIAAFTLPDLATRPEYKPMK

SEQ ID NO: 117085 - protein, 87 aa, Triticum aestivum
  unsure (1)..(87): unsure at all Xaa locations
  Clone ID: PAT_TA_11503.pep
RICLLYHXFQLPWASQVFQPFNGVHGSNSASXHGRLXGVVLLDNGADRGDPVGNGGVLCRGGALLVGDDASEVRGGSPSSDKSVSAV

SEQ ID NO: 117086 - protein, 81 aa, Triticum aestivum
  Clone ID: PAT_TA_11504.pep
ASPTRDNTLATPTDMVAMAHARGLQVHPYTYRNENRFLHYNFRQDPYAEYDYWLNDVGVDGLFTDFPASLRRFQDWTAAKN

SEQ ID NO: 117087 - protein, 89 aa, Triticum aestivum
  Clone ID: PAT_TA_11505.pep
ERPAGGAVEPRRVGSLRAEPPDLPPARHRRPARVLRVRDRLPQGPRGDGRPGHLILLPPIVHSAITLLVVNGDALMGLCMIANMATTHL

SEQ ID NO: 117088 - protein, 403 aa, Triticum aestivum
  Clone ID: PAT_TA_11506.pep
MAAGILVDFPSMGSACFFPSLESLLRDSTSRFLAAVSAAPDPDLTNFRSLFSRVLTTYPDPPLEAVWFFSALTFHDAPDDLRSILHLLSAFPPSPPPAAQPLARLPPAVPQLVLSAWPRSAIAALPSEQFFGVLLNMLVNPPLPVYSLLSADDEILVRDVLYDALILVDYSFLNGAEVDQADSSLLPIFVSRLVITLDAINDARAKGDQGRAMSFINAFSTSNIPVYLARWAARQAGTDQLGKPIAITPQAFLKWLVDLEDKGLTVFGENCSRIRERLMHDDAKNDYHYQSRMGHSDADLFFIDKQSHQEGMHTEGGEDEEAVEMETADNAFMAAAQSMKVTANGIRKRKECGSEDAAVVKFVKYKAEDSSVKDYFLSAATNGMSSGSEVENPQSDDEMEETA

SEQ ID NO: 117089 - protein, 145 aa, Triticum aestivum
  Clone ID: PAT_TA_11507.pep
RPSGPPAEVSGVVGLGRGPLSLVSQLSVRRFMYCLPPPASRSAGRLVLGADATGMRNASDRIVVPMSINPRYPSYYYLNLNGLSIGDKAMSSSFRSSMNATTPGTSDPNPNPNPNVAASPVPVSGDGDGGTGPNAFGMIIGIAST

SEQ ID NO: 117090 - protein, 171 aa, Triticum aestivum
  Clone ID: PAT_TA_11508.pep
LLDTMPSFSASPDEATVAARLAAYGRAGIPQEAVKLFRLMPDLGITRTALSYNAVLKAILCRGREAMARRIYNAMIADAVAPTLSTYNTLIWGFGLCNKMDSAVRVFGDVKAHGVTPDVTTYNTLLNAWVRKGDLESARKVFDEMPGAGFERNSISYNVMIKGYVDANKVE

SEQ ID NO: 117091 - protein, 105 aa, Triticum aestivum
  unsure (1)..(105): unsure at all Xaa locations
  Clone ID: PAT_TA_11509.pep
HWCSIEQTIEDHAMXRPKXYSTHLLCSGPKSKPKWKIATSIFALGRLSIHMNSLLSIVTSDPLARRDHRRPPPAKTTASTGRLLLSAPPLLAPWRQSSAADQNHR

SEQ ID NO: 117092 - protein, 105 aa, Triticum aestivum
  Clone ID: PAT_TA_11510.pep
CHPTYYLAARTQALQPTIYSPIIYNMSIPVIPFRLLSGCRTREPPWSALAMCSPPAARITRSCSCAVACAASTPRPKEERHASVQVRRLPRLPRHERGRRALPPE

SEQ ID NO: 117093 - protein, 323 aa, Triticum aestivum
  Clone ID: PAT_TA_11511.pep
MAAPLWPRANESGGWPEQGGAGPGARRLATALLFLAAVALPCLVLYRAVAPGGVLVQPAARLPWLQAGAPPHDDDDVDLESESEDVRLERVLRAAAMANDTVILTTLNSAWAEPGSMVDVFLESFRVGEHTRELLDHLVIVSLDLAAHRRCKQIHPHCLAVATEGVDFSGQKNFMTDGYLRMMWRRIDFLRQVLEKGYSFIFTDTDIVWLRSPLPRLYAEGDFQIACDHFTGDPDDVLGNAPNGGFAYARANTETVELYRYWYAARERHPGLHDQDVLNLIKADRYLTEVGVRIRFLSTEFFGGLCEPSRNLSAGCTMHANCC

SEQ ID NO: 117094 - protein, 78 aa, Triticum aestivum
  unsure (1)..(78): unsure at all Xaa locations
  Clone ID: PAT_TA_11512.pep
STHISPDLNRRVLGAGAPAQIWAGHISTVRFRKLEPPDLFPSSPRAASLGNIPIAPWTNDAPALEAPPDSSRRXXPLA

SEQ ID NO: 117095 - protein, 166 aa, Triticum aestivum
  Clone ID: PAT_TA_11513.pep
FFFFFFYFFFFFFFNKADLIKQLSKCTSMFEKSVVKPSKLKIVSFFATNEPSSPQQAARGQDHRSKGQATKNQPSYRRRHDPHTKHRNVEQDFTSAVCTSSYTSTRSLFMPGTLRSADPTVDIALSMCFRESGPRARRGTADAGGEPGWRLGAAASTIQPSLAAEN

SEQ ID NO: 117096 - protein, 178 aa, Triticum aestivum
  Clone ID: PAT_TA_11514.pep
MMIIPDDDIEQDYDDYTDPYLHRNFDEVYGLDLMRLPLFRSADAAEAVIGSSRRHGHHSVFSDDIMDTFFDNTTHQEPDFGYRGGRRQRGRARGTTSADHFNDHIVGMVLGSSLRIEDSSGASYRDTGAGPHHHINNTGGSSRPNGGWPERRGRSNRNSNSGGGRGTQNSRRQGANYN

SEQ ID NO: 117097 - protein, 269 aa, Triticum aestivum
  Clone ID: PAT_TA_11515.pep
ELPPIPDHLSEQCKDFIRKCLQRDPSQRPTAMELLQHPFIQYKVRLEKSVMSDPLEHLPVISCRPNSKVAGHTTNISSLGLEGQTIYQRRGAKYSSKHSDIHIRSNISCPVSPCGSPLLRSRSPQHTNGRMSPSPISSPRTLSGASTPLSGGNGAIPFNHSKQPTYSNEGFAIASRGPDDHFPNRPTDRNLGQFGRVHQVSQGNQERIVSEANILSPQFGKRLGNVFDLRDRLSPSEHFTRPALVDHVKPNPSLDLTTGSPHHGLKRDN

SEQ ID NO: 117098 - protein, 147 aa, Triticum aestivum
  Clone ID: PAT_TA_11516.pep
ISAPDSRSCWRGSGSCVRRVGASSRVNHLYTFIRKGQRSMHCVENSSSWKTAVTEGGCSRGSTQWAPGLRLNTVQPARNHVGVAPCTVLPTSTNATGCEAAKETRRRTAAARGAPPGAELSRAESALIVQPSSAAQANEGGAKQKVE

SEQ ID NO: 117099 - protein, 110 aa, Triticum aestivum
  Clone ID: PAT_TA_11517.pep
MVWALTPVGTERGAQKYYISAAGTYTVGRKDCDIVQTETSISRVHAEIAVEKMVAWEPRSGAPASPSCVSVVDRSKYGTFVNKVQGTQGSRLRKDEVVGLSDGDTVDFGN

SEQ ID NO: 117100 - protein, 154 aa, Triticum aestivum
  unsure (1)..(154): unsure at all Xaa locations
  Clone ID: PAT_TA_11518.pep
MSDGEDDTKSQVSAAAEVEVSADASGGKGQMSVLEALKGVLKLALIHDGLARGLREASKALDRREAHMCVLNEACEEEAYKKLVVALCSXEHKIPLIKVPXDAKQLGEWAGLCQIDREGQPXRKGVNWSWVVVKDWGEESQERSILLNYFQTEQ

SEQ ID NO: 117101 - protein, 96 aa, Triticum aestivum
  unsure (1)..(96): unsure at all Xaa locations
  Clone ID: PAT_TA_11519.pep
WVIMSEIFPIHMKGSAGSLVTLVSWLGSWIVSYAFNFLLLWSSYGTFFMFASICGLTVVFVERLVPXETKGRTLEEIQASMNSSLAPVSSGINRAA

SEQ ID NO: 117102 - protein, 158 aa, Triticum aestivum
  unsure (1)..(158): unsure at all Xaa locations
  Clone ID: PAT_TA_11520.pep
MHRGVRSHHTRTATAYHLGILLIFVGVAVAVGARRPPDARVARGPPGRPPPVPAQGPAARVGAPAAHVGPRGPRATAAAGTRLALQWILVKXLDCTHSNYQTLMRPXIVIYCHYLPVSGLGNLRACCLXLDVVAVSQAPSPESNPNSXSPVTTMVGPY

SEQ ID NO: 117103 - protein, 324 aa, Triticum aestivum
  Clone ID: PAT_TA_11521.pep
VRGRRPVDVRTYQAPASSRRRQQLGRAVTMLGLLAHLHAALVFLPNNGGPAWAGPGGGAGAVYDVVRYGARPDGMTDATLPFLRAWADACRSPRPATVLVPPGMFLVGSATFMGPCATRAVTFNVGGTLLAPSGYGWDSASPGRWLTFESVEGLAVSGGTLDGRGAPLWACKQQQPQQPRLHCPSGASSLTISNSRDVVVDGLRSMNSELFHVVVLQSNGVTLNRVTVDAPEDSPNTDGIHIHMSSHVSVYDANIRTGDDCVSVGPGNSNLWIERVACGPGHGISIGSLGHQQGLDMEDVQNVTVKTTWFTGTSNGLRIKTWGS

SEQ ID NO: 117104 - protein, 128 aa, Triticum aestivum
  unsure (1)..(128): unsure at all Xaa locations
  Clone ID: PAT_TA_11522.pep
TSENTAKKVRLPPDVNRCTWEQWCVGQGRLCESVPCSYLGXTSLTACNAENWCTAWLSVMMPKLSGRLCSCFSAAEVDLRRSSNREAPELEPPSELVPGAAGFVCELLNFAFLAWLGFAWXLHIRVTL

SEQ ID NO: 117105 - protein, 202 aa, Triticum aestivum
  Clone ID: PAT_TA_11523.pep
EFGTRHGLASSPSRPWSHRRRHHPRWPLPATSGDAQHAPELPMVRACLPSGQILRSRPLPPTSNPTPVARVSGRASPARLRRPQLFGSSSCRKFPTSLYTPWTSSEIRLHVLRCPPELRLPVDRGSSQSAGYISCVPSFLQPTGGTTDCTSAVFGFAASAGRSSASSSASPSSTPSETGNSQPCHVPVESTVWVAVKHVFAW

SEQ ID NO: 117106 - protein, 143 aa, Triticum aestivum
  Clone ID: PAT_TA_11524.pep
HHRGRGAGAPPRRAPSGGAARPQRARRPELRPPPAGERRGSKKQELNSQKKLEKELSFYTKVKDAVTSLQAKKAISKKKKQRSRQKKLKAYDLSALSEFLPQTASSQQQTEVKLNRKSKQALVQRESAQLNAVLNNAQFQQDP

SEQ ID NO: 117107 - protein, 196 aa, Triticum aestivum
  unsure (1)..(196): unsure at all Xaa locations
  Clone ID: PAT_TA_11525.pep
VSPLPQPVLVIVSPVPSGTSPLPRATSCTAVPIAWSPPRRPPVVPVACSPCRRPPAVPVACSPPRLPPALESAARSPSARTPCWGRTAAPCRRPPALQSAAXKPLSXPPAWGPSPTDAPPRWAPPSSPPPRGGSTSPAPFCRPSCSTPRPRLRRPRRSRGSCRCCCSRSSEETEWWRFPCPSGGRPPWRGSTHRRR

SEQ ID NO: 117108 - protein, 310 aa, Triticum aestivum
  Clone ID: PAT_TA_11526.pep
MAFESSAETERFLCERLLDAAQPIAERFRALFSLRNLRGDGPRHALLQAARDPSNLLAHEAAFALGQMQDAEAIPALEGVLKDLSLHPIVRHEAAEALGAIGLEKSISLLKESLAADPAVEVQETCELALRRIEGQKNASGAESTTISPYLSVDPALPAKQGLSVEQLRELLLNEQEKMYERYAALFALRNDGGDYAVSAVIEALGVKSALLRHEVAYVLGQLQNKAASDALSGVLKNVNEHPMVRHEAAEALGSIADQESIALLEEFSKDPEPIVSQSCEVALSMLEYERSGKSFEFLFLQTPHVQQES

SEQ ID NO: 117109 - protein, 175 aa, Triticum aestivum
  Clone ID: PAT_TA_11527.pep
ARAMDDSGVVLLFRDKAYLHPEKVVDLVRRAVPLALAPDNDTRQAEFKQLQEKKEEIDKLAHKQVRRVLWTGLGFFMLQVGIFFRLTFWEFSWDVMEPIAFFTTTSGLLVGYAYFVITSRDPTYQDFMERMFESRRRKLCVKHGFNMEKYLELQKHCKCPLEGHHSQGHDSQHLS

SEQ ID NO: 117110 - protein, 262 aa, Triticum aestivum
  Clone ID: PAT_TA_11528.pep
TRPTSEEEEEEPSHAAPNTAPKKQPPPARQSEDSDSSDEEEDGGSESDKDEPPPKPSPKQEAKAPEAKKPRLAFHRVWSTNDEVRILEALAAHQKEHGVLPQPDALVEALAGKLDNRAYSSKELQGKVKSLKHRYVSAGEKYELPTKEHDRRLFDLSKILWSGHKYRSRAATASTAAPTAKANDHEPKGFEEMCELYPYLAEEVKKMEASGMFKREFGKMDDNKARLLDEKIKKQRVQQMKVELRRSDLAREVTKAIMDLID

SEQ ID NO: 117111 - protein, 188 aa, Triticum aestivum
  Clone ID: PAT_TA_11529.pep
LFKEKMDSDGTSGQGAFDRKDCFGNEEPRGGQVDGTVSDPHPTFKRRVNATHLITPSEIISGVLPSDESTANGSPQNAEMESKLVVEKKADQNIGFEDVKETQIVQEKMERLNMSSEQTVETISERSVTTDKYSVEDSQRSDPTLLKQHSGARDENLPRRTAEATENINGSSSRNLQLPSPTKEEKVL

SEQ ID NO: 117112 - protein, 604 aa, Triticum aestivum
  unsure (1)..(604): unsure at all Xaa locations
  Clone ID: PAT_TA_11530.pep
MSKSTPVKASKNSELKKSTAILTIANGHACKKDAIGGEHPVHDIKSTGTWICRNSFCKRCSCCICHQFDDNKDPSLWLVCASENDDKQCCGSSCHIECALQQKRVGCFDLQKIIHLDGSYSCASCGKISGILGYWKRHVVIAKQARRVDILCHRIYVSYQLLEGTSCHTELHNIIQDAKAKLECEVGPLDGMSAKMARGIVSRLSGGSNILKLCSLAIQKVDELLSPPSPGLHLRGSLPAACRFKFVDITSSSLVIILKETKLASSDTIKGYKLWYWKSREQPSMDEPVILSRDQRKILVYNLATCTEYSFRIISFTDADATIGHSESKCYTASKEVFVKSVTQKATQICPQAQTTDRSQACMSTGFRIRGAGKILRRAWAEEGCFEDMYEGSCDISATEADQAENSEQGHFLSGACRKLQFNAFSVPDLNAPMPMDMDSSPEKSYDLNNRLLRSNDSGGSEACEAVRSAXRLLLNLDQEARQSSPMVLRMKAVSRMEFQPSAAKSNFXKRPRVLDEDYEYCVKVIRWLECDGHIETDFRLKFLTWLSLRSTENEHRVVNTFIKTLIKEPSSLAEQLVDSFGEMINCKRPKVGFGSELWHLDKQ

SEQ ID NO: 117113 - protein, 475 aa, Triticum aestivum
  unsure (1)..(475): unsure at all Xaa locations
  Clone ID: PAT_TA_11531.pep
MEPRPAAAAGGGGGGGRAGEGEAGRGADPDTGLEGSMWRMGLAGDGRGEGDGARLPERPDQADCIYYLRTGACGFGDRCRYNHPRDRGGTEFGGGAKNAVALDYPERLGQPVCEYYMKTGTCKFGSNCKYHHPKQDGSVQPVMLNSNGFPLRPGEKECSYYMKTGQCKFGSTCKFHHPEFGGVPVTPGIYPPLQSSTVPSPHPYAPLTNWQMGRPPVVPGSYMPGSYTPMMLSSGMIPLQGWSPYPASVNPVASGGAQQTVQAGPMYGIGHHGSSSTIAYGGPHTPYSPSTIPAPLSHQEHGFPERPGQPECQYYMRTGDCKFGATCKYHHPXXWSSPKSNYMFNPFCLPLRPGAQPCSYYAQNGYCRYGVACKYDHPMGTLGYSSSPFPLSDMPIAPYPLGFSIATLAPSSSSQDLRPEYRPAKDPSVNQVGSPVAASEPSGSILPKGVFPPDTVMRAQTNTTTGGSSSPGGGR

SEQ ID NO: 117114 - protein, 147 aa, Triticum aestivum
  Clone ID: PAT_TA_11532.pep
VPPITNTELPARQRRKTGIGDVRMHCLPRSPCPASAVVVAATAPANHQGAQGTNCSIGDLAAGREEHLLGVLWAATAAPYSQPRTRRSLPEKQLQGLMARVPVRCSGRRQPATAAGNDRGARNTSPLAIQPLHLLGVVRHPLHRDMI

SEQ ID NO: 117115 - protein, 224 aa, Triticum aestivum
  Clone ID: PAT_TA_11533.pep
MGPHPATVPCSLRCGAAAAAVRRSGWARSAGFLVRDGGRSNGTGVKLSCVGPTAWSYPHNFDSDSEPMPPGRWWGEALLEEDAEFFPLADFIPVGQGRKELDAIWHALVAGPLESVQLTLREILAAGNLFRCRSFHLGTLSGALLVVAWVFQLCKTSPTLFVDIVLGSVFYKLSVLSGQLQREGKSFSICARIQLVLLLILSFKDNGASQGFYRFLVESIWLLN

SEQ ID NO: 117116 - protein, 466 aa, Triticum aestivum
  Clone ID: PAT_TA_11534.pep
RVRWLGGAEHSAGQFERLLKASGADDDGDLLIESSVKGIPKVFAVSTLVSAMPAQPYIFRNYQYPPGTLEVSPGMAESPCTGAVGTVVSGAPVGIKRGAFMGSCKHHVWEAIRASSAAPYYLDDFSDDVNRWQDGAIVANNPTIFAIREAQLLWPDTRIDCLVSIGCGSVPTKSRRGGWRYLDTGQVLIESACSVERVEETLDTLIPMLPEMQYFRFNPVDDRCGMELDETDPAVWLKLEAATEEYIQKNLDVFKNVCELLVPRYQEEEKSSGIVKSLSFSRLSTSKSGLSESNPTLGWRRVVLLVEASFNPDFGKKINHTRSLEAFCSQNGIRLTLMNSTSGFGKPTTALPTPITSPLFTGSFPSSPLLYSPEGTQRIGRIDLVPPLSLDGHPAMKSSPPTSPIKSWASHLDMFGHCTTSCKNMPQGWGDTPGLFKNDNWVSDLLARMDFWYVCLSQGGNLQKVF

SEQ ID NO: 117117 - protein, 56 aa, Triticum aestivum
  Clone ID: PAT_TA_11535.pep
THASDHASDLPLDLFLCFHLLYVPDATDKFYTVEVYTFLIRAHIPVLLLKNSCNLE

SEQ ID NO: 117118 - protein, 179 aa, Triticum aestivum
  unsure (1)..(179): unsure at all Xaa locations
  Clone ID: PAT_TA_11536.pep
SPSQKSKQQRPREPQQSQQHNHNVQQQQPQRQAQPVMHRAASIAARQAAMAQQAQETKPISPKFKRQASAKGGPAASTKPAAAAAPTTKPDEKTKKSEAKPAAELVPAPAAEAVVPRPEPKAQPAPEAEVSDDMAIDEADVAVEGAEEVDPALEEDXMEETIRVTRAKLRRRAAAEAGA

SEQ ID NO: 117119 - protein, 123 aa, Triticum aestivum
  Clone ID: PAT_TA_11537.pep
MEGLLHKLKGLDAYPKVNEDFYKRTLSGGVVTLLSALVMLLLFVSETRSYYYSATETKLVVDTSRGERLRVNFDITFPSIPCTLLSVDTRDISGEQHQDIRHDIEKKRLDSHGNVIESRKEGI

SEQ ID NO: 117120 - protein, 258 aa, Triticum aestivum
  Clone ID: PAT_TA_11538.pep
FNVQSIEKKHDWRHGEREEYCGTFDGAEESAGQWCHSCEEIREAYKKKGWALTNPDLIDQCAREDFVERVKTQHGEGCSVHGFLDVSKVAGNFHFAPGKGYYESNVDVPELTAEGGFNITHKINKLSFGTEFPGAVNPLDGAQWTQPASDGTYQYFIKVVPTIYNDIRGRKIDSNQFSVTEHFRDGNVQPRPQPGVFFFYDFSPIKVIFTEENRSFLHYLTNLCAIVGGIFTVAGIIDSFIYHGQKALKKKMEIGKYR

SEQ ID NO: 117121 - protein, 328 aa, Triticum aestivum
  unsure (1)..(328): unsure at all Xaa locations
  Clone ID: PAT_TA_11539.pep
VRPRVRPIQAHGCGVLYDERTETYLWYGENKDGKTYKAHSKGADRVDIVGVSCYSSKDLWAWKNEGVVLRGEKKNVTHDLHVSNVLERPKVIYNDRTGKYVMWMHIDDANYTKASVGVAVSDSPTGPFXYLYSKRPHDCESRDMTIFKDDNGKAYLIYSSEDNSELHIGQLTDDYLDLTDDMRRFLIAQHREAPALGKFDGTDYMITAGCTXGWAPHTALAHAATSVMGPWETLGSPCVGGNEIFRSTTFFSQSTFVLPLPGLRGSFIFMADRWNPSDLRDSRYVWLPLTVGGVPDEAADYSFMFPLWSRVSIYWHRRWRLPEGWTDS

SEQ ID NO: 117122 - protein, 276 aa, Triticum aestivum
  unsure (1)..(276): unsure at all Xaa locations
  Clone ID: PAT_TA_11540.pep
MDFDDSLTPEIPIEQPPDADTMEVDGVGAAPPNMVVPGEIQQVGSTSSSSLTVSAGANGAASEPDLELLAVLLKNPQLVFALSSNEVGNLPTEQTVVLLDMLKQTGLGLSELVNSLPNGAGVPNKPEPVPETIPTSLPSPTPPKDLPASVGWRSDFPTHARAPNSQQAQLPNNGNTPFASEVHQSFSNVVSPLPSQPYTSVSXLPAHIQSNAPSLQSQSAISVNSLTQYAAPVNNMLDRTLVHQHTQPYGLASDHAAVAIHXKPAVNKPAHGISEQ

SEQ ID NO: 117123 - protein, 187 aa, Triticum aestivum
  Clone ID: PAT_TA_11541.pep
GYFNPNLERYEEIPSDTGIPFNVQPRMKAVEVAEKARDAILSGKFDQVRVNIPNADMVGHTGDLEATIVGCKAADEAVKIILDAIEQVGGIFVVTADHGNAEDMVKRDKSGKPIRDKDGNVQPLTSHTLNPVPIAIGGPGLAPGATFREDLPDAGLANVAATVINLHGFEAPHHYEPTLIQVSPVPF

SEQ ID NO: 117124 - protein, 95 aa, Triticum aestivum
  Clone ID: PAT_TA_11542.pep
SFFTWGKLRFMDDLSLYGRRGLFEPNVSVKNHLISTGEPSRNASFTSLMVYHSPVSQHSLPFSYPTSMLYHSNSKFSLQALMFLSNQCFVSNALP

SEQ ID NO: 117125 - protein, 177 aa, Triticum aestivum
  Clone ID: PAT_TA_11543.pep
SDAMESLYHTLLTKERKSNDELQDARKKLIDGLQTITTGLANIGIKRMGELDLKSLAIVCGRKFSKEDAEVTAAILCSKWEADIRKPEWHPFRVVMVNGKKKELISEDDAKLQALREEYGEEVYSLVTKALLEVNEYNPRGRYAVPELWNYKEGRKATLKEALQYVLKQWRTHKRKR

SEQ ID NO: 117126 - protein, 120 aa, Triticum aestivum
  Clone ID: PAT_TA_11544.pep
MASSNPSSGATAADDLDQLLDSALDDFTSLDLAAAPKSSGEASASSSSGSARPVKGLGMSLPDPRAPRRRAAKQPPPPPRGAHASEALEKLTRETREAARGLETATGGIASLDDEAMMDC

SEQ ID NO: 117127 - protein, 223 aa, Triticum aestivum
  unsure (1)..(223): unsure at all Xaa locations
  Clone ID: PAT_TA_11545.pep
RIYHASKLLHADTVLGLDDQQYINEVGNPLKVKHPNIVQLLGYWYEIQNELIEHNGXGHVASPYIVLGGDLLQGGRPDMLLCPRSCAPIRSALFDLIGAIRVARHVLRVRYPQFWQRGCLPTHLCLDSSAPPWGARFGLXRLFTPSHTHITQRIIGTRKYMPPEFLNEGKISPKNDVFGFGVVMIEIMAGPAGYSNSFEMHDVAQLMQQVRKNIVSFGTRVHI

SEQ ID NO: 117128 - protein, 137 aa, Triticum aestivum
  Clone ID: PAT_TA_11546.pep
VRVIREKMKTSQSRQKGQYDRKHKLMTYEVGEKDYLRVTPLKGTHRFGIKGKLAPRYIGPFRILAKRGEVAYQLELPPHLSRVHDVFHVSQLRRCFAETIHGVDHETLDLQDNLTSREYPVRIKLAPRYIGPFHIIK

SEQ ID NO: 117129 - protein, 207 aa, Triticum aestivum
  Clone ID: PAT_TA_11547.pep
MGTTPGSSYDCSFKVLLIGDSAVGKSSLLVSFVSAAPTDDDISPTIGVDFKIKFLTVGDKKLKLTIWDTAGQERFRTITSSYYRGAHGIILVYDVTKRQSFTNLADVWAKEIELHSTNKECVKMLVGNKVDKDEDRMVTTEEGLAFAQQCGCLFLESSAKTRENVEKCFEELALKILEVPSLSEEGSSVVKRNSLKQKHEKSGGCCQ

SEQ ID NO: 117130 - protein, 177 aa, Triticum aestivum
  Clone ID: PAT_TA_11548.pep
MSLRRTVGLVLSRRFSPRVIRRAAPARSFHTLKELPVGDGLRGAAGVAAAAIAGVGAWAVQYFRKGPDDDESAARKKEEDMKARFEDWMKEYNKTYRDEEEKAMRFQVFKDTVKSIESLPPSTQKKLLPPNGFADLTSKELPCIEPCIDDDLDDIDGEEYRQNKFLAENENGEEVVW

SEQ ID NO: 117131 - protein, 420 aa, Triticum aestivum
  unsure (1)..(420): unsure at all Xaa locations
  Clone ID: PAT_TA_11549.pep
DPHAREDVKILKALDGHENIVHFGWPFRDDXIFVSTWHFDKVANXWDRILAQKKTRCSEKDAAVLVRQMLKVSAECQQRRLVHRDMKPENFLYKPTKEDXPVKATQVPTYREHEQADKPVRISESAGSVATDXVSRWCEMVLSTGVCXFLLLSCCFPRSVRWEGFGFVSIQVLCAVIVWVHKFPGKCLRSCVEGAVYSXLLHKPRPLLPAAQALSHPWVREGGDASEIPVDISVLRNMRQAVKYSRFKQFALRALASTVNEEELADLKDQFDAIDVDKSGSISIEEMRHALAKDLXWRLKGPRVLEIIQAIDSNTDGLVDFKEFVAATLHIHQMAELDSERWGLRCQAAFSKFDLDGDGYITPDELRMHTGLKGSIEPLLEEADIDKDGRISLSEFRKLLRTASMSNLPSPSGVPNPQAL

SEQ ID NO: 117132 - protein, 383 aa, Triticum aestivum
  Clone ID: PAT_TA_11550.pep
DPRVRPRVRAAMRLQGEIQRIKSQKVQLQQKIKQESEQFRSWKAARDSARLQLKKEGRRNEYEMHKLLALNQKQKMVLQRKTEEATMATKRLKDLLEAKKSTRDAHGTGASGIQALMRTIDDELEVTVRAYELRSHYDRQIQERATISKEIAKLKECPEAMSPSARSSRISALENMLSSSSSAMVSMASQLSEAEERERVFNGRGRCDHVRSLPDAKNTMNYLFQLASSSRCQLHDKEVMCIEKDLIIGELKEKVVALNGRTRQLEAQVNDLHNQNMQLFAAMNNAKKSGRASRRDTTIDPEDGQIYALRKSARGSQSQHGKSSFYWSDDMDISDADESGELEDMSHDGSDTDWVESSRKINNTRRRTSNPSRNNSLTDVKSE

SEQ ID NO: 117133 - protein, 85 aa, Triticum aestivum
  Clone ID: PAT_TA_11551.pep
WAHGHPSQTPALLKRRPLWLLPVMGCTMAKWCGGPSLIKFVEASDGWAHEHPSQPPCSGKAPFAAACHGVGHGKRCGSLGPIPYY

SEQ ID NO: 117134 - protein, 391 aa, Triticum aestivum
  unsure (1)..(391): unsure at all Xaa locations
  Clone ID: PAT_TA_11552.pep
RDDFENEGTRKNNKLVANLANQIEVKYKYLQELELRYCETTVSLERMLAQREQRLQAYNEEITKGQQLGAQTSEKIIALLQNPRSELESKMSDLNSGSNXLHDLTTTTAHNXPSLERAKPGAPPRSRPLXFASAPRPAAVRHLVKLVRDQKREKVAALNKILELEQQLEAKQTLELEIQQLKGKLEVMKHMPGHEDSVSKDKINELSEELQDKMDELDAMESLNQTLVIKESKSNTEMQEARKELENGLLNLSGGRAHIGIKRMGELDLKAVSNVLGQKLSKEDAEVTAAILCSKWEAEIKNPEWHPFRAVMVDGKEMERINADDAKLRELKDEHGEEIYSLVTKALREYNANSTRYPVGELWNFREERKASLKEAVQVVLRQWRANRRKR

SEQ ID NO: 117135 - protein, 517 aa, Triticum aestivum
  Clone ID: PAT_TA_11553.pep
MSMEIEEEDSGETAPEMEAPGVSTVAIAVSGSRSSRHALKWALDKFVPGGRVLFRILHVRPPITMVPTPMGNYLPVSQVRDDVTSAYREELEWQARNMLLPYKKMCAQRQVEAEAVLLESDDVPAAISEEIDKFNIGKLVLGSSSRSIFPTRPKGSKTATKISECIPSFCTAYVVSKGKLSFVRSATSDACETPKTISSSTVSSPSSKSLSSAPSEWDDRNGTAAVLFRQSSLSSQRDHALANINRSASRGATPSGSAGSEISYHADTTLKTNSHSITSVAQLSSSSSSGDSVYRSFRGDSFRDISDLQAAVSETATDLKHSHDQDDLKLQIESMKVKLRHLQNLHDVSQNEPVDSTQKLPNDLGIRRVEDGIKLREIDLTEEMVKRLVRQMEREEEQVAEREAQPKQSSSEQDSNGDHQNSSDLETGRKNTGRCLTEYNRYSWEHIQAATSSFSSDLVIGKGTYGTVYKAKFQHTVAAVKVLNSLEGFGTQQLQQELEVLGKIRHPHLLLLLGACP

SEQ ID NO: 117136 - protein, 89 aa, Triticum aestivum
  Clone ID: PAT_TA_11554.pep
RLSTQLNRLLSNLAALTKLDKILVHPVYENSTRKTTCQREKRDTGHHSESALGRSVVARIIFAAKVTYAATAALPFLAASPSAFLASLS

SEQ ID NO: 117137 - protein, 282 aa, Triticum aestivum
  unsure (1)..(282): unsure at all Xaa locations
  Clone ID: PAT_TA_11555.pep
SGTSPTPPRPPTTTTTTLSRAPRLRSPSAPSSAPPQQNPRRSLARAPPPPPGLLSRFLSSSSQKAPPAASPPSSSAPVPAPGSPAPPAYTGNLKKALAGLRRIDLEGLRWRVFDAKGQVLGRLASQIAVVLQGKDKPTYAPHVEAGDMCIVLNAKNICIAGRAITVKIYYWHTGYIGHLTNRKLKDRIAKHSTEVIRKAVMRMLPRNKLRDDRDRKLRXFAEGEHPFHDRPRESFMMTLHYAREMCPLSSRPNVKALKCAPGTKPEMIEGEAAKNGKAAVAA

SEQ ID NO: 117138 - protein, 76 aa, Triticum aestivum
  unsure (1)..(76): unsure at all Xaa locations
  Clone ID: PAT_TA_11556.pep
GSGRQFFHRGAVSRCGVSDSLAKVSRLPDRGLWSLSFWTLFXWSIVYQFLHLVSSLLYSLVSMIXSRISYCVQSIH

SEQ ID NO: 117139 - protein, 136 aa, Triticum aestivum
  unsure (1)..(136): unsure at all Xaa locations
  Clone ID: PAT_TA_11557.pep
MEISSDNNNNASNQNKSLPPPAPSPAAGKLPNGIVKEQPPLRTLRSLTMRTTSTGDLRKGMMEDMPXVSSKVDGPNGKKIDGFXLYKYRKGEEVRIVCVCHGNFLTPAEFVKHAGGGDVTNPLRHIVVNPSPSVFL

SEQ ID NO: 117140 - protein, 125 aa, Triticum aestivum
  Clone ID: PAT_TA_11558.pep
SRRIGPHNRNVLHSELEDTKETVRATWRRATEAYSGCRSRGRRSWYGTAMARWGGGGGADVGQRRRVERAGGASVRPGGVSAQESGGGCRRRHRGRGAGGWCRPGQIGRECGAPACYKKLVLRKG

SEQ ID NO: 117141 - protein, 113 aa, Triticum aestivum
  Clone ID: PAT_TA_11559.pep
NLKCQNCGTSEKIAPPMHRGPDGPRTLCNDCGLMWAHASALRSCSKAKVEAPMLAIEQCNAAVAQCQTGTDVKALPAPNNYDVAPSNGEAMDNSVTANATAAAMEGAPKAQSE

SEQ ID NO: 117142 - protein, 322 aa, Triticum aestivum
  unsure (1)..(322): unsure at all Xaa locations
  Clone ID: PAT_TA_11560.pep
APPPPAMPDPASAQGPDAEMRDAAAAAGDEDDAEEEEEEDDELEEEEEEEEEELPPAEEPPSPAAPEPVSAFPGNPNQLTLLFQGEVYVFESVTPDXVQAVLLLLGTGEIPPGLSAMVLPSQRENRGLXIYVQRTDIPAKRVASLIRFREKRKGRNFDKQIRYAVRKEVAHRMQRRKGQFVGRANLEGESPSPGCDPASQGSGQDFLSRESKCQNCGTSEKMTPAMRRGPAGPRTLCNACGLMWANKGTLRSCSKAKVEAPMPAIEQCNAAVAQCQTGTDVKALPAPNNYDVAPSKGEAMDNSVTANATAAATGGAPKAQSV

SEQ ID NO: 117143 - protein, 223 aa, Triticum aestivum
  unsure (1)..(223): unsure at all Xaa locations
  Clone ID: PAT_TA_11561.pep
EEFGTRLXARFLVVAMLMRRAEAVDHLVARLRSLVQESKSAYPKTNFKEWKQVLQELDRFLKADGAYKGSRSLRYDNLFDSYASNLASIARFHSKRVLKLKEAVLTSYHRNEVKFTELTLDTFRMLQSLEWEPTGSYQIAVKELTENGTMSDQSGPSGLIDIHLSTEISDGNLPSNPQRAIIYHPTVSHLIAVLATICEELSQDSILLIYISASGLADQECIS

SEQ ID NO: 117144 - protein, 438 aa, Triticum aestivum
  Clone ID: PAT_TA_11562.pep
MGSMELSTAPENGTAAAAAACNGGAAPANGGVERRLRSSAASASWAAHLPLEVGTRVMCRWRDQKPHPVKVIERRKSAASSSPADYEYYVHYTEFNRRLDEWVKLEQLDLDTVEADVDEKVDDKATSLKMTRHQKRKIDETHVEQGHEELDAASLREHEEFTKVKNIAKIELGKYEIDTWYFSPFPPEYNDSAKLFFCEFCLNFMKRKEQLQRHMKKCDLKHPPGDEIYRCGTLSMFEVDGKKNKVYGQNLCYLAKLFLDHKTLYYDVDLFLFYILCECDDRGCHMVGYFSKEKHSEEAYNLACILTLPPYQRKGYGKFLIAFSYELSKKEGKVGTPERPLSDLGLLSYRGYWTRVLLEILKKHKSNISIKELSDMTAIKADDILSTLQSLDLIQYRKGQHVICADPKVLDRHLKAAGRGGLDVDVSKLIWTPYKEQG

SEQ ID NO: 117145 - protein, 132 aa, Triticum aestivum
  Clone ID: PAT_TA_11563.pep
MALEWVVLGYAAGAEAIMLLLLTLPGLDALRRGMISVVRSALKPMMSVVPFCLFLLMDIYWKYEMRPTCDDEHACTPSEHLRHQKSIMKSQRNALLIAAALLLYWILFSVTSLVVKLDHLQQRVDKLKKRDD

SEQ ID NO: 117146 - protein, 294 aa, Triticum aestivum
  Clone ID: PAT_TA_11564.pep
DTFLTRIGFMIIFIALRPILHELDLKQVSDNKTLAKTVSRSPASTLQRIHNTKQHTSPGLYLRKRYKRGRRTEHRNRRPGTCNDGEGQESSDSKVDVGGAWTWWSLTNGGRWRGRGSRWRGSAAAVRRALRLRVHGGALMVRRRVRGEGDDRRAASWRGGPDGVAPGRRPWSRGGAEACNDVTSWASRAVGRHGDHPLDGREHQGPEGSPAPAWWPPGPAEYHSTHPLRRQIAARHPRLPDAPEDRLVLGHGTLQHWGGRISRLPIRRRSVCLGEGDLGGGWGEPGLGRGVGRA

SEQ ID NO: 117147 - protein, 75 aa, Triticum aestivum
  unsure (1)..(75): unsure at all Xaa locations
  Clone ID: PAT_TA_11565.pep
VSNMVHFVLSFSKKGQNTEFCRNLIHTYMHAYVTLGLRVLTPLTMSRPRSRTRRASPXXPXGPYFCRXAXGQWPK

SEQ ID NO: 117148 - protein, 86 aa, Triticum aestivum
  Clone ID: PAT_TA_11566.pep
SSSSADYGNYPAAPAVTPLADIVDAVAGDEAVSTSTYTKDGVVYEVAIVEVVVTTTVGADYRRHAHKHRRGHFGPQLSLFLSKRNK

SEQ ID NO: 117149 - protein, 200 aa, Triticum aestivum
  Clone ID: PAT_TA_11567.pep
SAVDNFRRQFANLEENGGKGGAIVPSDRKHVSLPRTTTVHSTPIPPKDQKSSQVPQRIPTGRPGRVVGPVIPFENSCAMDPYSQRRVARNPVLPAAATNVSAYAYHRKSDSSERELQQELEKDRMQYQPMQRFMDAKMVSPDLRSTSYYMPKGVPKADVAERTGLQPNMMQGIAPFNGIAAVGGSYNKASAVQYGVSRMY

SEQ ID NO: 117150 - protein, 174 aa, Triticum aestivum
  Clone ID: PAT_TA_11568.pep
TQPRWIPSLPSSSIPFLHPTPLPDSGKPRGSPPPSSPPRGHLSPLTISTDRFLSSPRKATPRHWWWCTARRPQRRRAAVAAGTATSAWSGWSQPFKILNGGISALMAESTASIGGYMASGYRRVAGVQLYINHLKPARLGDRIEAKVNPIRYLHPDAYLDKDQLLDAVHWIWQA

SEQ ID NO: 117151 - protein, 51 aa, Triticum aestivum
  Clone ID: PAT_TA_11569.pep
GSIPEREPEKRLPHPRKAAGAQITQSWTSDNAEEGGDEIKEAASKPEGEGH

SEQ ID NO: 117152 - protein, 131 aa, Triticum aestivum
  unsure (1)..(131): unsure at all Xaa locations
  Clone ID: PAT_TA_11570.pep
MSAGGGWSQPFKILNGVVSALMAESTASIGGYMASGYRRVAGVQLSINHLKLTRLGDRIEAKANPIRYLDPDASLDKDQLLDAVHWIRXAVGLACGLLWGAVLLVGAFWIALSVLPSLHPQSPNLLLSLQT

SEQ ID NO: 117153 - protein, 78 aa, Triticum aestivum
  Clone ID: PAT_TA_11571.pep
RLMRKTLEATPPYFRRGSLLRSPFSWYKLSSIIVSLPDFHHCLLVAPTSNSFLPHMHMSSVDMFSVCLQTSKCYRHIN

SEQ ID NO: 117154 - protein, 102 aa, Triticum aestivum
  Clone ID: PAT_TA_11572.pep
REGFLELLPKQCSELAGCSQGLVQLGLLIHEVGLPSFRSPNPGVFRVQPAALQLLQGCLQVRHRGLEPLHFLTSSRCDIARNSVSAVHDYSKRFEYSRRVVW

SEQ ID NO: 117155 - protein, 82 aa, Triticum aestivum
  Clone ID: PAT_TA_11573.pep
WIRQAVGLACGLLWGAVPLVGAFWIALFFTISTVIVHLYYAHLLKIDEEDFGGHAALLQEGLFASFTLFLLSWTLVYSLAHF

SEQ ID NO: 117156 - protein, 125 aa, Triticum aestivum
  unsure (1)..(125): unsure at all Xaa locations
  Clone ID: PAT_TA_11574.pep
MSTAEATREENVYMAKLAEQAERYEEMVEFMEKVAKTADVGELTVEERNLXLSVAYKNVIWCPEGSWRIISSIEQKEEXLGNEPICFNQGYSRFKPTQQICGWTSTLDPTFPSALNKSKFLSEMK

SEQ ID NO: 117157 - protein, 130 aa, Triticum aestivum
  Clone ID: PAT_TA_11575.pep
MRKSKAAAAAAKLPHHAAQNGHALPSRLARYLDPDASLDKDQLLDAGHWIRQAVGLACGLLWGAVPLVGAFWIALFFTISTVIVHLYYAHLLKIDEEDFGGHAALLQEGLFASFTLFLLSWTLVYSLAHF

SEQ ID NO: 117158 - protein, 53 aa, Triticum aestivum
  Clone ID: PAT_TA_11576.pep
MIHDNSTDRTAFVPATHHSNFCPINLTLWTSDNAEEGGDEIKEAASKPEGEGH

SEQ ID NO: 117159 - protein, 173 aa, Triticum aestivum
  Clone ID: PAT_TA_11577.pep
MAGSGESARTSAPSPPGPPPGFGEGAPPDNALHALGFEYTRITGTEVLGRLAVTETCCQPFKILNGGVSALMAESTASIGGYMASGYRRVAGVQLSINHLKPARLGDRIEAKANPIQVGRNVQVWEVQIWLLDPSTSEHKDLVSSARVTLLTNLSTPEEMKSYEKGIKKYAKL

SEQ ID NO: 117160 - protein, 173 aa, Triticum aestivum
  Clone ID: PAT_TA_11578.pep
MAGSGESARTTAASPPGPPPGFGEGAPPDNALHALGFEYTRITGSEVLGRLAVTETCCQPFKILNGGVSALMAESTASIGGYMASGYRRVAGVQLSINHLKPARLGDRIEAKANPIQVGRNVQVWEVQIWLLDPATSEHKDLVSSARVTLLTNLSTPEEMKIYEKGIKKYAKL

SEQ ID NO: 117161 - protein, 143 aa, Triticum aestivum
  unsure (1)..(143): unsure at all Xaa locations
  Clone ID: PAT_TA_11579.pep
MAFTMRAVKVPPNSASMGEARHRVFDFFREACRAIPSIMEIYNLDDVVTPAQLRASISQQIRKNQGVSXPKVIDMLLFNGMEELNNITEHAKQRHHIIGQYVVGHKGLVQDLEKDQGSFEFLKKFNQNSRSEAHKISASVEVP

SEQ ID NO: 117162 - protein, 130 aa, Triticum aestivum
  Clone ID: PAT_TA_11580.pep
MAFTMRAVKVPPNSASMAEARHRVFDFFRDACRAIPSIMEIYNLDDVVTPAQLRASISQQIRKNQGVSDPKVIDMLLFNGMEELNNITEHAKQRHHIIGQYVVGHKGLGARPGKRTKGLRFLKKFYTSNY

SEQ ID NO: 117163 - protein, 213 aa, Triticum aestivum
  Clone ID: PAT_TA_11581.pep
MELATAAVVSTASIHPGRSHFSTARVASWSSSSSPSSSRSLSTSASTSRSQRRRLPVASAAVELREAAAGGGDSVRVIETPQPNSSVKFSVEVPPSICQECYQTTLLEYSKRFKVPGFRPGKIVPENVLLNYVGPQHVRAATVEAILRHTLPQALSSVEERALEDSVRILTKFDDMNEAFSLDHVFRYDVAVDVIPEVRWLSEDKYKNLKVVI

SEQ ID NO: 117164 - protein, 167 aa, Triticum aestivum
  Clone ID: PAT_TA_11582.pep
IIHSYIFITPSIVEIDEAITGTRAHTYTQGHQGQSIGGERASKPHAHAHAPLLDSIRSEGRSLFTYTLTPSHECMQLNSCRGCTCSCRRSCSPRRTGRRPPRTAPPCSQAPRRGRPRRRPGPRHCPAPSDQGTSSRTCSLSRSCNRIHSCKTSSKSDEPKKISRRRR

SEQ ID NO: 117165 - protein, 175 aa, Triticum aestivum
  Clone ID: PAT_TA_11583.pep
MFLSFLFKFQVVKAIEKAIPIPRGLSVAENHPAREELKAMEAQKVDIDRMATLQVRRELWGGLAALALQTAGFMRLTFWELSWDVMEPICFFVTSTYFMAGYAFFLRTKREPSFEGFFQSRFVVKQKRLMKARDFDVRRYSELRLACGLPALHPQSPCASSQESHHHCHSHCHCH

SEQ ID NO: 117166 - protein, 75 aa, Triticum aestivum
  Clone ID: PAT_TA_11584.pep
MSCNCGSGCSCGSDCKCGKVYPDLTEQGSAAAQVAAVVVLGVAPENKAGQFEVAAGQSGEGCSCGDNCKCNPCNC

SEQ ID NO: 117167 - protein, 173 aa, Triticum aestivum
  Clone ID: PAT_TA_11585.pep
MHTHPHPTHTHTPTLNPISLVFLDPLSPPTPPPDSGDPRGSPPPSSPPRGHLSPLTSSTDRFLSSPRRATPRHWWWCTARRPQRRRAPVAAGTATSAWSGWSQPFKILNGCVPALMAESTASIGGYMASGYRRVAGVQLYINHLKPARLGDRIEAKANPIRYLDPDAYLDKTE

SEQ ID NO: 117168 - protein, 156 aa, Triticum aestivum
  Clone ID: PAT_TA_11586.pep
MGTKKPWLLCLAVVAIAAVLLTASAKKSADVTQLQIGVKYKPESCTLQAHKGDKIKVHYRGTLTDGSVFDSSYDRGDPFEFTLGNGQVIKGWDQGLLGMCVGEKRKLRIPANMGYGERGSPPKIPGGATLVFDTELIAVNGKTSAGATAEGDDSEL

SEQ ID NO: 117169 - protein, 159 aa, Triticum aestivum
  unsure (1)..(159): unsure at all Xaa locations
  Clone ID: PAT_TA_11587.pep
MGTKKPRLLCLAVVAVAVAAVLLTASAKKSADVTQLQIGVKYKPESCTLQAHKGDKIKVHYRGTLTDGSVFDSSYDRGDPFEFTLGNGQVIKGWDQGLLGMCVGEKRKLRIPAKMGYGXERGSPPKIPGGATLVFDTELIAVNGKTSAGATTESNDSEL

SEQ ID NO: 117170 - protein, 128 aa, Triticum aestivum
  unsure (1)..(128): unsure at all Xaa locations
  Clone ID: PAT_TA_11588.pep
MSTAEATREENVYMAKLAEQAERYEEMVEFMEKVAKTADVGELTVEERNLLSVAYKNVIGXARRASWEDHLPPLSRRRRARGNEAYVASIKGVXRPRIETELNKXICDGILKASGTPNLVPSALQQNQ

SEQ ID NO: 117171 - protein, 130 aa, Triticum aestivum
  Clone ID: PAT_TA_11589.pep
MAFTMRAVKVPPNSASMGEARHRVFDFFRQACRAIPSIMEIYNLDDVVTPAQLRASISQQIRKNQGVSDPKVIDMLLFNGMEELNNITEHAKQRHHIIGQYVVGHKGLVQDLEKDQGSSEFLKKFYTSNY

SEQ ID NO: 117172 - protein, 321 aa, Triticum aestivum
  Clone ID: PAT_TA_11590.pep
MGESKWMGKRWEEMDTDVLVKIFKELNLVELSPVSQVCRLWRLACSDPLIWGTLDFGLLKSNFIQTRASPYIWVDDRSDKRLAKILRVAMAISRGNVNCMIFHYNLYMKDEHLHYISQRSPNLKRLVMPAWNRISRAGICQAIERWGELESLTMPTIGHPPYIMEGLANSCKNFKELKIMGSFDLLFASAVTTYLPKLKVLSLRCSKVTMGALQCVLNSLEHLEVLNISHCLLFEMATNGRRQVIHELDNKALERASRLREFHHCQSRQCVACQRMMLDEGILRWYRYEDWFWRRDEVRSLDLKDYGRLFGAQCEMLTSVD

SEQ ID NO: 117173 - protein, 56 aa, Triticum aestivum
  Clone ID: PAT_TA_11591.pep
IFHSYIFTTPSIVEIDEAITGTHAYTYTQGQFEVAAGQSGEGCSCGDNCKCNPCNC

SEQ ID NO: 117174 - protein, 75 aa, Triticum aestivum
  Clone ID: PAT_TA_11592.pep
MSCNCGSGCSCGSDCKCGKMYPDLTEQGSAAAEVAAVVVLGVAPENKAGQFEVAAGQSGEGCSCGDNCKCNPCNC

SEQ ID NO: 117175 - protein, 130 aa, Triticum aestivum
  Clone ID: PAT_TA_11593.pep
MAFTMRAVKVPPNSASMGEARHRVFDFFREACRAIPSIMEIYNLDDVVTPAQLRASISQQIRKNQGVSDPKVIDMLLFNGMEELNNITEHAKQRHHIIGQYVVGHKGLVQDLEKDQGSSEFLKKFYTSNY

SEQ ID NO: 117176 - protein, 130 aa, Triticum aestivum
  Clone ID: PAT_TA_11594.pep
MAFTMRAVKVPPNSASMAEARHRVFDFFRDACRAIPSIMEIYNLDDVVTPAQLRASISQQIRKNQGVSDPKVIDMLLFNGMEELNNITEHAKQRHHIIGQYVVGHKGLVQDLEKDQGSSEFLKKFYTSNY

SEQ ID NO: 117177 - protein, 75 aa, Triticum aestivum; identical to SEQ ID NO: 106874
  Clone ID: PAT_TA_11595.pep

SEQ ID NO: 117178 - protein, 75 aa, Triticum aestivum; identical to SEQ ID NO: 117166
  Clone ID: PAT_TA_11596.pep

SEQ ID NO: 117179 - protein, 75 aa, Triticum aestivum; identical to SEQ ID NO: 106874
  Clone ID: PAT_TA_11597.pep

SEQ ID NO: 117180 - protein, 75 aa, Triticum aestivum; identical to SEQ ID NO: 117174
  Clone ID: PAT_TA_11598.pep

SEQ ID NO: 117181 - protein, 167 aa, Triticum aestivum; identical to SEQ ID NO: 117164
  Clone ID: PAT_TA_11599.pep

SEQ ID NO: 117182 - protein, 261 aa, Triticum aestivum
  Clone ID: PAT_TA_11600.pep
MSTAEATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESKVFYLKMKGDYHRYLAEFKAGAERKEAAENTLVAYKSAQDIALADLPTTHPIRLGLALNFSVFYYEILNSPDRACNLAKQAFDEAIAELDSLGEESYKDSTLIMQLLRDNLTLWTSDNAEEGGDEIKEAASKPEGEGH

SEQ ID NO: 117183 - protein, 261 aa, Triticum aestivum; identical to SEQ ID NO: 117182
  Clone ID: PAT_TA_11601.pep

SEQ ID NO: 117184 - protein, 136 aa, Triticum aestivum
  Clone ID: PAT_TA_11602.pep
MALSLSTSFLPTPGAAAVARTANRTLRSLVPSQGMRCSMRKKGLHPEIFEDAKVYCNGELVLVTGGTKPEYSVDVWSGNHPYYVGDSSALVVMDSQIEKFRKKWGHVKEYWTKEQWLEMHPDGDPEFEPEDDETRK

SEQ ID NO: 117185 - protein, 136 aa, Triticum aestivum
  Clone ID: PAT_TA_11603.pep
MALSLSTSFLPTPGAAAVARTANRTLRSVVPSQRMRCSMRKKGLHPEIFEDAKVYCNGELVLVTGGTKPEYSVDVWSGNHPYYVGDSSALVVMDSQIEKFRKKWGHVKEYWTKEQWLEMHPDGDPEFEPEDDETRK

SEQ ID NO: 117186 - protein, 142 aa, Triticum aestivum
  unsure (1)..(142): unsure at all Xaa locations
  Clone ID: PAT_TA_11604.pep
MALSLSTSFLPTPGAAAVARTANRTLRSLVPSQGMRCSMRKKGLHPEIFXEAAKVYCNGEGWVLVTGGXREPEYSVDVWXSGNHPYYVGDXSALVVMDSQIEKFRKXKWGHVKEYWTKEQWLEMHPDGDPEFGSRKDDETRK

SEQ ID NO: 117187 - protein, 162 aa, Triticum aestivum
  Clone ID: PAT_TA_11605.pep
HPRVRQSRTLAASLFQIDLWCRRRTMAVAALRNLAAKIRIPGPAALRASPAPGPLAISHSTTPKSDLEKALLLRNNIESATYVDLHSSAEVLGKYCEHTEEIIKQYSDVHVEVGNKMRTLTLKYFFTCVAICFTDSMISNKDEVVLQERQGEGVVVQERQVE

SEQ ID NO: 117188 - protein, 299 aa, Triticum aestivum
  unsure (1)..(299): unsure at all Xaa locations
  Clone ID: PAT_TA_11606.pep
DPRVRATVVTKPHVEVDKADSKRRKTPPVERSNLSIDRVRPTEIVKPKMTKEERESLGDCLSSLAEGPEELPGPIIDLLQQCXDNNTEQPGDGEIEIDIHALSDDVLLELKKRVDKYLQERDHQQTKSEPSENEAVNVSGLSHSSTNPCKGGEPVEEDVDICGNASPILIEKDPQIRTNKCGSPSSSSSDSGSSSSDSDSGSDTESEPEKVGSPAKLVKGTKIPEQPAEQEKSDDVISPIDANHTTADVELREQDNESKAAPEGTAADSAKPDRQVSPDKLLRAAVLRGRYADVIVKAR

SEQ ID NO: 117189 - protein, 682 aa, Triticum aestivum
  unsure (1)..(682): unsure at all Xaa locations
  Clone ID: PAT_TA_11607.pep
MAAAEENSSLFLIFILTMIALPLVPYTITRLCHAATKKAKTIHCRCSGCHRSGKYRKSIYKKISNFSTWSNLTILLLWIVVIFLIYYIKLSSREVQVFEPYSILGLEPGASENEIKKSYRRLSIQYHPDKNPDPEAHTYFVESISKAYQALTDPISRENYEKYGHPDGRQGFQMGIALPKFLLNMDGASGGIMLLGIVGLCILFPLMIAVIYLSRSSKYTGNYVMHQTLSTYYYFMKPSLAPSKVMDVFIKAAEYMEMPVRRSDDEPLQKLFVAVRSELNLDLKNIRTEQAKFWKQHPSLVKMELLIQAHLTRESFALTPALVKDYRHMLELAPRLLEELVKIALLPRSPNGFGWLRPAIGVVELSQSIIQAVPLSARKAGGGNSEGIAPFLQLPHFTEATVKKIARKKIRAFQELCDMSEVERATLLTQVAGLSEEEARDVELVLEMIPTVEVDIKCXETTTEGGIQEGDVVTMYAWVSLQRRSGLTAALPHAPFYPFHREENFWLLLADTASNEVWLSQKISFMDEATAITAASKAIQDTQEALGASPKEIGIAVREAVDRVKKGSRLVMGKFQAPSEGNHNLTSFCLCDAWIGCDSKTSFKLKVLKRSRAGTRTYVPEEGPVAEDGIEEEEEEEEEEYDDYESEYSEDDEEEKKKGKGKVANGAAHQRASSDIDSGSDD

SEQ ID NO: 117190 - protein, 184 aa, Triticum aestivum
  Clone ID: PAT_TA_11608.pep
APPKINPFDDKPKMKFGFEEEEEVVPNKKAKVAGKATDTRRSAIDDLMKEEEKAKERSNRKDYWLCPGIVVKVMSPWGGEGRYYKQKGLVKRVMAKKEGEVAGQAREPGRRADEDELEAEEPAKGGRERKDNGACRGTDARLLSVDTERFSAKLQVEKGLYDGEEHEGEEEEEESKDAPRGRPG

SEQ ID NO: 117191 - protein, 111 aa, Triticum aestivum
  Clone ID: PAT_TA_11609.pep
MAAGSAFRVAVLAAVLLVPFLGPPAVEAQLGQVRKYCGSQFALASQACAILPPTSPEHRHHDDEDDDDEDEDEDEDEDEDDDEDDKGGGGGGGDKGGGGGGGGGGGGGGGC

SEQ ID NO: 117192 - protein, 468 aa, Triticum aestivum
  unsure (1)..(468): unsure at all Xaa locations
  Clone ID: PAT_TA_11610.pep
QEIASGRSSVSDPGGDSGSKRPKFDQDGLGDIVIQPHLSDDKPMHLDQESSSSLSYHPHRDAEASTSTSMNPAKAEETGADLPKGMNDMTISDDKVDGRNNDKEAEGVTVDGNGTKAGQIIVTTIGGQNGKPKQKVSYMADRVVGTGSXFGVISQTKCLETAETVEVKXLLQDKRYKNRELQTMQLLDLRNVVQLKHHFFSTTERGEVYLNLVLEYVSETVYRVANYYCRLNQRVPILYVKLYAYQMCRALAYIHRVVGVCHRDIKPQNLLVNPHTHQLKLCDFGSAKKLVPGEPNISYICSRYYRAPELIFGATEYTTAIDIWSVGCVVAELLIGQPLFPGESGVDQLVEIIKILGTPTREEIRCMNPNYSEFKFPQIKAHPWHKLFGKRMPPEAVDLVSRLLQYSPNLRFTAVDACAHPFFDELRDPKTCLPNGRPLPPLFNFSGAELEGLPVELLHRIIPEHMRK

SEQ ID NO: 117193 - protein, 414 aa, Triticum aestivum
  unsure (1)..(414): unsure at all Xaa locations
  Clone ID: PAT_TA_11611.pep
LEFTSVYRGGTGLPRLQPTRSREPAAHSAAAREPGQISNAHSEAVPAKKNVVNSSLNSASPPFYPSGASNQVGAQRRDIQPGGSNKVHPSSMKMDDNMKLQSGPVVRGKGTTDYGGRDRFHAEGPVRPSPARSVGGSSYSSGFASSSINSGQSPNNRAQGGNASIGVPSHNRPTPSFQQTSRVSTQQQNHTSIMHQKSGQAPSQASMRIPTQQLSHRTGNASPSAQHLPARSTESDENGSYPSSNQSKTSEVEKTNKETGRGSFMYGGAQVIGAAGLAQGEQNFPGTPALLPVMQFGGQHPGGLGVPTVGMALPGYVAQQQLGRGNNEMAWLPLLAGAAGAFGGSYPPYITLDPSFYSRSSGQTSSSVPSREGNVNHGAKSPQNDIVTEELDQRQNKHRXILRDELQSVKHPVR

SEQ ID NO: 117194 - protein, 160 aa, Triticum aestivum
  Clone ID: PAT_TA_11612.pep
AQTLPRSCTGHLDATSCFFPQNIIGSIKTPIFLLNAAYDTWQIHESLAPDVADHGGAWRACKSNRLACNASQMKVLQAFREQMVGIVQGAFSRSKGNGFFINSCFTHGQSKVPATWNAYGSPTIHNKSIAKSVSDWYFGRAEVRAIDCPYPCDHTCHNDI

SEQ ID NO: 117195 - protein, 259 aa, Triticum aestivum
  unsure (1)..(259): unsure at all Xaa locations
  Clone ID: PAT_TA_11613.pep
MLPFQLGLNSIKXTLTVRAPLGTIADVVDLGAMGVVVGQDVSTWLAAHPPVAAFGAPAALLYGAGVSVYAFEGVCMVLPLEAEAADKKKFGATLGLSMAFIAVMYGLFGVMGYVAFGDATRDIITTNLGSGWLSAAVQLGLCINLFFTMPVMMNPVYEVAERLFHGKRYCWWMRWVLVVTVGLAAMLVPNFTDFLSLVGSSVCVLLGFVLPATLHIKVFGAEKGWVGVLSDVLLVVLGLVLAVFGTYSSLVQIFHSSSA

SEQ ID NO: 117196 - protein, 256 aa, Triticum aestivum
  unsure (1)..(256): unsure at all Xaa locations
  Clone ID: PAT_TA_11614.pep
GAFVNICLFLPSSVPPSPSLSPNARPSLRRNRWPRAQATSPGGPIPSPRGSCPICSPSSPPAARVFPRTAAPSRPRPRPPLGRLEKITFRIGCLYFCAVPAGSSRRVSWKSSTPSSRAADATSTSAPLSRPQPAAHFMGMHQSLGIQLAQLGKDASAAGAARRGNTQRKRIEVESVAAAGKQQAREVVKKSFRAEFLXKLHKDLDDDIDVRALENGFISVTPLNVHGHVESELEAPASDWLSAAVSVSEEKEAPAT

SEQ ID NO: 117197 - protein, 359 aa, Triticum aestivum
  unsure (1)..(359): unsure at all Xaa locations
  Clone ID: PAT_TA_11615.pep
RSARPFRCPPRRRLRSLLSSSGRSHADPSSSPSTGGHFPPQEPAAWQRQPQQELSSGCCGRRSPAAGAGARGAAETSRAYPTTTRPRLPVRIRTKWPVLRRWDVPWERPRTRGRTRGRTRGFALTGLVEQSILQYVGFSAAGATIDEKAEILFLGQLSVTAVVLGVIFSITNTFRPFPDDVFRYDVKEPFKLQNGWLLWAGIGLFGAVISIALVGAAMTYLNGAPPEREKDSLVPLLPLIGSSTLSTAYLVGITGVLAPXLEETVFRGFLMVPWTKWFPTPVXVILSAAVFPFAHLTPDQFPPLFVLXGVALGFTYAQTRNLLSXLLPIHAFWNSXGVILLLTFLQLQGYDIKELLGAS

SEQ ID NO: 117198 - protein, 156 aa, Triticum aestivum
  Clone ID: PAT_TA_11616.pep
HAPTAGRHRIHPCSLGHQPRKKITIWTLNMMDGNSRFKWEPHRVIYLDGLLPNPHRLPEFPIISADDPDVLCCLLRKEEFHGEASMVMIDMEHARLRSSTPYINRQSVDEKAHKNEFLDMPLLPTVFSKHIERPTGMPWDNHKLATRPSKKLKSAM

SEQ ID NO: 117199 - protein, 171 aa, Triticum aestivum
  unsure (1)..(171): unsure at all Xaa locations
  Clone ID: PAT_TA_11617.pep
MGDATTKCSAGEENDRIKYATSSMKGFRDEMEDALTAVLDLDGYSSTSFFGVYDGHGGADVALYCSRQFHIELTREPDYGNNLRTALEHVYFRIDKKLKRSDEWKREPAHPPVSRTLKNLLRAALCEERYVPPLQEGTTACVALIRGNQIIVGNIGDSRCXLSRNGQANDL

SEQ ID NO: 117200 - protein, 103 aa, Triticum aestivum
  unsure (1)..(103): unsure at all Xaa locations
  Clone ID: PAT_TA_11618.pep
TNKPYNKLQTDGELGKRDENGQSSKKKKGGRRRREMHNYLHLFFVFCHTSKGHRSVGVGARLVAAGRRVXGAENGLFXLPLDDXPAVADXRADXLLVQGVXVG

SEQ ID NO: 117201 - protein, 150 aa, Triticum aestivum
  unsure (1)..(150): unsure at all Xaa locations
  Clone ID: PAT_TA_11619.pep
LDXKFDLPSYPQTLEELEIEFKREAMELARARDQEEDEENSKHRESLREMRENHIKSVSVTRSMQARKWDEFLEQSFKRQQQAQQTSYAQTGYSDFDQRTAHYAATGPPIDSKNTYPYPTDNYSAPRRHVAYGEFQHDRHDDLGRTYGRY

SEQ ID NO: 117202 - protein, 209 aa, Triticum aestivum
  unsure (1)..(209): unsure at all Xaa locations
  Clone ID: PAT_TA_11620.pep
MDQEVKESKPSGEPNLFLQWGSRKRLRCVKSREDGSPSPARSDALRRTIPRXNRPLLGGDVSQFRSPRRPXALFHPRKSEAQASEARQSISLSPEKDRYYSTRGSPFPFEGNGFDFSGGVEEKGTAALPRFFISLSNKEKEEDFLAMKGCKLPQRPKKRPKLMQKCLLTVCPGAWLSDLSHERYEVREKKSSKKRARGLKALCMESDSE

SEQ ID NO: 117203 - protein, 94 aa, Triticum aestivum
  Clone ID: PAT_TA_11621.pep
SCSRAIAAPGFPAAGNAPKAVTGAIGLLVRAPPSSLVGTIGLLICMPGGVLYQQSTTKPNAPNVEPKEENDEEEQKLLEMQHGRDISSTEEHSS

SEQ ID NO: 117204 - protein, 128 aa, Triticum aestivum
  Clone ID: PAT_TA_11622.pep
MSWAGPDEILLSTSLAGFLDKKLIVLLRDGRKLLGTLCSFDQFANVVLQGACERVIVGELYCDVPLGLYVIRGENVVLIGELDREKDELPSHMTCVSEAEIRTAEKAEKEARDLKGTMRKRMEFLDFD

SEQ ID NO: 117205 - protein, 105 aa, Triticum aestivum
  unsure (1)..(105): unsure at all Xaa locations
  Clone ID: PAT_TA_11623.pep
VDGRQXXGRXLLAVRELLSEKGCLYMIALEDNDPLGICHLMNEKGFASRVLLKRCTDEESLYVLKFWQDAAAGANASQSGRSPRAESWLSQLPFKSFWHKNTGSS

SEQ ID NO: 117206 - protein, 264 aa, Triticum aestivum
  unsure (1)..(264): unsure at all Xaa locations
  Clone ID: PAT_TA_11624.pep
HEDASAPPGRAVRRRRTRRRPAAGGSAPRRGHPFTWLDVAFSEPYXALSVIDYFSHLTALITAPAAEDDADLDSRLVQLEIQAVRVFLVAVTVIIVKDELWVVFFADYXRLTVGYLLGVIVIFAIAQQPPYDGLGLVNHLTPLQLDSLLTEEPTTRFWLVEFRTSFLTPCIQASSVMPELSNLYSNKNISFGLVDLGHFPNAAARFGISMWDHLPTYILFDKATEVARLPEIGNGTKVFVPKVTKKLLCHHFDLDRRLIEFLST

SEQ ID NO: 117207 - protein, 731 aa, Triticum aestivum
  unsure (1)..(731): unsure at all Xaa locations
  Clone ID: PAT_TA_11625.pep
TSSPRRPCCPRARPAPPSCSAYSTAVTFAKWEDTSSNPLLADFDFPPFDRFEPAHVRPGIRALLARLEGELEXLEKGVEPAWEKLVHPLERIVDRLDVVWNGFDHXRFEKDSADLRAAVEDVQPEKVKFYLRLGQSKPIYEAFNALRKASVWDSPAEAQRRVTCGRIGGAVPPFVALKFAAPALRNFYFHVKSMKQYCCCNXLKVVIFSQWTIQSPLINKSTGLPXLSLLGLAAQSGCLSQGHENASAENGPWMITLDAPSFMAVMQHAKNRALREEVYRAYLTRASSGDLDNTDIISQILKLRLEKAKLLGYKNFAEVSMARKMATVDRVQELLEKIRAASWDHAVQDMEDLKAFVKDSGSAEANDLAHWDLNFWSERLRESKYDIDEEGLRPYFALPKVMDGLFSLANKLFGITVEAADGLAPVWNSDVKFYCVKDSSNSPVAYFYFDPYSRPSEKRGGAWMNVVFSRSSVLARHGSSVRLPVAHMVCNQMPPVGDKPSLMTFREVETVFHEFGHALQHMLTRQDEAFVAGISGIEWDAVELPSQFMENWCYHKNTLLSIAKHYETGEPLPEEIYAKLVAAKNFRAGTFSLRQIRFAXVDMELHTTYDPSGPVSVYDVDRRVAEKTQVLAPLPEDRFLCGFSHIFAGGYAAGYYSYKWAEVLSADAFSAFEDVGLDNEKAIEETGRRFRETVLALGGGKSPLEVFVAFRGREPSPEPLLRHNGLLPVAA

SEQ ID NO: 117208 - protein, 151 aa, Triticum aestivum
  Clone ID: PAT_TA_11626.pep
LKIGHTRAHQGLARVHFLRNNRTGAFEEMTKLIEKARSNASAYEKRSEYCDRDLTKADLQMVTKLDPLRVYPYRYRAAVLMDNHKEKDAISELTKAIAFKADLNLLHLRAAFHEHVGDISGALRDCRAALSVDPNHQEMLELHHRVNSQEP

SEQ ID NO: 117209 - protein, 359 aa, Triticum aestivum
  unsure (1)..(359): unsure at all Xaa locations
  Clone ID: PAT_TA_11627.pep
MSALQASLLLRPLPSPLPPRRRPPPAPASVSFPRSCHHRRPPLPLRALASDGPQPPPSPAPEPPAAAAAAVAPEAEVDTGPAAQDGKEELEDLVDKARVWAVAFAAAVVEVAKRFFDWVVSGDWMSWWPFWRPDRRLQRLIDDADAHPKDPAKQSALLHELNKFSPEDVIKRIEQRSHAVDSKGVAEYLRALILTNAIADYLPDERSGRSATLPALRGRVGQRVSGEDKPFSNPGISDKQPLHVVMVDPKATGRSTRFAQEIFSTILFTVAVGFMWVMGAAALQKYIGSLGGIGASGVGSSSSYSAKELNKDITPEKNVKTFKDVKGCDDAKKELEEVVEYLRNPMKFTXRLGGKVTKG

SEQ ID NO: 117210 - protein, 93 aa, Triticum aestivum
  Clone ID: PAT_TA_11628.pep
EQAGTARASSSIARGTAVKAAPAHAFSEFHSSPALLTWVFGPAPLGISTPGSRNACANILLAAPVCSFFERLGANSRCRTASSRWVPTRTTTR

SEQ ID NO: 117211 - protein, 318 aa, Triticum aestivum
  unsure (1)..(318): unsure at all Xaa locations
  Clone ID: PAT_TA_11629.pep
RPPTRPGEIMLSVWLGTQADEAFPEAWHSDAHGAAGPSAVASTRAKVYFSPKLVYLRVAAIGAQDLVPHDTSRPMNASVKLQLAGQVRRTRPGGPPGTPNPMWNEEFMFVASEPFDEPLLVTVEDRVGPGRDEPLGRIMLPLNAAMPRHDHFGKPVEPRWYSLARPSDDGEKKEGKFASKIQLRMSLDFGYHVLDESTYYSSDLQPSSKHTRKPSIGILEVGVLGARNLIPMKAKDGRSTDAYCVAKYGPKWVRTRTIMNTLNPQWNEQYTWEVFDPCTVITVLVFDNSQIGSKNGDARDESIGXPRIRLSTLETDRV

SEQ ID NO: 117212 - protein, 158 aa, Triticum aestivum
  Clone ID: PAT_TA_11630.pep
SEVACENNGKCDVDQRSFKAYLARSMAYTASVAPWTSDQINPYLQTSAQAAAKQCTGGANQTSCGLKWTTNGVNDGSFGVGEQMAALEVVQSLLYPSVSGPATAEKGGISKSNPDAGDTSSDTPIKFDTVTTGDKAGASILTILVLVSILVGAWWMVS

SEQ ID NO: 117213 - protein, 154 aa, Triticum aestivum
  Clone ID: PAT_TA_11631.pep
SVIQIKDMEAKVFRALLSFIYTDSLPAMEKDSMEDEMSEVMDEGREEAAEFEMWLQWLEDLFVAADRYDLQMLKLICEKQLSEHISVSSVTSTLALAEKHHCCGLKEACLKFIQVQSPSCLQTVMATSGWDHIAVTYPWVVKEFIAKLASNQRK

SEQ ID NO: 117214 - protein, 76 aa, Triticum aestivum
  Clone ID: PAT_TA_11632.pep
DGMKINAHRAEKAEEHPTTGMRRSEGMSSQSSRIPMSVDVGVVFGTRPAPRPTLNSADKSRLKRKLDMDPEFEYAE

SEQ ID NO: 117215 - protein, 204 aa, Triticum aestivum
  unsure (1)..(204): unsure at all Xaa locations
  Clone ID: PAT_TA_11633.pep
AELVFIDAPHKLSFVYRPHPDVCSXNPSPPSGTAKTKSAWLVSPNMSCHTMQDWKVADAPFDPLQYQEQTDGFKESYAYLESIIAQDGNFDGVLGFSQGAAMAALLCRQQQKTCGSPKFRFGIFCSGYPAPVGDFDREPIRLPSLHCFGGGEGHDRQIASRASTELAGMFEEGRCTIVEHDMGHIIPTRPPYIDRMKEFLCNFI

SEQ ID NO: 117216 - protein, 303 aa, Triticum aestivum
  unsure (1)..(303): unsure at all Xaa locations
  Clone ID: PAT_TA_11634.pep
SISSCWDRDEIVFNSIDGSRLRPVPAFGNWVPCLVPHALSARLLRRLAGVRPTSDGTASVTDDVLEKIVKQFRRLKFMSLRGCMEVTRLLDSLAAMTQLETLDARHTSIVELPPAIITKLHKLQYIPAAMPPPPPPPPPTTTTTIQAGDLHRCMLWWNPAAAVAGGSRRNSAGVAFVLLQMVTVLRLFVPPPRXIGKLTELHTLGVVNIAGGKDSLLLLKELENLTQLRKLGLTGINSKNWKELCDAISGHLPHLESLSLQLLVLQENAGSYEFACFDRISVLPKTLKRLKVLYTSSRTVLHA

SEQ ID NO: 117217 - protein, 208 aa, Triticum aestivum
  Clone ID: PAT_TA_11635.pep
EPVPEKFSLDDIQEVSQEEDVIETQEDYEDIYNKLGDYKFRHEEVEASRPRTRGRVMGHPRVVEGSVRKKESSRKKQRKSKEERLARAKQEQAEELKHLKNLKKKEIAEKLEKIRMIAGIEGEAACKLGADDLEEDFDPEDYDRKMQEMFDDSYYGADEVDPGFGSGDDLDLVKPDFDKEDELLGLPKDWALDGKEGSTATGEKKKKK

SEQ ID NO: 117218 - protein, 231 aa, Triticum aestivum
  unsure (1)..(231): unsure at all Xaa locations
  Clone ID: PAT_TA_11636.pep
HLTPRPYRHKPAARSLPALPLTRGALHFSGHATGSFLPRPAGDGVRAHVPRRGGVPVRGRRRGRRRVLVREARLLQAARVAAPRRPLRRGRAPPALRPRRHACDWFRACSVTPSVWRCGKRALQQDNEGTRTGALNVQAAARHEVAVGACSSTVYVESCYACCQREVTRNPDFDWYACIRSCHDXDALPIKERENKKAGEVVVCCELILARFLSKQIMCGAVNPSQSICLL

SEQ ID NO: 117219 - protein, 218 aa, Triticum aestivum
  unsure (1)..(218): unsure at all Xaa locations
  Clone ID: PAT_TA_11637.pep
RFGARFLLGAXGEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMRLMEGDHIGPFNLGNPGEFTMLELAKVVQDTIDPNARIEFRENTQDDPHKRKPDITKAKEQLGWEPKIALRDGLPLMVTDFRKRIFGDQDSATTATEGQ

SEQ ID NO: 117220 - protein, 189 aa, Triticum aestivum
  unsure (1)..(189): unsure at all Xaa locations
  Clone ID: PAT_TA_11638.pep
MGMCSDKKRSSPGVAVWCVVLGIALLVXVDAAGSEGRARAGQLAEEHGDAADCSALCDGRAKSVDGPCSDDSLNGRDHGRDQALEVVGVGGVAGLLVVATKLDDREGAAKTMHCEYHRAVTIKPTVAATLDVNGPSMSIADAALIATVPIEVLRHARQPVYVLDQLEQEDPKRFYDWLMGGQECGTGAQ

SEQ ID NO: 117221 - protein, 483 aa, Triticum aestivum
  Clone ID: PAT_TA_11639.pep
LGKLVKTGALCCVAARPHGTKSNPASRDCSMDPTEPRWRMNSSFSPPSRGWDCMYSSDGLPHRTPDAPHDHPPYVSSLSSHSKGSRSAFGSDQYLNHHHSVSDGALSYFGSPVDSLQAPRWTPSLQRFDLGEFSTPGGGPKPESSDLQSSERHLTAVSSFSSASPFSETSQLASSGKRPASHLPRNHLGRRSFMSTPVYPLVFRNPVSEAEASGVAEASNAGRTTPSDDSLASPVWRRSLASPELKFHDTLSELRKMEASPEPNTSSRREGFRWSSASSYDFGYDGDAIDISDHISIDSQRSPTSSTSFLKCGLCERFLRQKSPWSSNRIVRNTNMPVAAVLPCRHVFHADCLEESTPKSEAHEPPCPLCTRAPDSEGCVSFSEPLHAALRSARRNHGIRFSSGDAGGSSSSANPSRNDHVLKRNQSALAPARSGSLFRNRFKKQFPFKGRLGKDLFGGRVFRKVGSSSSSGGQKDDASAASS

SEQ ID NO: 117222 - protein, 324 aa, Triticum aestivum
  Clone ID: PAT_TA_11640.pep
RGITGPHMVVAPKSTLGNWKKEIQRFCPVLRAVKFLGNPEERNHIRENLLAPGKFDVCVTSFEMAIKEKTALRRFSWRYIIIDEAHRIKNENSLLSKTMRLFSTNYRLLITGTPLQNNLHELWSLLNFLLPEIFSSAETFDEWFQISGENDQHEVVQQLHKVLRPFLLRRLKSDVEKGLPPKKETILKVGMSEMQKQYYRALLQKDLEVINAGGERKRLLNIAMQLRKCCNHPYLFQGAEPGPPYTTGDHLIENAGKMVLLDKLLPKLKARDSRVLIFSQMTRLLDILEDYLMYRGYQYCRIDGNTGGDDRDASIEAFNKPRRE

SEQ ID NO: 117223 - protein, 211 aa, Triticum aestivum
  unsure (1)..(211): unsure at all Xaa locations
  Clone ID: PAT_TA_11641.pep
SXEGEDEEDEEEEQEPEGEQAAGDGEDAEEEVDEEEIVAATTGAGADDDDDDGGDGAGAAEEAESTEDDAAAEEGGEEDADESEDATAKTEIGKRERAKLREMQKLKKQKIQEILDSQNASIDADMNKKGKGRLKYLLQQTEIFAHFAKGSQAAEKKNRGKGRHASKVTEEEEDEEYLKEEDALAAGGTRLLIQPSCERLQMRDYQLLNWL

SEQ ID NO: 117224 - protein, 187 aa, Triticum aestivum
  Clone ID: PAT_TA_11642.pep
GTRPHNRGAGSASATPVLLVVVVAALAAGASATSTLTPLSITNRCSFTVWPAVASAGLGTELHPGANWTVDASAIHYTADIWGRTGCSFDAAGRGRCQTADCGSGLRCRSTDPAAPATKAQVAISEGFYHYGITLDKGFNLPMDLTCSSGDALRCREDGCHDAFPYVKYNDHSCTAAGSRLQIVFCP

SEQ ID NO: 117225 - protein, 137 aa, Triticum aestivum
  Clone ID: PAT_TA_11643.pep
FYNTKSYTCEKRAHRKSKSDARMTLSIRLRSKSSINTGVSVLISAVPLAVWRWLDIGKEPWGSARTWHGRWRQSRHPQAATAHHERAVVLRERTKVLPLDSCVSVTDRHGSGGGGSRIRVSSGEAGEVEGSEEASII

SEQ ID NO: 117226 - protein, 437 aa, Triticum aestivum
  unsure (1)..(437): unsure at all Xaa locations
  Clone ID: PAT_TA_11644.pep
LGRQRRSRSRSXERRRGEEEEMVRELQRERERSDRHRDYRDRDFRRKKDDGTEPEVDPERDQRTVFAFQLSLKADERDVYEFFSRAGKVRDVRLIMDRNSRRSKGVGYIEFYDVMSVPMAIALTGQPLLGQAVMVKPSEAEKNLAQSNATSGGAASGGARKLYVGNLHSNITEDQLRQVFEPFGQVELVQLPVDPLTGLCKGFGFIQFARLEDAKAAQSLNGQLDIAGRVIKVSAVTDQGGVQLGTTTGDLDDDEGGGLALNASSRALLMRKLDRSGTATSLTGGIGAPGLNTSCXFPAAASVLGAPLTAASLLVQPVGAIPGAPLPIISQSADIGTPTEFLLLKNMFDPAVETDPDFDLDIRDDVQDECSKFGVVKHIFVDKHTAGFVYLHFDSATAAASAQRSLHGRWFAGKMITATFMTAQQYEMKFPDRAAME

SEQ ID NO: 117227 - protein, 218 aa, Triticum aestivum
  Clone ID: PAT_TA_11645.pep
DWTFSDARFARQNRRFRKSEEKKEQKRREQDAKYTKLMKEKAARAEEARKEDRLEFIKEGVLGLQKSLGKVGERVDAGFNKSQQAIDTAYQLELVNSQTLLLSLGVLEDMSKDLGYLMFKAAQETKRLESEKLWVYVGLEKLSQKLPFNLAVHVKSIVRNVNESKALYPIAGCAIVLSRAHFTPLEWVEIAKISNDDWVEKWTKKLQEVHERSKNKTG

SEQ ID NO: 117228 - protein, 174 aa, Triticum aestivum
  unsure (1)..(174): unsure at all Xaa locations
  Clone ID: PAT_TA_11646.pep
MAAAQHTADLPTRSYSYLHWFRQSVGARSAGAFSAFSPSYAPPEEASSRGPTPHSRDPHRHHPSRPAXTRHRGXPPPPPPPPPRPPQPSXGGPQQPPHDLERQPAPLPPAGRLSSPCPGKARPGGPAAPEPGRTPRGGGPWASGGGGEARLPSRGPPSRLQRQNHALGKDTLGG

SEQ ID NO: 117229 - protein, 129 aa, Triticum aestivum
  unsure (1)..(129): unsure at all Xaa locations
  Clone ID: PAT_TA_11647.pep
SARGANQVVIARXRGEQTSPPILNETLGETAPKPRCARRVRHKYSLGFFEYLVAICLLLLCSLERRRKESGILFFVACEEKQHLDAIVQIIRLYPLIHCSKARTSSPPHSFLVLVRIEDRDNLSVILVV

SEQ ID NO: 117230 - protein, 344 aa, Triticum aestivum
  unsure (1)..(344): unsure at all Xaa locations
  Clone ID: PAT_TA_11648.pep
PRVRQKPAAGPHDKSYPVGSVLISALRLVDVFSDDSNFRSSFITNTIPFLTQILATPHDEFVSSWCSVDLPVIEDDANLDYDPFGAADLALLAASNMLTEAKVNYSCNFRSISMPSIQYAQXXTSCVVKIIANLHVFVPNICEEQERDLFLQKFQKYLLSESPKPSLDHPAADEITIVCTNLGSLSHYAKSLIPGNLLNEEDVQLLSDFAYKLQRWCKSQVGQRISQVAKSDVTSEMKVDLQPVQQPQPQPARASVPDPNMDGPPKDVQNIEESMATPPMKQDGNARDETPRNRATTNGGVLQNSVGQNLIHLGVARTTSAGYPGPSTATSMEVPRCRSVDHFK

SEQ ID NO: 117231 - protein, 98 aa, Triticum aestivum
  Clone ID: PAT_TA_11649.pep
SDQDDDQEPDDGGADYNLSVSEICLARWLVQEDVFVLCQFSFFVCPANLSCSWQKSQSALSITGVPLFRIADKFALQDGSSKRTSSYLPVQLLVCVAR

SEQ ID NO: 117232 - protein, 217 aa, Triticum aestivum
  Clone ID: PAT_TA_11650.pep
EQLFIAIDVGDICSHDGSHDNCMVTRLNNISFHLPTTTSLLQAHYNNNMSTSAISMLKEFPRCPPSSEFGYSPTSVGTAVRTVRYNTTVEIVFQNPYSSGMFSASNPMHLHGHDLFILGQGLGKFDPVKDVQAYNLVDPPVRNTALAPIYGWTAIRFVASRTGVWFLHCHMEKHVSSGMALALVVENGPTPETTLPPPPADYRSCDGGQNNRALADE

SEQ ID NO: 117233 - protein, 130 aa, Triticum aestivum
  unsure (1)..(130): unsure at all Xaa locations
  Clone ID: PAT_TA_11651.pep
QHKERGLVARRRTHMRGGCSRCRTRPRSSSRGRGGCSRVGPCAERRRGGGCPGCRHHPQRMPTHTVAGLGVLDNPLCVRSLTLHQTRMRCIGRGLGDGVGVVMELRPPWHPHIHGVIPXHGVLSXHGVPA

SEQ ID NO: 117234 - protein, 253 aa, Triticum aestivum
  Clone ID: PAT_TA_11652.pep
PRVRALITTSGLLYTFGDGTFGALGHGNRETISYPKEVESLKGLRTISVSCGVWHSAAVVEVIMTQSNASSGKLFTWGDGDKYRLGHGDRASKLKPTCVSSLIDYNFHKSACGHTLTIGLTTSGHMFTVGSSVYGQLGNPNNDGRYARLVEDKVGGGGVVEVACGSYHVAVLTNAGEVYTWGKGANGRLGHGDIADRKVPTLVEALRDRSVKRIACGSGFTAAICQHKWVSGMEQSQCSACRQPFGFTRKRHN

SEQ ID NO: 117235 - protein, 120 aa, Triticum aestivum
  Clone ID: PAT_TA_11653.pep
TTDFSSLHQSTQHPPWFPSLFPSRCEQSSAFEHTKLGGKHSATACFHLYSSLELTIAICMASILNHCSLSTKTQHEQFSTGKPLSLIAVPMGLYRTSNLNIDLLLLPGRRGNDQTWKLRP

SEQ ID NO: 117236 - protein, 204 aa, Triticum aestivum
  Clone ID: PAT_TA_11654.pep
GTRSASSSSSSSSHFRSLSWSVSRTWSASRQLQAIGSGLAAPRAHEAGLAAPVYAMGCLLHLASWALVAAVPCPDRVAALQAHHLPAAPPRGAFAWAPPLLTLQDRLTEEGKRKDRRNSCGLLKEIHALEKGAQRLAEAIDAAPIPLTGEREAAVREAAAELAAVCSAMKDGLEPLERQVREVFHRIVRSRMEGLDSPMPNAAD

SEQ ID NO: 117237 - protein, 96 aa, Triticum aestivum
  Clone ID: PAT_TA_11655.pep
MEHSYSIKAQLNNRPPNGLHHHGSSRPNSQVAWKPWLSPASFAASKWVPRLELLQALNFTAAIRFLQSVSKTILPIPLCSAKNSAFLTVNASACIA

SEQ ID NO: 117238 - protein, 323 aa, Triticum aestivum
  Clone ID: PAT_TA_11656.pep
MGLEAGEPSSFLSLSSAFSYGVASMAMVFVNKAVIMQYVHSMTLLTLQQLATALFIHFGQVLGMSKRKDLSMATAKKLLPVSIFYNANVAFALASLKGVNIPMYIAIKRLTPLAVLVSGFLRGKGKPSTQVSLSVVCTALGVLVAALGDFSFDLYGYSMALISVFFQTMYLILVEKSGADDGLSSMELMFYNSILSIPFLFFIIVATGEFPHSLSVLSEKTASASFSVILLISLVMGIVLNYTMFWCTIVNSALTTTIVGVLKGVGSTTLGFMVLGGVKVHALNVTGLVINTFGGVWYSYAKYTQKKKLPRRVAPDEESHPHK

SEQ ID NO: 117239 - protein, 84 aa, Triticum aestivum
  Clone ID: PAT_TA_11657.pep
GAAPREERQVWVCAARPSGQCVGHWIQAGVSETLLVSMFEVLGLTIQSFWWVCCVRARRELVMGRSEEIKNVIVLILFLPRAFG

SEQ ID NO: 117240 - protein, 296 aa, Triticum aestivum
  unsure (1)..(296): unsure at all Xaa locations
  Clone ID: PAT_TA_11658.pep
MTTDGDIDMADLASLDAPASPAAAAAPSVRFQPNVKGKPKPKPKPKPKAKPAPKPKHKPEPEPEPTPEEGDPHAAAAAAAATLPEGGVDAMETDADRGRPRTRXDDMDVEDEDFVVREIDVYFTPKPFDKDSKLYIMQYPLRPCWRPYELGEVCKEVRXKPGSSKVEVDLEVDTQSDNYDPEVSASLRLTTHTLSSSEAADVSDYAVGVLRGNMVHLNHLDAVMQLRPSMPHLISGASRTRQPLQQVETNGGGAGRQAVPSVKGRQHPDGSKVSPEEPEPWISLTYEPAGSDVARK

SEQ ID NO: 117241 - protein, 148 aa, Triticum aestivum
  Clone ID: PAT_TA_11659.pep
IRHEANDGVNSSAESTLLWKKHEPPTNSTRYNLSSFAITLNELTPNLKEKLPPTDSRLRPDQRHLENGEYDKANSEKLRLETRQRMARKMQDNGWKPRWFDRDTEDGPFRYTGGYWEAREQRKWDGCRDIFGELPGKKTSPVPASVGI

SEQ ID NO: 117242 - protein, 107 aa, Triticum aestivum
  Clone ID: PAT_TA_11660.pep
LSRRLVETMKVGSMVFTVALVFIGCLLMVGQCRPEPKSTYEDGHSNTTMVFQSKLALKWCVARDCKTKHEPSLFAPRCFCCFNAQGTPCFKSIGDCQNHCPTLPPGK

SEQ ID NO: 117243 - protein, 148 aa, Triticum aestivum
  Clone ID: PAT_TA_11661.pep
MATPGKPDPAAVPPKAPQPQPQPPVKGAIMRRVFPFLLATNLFIGVYVFAKTYKRDQDKKNAETAAAAAAAAALSAPPAAVAKHAEPAPPPKRVLPPLSEDEQRKVYKWMLEEKRKSKPRDAAEKSKINEEKALLKEIIRAESLPRLW

SEQ ID NO: 117244 - protein, 206 aa, Triticum aestivum
  Clone ID: PAT_TA_11662.pep
MGNEFDYLFKLLLIGDSSVGKSCFLLRFSDDSYVDSYISTIGVDFKIRTLEMDGKTIKLQIWDTAGQERFRTITSSYYRGAHGIIIVYDITDMESFNNVKQWLSEIDKYANDSVRKLLVGNKCDLAESRVVDTAVAQACADEMGIPFLETSAKESINVEEAFLAMSAAIKKSKAGGLERKASNLVQMKGQPIQQQQHKQKSSCCST

SEQ ID NO: 117245 - protein, 110 aa, Triticum aestivum
  Clone ID: PAT_TA_11663.pep
HLERMTTVSDNARFWHERYSTCKTIIDWLMRGNHTGNKLVAYVALWHTRKNTKSCTVWIVTIQNFGTTWLRRKTESQLSCVVGSRWRECRIIVHPEETKKQDSGWIVNAS

SEQ ID NO: 117246 - protein, 207 aa, Triticum aestivum
  Clone ID: PAT_TA_11664.pep
PGISTLSMQEVSINRFFSRIQRQYRRTQRKAALISFSDIRNAIANSMLSTVLLKLVRVSVGYLTVVLPSIRLERGVACKPSPSSPSPPSLLDLDMASTTTPAIGLGNEALPSTELLGDFVGFDDSDSATDEGNESAFDGSAPQDENKETSLDRDLWALLDIPQGSSKKIDNMIEANLSDFSGQDKYCSPAVNYSGVSRRFHGGSKVL

SEQ ID NO: 117247 - protein, 114 aa, Triticum aestivum
  Clone ID: PAT_TA_11665.pep
ADRQRCKSRTADPPRRPDPPHTNDPPVRAAPLTGLLARGSRSVDVQFAGTTTAEAHCEWPPPRWDRGDEATDIDNPLPPSLLPRWGSTSVAAQCTATPRARVIFGPGITRGCSL

SEQ ID NO: 117248 - protein, 229 aa, Triticum aestivum
  unsure (1)..(229): unsure at all Xaa locations
  Clone ID: PAT_TA_11666.pep
ATMGCVVMLEPTSRFVGIGFSICWNRQSHLLESMSRAYHFAATSRRDCWNRHLELLERASSSSTTPMVTTKTASAGSQRERGRVLQSPTKGLRRGSRAFAAASLSLRRAAAAPDAGEERIKEEEGGNDALEGLNHEGRNARIVWLPCVWSKFGPARRRLSVFVPEGQWRCSVYVQSACVEEVHTAMGHFDFTVTVSVHVVPPHSPVPPFPKDIYDVVMLAYVKYKXLYT

SEQ ID NO: 117249 - protein, 172 aa, Triticum aestivum
  Clone ID: PAT_TA_11667.pep
SSLSVGPSCPPRRPPTPRRPHSPSTTTSSPPAASRRSKPSRPPSTSPTASPPPTPSPSSPTSPAPPSASPRPTSPTSSPATRGSSTAASTTPSRPASPPFAAMASPRDHVRSFLRMAPGVFRSVSIQEKLGFWLHFLGSPEKFPRLRGRYCYPLSSGRRPVVKPNIAVLLES

SEQ ID NO: 117250 - protein, 144 aa, Triticum aestivum
  unsure (1)..(144): unsure at all Xaa locations
  Clone ID: PAT_TA_11668.pep
IQEGQDWGATLLIFKLNRALCVQXWSPKENKFAVGSGAKSACICYYEQENNCRIQFGTTASPMQTTWGSSCQAPRCCFHATAAAATETTTMNPSPCLQCLLSARRGHPAKAMSANPEAGMHTPEGHPHHLLPLPCSPIRRQDIE

SEQ ID NO: 117251 - protein, 290 aa, Triticum aestivum
  unsure (1)..(290): unsure at all Xaa locations
  Clone ID: PAT_TA_11669.pep
MADAAVRCLRDGRLDGEHAPALAVEGSLQCCPLAARAMLHVAAAVASNAAAGKAQARGLVVVAFDRSPEVYLDIMLRHGXIQNALSRCVRILDCYSDPLGWKQNIRSQQHQEDSGTPCSTNKDTITIFRSVKDVDKLSCSIIDLGRGFEGEGKTYFSVAVDSISSMLRHASVQSISGLLSNLRSHGLPSSSFCLAHPGLRVTLCSRACVSRSAMVASGVPVVVVSVCGDGPGAVFSLLAHSGPLAAFQVRLKRRNGRVKHLYEELCVEGYDVKFISATSVSIEVNQSLLP

SEQ ID NO: 117252 - protein, 229 aa, Triticum aestivum
  Clone ID: PAT_TA_11670.pep
MEVIPAAAAAHDGQKQRFDLGVFVGDLPLDDDDAASDNESLEGLQQELEDCKNDQEVANILANGIKMRDYTKGVENSIRQVELDSIQDYITESENLVLLHDQISDCDNILSQMETVLTGFQTEIGSISSEIKVLQEKSMDMGLKLRNRKAAESKLSKFVEDIIVPPRMIDIIVDGEVNDEYMKTLEILSKKIKFIEADSMVKTSKALKDVQPEVERLRQKAVSKIFEFI

SEQ ID NO: 117253 - protein, 127 aa, Triticum aestivum
  Clone ID: PAT_TA_11671.pep
MALPRAASGGAGAVRGPAGPLPADALAAAAPPPRASFRDLPPSGNDVCKDGKRQTINAEDVFKALDEIEFPEFVEPLRTALEEFRSRNAARKPASGKKQSEKKRKLDKEAVPEEQNGAADEANADED

SEQ ID NO: 117254 - protein, 146 aa, Triticum aestivum
  Clone ID: PAT_TA_11672.pep
MAEPPPPPSQSPAQTPPPTQQQTPAANARDGMMACVAALEAALLPCLPARELQAVDRSLQSSHQIDVERHARDFMEAAKKLQSYFIGMQREDQPTTEELLRKEITTMEEELKTKSELIAKHKSLIEGWQKELKDQLGKHNTELERV

SEQ ID NO: 117255 - protein, 169 aa, Triticum aestivum
  Clone ID: PAT_TA_11673.pep
KTRTPPCPPQQASAAAGPLLRCSSPRLSPANLHGRRVVPIYRPAPPYRAARSLSPAAADAPLWRPTAYSGRDPTPAEGPPFPLPTSQAVAMSSSVSCPVHQPILAPPLCQGDDGRADGGAPEADLHLRHHLRAARRDAPRPHGAPGFHCRYAHPYTNYTHLTARFTLSV

SEQ ID NO: 117256 - protein, 304 aa, Triticum aestivum
  unsure (1)..(304): unsure at all Xaa locations
  Clone ID: PAT_TA_11674.pep
MLSTVSETAGPGSDMVCPATESGPLTRSLRGQVASGKSDRGAELLFTSSKAIMKPPKAMRGGIPVCFPQFGDCGTFARHAFPKRXMWALQELLPPPSRSLSRSRPRGDHRRPPDPGVTKSWPHSFAFRRTISLTKDGDLSLVSRIRNVNGKPFSFSFAYHTYLSVSDISEVRIEGLETLDYLDNLSQRERHTEQGDAITFESEVDRVYVSSPNVIAVLDHEKKRTFVIRKDGLPDTVVWNPWEKKAKTMADFGDEEYQQTLRADAAAAERPITLRPGEEWTGRLELSAVPSTNCSDHLDQPGIM

SEQ ID NO: 117257 - protein, 140 aa, Triticum aestivum
  Clone ID: PAT_TA_11675.pep
MVEKVQYKNVVFTVWDVGGQEKLRPLWRHYFNNTDALIYVVDSLDRDRIGRARAEFQAIINDPFMLNSVLLVFANKQDMRGAMTPMEVCEGLGLYDLNNRIWHIQGTCALKGDGLYEGLDWLATTLDEMRATGRLASTSA

SEQ ID NO: 117258 - protein, 200 aa, Triticum aestivum
  unsure (1)..(200): unsure at all Xaa locations
  Clone ID: PAT_TA_11676.pep
MGQAFRKLFDAFFGNKEMRVVMLGLDAAGKTTILYKLHIGEVLSTVPTIGFNVEKVQYKNVVFTVWDVGGQEKLRPLWRHYFNNTDALIYVVDSLDRDRIGRARAEFQAIINDPFMLNSVLLVXFANKQDMRGAMTPMGSMXGCLSVMTVNNRIMAHPIAHVLVRGDGLYGWLWLWMKREQSGIKLRATGRLASTSGVKE

SEQ ID NO: 117259 - protein, 231 aa, Triticum aestivum
  Clone ID: PAT_TA_11677.pep
SPDDVRGVRLEIEVMARLSGHPNVVDLKAVYEDQDSVHLVMELCAGGELFHRLQERGCFPEHEAATLFRYLMEVVAHCHSKGIVHRDLKPENILLVSKSPSSPIKLADFGLATYTQPGQRLSGTVGSPFYIAPEVLAGGYNEAADVWSAGVILYILLSGIPPFWGKTKSKIFECITSTELRFPSDPWDRVSDSAKELITGMLRRDPAQRLTAEQVLEHSWIREHADDSRDS

SEQ ID NO: 117260 - protein, 310 aa, Triticum aestivum
  Clone ID: PAT_TA_11678.pep
NKSPSPEPLCAGAMRRLDGSGFSVSVAGKRKRSPEYPCVSRFRQRRLLSFLRRQKLFDAYDVLTGESGARIDLYHLTDLVKAGRWDEAIDHLSCFLPCDLALGAHGRVLLHFLRVHKAVHDIVSGAPESRAVSAALRMCFTKNFTINHAITKLRTILWSLHSSSGFRDSLDFGRVRDKAASTVVYLAYQTTELREHMKEARGPAEPHNVLPIGFGFRPRRHVKRGPIPGSVLVRHYLRKRRMLASSISSHCEGSSSESLIKAKEWMVDLVDSCLEAGKRHQGYPLQYVCTPMVHKGAPVDPFSRSNLGTF

SEQ ID NO: 117261 - protein, 179 aa, Triticum aestivum
  Clone ID: PAT_TA_11679.pep
MATKGQLVRERNVKITSSREGRQRGNSQSEQLVQVPKQKDSAASGNIDGKFEDRIRVVKNDKIRRQREPRNAEGDVGLKSSKPWPARKATTVDELVKHMSKVPSYLQRKETADHLQDKALNVGVLEWGLLARWSHEQKHEPCSSHGASSSDTSRSVLFSSPSHSSASPSSKSLDSNQSP

SEQ ID NO: 117262 - protein, 78 aa, Triticum aestivum
  Clone ID: PAT_TA_11680.pep
KAGDYGSKADEDCRKKEDYQATDSCPIVVYHLHLEGIDVSYKIDENSNIVVDNAALLPSAANQNRCSYLTWRDKLSTL

SEQ ID NO: 117263 - protein, 253 aa, Triticum aestivum
  unsure (1)..(253): unsure at all Xaa locations
  Clone ID: PAT_TA_11681.pep
RKHRRNPYGNEGSRNMQMSALEEHNNSLLHREALRLQSASKEKVQTPEKERLVYVKALSKTAASILESLFKKDPHEAEFIQSIQEVVHSIEPVLVKNSQYVXILERLLEPERCFIFRVPWVDDRGEAHVNRGFRVQFSQALGPCRGGLRFHPSMNLSVAKFLAFEQTLKNALSLYKLGGAAGGSDFDPKGXRFCQSFMDELYRYLGPDQDFPAEDVGVGPREMGFLFGQYRRLSGHFQGNFTGPKIFWSGSSF

SEQ ID NO: 117264 - protein, 160 aa, Triticum aestivum
  unsure (1)..(160): unsure at all Xaa locations
  Clone ID: PAT_TA_11682.pep
MVRSIAPIFVGVVKDSESFDFCMCNPPFFESMEEAGLNPKTSCAGTAEEMACPGGEQAFITHIIEDSVSFKNSFRWFTSMVGRKANLKLLVSKVREAGXSVVKTTEFRQGQTARWGXLAWPSMAPRKNVIRSSSTRKSPPFFHASGSPTWKWCISGVEVS

SEQ ID NO: 117265 - protein, 115 aa, Triticum aestivum
  Clone ID: PAT_TA_11683.pep
SSPCGRIGRFLKKGRYAQRVGMGAPVYLASVLEYLAAELLELAGNAAKDNKKSRIIPRHLLLAIRNDQELGRLLAGVTIAHGGVLPNINPVLLPKKAADKEPKSPKKAAKSPKKA

SEQ ID NO: 117266 - protein, 395 aa, Triticum aestivum
  unsure (1)..(395): unsure at all Xaa locations
  Clone ID: PAT_TA_11684.pep
PASTSPRPGRALPRVETQASSSARPIDCGPATLVGPSSSGLVSLGQPASSAPVLGPRAPCAAAPHGLAGGAWRPCSAAPGPASGPLPAAPRGQSAAACPRFLARSTRWSAAPSRARPNPRRSFHYGDITVTDVYLLQSRPPELIDGQLRSTINGISYIAPSTPLILAQLFNVPGVFKLDFPNHPMNRLPKVDTSVINGTYKGFMEIIFQNNATTVQSYHLDGYAFFVVGMDYGLWTDNSRGTYNKWDGVARSTIQVLKFMFCFSLWISIYYMVWRNLRXLYQICLTRQXTVFPGAWTAVLVFLDNAGIWNLRVENLDSWYMGQELYISVVNPEEDHSDKTPLPLPDNTIFCGALSSLQKEQSHRFQYSGASRVGKTVSAAMISTTWLAATWLLYR

SEQ ID NO: 117267 - protein, 48 aa, Triticum aestivum
  Clone ID: PAT_TA_11685.pep
LHRLFFTLTVLNNGYDDLVVLELLLSVFYFLIYVASEHLQQMMQNIKI

SEQ ID NO: 117268 - protein, 258 aa, Triticum aestivum
  unsure (1)..(258): unsure at all Xaa locations
  Clone ID: PAT_TA_11686.pep
VLLRFVRPACAVGADEAAAAARRIGAVSHPNLVPLRAVYVGPRGENLLVHPXYVGGSLHRFLQEGIADSQRWSLICKLSVGPPVRLDHLHTGMEKPIIHGNLKTSNVLLDASYECRVSDYGLYLLLNTGGAHEMLEASAAQGYKAPELVKMRDATRETDVYSLGVVLLEMLAQKEPAGGDDRAPSSRDIFLPASFKNLVRERKISDAFSSDLVRQSRKSGNERKLNAFFELATACCSPSPSLRPNTKEILRRLEEIAK

SEQ ID NO: 117269 - protein, 266 aa, Triticum aestivum
  unsure (1)..(266): unsure at all Xaa locations
  Clone ID: PAT_TA_11687.pep
DTWXCTAHYAPXRDIDVIPPLPRAQYHGQKIFNTILSKEEGGVLSYLYMLAEFFSKPKIFRVRVYMLQGGVWCMHASATTQLPRLLTSLEVVLVDEKIYMADTFSDEIIVLDMTTSGFSTIPLPQGVNFHCVRTIMSRAGDASGVYLTHIHVKELQLCIWLHKGDNWLLVHTICLHQMWDNLRMLDQTLEDEHISFTCISNVGDNAEFVFLEMCGCIFYLDVTSKTLRKVHGVTVKDRPFNDVYPFMMIWPPKFPAPKDDPARNAM

SEQ ID NO: 117270 - protein, 184 aa, Triticum aestivum
  Clone ID: PAT_TA_11688.pep
MDDEAQETPPRRRRPKRAPEVRVFRQQILQLAGIACHEQEGKSRTELLEKLKTCNKVMLVELCRSFDVPGSTSTKKDELVTIVMEFLMEHCSGIIYTDPDKAQLLSCQKFNKRKRKKNGADLSGGEPSKKRKPDGTLLEFCSQEEADGRKAVEDRTNHSEFSLRDSRDELVNDSALGKLAVVPL

SEQ ID NO: 117271 - protein, 112 aa, Triticum aestivum
  unsure (1)..(112): unsure at all Xaa locations
  Clone ID: PAT_TA_11689.pep
APSPASSAVMXFAPREPRCAPPSFLPRRRTSVPAPLLCFRSSRDERSPAFVDHARTQPAVGPACFPSRAGLPWPLPPIWAWPMGEATPSALFFFSYCWASSVSAQWMFFLVL

SEQ ID NO: 117272 - protein, 302 aa, Triticum aestivum
  Clone ID: PAT_TA_11690.pep
APKAAEGEKQPDPVVNVYSAAAYGDLERLRRFVELDGGGASLAVPDGNGYHALQWAALNNYPHVALYIIEHGGDVNAEGHAQQTALHWAAVRGATATADVLLENGARLEAADVNGYRAVHVAAQYGQTTFLHHIVSKYGADFEALDNDGRSSLHWAAYKGNADTIRLLLFMDANQVRQDKNGCTPLHWAVIRGSLEVCTLLVHAGTKQELTLRDRGGFTPLQLAADKGQQHLSNILSNATKVSFGDKYCSGRLGKVGYAPILFSYLVILMILFLKSIVFASDFSRITAAVGLWSWAAISLAL

SEQ ID NO: 117273 - protein, 372 aa, Triticum aestivum
  unsure (1)..(372): unsure at all Xaa locations
  Clone ID: PAT_TA_11691.pep
MSASRSEGDEALVNEVLTDDELRAVLTRLGPESERDAFGLVCRRWLRIQSSERRRLRARAGPSMLRRLAARFPGILELDLSQSPSRSFYPGVIDDDLHVIAGGFCNLRVLALQNCKGITDVGMVKLGEGLQCLQTLDVSHCKKLSDKGLKVVASGCQKLRQLHIAGCRLITDNLLHAVSKNCLNLEELGAAGCNSITDAGISALADGCHKVKSLDISKCNKVGDPGICKIAEVSSSSLVSLKLLDCSKVGNKSIYSLAKFCCNLETLIIGGCRDISDESIEALALACCSSLRILRMDWCLKITDASLRSLLCNCRLLAAIDVGCCDQITDAAFQGXGSYLVQSELRVLKINNCVDSNGIINLKDSILSVSPR

SEQ ID NO: 117274 - protein, 191 aa, Triticum aestivum
  Clone ID: PAT_TA_11692.pep
VHRGRHALPVQRSPAASASMSVALVVNSSCVASASAMTVAAPRTSIGRHTARSFTQPPTNAGTPPTWRTTPKLTKLMIPNVGTNPEPILHGDTRRTAFRCHKRRTKVDEGETMIFPDECRGAPMPISWLYFSLRLEHTHEVDTHPLRTTRKNSHIDRTHITVPTETTSSRHLTLGSAHPIARQHTGARLTT

SEQ ID NO: 117275 - protein, 188 aa, Triticum aestivum
  Clone ID: PAT_TA_11693.pep
GKEDQGLFRPKNVSTCHVIRGGAGRFADGRVPRAVGPVTYPAGQAGSTRGEADSRGPRAGGDHQLGRRLQPPARARSRQGRTPTAIAGDVGDLLGRATHWRDQGVEPHALGREAATGEHRDERTISRGGGWFRPPVDSRLQARGGGEGLRGGFLEMGRGSRGEEEEGGGRLRANLGRGRCGHGSHGGN

SEQ ID NO: 117276 - protein, 236 aa, Triticum aestivum
  unsure (1)..(236): unsure at all Xaa locations
  Clone ID: PAT_TA_11694.pep
IARQFAIRXRKSITIIQSFVKAYHVRKASKQEVVDIRSRIQKASAQVDDDMRLINRLIAALSQITGCRSISSIRQTCTTLSIATELSEKCCATLVDAGAVDILLKQIPQLNRGIPDQEVLKQVLYTLRNIARFPNVRPVLANNPQLVNTIFQELLRNKTDMFFIACEILKKLCESEEGRGFAGALGHHIRRLDSMVRGLEKKVELDKRNGHTEARKEDNLRRLGEAAALYHLLTNK

SEQ ID NO: 117277 - protein, 302 aa, Triticum aestivum
  unsure (1)..(302): unsure at all Xaa locations
  Clone ID: PAT_TA_11695.pep
FGTREKTFTCAPSDDDWIFCGEVCDRLKLFADITEIFSGTQYVTANIYFPKICEIKMNIRKWSKCGNEIIESMSDAMSAKFDKYWSDIQGLMGIATLLDPRFKIDMLHVCLEMLLGDESIIDCESKVHEIRELVSSLMLEYQMEREQENTEAQVXSISAMEANEVMSIFSARVARKRPATSLSRTELDRYLDDEYVPANQENFDVLGWWNVAGSRYPTLRXYWRRGIFGHPQSTTGASPAAFSRSGRVLSEHRSRLTPDLLEALMCSPVWVGISPVDDEKTEAASFWSCLDDIQEGLERITL

SEQ ID NO: 117278 - protein, 326 aa, Triticum aestivum
  Clone ID: PAT_TA_11696.pep
GRPPAQVHDRRTNNQRSSQADTADVDSKQFGGAKGNHVSIGTNGIEEAGQPIPRRRQSKGNRKTHTSHKQRFFAGNFANSPNSRSHYGGVSESPPSNSIGYFYGSTPENHSSYKSSKLSSSPHGIPTGSSPIGSVPKSFPPFQHPSHQLLEKNKFQQQRYNKFKNKCVAERKKLGIGLSEEMNSLYRFWSYYLRDNFNEDMYKHFKNFAVDDAAANYRYGLECLFRFYSYGLEKNFQWNVYEDFEQLTLEFYHKGDLYGLEKYWAFHHFRKQDSSPVNKHAELERLLREEFRTIEDFKARRAADKETGGSGSKSAVAASHSKAVAK

SEQ ID NO: 117279 - protein, 125 aa, Triticum aestivum
  Clone ID: PAT_TA_11697.pep
HTNLIPPVHTTLTWLVLPSPSPSRSQTITATPMRLSLLVALQKSPSPEACEEDKTESPPINSRTCSHRDKKRPASPTNNGPLRKIHGKERAARQATAPATRARTKRDEQSCTRESQRQDKIQWLC

SEQ ID NO: 117280 - protein, 47 aa, Triticum aestivum
  Clone ID: PAT_TA_11698.pep
LETNVGDNGFFVYAQSLANQRSNTRRLSTKMNLQAYFLFGALVPVNL

SEQ ID NO: 117281 - protein, 117 aa, Triticum aestivum
  unsure (1)..(117): unsure at all Xaa locations
  Clone ID: PAT_TA_11699.pep
EPKPFTSTGSAHSNPISHDQLVEMAQTNALPSIGGNSSHISFVTGHRLLXTDELHGXFLDAVTXLRGPVRASPLGILRTMGVQGLTIYHVKSHLQKYRLAKYIPDPTASGDKLEPRE

SEQ ID NO: 117282 - protein, 311 aa, Triticum aestivum
  Clone ID: PAT_TA_11700.pep
HASGKKTFAPPKEVHVQVTHSMPPQKMEIFQSLDGWARDNLLLHLKPVEKCWQPQDFLPDPASDGFHDEVKELRERAKEIPDDYLVCLVGDMITEEALPTYQTMLNTLDGVRDETGASPTAWAVWTRAWTAEENRHGDLLNKYLYLTGRVDMRQIEKTIQYLIGSGMDPRTENNPYLGFIYTSFQERATFISHGNTARHAKDFGDLKLAQICGIIASDEKRHETAYTKIVEKLFEIDPDGTVLALADMMRKKIAMPAHLMFDGQDEKLFDHFSMVAQRLGVYTARDYADILEFLVGRWKVPELTGLSGEGH

SEQ ID NO: 117283 - protein, 310 aa, Triticum aestivum
  unsure (1)..(310): unsure at all Xaa locations
  Clone ID: PAT_TA_11701.pep
LNSIEMCWRPQDYLADPASNDFHADGREHISAPEEIPDWFPPCSERSQENCQRPSLVENCVXEIDPVGTVQALPAMLIKQIALPAHLVDDGQDEKLFDQFLHGGAGAESRHREGLSQYLRVPGREARRQSNHRLGLINGSWPEPATVISPGNTASYTKDLGRVTLTQICSTIGSDEKRQEPAYTKNVEKLFEIDPAGTVLALADMMRKKIAMPAHLMFDGQDEKLFDHFSMVAQRLGVYTARDYADILEFLVGRWKVPELTGLSGEGHKAQDYLCTLAGRIRKLDERAQSRAKQAGKMPFSWVYGREVQM

SEQ ID NO: 117284 - protein, 315 aa, Triticum aestivum
  Clone ID: PAT_TA_11702.pep
MTSKTMPQTIPTTPNTEEKKQCSPNDSPLDLTSSSKPSTALPRKLPESAIPSSPNKEVQSNDQKPSHKLHESVDVTSSKVPADDEKDTVENGNTDGTVKSDSTVDKDHGAASASGSARLTGRSETGERGISSRCRPSTGSDVSEESACSSFSSTSKPHKANDSRWEAIQMIRSRDGILGLSHFKLLKKLGCGDIGSVYLSELTGTKSYFAMKVMDKASLTGRKKLLRAQTEKEILQCLDHPFLPTLYTHFETDKFSCLVMEFCPEGDLHTLRQKQRGKYFPEQAVKFYVAEILLAMEYLHMLGIIYRDLNPETFL

SEQ ID NO: 117285 - protein, 93 aa, Triticum aestivum
  unsure (1)..(93): unsure at all Xaa locations
  Clone ID: PAT_TA_11703.pep
KRSKXEEAGXPKTELGKEERKNTAEQHRTDGGRRRRPRYSNSKMINETRCIAHVSDRSNPEVVRARCEVTGTVAPSKNLLLQRRSSVLPQEWL

SEQ ID NO: 117286 - protein, 184 aa, Triticum aestivum
  Clone ID: PAT_TA_11704.pep
MGKRKAKKPAARPRSGAGGSVPRPVSEDDTETEPEPDGEEGDFCFVCKDGGHLRLCDYRNCNKAYHPKCVVRDEDFLNSDEDFICGWHTCCICKGHSYYRCLCCPVKSVCYGCLREADFVQVGRRQTKGLCANCLRLGIMIENNIQTDSDGERVDFSDRSTVEFLFKEYWEIIIKKEGLTLDNL

SEQ ID NO: 117287 - protein, 141 aa, Triticum aestivum
  Clone ID: PAT_TA_11705.pep
TGKGAQKQQNKGKEKVIEPIVPISYYYSGAGSAPRVRQGRKSAAAPPPPQHPPRHDPIFLAVFSFIFVFFLLLQCHGVSSSSTPPARRPTVVAGRRNGGGRTGCPQAHALQLYIGGEVSLAHSHTHSHSILAHSVKQLAFS

SEQ ID NO: 117288 - protein, 79 aa, Triticum aestivum
  Clone ID: PAT_TA_11706.pep
SRIIAVDVSQASYDSLSEAKGYGNCNGTSALQSQCVPTLLLAIARKVIVGRTKKNSSRSVMVFYGACYSLEFASISCKL

SEQ ID NO: 117289 - protein, 203 aa, Triticum aestivum
  unsure (1)..(203): unsure at all Xaa locations
  Clone ID: PAT_TA_11707.pep
MKDPFEAAVEEQESPPDSPAPPEEDPATAVPHTAAEDYDGSAGAGGSRAPPPRPRPSALAAPSTSVAPAAAKAKVRAHKEQDDDDDEEDPMEVDLDKLPSGTSDPDKLAKMNALLSQFTXEDQMNRYESFPEIWDSKKSNMKKLLASITGSQKISMPTTIVVSGIAKMFVGEVIETAKNSYAVKGKILGPSRPCHIQEKHTED

SEQ ID NO: 117290 - protein, 247 aa, Triticum aestivum
  Clone ID: PAT_TA_11708.pep
MGFKMNQMVLGYSLKDRLSGPDCPGRPTRPSRQHYHPMILFILVQMCMYLKKHRLMRTFLVRMSMYSEKTQISADLSSQDEYVPEETRVNTSLPSQDEYVAEEIQVNANLPSQDEYVPEETQVNGSFPCQDQKVAEETHVNVDLPIQDQYVPEEAQANASLSTPSHHVPEETQANSSLSNKPLCSTVEDNSSFEQHQAKAELLRIITDLAKKADALEKNQIKSDQEIISLKEVVKDSGRKVSNWNIA

SEQ ID NO: 117291 - protein, 256 aa, Triticum aestivum
  Clone ID: PAT_TA_11709.pep
RYYSVREVLLGYPYTTAIDMWSFGCIVAELFIGLPLFPGASEYDVLKRMLKILGGQPPDDLLREAKNTAKFFKHVGSGYLGIGAHDGPGTAYRMLSEDEVEGRETKRPKLEKWYFPQQRLDQLIYTYPWDNTKLPETEKADRVLLVDFLRGLLEFDPNKRWSPFQASGHPFITGEPFTGPYEPVSETPRIPVAHAAAVDHNPGGGHWLVAGLSPQVGSANRCLPPNPYPPKVPFSYGSSYGSLGSHGSYAGNAGLA

SEQ ID NO: 117292 - protein, 215 aa, Triticum aestivum
  unsure (1)..(215): unsure at all Xaa locations
  Clone ID: PAT_TA_11710.pep
MLEAQPPPPPRAMMLADLNVDPPESDGEDHPPTPKPNPAIAAAAPVVAVDSSTRSCNDEGSLAKSMTTTKEPDTVECEDVEQHCPGASVSREEKVSNLKAALVNVARKMPKNAHAHFMLGLMYQRLGQPQKAIIAYDKSSEILLQDEQEVRRPDLLSSVRIHHAQCILQASMXGDSFDEELDASELSEILVKLKSSVELDPRQAAVWNILGLVFF

SEQ ID NO: 117293 - protein, 140 aa, Triticum aestivum
  Clone ID: PAT_TA_11711.pep
TTHHENDFEKSQLSLPLPLLPIFRLLQVYLLTMEITNTTRRLLVFSGTARAAHRGQWCIRARMHNRMLAAAMLECSARRGLSLTQLAVTSAPLGCGVHRFYARTNRIKKPDKNKRTKKKGSRSWICSQGDSWNASAPGSL

SEQ ID NO: 117294 - protein, 189 aa, Triticum aestivum
  unsure (1)..(189): unsure at all Xaa locations
  Clone ID: PAT_TA_11712.pep
KELGEFAAEKIMELEPDNTGVHVSXLSGIYASLGQWEDVKAIRKLMRDSRIKKLPGFSWVDANNKTHVFSSEDWSHPQQKKIYQKLEELYERIKEEGYVPDTRSLPSNLEDTAKERILRYHSERIAVAFALISMPATKPIIVKKNLRICVDCHSALKFISKVESRDIIVRDNSRFHHFAEGRCSCEDYW

SEQ ID NO: 117295 - protein, 210 aa, Triticum aestivum
  unsure (1)..(210): unsure at all Xaa locations
  Clone ID: PAT_TA_11713.pep
MNGLFSPTGWRAPPSMSHMRQPLSARVSGRAKAMDQDGAKIKKVLFDSAVHTTAENTPRRDEVKTTKKEVPPSLTPWKEDKSESPLRKALSPIPSNMMTPCNVNCPPSLEPKTPIGVEKNPDGTPLDKFNALGSNLKESLIQQYLEFLNVANKEELQQLKGIGEKRAEYILELREDSPRPFQSLSDLGNIXXSTKQIQDIIQKTATGIFK

SEQ ID NO: 117296 - protein, 241 aa, Triticum aestivum
  unsure (1)..(241): unsure at all Xaa locations
  Clone ID: PAT_TA_11714.pep
MASADMFPNVSFSDVNAAASQEAAGKAVFGLDPASGAARLSLVRPGAEQAFQIDLSDAQIFKLGPMEWLCVSGETEAKAGVEEKLFSRAIKVVLRTEAESKAFSLAFQRWKQQTISGKAGESLENGSIVACKSKFDTKIEASSAQMYFHYYGQLLHQQNMLQDFVRTGTYYAAVMENRADFEGKVVVDVGAGSGILSLFAVQAGAKHVYAXEALKWLYMPNRFIFGNPSFGQRITFIKCIV

SEQ ID NO: 117297 - protein, 131 aa, Triticum aestivum
  Clone ID: PAT_TA_11715.pep
KRKQEEREAERRQDAELVRMQEIGALKREQARRATEQKILEQELQTLKERAKNDRETNKENAISNAKAKAHEAKLTEDYERRMLVELMNGEREKWLAAINTTFQHIEGGLRTLLTDRSKLVMGIGGVTALA

SEQ ID NO: 117298 - protein, 136 aa, Triticum aestivum
  Clone ID: PAT_TA_11716.pep
MMEAARSPPWSDLHPELLGLVLKRLPSLADRVRVRAVCHPWRSNSMLQPLPLPFPWLTLPDGTFLSISSGEIHHISLPEGACCQGSIGNWLFLMHNDDVCYLMNPFSKTRLELPKLAKVCDPEILDPDSIYNPIFY

SEQ ID NO: 117299 - protein, 62 aa, Triticum aestivum
  Clone ID: PAT_TA_11717.pep
FFFWECHTRYIEMVSIRPSTNMPSQRQRFLICSKCSSQLSNFSSIFINMYLSFPVSFAHICS

SEQ ID NO: 117300 - protein, 158 aa, Triticum aestivum
  unsure (1)..(158): unsure at all Xaa locations
  Clone ID: PAT_TA_11718.pep
SAIELRKSEIEDGYTGLLATRRQALLLDVRDKLLFEXEYAGSTRAKVPPRSSLHIPWGWLPAALCVLQEVGEEKLVLDIGQAALRRADSKPYVHDVLLAMALAECSIAKACCEISTLALGLAALPRAQHLLRAFPPLEPLPPLPPGDPPPEVLPPACT

SEQ ID NO: 117301 - protein, 47 aa, Triticum aestivum
  Clone ID: PAT_TA_11719.pep
GILYKNLLRVVDMVAHSSHKETVSMRGMGSIAITLLRFIFSERPSRC

SEQ ID NO: 117302 - protein, 199 aa, Triticum aestivum
  unsure (1)..(199): unsure at all Xaa locations
  Clone ID: PAT_TA_11720.pep
GAYIAASCMDHRIYLYSTLHMDKGPIKTYTGSKIESFFVKRPRTRGGTHILGGSSNGNVYLWQVDQPENGPIVLKGHEGEVTSVDWCSLEVGKIVSSSDDSTVRVWNTKKIDCTNISSPTVIRKRVTAPNIDCPRSASHERATSSRDVAACTSADNELPASSHSPLRPXVLEFGTPESVKKRAFSVFREEALDTRSSPG

SEQ ID NO: 117303 - protein, 276 aa, Triticum aestivum
  Clone ID: PAT_TA_11721.pep
MRPSRDLRLAVLLLLFSASVLLPAARAQQETDEEEEFSYSLDAENGPAHWGEIKEEWSACGKGNMQSPIDLASPRVSLVRGLGYLNHSYAPANATIVNRGHDIMLKFEGDAGSVSIGGTPYFLRQLHWHSPTEHSVNGRRYDMELHMFHESAQGKAAVIGVFYEIGAHDAFLHKLEPYLEMIADRKDREEKMGMMDPRGARGKASVYYRYVGSLTTPPCSEGVIWTIVKRVRTVSRHQLELLREAVHDDMEKNARPRQEVNSRDISMFRPFQQNRH

SEQ ID NO: 117304 - protein, 285 aa, Triticum aestivum
  unsure (1)..(285): unsure at all Xaa locations
  Clone ID: PAT_TA_11722.pep
MGEGAVVVLEAPKPRSPPRYPDMCGRRRLQLEVQILDRELTFLKDELHLLEGAQPVSRSGCLKEVNEFVGTKQDPLIPINKRKHRSCRLYWWIRSKLCICASWLCCSCQCLPTCKRPRCFDCSCCEPNCSCCSLNCCSCFSIPSCCKPSCGCFECCSCSKXKCCSSGCNPCGECKPECGSCSGGGCCGEQCCSCPRCTGCFSCFKVPKCSCAQCFNCQSSCCKGQPSCFRCQSSCCDKGGCCSGGSCLSCPKPSCPECSCGCVWSCKNCTDGCRCARCCAGGCLC

SEQ ID NO: 117305 - protein, 183 aa, Triticum aestivum
  Clone ID: PAT_TA_11723.pep
MAANPRSGTKRLTGGGHGGAAALLLLLCCTASMALTPDGEALLELKLAFNATAGQRLGSWRAADPNPCGWEGVSCSFPDLRVQAINLPYMQLGGIISPSIGRLTKLQRLALHQNSLHGPIPAEIRSCTELRAIYLRANYLQGGIPPGIGDLTHLTILDLSSNLLRGAIPATIGSLTHLRFLNL

SEQ ID NO: 117306 - protein, 58 aa, Triticum aestivum
  Clone ID: PAT_TA_11724.pep
VEWLSPFCGPFYRISYKWHTKGQEIIRYGSSVCVDCRRGQADWQESWGIICYLALVPN

SEQ ID NO: 117307 - protein, 64 aa, Triticum aestivum
  Clone ID: PAT_TA_11725.pep
FRTRASSAIFQPASMSSGKRFPRVVMLLLGASLTRNPLMEFFFYRFIIAVRAACRGLSFGASCR

SEQ ID NO: 117308 - protein, 527 aa, Triticum aestivum
  unsure (1)..(527): unsure at all Xaa locations
  Clone ID: PAT_TA_11726.pep
MQSATRLTLLLCAAWVAALLYGEMGAYWAAHLSCSWPSASSSSPSPSNHVKVAVIADPQLMDSTSLGLPASSVALQAAEFFTDLNMRRSFQSVILPFKPDVVLFLGDYFDGGAHILDEEXRWQDSLFRFKHIFSMSEQRTSPHVPIYYLSGNHDIGYSAFHSVHPEVISRYEKEFGPRNFHFLSGKVDFVVVDAQTLDGGAKQSKERSSSWEFIKTLSSGNESNPKILLTHIPLYRPDNTPCGPHRSSPAINQRIYSAAMDQGIKYQNYLSKQTSDLLLGLLKPTLVLSGHDHDQCTVVHSTPFGPVTEHTLGTISWQQGNLYPSFMLLSAGPRNSTDSSQEVLTNLCFLPKQTHIYIWYIFQFVVTVLLLMFWPTNGLSSLPYVNTFVSFMSSAGADLFPRSKEKDDAEDGEYEMVWDAEGSMHLVKKAVARPPITNSDSKTTGRGNVVPRPTARKHQPEPDSSSVHVEMGSETPPEDGGKAPRPSKWKIRTVLQRLFRVVQSVAIIAVLNVPLYMMLLFKDWVDR

SEQ ID NO: 117309 - protein, 301 aa, Triticum aestivum
  Clone ID: PAT_TA_11727.pep
MSRAHLLSLSSLRESDKGTLRKASPNLPFRLGGGGGRSPDDRRSAAGQEKKGKKEKDEKEEEGGGVSGALTGTLLAGAVLVGVVGGFGAAGYVYKDQINTFLTHFSGFIEGYGTAGYALFILAYAGLEVLAIPAVPLTMSAGLLFGSVTGTIMVSISGTLAAAVAFLIARYFARERILKMVEGNKKFLAIDKAIGENGFKVVTLLRLSPLLPFSLGNYLYGLTSVKFLPYVLGSWLGMLPGTWAYVSAGAFGRAIIQDETEIGLGGNNQLLTLGIGLLVTAVAATYVTRLAKDAVKDIDDE

SEQ ID NO: 117310 - protein, 292 aa, Triticum aestivum
  unsure (1)..(292): unsure at all Xaa locations
  Clone ID: PAT_TA_11728.pep
QTDIDFXRKGEMSGTTATLVIIDGFTVTVASVGDSRCILDTQGGVVSLLTVDHRLEENVEERERVTASGGEVSRLNLCGGQQVGPLRCWPGGLCLSRSIGDTDVGEFIVPIPHVKQVKLSNAGGRLIIASDGIWDAVSSEIAAQACRGLPAELAAKLVVKQALKTTGLKDDTTCVVVDIIPSDHCSTPPPSSPKQNQNKLRFLLFGRRSHSSVGKLGDKKNLLHLGFVEELFEEGLHCWEERWGRNPCQKQIAPIRCAICQVGPNAIRRFNNKIMGEVYWSAPSNTKPNFVV

SEQ ID NO: 117311 - protein, 85 aa, Triticum aestivum
  unsure (1)..(85): unsure at all Xaa locations
  Clone ID: PAT_TA_11729.pep
FLLLVNYSSNPPKNTCNISFLLFYYYHYHALLCCIAPAEATPQKSSSPRHPASACGDPWRTRCAPRSSPPRHPPPPASPRAEXPA

SEQ ID NO: 117312 - protein, 146 aa, Triticum aestivum
  Clone ID: PAT_TA_11730.pep
RKSTAAAAHTCHLAQAGIHRSHLGATPPNSESVLIPAVATALRSTPARGGRRAAPPSQHHKIWAMPSPCSHCHNEHTLLQPSNISAQYHAAAPPCPTPTCATSLSVTHRRHPRFTSQASPRAIKTRNAPSPPSLAPARALPAMARG

SEQ ID NO: 117313 - protein, 175 aa, Triticum aestivum
  Clone ID: PAT_TA_11731.pep
MLPARFLKLSLLRRLGAARAAGVPPPWQTRQFPVRGFQSRGYSAGGSSKYDRPMRQFAEENESNSRPLIYYIVPSAILAFAGLATYVHYNDEKRAVPLGKQAQQNSIPKRCTTNRPAIGGPFKLYDTENNVVTESKLRGNWTLMYFGYTSSPDVGPKEVEKIADVVKLLESKYDI

SEQ ID NO: 117314 - protein, 104 aa, Triticum aestivum
  Clone ID: PAT_TA_11732.pep
TRPAPASPVPLLLPPTTGAIPATPQEPASAAPRSHLAGTSIHPSRPLPLPTAPTRPSRRPPPSSAVPNEPIPPVAALLAPLPDGVMRNLEGKTSEIFPPDLSDI

SEQ ID NO: 117315 - protein, 189 aa, Triticum aestivum
  unsure (1)..(189): unsure at all Xaa locations
  Clone ID: PAT_TA_11733.pep
MAATSSPSTAAAAMWAFAAATCVKLLLVPTYRSTDFDVHRYWLALTHALPARQWYTDASSQWTLDYPPFFAYFSRLLSLPAPFVDASLVAIPVPAAPSSSVYILYLRLXVAFSDLLLLASVLLLARXLAGGKRPFLALLLVLWSPALLIVDHIHFQYXNGFLMGLLVLSLHFLEQGEDLARGRCVCKHC

SEQ ID NO: 117316 - protein, 169 aa, Triticum aestivum
  Clone ID: PAT_TA_11734.pep
MQKKCRRAKNNTRAHQGEPVEEKENFQHDSGSLLEADKKDFQEAKLEANPRVVAAVAEETYAVHDELKQVDTLSPEEYSDEGWQAATLKGRSANVRKKSIRRRSSLTKLVVDRTCPGGRSTTHRSGVQPQAKEHKEEAVNSPSQLSFGNFIRSDKLNGDPIITEEKSSK

SEQ ID NO: 117317 - protein, 249 aa, Triticum aestivum
  Clone ID: PAT_TA_11735.pep
GSAVYITPTGPSPIMVQPSFQSAPHFGVSSIPPVFGVSGPFGIVDPSRANGVNIHAGASATSGPSGGSTTASATTANGESQNAERPQGGNPPATRGLPPRTVVTGLAAIPAFPGRSSVGVILPVQMRSQVAAPNQSTGPQGPQTAVGNGSQPNSAYVVPQASSGSAVSAMIAQISAQVANALAANPQALASLTSAVLNPAAQGPHPPTTNNGAGTVSSVTSGNTQSQNELPGSHHGQTSVNMQSDATGA

SEQ ID NO: 117318 - protein, 116 aa, Triticum aestivum
  Clone ID: PAT_TA_11736.pep
PHEPIAGQQGQSLKPDIMTTLAKLMPNVQSSVPANSQVGNLQQSGQQFGRQAPASYGGMVGAQEQHPIHTAYNPEVTLSLPPPPPLPTQGPLSALPTQQQYQPAHDYAPQNNYSSL

SEQ ID NO: 117319 - protein, 174 aa, Triticum aestivum
  Clone ID: PAT_TA_11737.pep
RHEGGYERYWLRRFVEKLNVLLGMGIVLTVSLITVAALNWLAPLAFIPLLVSVMAGVFVILNDDGSGYLPLFVPRQVKPASMELTKVTFTGFLAVSVQSFGSKSLSSYSHAFILLTAAAVITGIFWRLLTHITPSTIGMHKAVKRTVNVASVGAHVCIAAAVIPFTVMAFHALK

SEQ ID NO: 117320 - protein, 240 aa, Triticum aestivum
  Clone ID: PAT_TA_11738.pep
MDSARPRRVPNKSRRPDWREELRANCMTRVKNERVHLLWKMRNQGQPPANDMKTVESAVRNIISDEVQKLKRNVNGKEDQEVDMIWEYEGPQEAMPAEFESEDMLLEMERVLYEDLREEMIRKEIEALDEEDAYLAQAVFEHMQLKDEGVENAKLWCPVCKQGELRETHNLIHCTLCKIRIDLEEDKVNLDFLRERLANVHMEHLDRGCTLSPKFCLHDMFGLNALYIRCDECSTFEVVV

SEQ ID NO: 117321 - protein, 80 aa, Triticum aestivum
  Clone ID: PAT_TA_11739.pep
CDRIMLHNRQRNVIVILHICRWNCCPNIEDVTCSSRAPLHCLLHILPTVNPFRLNQVLAPSAFLTMQGGFLDQRKQISAY

SEQ ID NO: 117322 - protein, 115 aa, Triticum aestivum
  Clone ID: PAT_TA_11740.pep
ECVTQSVCNSASSDCQASTSAPGRIEIVFSCMLACILVARVVSPIVCWWRCQYSSIFTNPLEMFRHMRQSRFFASSCNKPNRSIRPIHLEKFRHLHNNLHFLMQEIKSKHKTSNP

SEQ ID NO: 117323 - protein, 61 aa, Triticum aestivum
  Clone ID: PAT_TA_11741.pep
KQFIAAQTEPRAHTRLLSNYLLILLCSPQPCLVPSSDEAAQDTQGCCFSVDSSRSRMFAVL

SEQ ID NO: 117324 - protein, 95 aa, Triticum aestivum
  Clone ID: PAT_TA_11742.pep
MKSSTLVAVLLLQTVMVMGILAHSQPADAHDDFPKCCDHCNSWSGAQFCDDVGPKCRDGCVNCRVVQTRPVKTFRCGDGRSAFPYIPCPPPCKKN

SEQ ID NO: 117325 - protein, 110 aa, Triticum aestivum
  Clone ID: PAT_TA_11743.pep
GSAGIRPVPRIHHAPVLRVAQDDSSAYALAIMRNPDPIGMGLAMEAVAEAAGPECLVPGQQAPLRLMGLKVWPLDIEMKFLEPFGRELHSMKKFMDKSCSVMDSSSIAHK

SEQ ID NO: 117326 - protein, 93 aa, Triticum aestivum
  Clone ID: PAT_TA_11744.pep
MKSSTLVAILVLQAVMVMGILSHSLAADDNFPKCCDNCNSWSGAQFCDDVGPKCRDGCVNCHVVQTRPVKTFRCGDGRAALPENPCPPPCKKN

SEQ ID NO: 117327 - protein, 95 aa, Triticum aestivum
  unsure (1)..(95): unsure at all Xaa locations
  Clone ID: PAT_TA_11745.pep
MKSSTLVAILVLQTVMVMGILSQAAAKDNFPKCCDNCNSWSGYQFCDDVGPRCRRGCANCQVVQTSPVKTFRCGDGLXANGRDTPTPCPPPCKKH

SEQ ID NO: 117328 - protein, 235 aa, Triticum aestivum
  Clone ID: PAT_TA_11746.pep
EYYNHACADYARQKLSSPDFKVDGSQLTVSWAEPKGSSSSSSDSSSSAAQVKTIYVKNLPENVSKEKVKDLFEVHGEVTKIVLPPAKAGHKRDFGFVHFAERSSALKAVKGSEKYEIDGQVLEVSMAKPLSDKKPDHSFKPGGAPSYPLPPYGGYMGDPYGAYGGGPGFNQPMIYGRGPAPAGMRMVPMVLPDGRLGYVLQQPGGMPPPPPPRRGDRRDGGGRGGEGSQRRYRPY

SEQ ID NO: 117329 - protein, 143 aa, Triticum aestivum
  Clone ID: PAT_TA_11747.pep
MAMAYKMATEGMNIKEECKRWFTEMKWKKVHRFVVYKIDERTRAVLVDKVGGPGEGYDELVAALPGDDCRYAVFDFDFVSVDNCQKSKIFFIAWSPAASRIRAKILYATSKQGLRRVLEGVHYEVQATERSEMGFDVIRERAQ

SEQ ID NO: 117330 - protein, 139 aa, Triticum aestivum; identical to SEQ ID NO: 109909
  unsure (1)..(139): unsure at all Xaa locations
  Clone ID: PAT_TA_11748.pep

SEQ ID NO: 117331 - protein, 95 aa, Triticum aestivum
  Clone ID: PAT_TA_11749.pep
MKSSTLVAILVLQAVMVMGILAHSQAADTDDDFPKCCDHCNSWSGAQFCDDVGPKCRDGCVNCRVVQTRPVKTFRCGDGRSAYPYIPCPPPCKKN

SEQ ID NO: 117332 - protein, 88 aa, Triticum aestivum
  Clone ID: PAT_TA_11750.pep
MKSSTLVVILVLQAVLVMGILSQANAEFPKCCDNCRFFSGAVVCDDAGPKCRDGCVNCRVVQTSPKKTFRCADARVDDGTPCKPCKKH

SEQ ID NO: 117333 - protein, 88 aa, Triticum aestivum
  Clone ID: PAT_TA_11751.pep
MKSSTLLVILILQAVLVMGILSQANAEFPKCCDNCRFFSGAVVCDDAGPKCRDGCVNCRVVQTSPKKTFRCADARADDGTPCKPCKKH

SEQ ID NO: 117334 - protein, 88 aa, Triticum aestivum
  Clone ID: PAT_TA_11752.pep
MKSSTLVAILILQAVLVMGILSQANAEFPKCCDNCRFFSGAVVCDDAGPKCRDGCVNCRVVETSPKMTFRCADARGDDGTPCPPCKKY

SEQ ID NO: 117335 - protein, 88 aa, Triticum aestivum
  Clone ID: PAT_TA_11753.pep
MKSSTLVAILILQAVLVMGILSQANAEFPKCCDNCRFFSGAVVCDDAGPKCRDGCANCRVVETSPKKTFRCADARGDDGTPCPPCKKY

SEQ ID NO: 117336 - protein, 88 aa, Triticum aestivum
  Clone ID: PAT_TA_11754.pep
MKSSTLVAILILQAVLVMGILSQANAEFPKCCDNCRFFSGAVVCDDAGPKCRDGCVNCRVVQTSPTKTFRCADARGDDGTPCPPCKKY

SEQ ID NO: 117337 - protein, 143 aa, Triticum aestivum
  Clone ID: PAT_TA_11755.pep
MAMAYKMATEGMNIKEECKRWFTEMKWKKVHRFVVYKIDERTRAVLVDKVGGPGEGYEELVAALPGDDCRYAVFDFDFVSVDNCQKSKIFFIAWSPAASRIRAKILYATSKQGLRRVLEGVHYEVQATERSEMGFDVIRERAQ

SEQ ID NO: 117338 - protein, 88 aa, Triticum aestivum
  Clone ID: PAT_TA_11756.pep
MKSSTLVVILVLQAVLVMGILSQANAEFPKCCDSCRFFSGAVVCDDAGPKCRDGCVNCRVVQTSPKKTFRCADARVDDGTPCKPCKKY

SEQ ID NO: 117339 - protein, 169 aa, Triticum aestivum
  Clone ID: PAT_TA_11757.pep
MSDRQPSEEPEEQVDLEGDDDVMDDEEGYRRRRHGGEDSDEPEEEPEEPQIEVEGDGDGDGREEDAGMAVASDEPAAGSGDEMEKGDGPEDEEEKMKWEELLALPPQGSEVLVGGVPGKQAPLRLMGLKVWPLDIEMKFLEPFGRELHSMKKFMDKSCSVMDSSSITHK

SEQ ID NO: 117340 - protein, 195 aa, Triticum aestivum
  Clone ID: PAT_TA_11758.pep
HTDTNSTDTQQNILERDSGVPVLETESGKRSAVAVGTRERFRAELQQVRSGRGRWRRRAAAKGSKKKQQAAEGRKSSSREAQGRAAAEMRGKSSSVVRSSEVKEKKEEEVAAAGSGKKKGSGDAGRRLGEEERLSSSRDMDGRRREVMRRRCGWWWMEAQGDGGGVGGALGCGGAGDGWRGGAPPRRPGHGGGRR

SEQ ID NO: 117341 - protein, 276 aa, Triticum aestivum
  unsure (1)..(276): unsure at all Xaa locations
  Clone ID: PAT_TA_11759.pep
MAKKAGAERDAAAESCAQKKARIEYEAKAAASKITVNLDHKLLECSACCSPLAPPLFQCTNGHIACSECRTNAEYSCSFCAEPANTXLRXMERVLGGMTAPCSFREFGCSATIPFTKKLTQEESCLHAPCHCPIPYCRLYANRGQCLREHIETKHCLVPYGDATAGSLSPVRVCDSEPARLVFLDARAVFLLVVERSGPSGRAVSVVQLVSEPVKEEEEKDFKYKIQVHTRAGVLSLSGETQSVGRLMRPYQAAASLFVSDDVWSPQDSPVYLEFK

SEQ ID NO: 117342 - protein, 98 aa, Triticum aestivum
  unsure (1)..(98): unsure at all Xaa locations
  Clone ID: PAT_TA_11760.pep
QXIRHEAHYHVLWDEXNNFTADEMQTLTNNLCYTYARCTRSVSVAVPPVYYAHLAAFRARFYMDQDSLSVKNANRTNGSAMKTMPAVKERVKRVMFYC

SEQ ID NO: 117343 - protein, 213 aa, Triticum aestivum
  Clone ID: PAT_TA_11761.pep
STPPKAADKGEPLPEAEPAKEDDMDEDSSMPSSGAADDTLSKGKKSKRATRSSGKTKKNDTSKDADKTESVTEPAKEVAENEDSSMPSAEATDDTVSKGRKSKKSKGSAKTKKKDADKNESLPEPAKEVAEDEDSSMPSAEAIDGALSKETNSKSSTRSAKKKKKDAGKKESLPDPAKEGAENEDSSMPSGGAYRWCVEQGNKFQSVRGRQKK

SEQ ID NO: 117344 - protein, 70 aa, Triticum aestivum
  unsure (1)..(70): unsure at all Xaa locations
  Clone ID: PAT_TA_11762.pep
PSARGSPRRATVAAHKVFDGIPIKDGITWATIDFDGGFHDEAVSLLTCMCHEXQGLIGAMLVHAIVAVFG

SEQ ID NO: 117345 - protein, 495 aa, Triticum aestivum
  unsure (1)..(495): unsure at all Xaa locations
  Clone ID: PAT_TA_11763.pep
MAAAGERRLLVGLLLLALMVSAHCLDGAGATTARXVKRRRKKREIHSPVKTVVVVVMENRSFDHVLGWPPRPPAPTSTGLTGTESNRLNASDPSSPEIFVTDKARPRRRGTTGSGFEDIREXQIFGSAXTSAVPPPTPAAPRSNRERARGLAPRLATSSPSRRPLASPPTHAAPTSSSAGSASWSPYAPTTAPHGLLIHSAASPRRPALNRQNLIIHCLQKTTFVGPXEDGRSSAFFYQPNPPDALFHERARSPLPPPXYQYNIRLHIDAATGNLLNNYVVMQRYFVCSKFLPDDDHPPPDDAAGQRVVKEVCGTLRAGRPRNETALILSYAKLSGFYDHVPTPVVKVPQPDGSIGPDPYYFKFDRLGVRVPSFLISPWVEKGTVIHEPNGPEGTSQYEHSSIPATVKKLFNLRANYLTKRDSWAGTFESYLKVRKTPRTDCPEKLPEVTKSLRPFGXSEDKSLSEFQVXLIQLASQLXGEHVPNQPIQGYWLRR

SEQ ID NO: 117346 - protein, 219 aa, Triticum aestivum
  Clone ID: PAT_TA_11764.pep
CRSVLPSCRPNRNSQILLARILQPLPSINHPSDQPMAPDEAVAGVECVCPAKRKAEAFAGEECSRAAKRLDCSEGDKDAPAGTVQRKKMWRLPLEEIKWILAQPNEPVWAEIRELKRANPSLLPSPEEEKDEAMVLLYACARDCYEDEEKFARFQAWVRSEYASMGFVEVDYDYFGERAEATRLSKEAREEVFRDTDLSSDSEDDDELKHLKRTVRSWV

SEQ ID NO: 117347 - protein, 184 aa, Triticum aestivum
  Clone ID: PAT_TA_11765.pep
GISNDFIDEGRKAGNVLVHCFAGVSRSATIITAYLMRTEQKSLEEALESLKEINESVCPNDGFLDQLKLFEEMGFKVDTSSSLYRRFRLKLLGQSYKVGEKIGNHVFEDDPGVARQPNPTQELSGKEKALKTAYRCKKCRRIAAAQDNVIGHTPGEGNAAGAPLPSRFPRAHFMEPPSSSPPMG

SEQ ID NO: 117348 - protein, 292 aa, Triticum aestivum
  unsure (1)..(292): unsure at all Xaa locations
  Clone ID: PAT_TA_11766.pep
EALLFSQQQQQQQRLSLVQPPHHNYLNMQPHLYHHHSPEIIGRFDHIPSVPSPRDKRSRSGRGKHSMRFSQQQSDTAGQNVDTGGTKFRSKYMSSEEIDTILRMQHSGSHSSDPYVDDYYHQACIAKRSVNSQQKVNFSPASIKDSHSKSRSGGDQHSYLKVDSLGRVSFSSIRRPRPLLEVDIPASGDGHKSSTRPLEKEPMLAARITVEDGICLLLDVNDIDRVLQSSQAQDSSFQLRRRRQVLLEGLATSLELVDPFGPNKPGNSSGLAPTDDLIFLRIVSLPKAEXLG

SEQ ID NO: 117349 - protein, 99 aa, Triticum aestivum
  Clone ID: PAT_TA_11767.pep
IHMLISFSLLFVTQNKVLEQFKCVTSSPTMSLQVNELYQPCKILARRRSQCKAKTATERSVESPMEASTMPELQASLAASAPHWPPSRRPTRRRPMREL

SEQ ID NO: 117350 - protein, 369 aa, Triticum aestivum
  Clone ID: PAT_TA_11768.pep
DTVLEAAKFRGIELNIVAYNSGIGSYLSFGDYEKALEFYAAMMASNVNPDAVTYNILISGLCKLGKYAESLKFFEDMVDLQIPLTKEVYSSLICSYVKQDKLAEAESTFSYMKTSGCFPDVLTYTAMIQAYIDHGSWTSVWDLFKEMEGNAILPDAIICSSLMEALNKGNQHERVLQLMKFMHDRSIQLNQKAYFEIIASCSMLRDWRTASEIIEHLDSSLPSISVGKLNHLLNFLGKCGKTESMMKLFYKMVSSCSTVGPSSRPGLRSCPLARGKWRKYVEVLQWMEDAGVRPTLYMYQNVLPYIWRDNSMDCVTLMQEKISAVRVCIACASGVFLRVFGGQQCVRVSWGCSLCGVCALKLWSHGYFP

SEQ ID NO: 117351 - protein, 126 aa, Triticum aestivum
  Clone ID: PAT_TA_11769.pep
GPPETRTPHPYHSPLLPPPPPPQWQGKARQATPSRACAPSPAPADALLPTLPSAQRPEQRDLGTGRVIWAVIRWTGGCAARRSPESPCLAVWRRVSSAVPLVDGPPPSWMAGTMDDHLLPSFLPSW

SEQ ID NO: 117352 - protein, 122 aa, Triticum aestivum
  unsure (1)..(122): unsure at all Xaa locations
  Clone ID: PAT_TA_11770.pep
KXXIKGLXFXGVXFLYRDYPRGAFPGETMADFILDPDNADVLKAKILVMESTFLDDSVSIEHAREYGHIHLFEIANHSEKFENRAILLIHFSARYTTEEIDAGISRLPPSFRSRVYALKEGI

SEQ ID NO: 117353 - protein, 156 aa, Triticum aestivum
  unsure (1)..(156): unsure at all Xaa locations
  Clone ID: PAT_TA_11771.pep
ERQSQSHRLVVGYLGCSTKPQCSETTTDRPRGYEMHADEPRGDAVVDDGVAGELQDEGGEGEERRGEGEVDADDEHRAHLPVPPSGAQVVGHLADPDEYPGGRGGGAHEGWCAPGPRAPGDPSSSVFRSRGDRSCPPSGTRNMTPSTQRATRRHXP

SEQ ID NO: 117354 - protein, 51 aa, Triticum aestivum
  Clone ID: PAT_TA_11772.pep
SARGRKQASAVAYIKCSLETHQNAMVVFGTAFKGVLQPPRRRELMAARETR

SEQ ID NO: 117355 - protein, 140 aa, Triticum aestivum
  Clone ID: PAT_TA_11773.pep
MPAAGGSPRTTTTGHGSFPPPCPPTKVRSGGGQRIKGGRGGAGETRGCPRRERRWLLLASGPQCTWDLSPASPRKRVESRRRTSTCARVMARRRGDGRSHSRANATQLPTGHRYPSSPGGEINRAEQSSHPPLLLVYSAP

SEQ ID NO: 117356 - protein, 175 aa, Triticum aestivum
  unsure (1)..(175): unsure at all Xaa locations
  Clone ID: PAT_TA_11774.pep
MSLTCGEKGTKDLVKRLRGNNVKLNKVYNIVGSFFGSSQRLRMCLSQSGLLRNLCGRISRDQADHADVNKTLAVFKEIQRNDPEFTYXYKXDEESRIKNLMWTNGNNKLQHKFFXDVITFDTMYRTNLYDTSFGLFVGVNNHFQSVILASVLMCYEQVESFQWVFSELLKCELPM

SEQ ID NO: 117357 - protein, 72 aa, Triticum aestivum
  Clone ID: PAT_TA_11775.pep
VIQTELPLELRVLLAWSYPHRPANNGVYTSPRQWVVSNKITQLWQSRRLEPLVQRGVQQRHGMTLWHSRPAS

SEQ ID NO: 117358 - protein, 120 aa, Triticum aestivum
  Clone ID: PAT_TA_11776.pep
ILQLTPRGRERGGRRGGVSPVVRALELPIEDNIVKMELTADTASTDAITPITADGDAASTPPPLLFPMQLQLRQCCRLPSGVPRLRSRARHPGRRWYRPPTSIWIRLWLMYRLIPTQNIH

SEQ ID NO: 117359 - protein, 221 aa, Triticum aestivum
  Clone ID: PAT_TA_11777.pep
TAEGRHGAVVSDGGDGGVVARRVWDGKGMSGYGAARWASSAEFATGGAGCGVQWWDRRKGDAVVAQCKGVWGHGVATGMVHSIDIHPSRKHVCVVGGSSGTIFAWDLRWAQQPIPLSGVGLDETAQPLCESEVWEVLFDNYTQSSDIISSVSTRILPVMLCSEDGILAIVEQDEWPLALLAEPCAINSFDIDPQNPSDVVCALEWESIGVLTRGRDAMAEE

SEQ ID NO: 117360 - protein, 124 aa, Triticum aestivum
  unsure (1)..(124): unsure at all Xaa locations
  Clone ID: PAT_TA_11778.pep
QPVDITQANSATELTRCLASLRLAFIVVXLSNWGSGRWVGTITTSIXICTRPLLFLIITNVTIVMSLLMENRDPNARGRQAGISLGXSDGLMADAXSSGMLLQKASEAMLMDFGICAFIMIYVL

SEQ ID NO: 117361 - protein, 126 aa, Triticum aestivum
  Clone ID: PAT_TA_11779.pep
RHQFISGLPDGYNTVVGERGIQLSGGQKQRVAIARAVVKDPKVLLLDEATSALDAESERVVQEALDQVMVGRTTVVVAHRLSTVRGADIISVVKNGTIVEKGRHEELLRIKDGAYASLVELSSTSR

SEQ ID NO: 117362 - protein, 213 aa, Triticum aestivum
  Clone ID: PAT_TA_11780.pep
MGCVSSKQFRRAPPHEDAALLAKETTFSLNEVEALYELFKKISYSIFKDGLIHKEEFQLALFRNSNRKNLFADRIFDLFDLKRNGVIEFEEFVRSLHIFHPDTPMADKIAFAFRLYDLRGTGSIEREELKEMVLAILNESDLLLSDDAVEQIVDQTFKQADLNSDGRIDPDEWKEFASKNPALLKNMTLPYLKDITMSFPSFVVYSGAGDEEL

SEQ ID NO: 117363 - protein, 76 aa, Triticum aestivum
  Clone ID: PAT_TA_11781.pep
MDADASGNIHVAQRKTRRSGMWHYRDPFGDEQGPFSLELLDGWNKQGYFDDDFRVWRAGQSSDSAILLKDALRLKR

SEQ ID NO: 117364 - protein, 301 aa, Triticum aestivum
  unsure (1)..(301): unsure at all Xaa locations
  Clone ID: PAT_TA_11782.pep
GTSAKLTFPISLKQPGPKDGTLKCFIRRNRTTQTYYLYIGLTEALADDGKFLLAARKCRKPTYTDYLIYLDMGDMSKGSSTYIGKLRSNFLGTKFTVYDAHPPYDGAIVSKSRSARVIGLNQVSPRVPAGNYPVSHISYELNVLGSRGPRRMNCVMSSIPASAVEEGGKAPTQTEFPLGNLDSFPSIPFFRSKSARIDSAPAQAQDEEKLVLKNKSPRWHEQLQCWCLNFRGRVTVASVKNFQLVASDENGAAGQEHDMVILQFGKXLGKDLFNMDXRYPISAFQSFAICPSSFGTKIACE

SEQ ID NO: 117365 - protein, 114 aa, Triticum aestivum
  Clone ID: PAT_TA_11783.pep
RPENSSSTGASIALHTVQPELPVFVPSELPVFVPSEASHLNGVAAAELRRPSSSGSPSERRLSCVAPSPTHPLLEDGKALEASRSTQIDIAISQPEEAWHPSQGGNKLERAVSC

SEQ ID NO: 117366 - protein, 99 aa, Triticum aestivum
  Clone ID: PAT_TA_11784.pep
TGPECPRPPTRPPARPDRVMLTTDTDLAGAVLHAKSSGLKVLKLHIVDESNPNTEVVKPLQELAPRSRNGVSSVKIGLMAGAVALSGAAVMVYLKRSRV

SEQ ID NO: 117367 - protein, 160 aa, Triticum aestivum
  Clone ID: PAT_TA_11785.pep
HASAAIVSCCSITCAGMYSPMPLGTKRSALTKFKEDPTCMALLMDGTAALGLDLSFVNHVFLMEPIWDRSMEEQVISRAHRMGATRPINVETLAMRGTIEEQMLQLLQDSSACRNMVNKGAGGTENEGARPHRSLHDFAESSYLAKLTFVKGSNTACMDA

SEQ ID NO: 117368 - protein, 274 aa, Triticum aestivum
  unsure (1)..(274): unsure at all Xaa locations
  Clone ID: PAT_TA_11786.pep
KMVNGGVVNTWACINFAWEVTDAHALNFCDELVLMCNVSGMDFRPEPVLPVAAYDPKSVARSLXXHHKRVMNILGPRRQKLDLLILILPDNNGTLYGDIKRILETDIGVVSQCCLAKHVFMPKKQYFANVALKINVKAGGRNTVLVSALERKLPRIGKIPTIIFGADVSHPHPGEGCSSPSIAAVVASQDWPEITKYAGLVSPQTHREEVINNLFNEETGGMIKEHLISFRRATGCIPGRIIFYRDGVSNGQLNQVLDVELPAIKKACASLDPC

SEQ ID NO: 117369 - protein, 127 aa, Triticum aestivum
  Clone ID: PAT_TA_11787.pep
VEFLSMKLSAVSPELNCDLDLQDILCPQDARSTFPGYGQRLGNVHPNNNMYRASQPGLSRPELYGNGIIIPNHPASVHMARTAQQLSAFPHRSIVWDEELGNVGPSAFPSDVVGASSLENSESMKVE

SEQ ID NO: 117370 - protein, 231 aa, Triticum aestivum
  Clone ID: PAT_TA_11788.pep
LQHLRPGMVLLKSFLKPDDQVEIIKLCRELGVGTGGFYQPAYRDGGKLSLRMMCLGKNWDPDSRSYGDIRPYDGAQPPQMPQELTKFVEEAIKASHDFLKQRGKGATDPAVELPLMSPDICIVNFYTTGGKLGLHQDKDEDKSSLDKGLPVVSFSLGDTAEFLYGDDRDVDKASKIKLESGDVLIFGGQSRRIFHGVSSIAPKSAPLWVTDKANLRPGRLNLTFRQHKYEP

SEQ ID NO: 117371 - protein, 322 aa, Triticum aestivum
  Clone ID: PAT_TA_11789.pep
GEVVMASSLAAPSSAPAPACCSLQLHLLRRPALVLFPSYSRARPHLRLRAQPSPEPEAGDSFAGWSDKQEDNKDAAADSDSDSGGGALGGLVGPALAGLLFLAGITFAAISIRGSKAPLPTHTETTADTTPDQQQQDDNDAAAAQALSPADDTLDATSDATPLPNNLQTDDKIPEEAAQHDDMDNHQLDLDRGSSHLDPTTDKYIASQDDTPVTDSPQSLVPAYDPTSEDALLLLDSEPTLPENQDTTFTSDIMVLESGDVVQISDAVAEVKHLQDTERNPQLSSTQDGISSASTFPDYVAYGSTDRMLPSGSNDLPTQDAD

SEQ ID NO: 117372 - protein, 53 aa, Triticum aestivum
  Clone ID: PAT_TA_11790.pep
NTEKKFYATYMWSTVSDKFYRPYNLKVPSIQSYRTNYLSNDNVIVTTSNHKQH

SEQ ID NO: 117373 - protein, 153 aa, Triticum aestivum
  Clone ID: PAT_TA_11791.pep
VLEPVSAITGVRQDQGGSHARASTGSYLHPLPHEGNSQQAHVDPGWLLCPECRCRPPCSMASVPSYGCVCANHLMHQKARFTNSSSICFSVHRLPIVWHQNSHQFRGARITVSLCYRNLSLIRHRTSPSSHFGKLSLLAPVPGSHVSADGSPL

SEQ ID NO: 117374 - protein, 287 aa, Triticum aestivum
  Clone ID: PAT_TA_11792.pep
RHEAKARNQGSGANSGISSQFAFRTSVRNKDSLLAELATDSRYVYQENDDLMGSPLVLSKVMYVANVGGDMSVAAVPVGARCDDFSTDPSIQEGQWVPSSHSSLRPPLLLKRHRRAAGLILRSQNFAASLAELISTAAKSNGEASSSVFTGFGQISCKMCDDIKLTMSTAWHGPSAIPRKSKPTAGGCVDFELKFDEDSRFGAWVEVKRSNPRQLKWAVTLSDTPENDLGWGVSLQRGSEGAPERMQLEGFLNLHLGQNATLQPGVMFNLDGRRCAPALVFRSSWFL

SEQ ID NO: 117375 - protein, 124 aa, Triticum aestivum
  Clone ID: PAT_TA_11793.pep
PAAVQVQPHAAVVFFAQPAAAAPHARVQGREGEPPPASGAREVRQRPDPRRHRRAVVDLSRHGLTLLCSFPSTAPSSGNNKPSQESGFSSHPISRGKVASVEVPSNSVTTPNLLQWSSICCYGR

SEQ ID NO: 117376 - protein, 91 aa, Triticum aestivum
  Clone ID: PAT_TA_11794.pep
ELTRFHGHSTHHCLHCFLLYSAKPPRCQLPEEEEEDSRALLRSGCSLCSLTSWRSGRWRRRPSGRSISSDRRLNNDDPPGFNKSSSRSSLS

SEQ ID NO: 117377 - protein, 139 aa, Triticum aestivum
  Clone ID: PAT_TA_11795.pep
RRGGQRRSPAPRMKRSPPHLVPVLFPTQRTAGGGGYAVSLLPVHRRQILSGLCPLTQICSLLSVDTCSEGVICIIVMYCVGHKDCGCGSASALRACFHQNVGAAGSANMVRVSPKTSGWDWHSTNCSIPYLLCNNGMMS

SEQ ID NO: 117378 - protein, 89 aa, Triticum aestivum
  Clone ID: PAT_TA_11796.pep
GKDADPVPSRVLKQTRIDVIFKKETETRSKLSKAWAKWFRSNGVPAFKADCPHFRSALKLTQQLGTRLVAPTGNEIDGANLDASDEELP

SEQ ID NO: 117379 - protein, 274 aa, Triticum aestivum
  Clone ID: PAT_TA_11797.pep
KRCFFFGDVAAHKNPKLLLSYIFGLYDYFLKELYHFNEADNPHKSAIPIVINTSGWVKGIGLHVLSEILRYVSPTDVIRLNTTAEGKNLPGGAFWLDAHEGNSQVNLVEIRAVQNSPRHLLVKKEARIIRDLRLIAYFRQCLPRDFPIFSSEDLVQGIAAIDPFQLPLSKIQVIDLHSQISGDSVYDFLAGTIVGIGSSSSVPLSTECSSPWCMGLGFIKAIDIPGDCIHLITPVSHQLLENVDIIFPSCIAVPDGLFQVPDTVDDITARLRDL

SEQ ID NO: 117380 - protein, 160 aa, Triticum aestivum
  Clone ID: PAT_TA_11798.pep
SIVRNSKKSDHCRALRVGNTGCYCSGFPLIVSSGGVTLPGKTALSRCARPTLNLLVHIDASGVHLPGRFHGLGCRLHRNSGAQQRRRGVQPQPRMRSGLRSCPTARRPSSPTDLAAPRPRPPPCQLDPAETRVRCRAGEAGQNHPPYCSPPPFFDLPSCR

SEQ ID NO: 117381 - protein, 145 aa, Triticum aestivum
  Clone ID: PAT_TA_11799.pep
RCWGSGANRPRRGSTFLMAAHGTQARHAPVGLLDCHNVGNGPASVNCCNLDRSKCAVRCTGMPASAWLAGGHAQEGPEVCATTLNLHQGFRRRCSSGEGDGCAGCRQVQTGTFLDSQFLSSQPTIMQSLGRGLMYLPFPSSPVSV

SEQ ID NO: 117382 - protein, 99 aa, Triticum aestivum
  Clone ID: PAT_TA_11800.pep
AGEPACWLNLGPPPPPRPPNPLPSPNTIWPALSLPLPKLPANGPAPAPKPAVPPPRRPPFPCPAPKVHTIPACGRNPHKRPRLGGDSRGIGERAREERR

SEQ ID NO: 117383 - protein, 291 aa, Triticum aestivum
  Clone ID: PAT_TA_11801.pep
MVMAAAEGRRGDAEAELNLPPGFQFHPTDEELVADYLCARAAGRAPPVPIIAELDLYRFDPWELPERALFGAREWYFFTPRDRKYPNGSRPSRAAGGGYWKATGADRPVARAGRTLGIKKALVFYHGRPAAGVKTDWIMHEYRLAGAAAKRDGASLRLDDWVLCRLYNKKNQWEKMQRQRQEEEEAAAKAAASQSTSWGETRTPESDVDNGPFPELDSLPEFQGMGTTNAAILPKEEVRELGNDDWLMGISLDDLQGPGSLMLPWDDSYAASFLSPVAAMKMEQDVSPFFF

SEQ ID NO: 117384 - protein, 271 aa, Triticum aestivum
  unsure (1)..(271): unsure at all Xaa locations
  Clone ID: PAT_TA_11802.pep
MVMAAAERRDAEAELNLPPGFRFHPTDEELVADYLCARAAGRAPPVPIIAELDLYRFDPWELPERALFGAREWYFFTPRDRKYPNGSRPNRAAGGGYWKGTGADRPVARAGRTVGIKKALVFYHGRPSAGVKTDWIMHEYRLAGADGRAAKNGGTLRLDEWVLCRLXNEKAAKAEAAASAAWGEAGAPGCDVAVDTFLELDSLPAFQTTNAILKAGLAAGVADGNRVMGISLDDLQGPGSLMLPWEDSYAASFLSPVATMKMEQDVSPFFF

SEQ ID NO: 117385 - protein, 158 aa, Triticum aestivum
  unsure (1)..(158): unsure at all Xaa locations
  Clone ID: PAT_TA_11803.pep
GSADLANSMHTVKILALRCCGXNCRGVLSILRRFPCLEKLYIIFHKHYETDAKIEPQYDRLYPVECLQARPPVSGCATSLEFAKFFVLNAKALKEIEFEGIYGAKNDVSLAYQHTLLRVENRASRDAQFEFRSRYRNTAIHLLRHIHDLSVADPFLLL

SEQ ID NO: 117386 - protein, 249 aa, Triticum aestivum
  Clone ID: PAT_TA_11804.pep
ARRHPGRPPAFAACREEARGEEELPCASHVGEVFVDIDKRGLEAEEPRIASGCDKEMALSTANSIFSTLNRYSKLTGLVVCERRCDSVGIPALSSSLNLSLGRIKQSFVLTDRHLPDMPIVYASDAFLSLTGYSREEILGCNCRFLNGPGTSAEVLEEINRHICREEACTVHLLNYRKDGSTFRDLLHVSPIRNSSGKVAFHVWVHLDESAKHDFSGLTPEVWQLGAVGAVRVAVRSLSASGSLLRPSQ

SEQ ID NO: 117387 - protein, 83 aa, Triticum aestivum
  Clone ID: PAT_TA_11805.pep
QPHKHQQAGSAGTSTRSLPAIYNQLAHVQLINCHQRTLCSRSSHRVQLESYPLALALALAVRLMLLAAPLILRIVWTRMEGIV

SEQ ID NO: 117388 - protein, 297 aa, Triticum aestivum
  unsure (1)..(297): unsure at all Xaa locations
  Clone ID: PAT_TA_11806.pep
TVRALKRKPDEPAARALLDRIAKHVQPIMRRRKWRVEVLSEFSPKNPRLLGLNXRPGSEVKLRLRRDGRXXDFIPYEEVLDTMLHELAHNARGPHDAQFYKLWDELRKECEELVAKGITGPGQGFDGTGRRLGGFSIHPPPPSLRQAALTAAQKRARNGALLPSGPRKLGGNNAIMSALSPVQAAAMAAERRMQDDLWCGSHNDSGIDDSEDVVILEQPPKLTTRDGKNTKRAKNTRCDSSSSSAEPSTSSGSQVPARADSSSGRTTDADFSSMWECSACTLLNQPLAPAGGGCGTA

SEQ ID NO: 117389 - protein, 114 aa, Triticum aestivum
  Clone ID: PAT_TA_11807.pep
FGLKEENKYQRTNFLLDCIVESLDSKFCDFGKCGYKALLRMPLTLSKDVLKREISEEIGSWSEISSDRAAEKELDQVAAARCDGCRTEAFDISIAIEDDILEDLVGEFAFDQCC

SEQ ID NO: 117390 - protein, 226 aa, Triticum aestivum
  Clone ID: PAT_TA_11808.pep
MRSMKMAVPKNGSKTSRGEDEGYSYKRHVEINDTPAKERHSNPDRDRDRETDKHSRRKDDSEDKDKWPIDNRDSDDRKTLSRYDHGKVRSSKEQRFDDEKYKQKYKDDYERDKRQQDDKCLDERMIRDHGSDRVDYKSTKDGHRISEGHYRKDIVQDGDRYDEYGSRYKENRGRKRLPEENDDHYDLKTPSAREQRGNLEKSSGSGRLDSLIERARSEHRHQENVD

SEQ ID NO: 117391 - protein, 167 aa, Triticum aestivum
  Clone ID: PAT_TA_11809.pep
MNPEPMTPPLKKKPTPVVIHRTDPEPARTSPEKKASPVIRRHFPKQEPVDDTPPEEEEYEEIQGRPSALSTSNRRMQNIVDLVMWRDVSKSAFVFGFGTFSLISCSYAKDLNFNTITAASYLGLVYLGLRFLSKSLLNRGESVECDDETNNERSHYLVGEEDAVWLL

SEQ ID NO: 117392 - protein, 83 aa, Triticum aestivum
  Clone ID: PAT_TA_11810.pep
MYGLDVTARSLTRTGATWMSTGVFVIALLDGLWTNRRGGTKWMDSGSTAAHTLPRVGRPITAHRWPALGSVGLPLCFPSCWLT

SEQ ID NO: 117393 - protein, 182 aa, Triticum aestivum
  unsure (1)..(182): unsure at all Xaa locations
  Clone ID: PAT_TA_11811.pep
MASHHRGRIPSHLAPAAALLFAFIIALPASGDPLGQLCGNSGNFTANSTYQANIRRLSATLPKNASSSPTLFATDTFGTLPDIVYALALCRGDTSAANCSQCVATAFQDAQQRCPYNXKDATIFYDPCALRFSNQNFLSSTNGDGTLLLLMNTQNVSAPVKVFNAAVGVLLNATANYAAANS

SEQ ID NO: 117394 - protein, 183 aa, Triticum aestivum
  Clone ID: PAT_TA_11812.pep
EVSPLLLLPSFLDLDRTPYNWYQRSAVDLETAYPRPRYTTKQALKTAAMEEQLAALLQSVQEGRAANDAKLEAIQQSLELWRPVVLNLQGQLDELRTQVGRIAIHPALADPAPPTVVQQVPPPPSAVESGHHGPSGHGGIDNSGGLVHGVVTTLAPPPVKELSMRVKSINMGEDLSSYRSISR

SEQ ID NO: 117395 - protein, 335 aa, Triticum aestivum
  Clone ID: PAT_TA_11813.pep
PSLFALPGEHCSKVSSIEGPSKHAPESAHVKAGNSAPSLCLPGESGSKENVAHFPDMAGVSCIRPAFTLSYQQSVPTDLLPAKPKSQVTPLTPKDLMPVQFSSDLPDPTSIRFEGIASITSPNFGDHANRVSNTPGPKDMSKFPVFNEQSRSQHDVLFRNIDGYLQHRRNHHLAVDIPAFSDSTVSGSVGISHPDQFTITKYQNGRSGSSGLSSTSAGFLMNGSSKELREGQLKPCSHKASTESCDQVKRPGDVKLFGKILSHQSSLQSSGSSSNVTRSKPPPPTTAAGLLGSGMDRMVYSSRPTNTAHFGQDERVVRSYTHLDGSTALPESSLF

SEQ ID NO: 117396 - protein, 179 aa, Triticum aestivum
  Clone ID: PAT_TA_11814.pep
EEEEADEASAEEQPEDQRSPPKLAEGYYEIETIRRRRRRQNQIQYLVKWRGWPESANTWEPEENLKACSDFVEAFEKRQQPRSYGKRKRKRKISTTPVVSPNPSSQGRRGRPRRSDPRSLSQRPVPERKILPPRASSRRGTDNTNRNLVAGSDASVNVAPQQMLGQGATQEGSSNVLSV

SEQ ID NO: 117397 - protein, 152 aa, Triticum aestivum
  Clone ID: PAT_TA_11815.pep
CSVNLKVFEKMFVTIHLSVFILPLNMTKFDFEARTCDLHQINSVKKKSTMLCLRFFFLSALGASATAPMACLILCLGASHCACVGRCDCELHLSDEFLARPPIYCTEQMLKSSDRVMFILRVLLIWACQGKAAPGLLQRVQYSREYSTRLSS

SEQ ID NO: 117398 - protein, 185 aa, Triticum aestivum
  Clone ID: PAT_TA_11816.pep
MAASSLLRSLSRVSRRGCAPAFYGRGPLSPLSTAAAAAASDAGDAAVLRRGLAGLGPTAKGEKPRVVVLGTGWAGSRLMKDLDTTGYDVVCVSPRNHMVFTPLLASTCVGTLEFRSVAEPLARIQPAVSTSPGSYFLLARCTAVDPDAHTIDCETVTEGEKDTLKPSKFKVSYDKLVFGCGAEAS

SEQ ID NO: 117399 - protein, 146 aa, Triticum aestivum
  unsure (1)..(146): unsure at all Xaa locations
  Clone ID: PAT_TA_11817.pep
PCGAFKVGREVTVHSVNVFSHLVACERVAREAYRVYPKKGSVWALHAGEXPDTGRPRYDFVVFLSGYSEVHGISFGYLEKIEGFRSIFTRSDIGVRAVQYLREGDVGMLSHQTPARKVSKGEASTLPPGDCWELDPASLPAELLHA

SEQ ID NO: 117400 - protein, 167 aa, Triticum aestivum
  unsure (1)..(167): unsure at all Xaa locations
  Clone ID: PAT_TA_11818.pep
MSLSATFRVAKIPRATLPPKSCKVTPSSVSASPASTSGDPPPKAVKKKKEAAPWCVYLIASAXVPRTYVGVTTDFPRRLRQHNGELKGGAKASSAGRPWNLACLVQGFTNRSEACEFESKWKNISKKMTRKRSEPGLNAVLQHREVALSRVKTFLDCNHLNIKWHSS

SEQ ID NO: 117401 - protein, 384 aa, Triticum aestivum
  unsure (1)..(384): unsure at all Xaa locations
  Clone ID: PAT_TA_11819.pep
SARGAALSTEVNSRIPKPGTPGNELKHTSEVSKNTPVLDTGKEQQSGNKVVESVGVLSSSSHIGHSTETKSAPLEQPQQHPTPESSALAHQPFTDLQHVQLRAQIFVYGALIQGIPPXAEAYMVSAFGEPVGGGKPAWEAVWRVAVKIFQNQKSPVAGLETPTSSRIGSNVAEKASKGTAGKTSPASKKGGKAVLPAHTAVTLHSPTFNMSPLGSSTLNLQRGSHLDFSQAVSPVFAYNSQTRQPTSAVASWFPQSHGTRAAPWLAPPQNLIFDSSMQPTVPSSESAKGSSKTISISQAITPGLFLPSQASSTVASPLAVVQEEKQKTPASKRNRAGAASPKPRKRKKASASQEQQPDIASSQLKTDIASSQLKTDIASVIPAT

SEQ ID NO: 117402 - protein, 111 aa, Triticum aestivum
  Clone ID: PAT_TA_11820.pep
GGHGCGAGGCRASGVGSGASPGTFPPNLPVGGGPSGGGWERKGAGDCIALLNPSASSKNVGDQQAEVSSQPERNSVERDNRKISPKTQSKEDSSDGDGTKENYVHFRAKRG

SEQ ID NO: 117403 - protein, 158 aa, Triticum aestivum
  unsure (1)..(158): unsure at all Xaa locations
  Clone ID: PAT_TA_11821.pep
PETVDLDVNLFFKAMESVLGRASQEEAGHDTEXGRKSSSSDMDFDDSDFDNDSTEEAGEKDMDDSFMESYSDALNDELSKTTIEETFSRAQRPSTNSEGPSNDADSDDGEMAPVDVNLNLVESFLNSYSSQQGLPGPASNLLGLMGVKVPPPDGSKKP

SEQ ID NO: 117404 - protein, 85 aa, Triticum aestivum
  Clone ID: PAT_TA_11822.pep
CNPITNSLSKLPCPLPWNECLKEDEKRLSTLSRSICQFPSKSQIVLFMQAHGTRYMHASNPAYDVLVSILTVMSLFRKAEVKPFI

SEQ ID NO: 117405 - protein, 120 aa, Triticum aestivum
  Clone ID: PAT_TA_11823.pep
ARMSRGRLQFGSAHPACEVQPVSMCSPTACVCLCPVHGRTVCGACVHTAAKCGVRRSQAKKKSTLPSHACTHDRYREVQGFRQCDGAAAAASTTTARVLLSLCCFACCDATASSLQKRFE

SEQ ID NO: 117406 - protein, 143 aa, Triticum aestivum
  unsure (1)..(143): unsure at all Xaa locations
  Clone ID: PAT_TA_11824.pep
GGGRDGIEVSMEALARGGEMQRCGVVRMERQLQIRAQPPALSFLRRLPCGQLRLLPALHPHVFSSNPRRSSSHIGECSLLGLVLLLRLRSQPSRTFPRSSSSWPGPLVCNSWXLAHLRLNSCWNGKQRFHLVXXXKMXKTXNL

SEQ ID NO: 117407 - protein, 167 aa, Triticum aestivum
  Clone ID: PAT_TA_11825.pep
RPKLLECLAPINKPLDMLSIADNHLGSSVAATLVKFLGSHVRELNVEDIGLGPIGFQILEEALPRKVNLSHINISKNRGGMGTAHFVSRLILQAPNLISVNAGSNLLPPESVEVICNALKQTTCNLTRLDLMGNLQLSSTIFPAVFEFKKRGKPILLVPAQQGSCAP

SEQ ID NO: 117408 - protein, 466 aa, Triticum aestivum
  unsure (1)..(466): unsure at all Xaa locations
  Clone ID: PAT_TA_11826.pep
MARRGLMEQDLTKLDVTKLHPLSPEVISRQATINIGTIGHVAHGKSTVVKAISGVQTVRFKNELERNITIKLGYANAKIYKCEDDRCPRPMCYKAYGSGKEDTPACDVPGFENTRMKLLRHVSFVDCPGHDILMATMLNGAAIMDGALLLIAANESCPQPQTSEHLAAVEIMRLQHLIILQNKIDLIQESAAMNQHEAIQKFIQGTIXEVVPVVPISAQXLKYNIDVICEYIFKKTPTPEGIHSSSPNVIFIRLLDVNKSVSEVSKIRVGRAGXSILRGVLRVNQNIEVRPGIVXRDESGNIKCTPIYSRIVSLYAEQNELQFAVPGGLIGVGTTMDPTLTRADRLVGQVLGEIGSXPDVFVELEINFFLLRRLLGXVRTKGTEKAGKVSKLTKGEILMLNIGSMSTGARVVAVKNDLAKLQLTAPVCTSKGEKVALSRRVEKHWRLIGWGQIQAGATLEVPPCPL

SEQ ID NO: 117409 - protein, 100 aa, Triticum aestivum
  Clone ID: PAT_TA_11827.pep
FQSVCRLLRPHARPPRASETRWAATSGRRFHQPRIRVRPSSSSNLHRHRSNPQHQLVSFQHQALVSSLRFRCSNHRRSSGNDYIATVRLKRCQFGPNFVY

SEQ ID NO: 117410 - protein, 338 aa, Triticum aestivum
  unsure (1)..(338): unsure at all Xaa locations
  Clone ID: PAT_TA_11828.pep
SGESWHSAFKCTVAEVLFCPLTPVASGSPLRHGERSMRFASGMRNFGGSFGSWNPDLVGKMEGNLMPSLLEEFESNKSRTYDLSEIAGHVVEFSADQYGSRFIQRWLGSASPVACVLLSSVVTPLARTLWTAAFPNYVVQKFFEHGSTTQIKELSDQLIGRVLALSLQMYGCRVIQKAIEVVDLAQQTKMVAELDGHIMRCVRDQNGNHVIQKCIECIPQXDVIQFIVSTFYGQVVLLSTHPYGLXGVIQRVLEHXDDPTTQQIMMDEILQSVCLLAQDQYGNYVVQHVLEHGKPHERTAIIDKLIGQIXQISQQKFASNVIEKXXXFXNPXERQILI

SEQ ID NO: 117411 - protein, 364 aa, Triticum aestivum
  unsure (1)..(364): unsure at all Xaa locations
  Clone ID: PAT_TA_11829.pep
MYSAPGNNSLALAAPRPGMELGNVQQHPNQAFGLGPGGKQRSSSLESRXSRLTGHQSAVYCMKFNPAGTVIASGSHDKDIFLWYVHGECKNYMVLRGHKNAILDLHWTTDGSQIISASPDKTLRVWDVDTRKQVMAEDEYFVNSCCPSRKWPPPPLGGSGAGAATPWDLRLSRGVDTLPLPDQFPVMAFSLSAAEVFAGALGHDIDGRGRRLSEVTDTDTLQRHLVTGTRLRPGPAGPLPLAMAMDLELWVRRPRPPAPRNRNTLTGPRHHLDFEKTLLKCSWSPDNRKVTAGSADRMVYIWDTTSSRFLLPRPGHFRPGDRTPSHPAQPLIGSCSSDKLSRRAVRRGPVPSSDCLSCLGWVWN

SEQ ID NO: 117412 - protein, 210 aa, Triticum aestivum
  Clone ID: PAT_TA_11830.pep
AIGPDLAFQFSFENHLRESVAAMARQYVRAVMASVQRVAMAIAPSRLGGSQIQLKHPPGSPEALTLASWIGRSYRAHTGEEIRWSDTEEADSPLKLLWNHSDAILCCSLKPAPMFTFGNNAALDMLETTLVNLQDISLEAILDDEGRKALCAEFSKVMQQGFAYLPGGVCKSSMGRQVSYEQAVAWKVVGDDVAGAPHCLAFMFVNWTFL

SEQ ID NO: 117413 - protein, 214 aa, Triticum aestivum
  unsure (1)..(214): unsure at all Xaa locations
  Clone ID: PAT_TA_11831.pep
QKISSRVGMASSSNVLVHEDTKQNAMGVGRKLNPKSATHSQQQRNLHPPSAASRKAGVTSARSENTMKGNRKGELQPTNYANRRPNSTAKTIPKPRRLPDEGMRSKKNQPSDKVLTERSPRRVRHNIVIEEQSSFTTNKKKISTEIVSFTFTSPVDKSLHGSQFPHSVEKRSIENWNSVSTSSNTSNTESDTIDGDYLRLLLEQKLRXLTXXXE

SEQ ID NO: 117414 - protein, 375 aa, Triticum aestivum
  unsure (1)..(375): unsure at all Xaa locations
  Clone ID: PAT_TA_11832.pep
MSCAAVCAPPSGLGRHHGFPSSPSTVCRRRGRASYTIRACANSGDADDSGGGLLPRMVLHDSLEAAGVVTDHARAARERFARPRGRLTRLNAESSITIXVPLPVDAFIARLDDLSXGFLAAGSLPPPGAPSVLFFDHLDRYLYVHKASSTNKRSALMLSLIYSEMLKTLRLYGLLDFDEEISFPHDLDGCPRGYDKRRSKFCDEPNVVTAKSLLVEILQTLKGMFWPFQSNQSSSLFLNAVAANHHGPGNVGGSQARSCGNISAIEMAAAKSAQHRLMRGVWTNVRFGDMRRALAACERLILLNHNPCELRDYAALLYHLLNIVPNCHGWTAPDQSTGDVGGRHSEHSHGTSKPNFSRGWLGQPQTCCKLLDQKL

SEQ ID NO: 117415 - protein, 136 aa, Triticum aestivum; identical to SEQ ID NO: 106663
  Clone ID: PAT_TA_11833.pep

SEQ ID NO: 117416 - protein, 113 aa, Triticum aestivum
  unsure (1)..(113): unsure at all Xaa locations
  Clone ID: PAT_TA_11834.pep
RFXSXLKRXXGYVPPGPPCRPPPVASAHVPRLRPPAFSWVHVLPDPVPDMAFGRFRPALAARGFVSHGSVHPAAFRGVTTGAPRGWVWSGGFPLPRILKRWGNSHHILDIKRW

SEQ ID NO: 117417 - protein, 171 aa, Triticum aestivum
  Clone ID: PAT_TA_11835.pep
DMMSVPKPVNNSLPRNLGDAKFTSWELWQKQEYSFKKIAHFRRAVPIKEQTVISYILDAARDGCEMNWNRFFEETGLTPEIASQIRLAIAKVGSRERLKPIKEELPENITYEMIKIFFAADDLGVLEKTFGNAPTDGSPAQTARVGKTLFPWQRSSGEGRSRRPRHHIRRL

SEQ ID NO: 117418 - protein, 79 aa, Triticum aestivum
  Clone ID: PAT_TA_11836.pep
ASATFPEPGFFLFCCFSGLSAFLLFFPLFFPFSSSFIMLPFLFLFLFFKFIFLFQKVSRNCKMILFSKMYENVPVFKLC

SEQ ID NO: 117419 - protein, 217 aa, Triticum aestivum
  unsure (1)..(217): unsure at all Xaa locations
  Clone ID: PAT_TA_11837.pep
HNSRAVSNPGPIPCPASFPSNLQWPHPLSSRTNPRKCQPPPSLLPAASMLSSPSSSILPHLIHLAGSQAWEHRGELLRQRRETAGKGRPHGSVSSPPHPGSHGSEACRHGGELPRRRRQLQARGNGGAAPSDLHERDKMRGRERWKTRRKTGRGREEGCAASAVRGSLARFVVAKMASKSTTLSCSNRMPPLASFPLLVDPPCLSPLRQSLXFLLFL

SEQ ID NO: 117420 - protein, 304 aa, Triticum aestivum
  unsure (1)..(304): unsure at all Xaa locations
  Clone ID: PAT_TA_11838.pep
ARPRYRXLEIXLDGVYKRMLLLKKKKYAAIKVALDGSLRENIERKGLDMVRRDWSMLSKEIGDFCLNQILSGGTCDDVIESIHNSLVQVQAQMKSGQIELEKYIITKSLTKAPEDYPDAKNQPHVQVALRLKQNGFSGCSAGDTVPYIICSQQDSDNTHSGGIAQRARHPDELKRDPNKWMIDIEYYLSQQIHPVVSRLCASIEGTSPARLAECLGLDSSKFQSRSIGSSNEDTSTMLLSVIDDEDERYRGCEPLRLSCPSCTNTFECPPVSSLIASLSDPNEGKDATVNFWRRMRCPRCPDDN

SEQ ID NO: 117421 - protein, 216 aa, Triticum aestivum
  unsure (1)..(216): unsure at all Xaa locations
  Clone ID: PAT_TA_11839.pep
MSDFQTSTHRERWIFQPQDLVNKWTTANRRSAEILAQYGTTRLKVDPVDGSISNPEPLPDHVVGSSSVKPLSCEEEQVMRIFYEQKIQEVCRAFKFPHKIQATAIIYFKRFYLQWSVMEHHPKHIMLTCVYASCKVEENHVSAEELGKGIQQDHQIILNNEMIVLKSLDFDLIXVYAPYRSIEGFIDDLDDLCRARNGAHQRLKDLHQTANSEVDT

SEQ ID NO: 117422 - protein, 99 aa, Triticum aestivum
  Clone ID: PAT_TA_11840.pep
TPFRRDAPSFISAGTARRPFGVPHVPRAPDAPDEPDRTSASRTSRTHLTRPTSPTAPDALRVPPPRPPWQPPRRAYVPCTFHGCRPEPSRPLRHHAGPS

SEQ ID NO: 117423 - protein, 177 aa, Triticum aestivum
  Clone ID: PAT_TA_11841.pep
EFSPEDPPPGVTARRVSAPSFSAPPNQNSDLRPPESRSATALPCHLEQAREMSLIRIAFSLVLLLAAAESAAATRSPSAFVQNAIYSNRITIFSKSYCPYCMRAKRIFKDLNEDPYVVELDLREDGREIQGVLLDLVGRNTVPQVFVYGHHVGGSDDTKTALSDGQLQKLLGKSQSQ

SEQ ID NO: 117424 - protein, 210 aa, Triticum aestivum
  Clone ID: PAT_TA_11842.pep
KLDARQAQGFISFFKKLPKDPRAIRFFDRRDYYTAHGENATFIAKAYYHTMTALRQLGGNSDGISSVSVSRAMFETIARNLLLDRTDHTLELYEGSGSSWRLTKSGTPGNIGSFEDILFANNDMQFSPVTVALFPVFRDGQLYVALSFVDMTNRKLGLAEFPEDSRFTNVESALVALGCKECLLPADFEKSIDLQPLQDAISNCSILLTE

SEQ ID NO: 117425 - protein, 255 aa, Triticum aestivum
  unsure (1)..(255): unsure at all Xaa locations
  Clone ID: PAT_TA_11843.pep
FWQVGEYLEAAMSENTQGSVRRAFGDLTNVLGKRPASCDLEKNAGGVKMSRVEKVVDPRKESDEKAKANAGASGNLFEVLVDGIGKEDFARTSIFRGAKVQHMAAQAAGLLSKDDDDVRNRCVSLDSSGLNDKAESSLESEGGCEGEDDEDTDSELLPYASEASKIVINDKTNEGECLTQEEMVVSPGNQNSQSSFDATARDDMTCTNVQHPPMXXGGLEKSCATKSCTCSFCLKAAFMWTNLXYXXXXSRLGAL

SEQ ID NO: 117426 - protein, 234 aa, Triticum aestivum
  Clone ID: PAT_TA_11844.pep
YLDILLGNLQYQCKTFDINLPSEMVKCVEVFKEFYATRTKHRKLTWIYSLGTCNISAKFDAKTIELIVTTYQAALLLLFNGSTKLSYSEIVTQLNLSDDDVVRLLHSLSCAKYKILSKEPAGRTISPNDSFEFNSKFTDRMRRIKIPLPPVDEKKKVVEDVDKDRRYAIDASIVRIMKSRKVMAHTQLVAECVEQLSRMFKPDFKAIKKRIEDLITRDYLERDKDNANTYRYLA

SEQ ID NO: 117427 - protein, 822 aa, Triticum aestivum
  unsure (1)..(822): unsure at all Xaa locations
  Clone ID: PAT_TA_11845.pep
MQHFGERAFWMFCIFGMTRRIFQGCIDNSPRGLSPPHLSPPQTPRGDGRNRTQPPPLGFAAAVGGGKPAATAAMAGHGQDRKTIDLEDGWAFMQRGITKLINILEGKPEPQFSSEDYMMLYTTIYNMCTQKPPHDYSQQLYDKYREAFEEYIRATVLPSLKEKHDEFMLRELVQRWSNHKVMVRWLSRFFHYLDRYFITRRSLTALRDVGLICFRDLIFQEIKGKVKDAVIALIDQEREGEQIDRALLKNVLDIFVEIGLGNMDCYENDFEDFLLKDTTDYYSVKAQSWIVEDSCPDYMIKAEECLKREKERVGHYLHINSEPKLLEKVQNELLASGETYLFVKEHSRIFCNAYGVYLVIRPGNLLISLQNLMLKLXSSLLQHIRLRCCCYYNVSTKLSYSEIVTQLNLSDDDVVRLLHSLSCAKYKILSKEPAGRTISPNDSFEFNSKFTDRMRRIKIPLPPVDEKKKVVEDVDKDRRYAIDASIVRIMKSRKVMAHTQLVAECVEQLSRMFKPDFKAIKKRIEDLITRDYLERDKDNANTYRYLAXGQFGGKMEGMVTDLPLARVHQTMLQHVVLLHPVLNPAVDMAVTVLTTGFWPTYKTFDINLPSRLVKCAEFFKEFYATRTKHRKLTWIYSLGTCNISAKFDAKTIELIVTTYQAALLLLFNGSTKLSYSEIVTQLNLSDDDVVRLLHSLSCAKYKILSKEPAGRTISPNDSFEFNSKFTDRMRRIKIPLPPVDEKKKVVEDVDKDRRYAIDASIVRIMKSRKVMAHTQLVAECVEQLSRMFKPDFKAIKKRIEDLITRDYLERDKDNANTYRYLA

SEQ ID NO: 117428 - protein, 196 aa, Triticum aestivum
  unsure (1)..(196): unsure at all Xaa locations
  Clone ID: PAT_TA_11846.pep
MLSCGRNGPAPPSVAPDVVAGLCVLSWPAVRSAGPCALSFPGVDGDGGPSGPSSPRPSAPLVTPGSSPFRPVSCPSFGCAIPPSVGASLLTCREAPPSCSPSVFLPHDSFGIVYGMRCELCDSVATSSAVFFXWFVPLSVLALYDFTAGGDDELSLNSGEDVDIEYEVDGWYLVRETAPGRDGKMAGLVPVLYVSS

SEQ ID NO: 117429 - protein, 173 aa, Triticum aestivum
  Clone ID: PAT_TA_11847.pep
AHATPARPPHPPPATTTHCPRPAALRLRAPPPCIRSRSLPVLPRPPLPPHQPPPPPSPRCRPQAHPSPWPTPPPPPPPPRLPLVIPRRRCRRSPASRPSSSRRALARTQTWRWRSWCSTPTSAAMERRGRSSPLPPPLRVRPRQERLQLCPWASHQGRTSLALATSTAAAQAT

SEQ ID NO: 117430 - protein, 293 aa, Triticum aestivum
  unsure (1)..(293): unsure at all Xaa locations
  Clone ID: PAT_TA_11848.pep
MRFRPPIPLRLLLPQLWRRPSLPPAHLPRPISSYPSAAAVAAATDSEEDAVVARDPRLAPHFVGGAGGSPRFGENKTEFERKASIAARFKLCYELLRQRRWREMRGGLAQIVSEQGSGSAATLCDILWSEFREYDSSGVVWDALANSYARTKMVHDALYVLSKMNSLNMQISVSTYDSLLYGLRKTDVALELFDEMEAYGISHSEYSHSILIDGLCKQNKVGEALSFLQEAREGGTFRPLGMSFNTLMSALCNWGFIQPAKSFLCLMLKYGLNPNRYTYSTLIQXLCKVGSLD

SEQ ID NO: 117431 - protein, 436 aa, Triticum aestivum
  Clone ID: PAT_TA_11849.pep
SQIKIDVLDFLPEGTTACYQREIVRINGAAVEATKSIMSRRDPSRNTIHLLSMKFFLRDNDTISIGHSVGQIMATHKVEIAQFAILTEAHYSCRGDDDLASHASDFMLFFEACPGAFGGLTRLKLQDLRFGKSDICNVLLTCKQLKHLRMFNCDSGVWTTLQVEHLELSELEIVNCSFRKVVLISLPKLTQMAFHGWIAFQDPLSVGDVPLLETVDLTNVCLSSHKMVKLSKFLGGTSVRNLRLGFESEKIWVQPEHLTRQLASVFYQLTFVHMAEIPEGYDLSWSLFILEAAPNLKELYLTVWDHLCTMEMDREKRRALSYSIRKGVRWESSASRFQHRSLETLVIFGFESEEYMLTHVRCVMEAAVNLKNVFLYNRLACKMCRDNPLPSSFPFAETKKLLVEKIITSGIDSAASIHFLAGKAIWASHVAKKNFP

SEQ ID NO: 117432 - protein, 94 aa, Triticum aestivum
  unsure (1)..(94): unsure at all Xaa locations
  Clone ID: PAT_TA_11850.pep
MTLTRQRRPKSRDCRLSPGDRGGGGDXEVRPWRRPRTGATVAGGGAPWCAASPGQGVPRPSAPPQRAAPAPGAGRTDTARPAGEAAQPGAGLDR

SEQ ID NO: 117433 - protein, 198 aa, Triticum aestivum
  Clone ID: PAT_TA_11851.pep
MAEDAGSRIEVANLLSLGEDLVGVLVGIKDGEALAQACDGARMLRSACRSESGDLELQIKEYQEKINSFKEKLDKAKAETVTDEELNTLQNEMEEKLRGEQQLRQDLRAVSDELDNLDRQRTSIEERKDSVKKKEKDMLKAQSMLSMCVSVTNMMPDFEDQEKISGYIVDKNRKKLDKFEFGKTMSPVEICDKLWKMI

SEQ ID NO: 117434 - protein, 274 aa, Triticum aestivum
  Clone ID: PAT_TA_11852.pep
VGDDEVTSHRFTPARMSHVSSINPDDFDCVSEPIIRSASVNGDHLRSRSVNSNANAADADMQFSIRSLRSSSMSHEMVEVSTVPVLIDGASSRKFTRTASQQRSVIIEDAPPSSPTDDEAAANGDKDKGELPEVVEKRWKVLVWKTAVYLITLGMLIALLMGLNMSWTAITAALVLLALDFTDAQACLEKVSYSLLIFFCGMFITVDGFNKTGIPNTMWELVEPYSRIDSARGVALLGLVILILSNVASNVPTVLLLGTRVAACGCAKSAAGAR

SEQ ID NO: 117435 - protein, 303 aa, Triticum aestivum
  unsure (1)..(303): unsure at all Xaa locations
  Clone ID: PAT_TA_11853.pep
CKFVSSALGVEQLNDQEILVRFALPGFGNKTVQEQEDILAYLYANWKDLQLNSAVVNTLRETNFVTNANEFCTELFKPKELLDPSDALLASVFSGERNKFPGERFMSDGWLGILRKVGLRISTEADMIVQCATKIETMGNDVMSSLEKHDDFDADLPDRKNEIPFELWSLAESVRPVILANFATLYDSTFCQKIGKIVFVPAEKGFPSIGGKKGGRRVFASYSEAILLKDWPLAWSSAPILAKQSIIPPDFSWGAFQLRSPPAFSTVLKHLQTVGRGNGEDTXAHXPSLSGIMTVEDAFLRIL

SEQ ID NO: 117436 - protein, 179 aa, Triticum aestivum
  Clone ID: PAT_TA_11854.pep
MAGVGADGGGDTEMGGWSELLNISTKLLEQAAPTPHFPTLQRNLDQLEVLSTKLKAKTIRAEAPSQSLSATRLLAREGINAEQLTRDLKSFELKTTFEDVFPSEATSVEEYLQQLHEMAIVSSIQGAQKDNLQSFNNYMMQVLEDDWQKEKRDFLQRLSRLSTLPKRNTHLAGGLARML

SEQ ID NO: 117437 - protein, 218 aa, Triticum aestivum
  Clone ID: PAT_TA_11855.pep
MAKKLGKKARKFAHKHLQGGAKRSRKLRSQFNRRTRKDGKGREDDNRLDGDGGSEETRRNDPTMNMNDDVATLANCLEFPEDENELDGDLSDSDGYLSEDLECVYYSDSDDDNVMKECIVQDDLDEQNNEMRLAVKKQKKKLKKLLDKDPKFANFLEKWQLELVNYESKEDSDEQDEMDSVDNGVNSGDKDPPSDKILTSKTISEWCQLVLDEPKAPA

SEQ ID NO: 117438 - protein, 166 aa, Triticum aestivum
  unsure (1)..(166): unsure at all Xaa locations
  Clone ID: PAT_TA_11856.pep
PPPRRRPRPPRRPAPAPPRRQLAAPPRLPAPLPPPPAAPAAGPPASPAAGPPPXAPPPPPAREEVGAAPAACPRAGPGRAARRAGRPRWSPWACGRGSRSWCRPACPAAAAAAPPPPSPSTTTSGGSTRSTRSPATPPSEEATDAKCGRHSTTWREKLLLIYEVTI

SEQ ID NO: 117439 - protein, 152 aa, Triticum aestivum
  Clone ID: PAT_TA_11857.pep
KSPRLLLQWNHQEQACPRGHLLELLQRSSPGHHIFPAAWPKTLGMNETVELAHTLCHEMHVWFLKFVNEAMDVGFHLFEDQNIATRGKQSGHITVVLSQFKRISDWLDGVGKIADEDATKDNVERLKRKIYQFVISRMGSAFESSVSVSAKS

SEQ ID NO: 117440 - protein, 234 aa, Triticum aestivum
  unsure (1)..(234): unsure at all Xaa locations
  Clone ID: PAT_TA_11858.pep
LTAXILPFSNAFYRGLSDLISPSWLSLFNANEFNQLLSGGSQDFDVDDLRNNTKYTGGYTESSRTVKLFWEVIKGFKPTERCLLLKFVTSCSRAPLLGFKYLQPGFTIHKVPCDVTLWASIGGQDVDRLPSASTCYNTLKLPTYKRSSTLRSKLLYAISSNTGFEPVVGGGGTFARACSAAVNRLERGAAKLYQKPEHLAVNVLLCLITDLFWVEWIVMSRCSTPFLSTFVADF

SEQ ID NO: 117441 - protein, 113 aa, Triticum aestivum
  Clone ID: PAT_TA_11859.pep
MPKKKAAASGTNRCFGDDILRHVLSYLPLDDALQTCVLNTRWRDHWRHTTDLSLIFDDLSFERFKQLVKLFIQLRGDSPLDKFVILAYPESDECTYTNTMVVIEDALKCQANE

SEQ ID NO: 117442 - protein, 96 aa, Triticum aestivum
  unsure (1)..(96): unsure at all Xaa locations
  Clone ID: PAT_TA_11860.pep
IYAIGAGITAAAGTRLALQWILVKXLDCTHSNYQTLMRPXIVIYCHYLPVSGLGNLRACCLXLDVVAVSQAPSPESNPNSPSPVTTMVGPYPTIES

SEQ ID NO: 117443 - protein, 223 aa, Triticum aestivum
  Clone ID: PAT_TA_11861.pep
RNISVYSHFDSTAVLNFILNLSIEEQNLVRRSLKQYTPRIEVDLVNYLQSKKERSRPKSYEYEQIDFGTSEDGYNLTSRNSYPFGRVSASSFDNESGKRMHAVQDVHTDHANQCFEPSSEAEIFTASRESKSNARSVVEAARSWADYPEKSDATIDDENSVGTPRQDFGRHVSDGHNNAAFTTVGKNMQDMDQFVDLSSVKVVSHTTNSPSIPQLLHQISNDG

SEQ ID NO: 117444 - protein, 260 aa, Triticum aestivum
  Clone ID: PAT_TA_11862.pep
TRVPASKPYITLEGAGRDVTVVEWHDKASDRGPDGQQLRTYNTASVTVLSNYFTAKNISFKNTAPAPMPGMQGGQAVAFRVSGDKAFFFGCGFYGAQDTLCDDAGRHYFRDCYIEGACGFRPADPPSRHPGPALLPRLLHRGLHRLHLRQGPCERTGFAFVNCRVTGTGMLYAGRAMGQYSRIVYAYTYFDNVIAPGGWDDWDHNSNKSMTAFFGMYKNWGPGADAVHGVPWARELDYFTARPFLGKSFVNGFHWLTPDV

SEQ ID NO: 117445 - protein, 77 aa, Triticum aestivum
  Clone ID: PAT_TA_11863.pep
ISYSLFDGTCYSDNRSNSRANTCNKPRLLGGAHLLDKRLTRALLADPMIHDNSTDRTAFVPATHHSNFCPIYLSFIS

SEQ ID NO: 117446 - protein, 186 aa, Triticum aestivum
  unsure (1)..(186): unsure at all Xaa locations
  Clone ID: PAT_TA_11864.pep
MDGGAAELRETHRLTGHADRAWSLAWNPNPGPGAGPVLASCGGDKTVRIWKRAPDGVWDGSALLDGVHERTPEPFPLAPXRKHRATANFDGTSRLWELGCGRXVHERTVRSCAWSPDGKLLATASFDGTTAIWEYSGGDXRVRRRNEGECVAGLERVAQDVKMVQWHPVLSXLVXVSYDNTIRVWG

SEQ ID NO: 117447 - protein, 155 aa, Triticum aestivum
  unsure (1)..(155): unsure at all Xaa locations
  Clone ID: PAT_TA_11865.pep
XRXGXVXDHLGDCTAPRMRLYRDGSSNAPSHLHSPVRWHPDHPFRSCNHNKFVRPAHKLVQIKPCAIAMSSTTAAASDVAGVWFFGKLSAAIRGKKRQAVPTVSHAEHQHQMGGAGHGKKAAAAAKPSVVDRKEAGGGGMSDATVYLLLDRFAPS

SEQ ID NO: 117448 - protein, 363 aa, Triticum aestivum
  unsure (1)..(363): unsure at all Xaa locations
  Clone ID: PAT_TA_11866.pep
MRQTEELWIDKYKPLSSGELAVHKKKVEDVKNWLEEKLKAPKGTFGGRSLVLTGQAGVGKSATVKAIAAEVGADLCEWTTPVPTLWAELVHANSELEYVSKLEEFENFVNKIRKYSLLSPTSIGSQRKLIIILIDDIPVTSGKASFARLGKCLTGLIQTTQIPTVISLTHHHKNEANDTATWNSEELESLLQGAGAHKIVFNPVTVSSIKKXLLRICKQESSGTTEELVHQIATSCGGDIRHAIMSLQYYCLNPRRLDSALAISASLSELKGHATLAPAQDCYGLGSVIHSPCGRDETLTLFHALGKFLHNKRETHGDVNIDLDSFSFKEQLRRNPLKMDVPEMILSQAHGKSXTVADFLHEN

SEQ ID NO: 117449 - protein, 259 aa, Triticum aestivum
  Clone ID: PAT_TA_11867.pep
MHGQPRRPKQPEDDAAAAAKAAKLRELQVQVLHNHHTCTYTEEALGLSFKLLEINPEAYTAWNYRKLALQHNLKELSDPEAIKSSVDAELRVVELALRQNPKSYGAWYHRKWLLNQKLAPVDFKREYGLLDKLLKVDARNFHGWNYRRFLAKFMGVPEEKELQYTMDKISENFSNYSAWHNRSILLSNLLIQRSEGFESKQKIFSEEFELVIQALFTDPGDQSGWFYHLWLLAQTSTPDNPQLISSWPSNGAKLSLFPT

SEQ ID NO: 117450 - protein, 71 aa, Triticum aestivum
  Clone ID: PAT_TA_11868.pep
LGDRRHRLPGWCRRPRALPPLPGHRAHLIYPSHTDSRSKKLRIVRLQNTTETKRVGMKKQPMYTRLYITGQ

SEQ ID NO: 117451 - protein, 85 aa, Triticum aestivum
  Clone ID: PAT_TA_11869.pep
GEEQMKGPCPRRIKLWTWEGVWSVRMDKRDGHDAKYLMDGWDDFVDAHGVEADDLLTFQIVEPDGWYVRIYAPCGKERPIGRLLL

SEQ ID NO: 117452 - protein, 219 aa, Triticum aestivum
  Clone ID: PAT_TA_11870.pep
MILGAGPIVIGQACEFDYSGTQACKALVEEGYEVVLVNSNPATIMTDPDLAHRTYIGPMTPPLVEGIIANERPDALLPTMGGQTALNLAVSLAESGALDRLGVRLIGASLPAIRAAEDRQLFKQAMDRIGLKTPPSGIGTTLEECLAIAKDIGEFPLIVRPAFTLGGTGGGIAYNRAEFEDICRSGLAASHTQQVLVEKSLLGWKEYQLEVMRDMADNV

SEQ ID NO: 117453 - protein, 89 aa, Triticum aestivum
  Clone ID: PAT_TA_11871.pep
FFFFFFFPSPNMIQSHMLIYMHIHPSIQKHVPTAETYWRGRARLIMLSRAIHSFEDMRRTLYCLVFTSPHLMPIVDGRSRCSANVANGT

SEQ ID NO: 117454 - protein, 167 aa, Triticum aestivum
  Clone ID: PAT_TA_11872.pep
PGRARRRRPRRSRQSKTRPRIMDHQQLPAPLPAPAVRVIGIDDFFKAFDLVKITGLPIPDDAPEVEGTTWDFTKADSTGNDHWDWIKRQCYNKSNELSNNRRDILPLLKNKRAHRREIARLGSQLKDLEQGLRAKILDFDQFVLGGFTFPSHFDHFPALKEKGKKKK

SEQ ID NO: 117455 - protein, 55 aa, Triticum aestivum
  Clone ID: PAT_TA_11873.pep
TTCAKKYKMFTYGQKCPWIKKDSYVYEKQIMFVLKRVQRVKKYSFKKISCILKLV

SEQ ID NO: 117456 - protein, 228 aa, Triticum aestivum
  unsure (1)..(228): unsure at all Xaa locations
  Clone ID: PAT_TA_11874.pep
RRLPAVPSYSTTAPPCTAAAPSQCLPSRXPVEIRKATAMADQGEASRSVSPAGSRRDPRGHGNGGSRRGHGLLPCPHTGHGCSHLPHLLPQIQPPAPSSTTNPFPHLLPPLPLSLPIGHIQSLKADLVHAVSVPLMQVVPVSMQRASGFVRGGAKPRGGRRDPTHARDFRPTPCIQCTEATPNRAKTARSATHQSHAVHHEEMCCGESPARDWRRWSGGLWPSLQMSL

SEQ ID NO: 117457 - protein, 199 aa, Triticum aestivum
  Clone ID: PAT_TA_11875.pep
FGTREKRAHVAANGDGLCVAQPSRADPLNWGKAAEDLSGSHLDAVKRMVEEYRRPVVTMEGASLTIAMVAAVAAGSDTRVELDESARGRVKESSDWVMNSMANGTDSYGVTTGFGATSHRRTKEGGALQRELIRFLNAGAFGTGGHEHVLPAAATRAAMLVRVNTLLQGYSGIRFEILETVAALLNANVTPCLPLRGTI

SEQ ID NO: 117458 - protein, 100 aa, Triticum aestivum
  Clone ID: PAT_TA_11876.pep
MSEFLELEALDGIRMPWNVIPGTREDAVSCVVPVSAIYTPLKSIPDMPVVPYAPLRCRMCRSILNPFSRVDYNAKIWLCTFCFQRNQFPQHYSSISENNL

SEQ ID NO: 117459 - protein, 40 aa, Triticum aestivum
  Clone ID: PAT_TA_11877.pep
SYFYVCNPWICMVTAKKDLENTSNHHLRLRVQLDRSCTCS

SEQ ID NO: 117460 - protein, 151 aa, Triticum aestivum
  Clone ID: PAT_TA_11878.pep
LLQTIDREAVFAYADDPCSANYPLMKKMRAVLVEHALANGEAERNVETSVFAKVAKFEQEVCATLPQEVEAARGAVENGTAAEPNRITDCRSYPLYRFVREELGTVYLTGEKTRSPGEEVDKVFIAMNQGKHIDALLECLKEWNGEPLPIC

SEQ ID NO: 117461 - protein, 145 aa, Triticum aestivum
  Clone ID: PAT_TA_11879.pep
TRRAPSLNWPGRVSGIVTLKKIGEDIAKETAKDWKGLRVTVKLTVQNRQAKVSVVPSAAALVIKALKEPERDRKKVKNIKHSGNISLDDVIEIAKIMKVRSMAKEMAGTVKEILGTCVSVGCTVDGKDPKDLQTEIDDGEVEIPA

SEQ ID NO: 117462 - protein, 103 aa, Triticum aestivum
  Clone ID: PAT_TA_11880.pep
MECENAHVAANGDGLCMAQPARADPLNWGKAAEELSCSHLDAVKRMVEEYRRPVVTMEGASLTIAMVAAVAAGSDTRVELDESARGRVKESSDWVMNSMMNGT

SEQ ID NO: 117463 - protein, 200 aa, Triticum aestivum
  unsure (1)..(200): unsure at all Xaa locations
  Clone ID: PAT_TA_11881.pep
PHQLEKARQKEALKGVTIMEGDAEDLPFPTDSFDRYISAGSIEYWPDPQRGIKEAYRVLRFGGLACVIGPVYPTFWLSRFFADMWMLFPKEEEYIEWFTKAGFKDVKLKRIGPKWYRGVRRHGLIMGCSXVTGVKRQSGDSPLELGPKXEDVSKPVNPITFFFRFLVGTICAAYYVLVPIYMWIKDQIVPKRHANLSERE

SEQ ID NO: 117464 - protein, 122 aa, Triticum aestivum
  unsure (1)..(122): unsure at all Xaa locations
  Clone ID: PAT_TA_11882.pep
MAANGNDGLCVAEPRSADPLNWGKAAEALSGSHLDAVKRMVEEYRRPVVVMEGASLTIAQVAAVGHRRRGQVGLHDXPRRVKESNDWXMTSMANGXDNYGSTXAFXATPIRRQGRRVKIIRS

SEQ ID NO: 117465 - protein, 131 aa, Triticum aestivum
  unsure (1)..(131): unsure at all Xaa locations
  Clone ID: PAT_TA_11883.pep
LIGPVHPTFWLSRFFADMWMLFPTEEEYIEWFKKAGFKDVQLKRIGPKWYRGVRRHGLIMGCSVTGXVKRESGDPLYSLGPKAEDVKQAVNPTLFPFASSMGTICAAYYVLXVPIYMWXIKDQIVPKGMPI

SEQ ID NO: 117466 - protein, 59 aa, Triticum aestivum
  Clone ID: PAT_TA_11884.pep
RAAARAGHNSCYSPVDYCKATFTCAIHGFAWLLQNFACTYVHHELAMRLALGKKKKTRD

SEQ ID NO: 117467 - protein, 200 aa, Triticum aestivum
  unsure (1)..(200): unsure at all Xaa locations
  Clone ID: PAT_TA_11885.pep
TGXGSFNISDFVPALSXLXXQGVQAKLRRVHRQFDGLNTKLLVPGGATRANDEEPRLGGGPVGLRGHASVGGLEQAGARRKTRVPSRGRSKDERRGIGRTSGGRVAGGGGCGRGRPNRIGGEAAGRIRSGPATGAGRPDQTHGRGASMAPMGSSLIRGDALALASHHGRAHSRRVECIVGTTHVEEEEQHWVIVAGEEEE

SEQ ID NO: 117468 - protein, 315 aa, Triticum aestivum
  unsure (1)..(315): unsure at all Xaa locations
  Clone ID: PAT_TA_11886.pep
LTDRCALDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFLVALCQAIDLRHLEENIKEAVKSCVKMAARKTLSTNNNGHLHNARFCEKDLLLTIDREAVFAYADDPCSANYPLMQKMRAVLVEHALANGEAERNVETSVFAKLAAFEQELHAVLPKEVEAAXRTSVENGTAAQQNRITGCRSYPLYRLVRKELGTEYLTGEKTRSPGEEVDKVFAAMNQGKHIDALLECLKEWNGEPLPIC

SEQ ID NO: 117469 - protein, 286 aa, Triticum aestivum
  unsure (1)..(286): unsure at all Xaa locations
  Clone ID: PAT_TA_11887.pep
MGGVLGLIQIDQSTVAIKETFGKFDAILQPGCHCLPWCLGQQIAGYLSLRVQQLDVRCETKTKDNVFVNVVXASVQYRALADKASDAFYRLSNTRXEQIQSYVFDVIRASVPKMNLDDAFEQKNEIAKAVEDELEKAMSMYGYEIVQTLIVDIEPDEHVKRAMNEINAAARLRLAATEKAEAEKILQIKRAEGDAESKYLAGLGIARQRQAIVDGLRDSVLAFSENVPGTSAKDVMDMVLVTQYFDTMKEIGASSKSSSVFIPHGPGAVRDIAAQIRDGQLQASLL

SEQ ID NO: 117470 - protein, 201 aa, Triticum aestivum
  Clone ID: PAT_TA_11888.pep
MECENGEVAANGNSVCMAIQHADPLNWGKAAEELTGSHLDEVKRMVADYRKPVVTIEGASLSIAKVAAVAAAGEVVVELDESARARVKASSDWVMNSMMNGTDSYGVTTGFGATSHRRTKEGGALQRELIRFLNAGAFGTGSDAHVLPAATTRAAMLVRINTLLQGYSGIRFEILEAVAKLLNANVTPCLPLRGTITASGD

SEQ ID NO: 117471 - protein, 135 aa, Triticum aestivum
  Clone ID: PAT_TA_11889.pep
PCSANYSLMQKMRAVLVEPALANGEAEPDMETSVFAKLAAFEQELRAVLPKEVEAARSSVENGTATQHNRITGCRSYPLYRFVRKELGTEYLTGEKTRSPGEEVDKVFVAMNQGKHIDALLECLKEWNGEPLPLC

SEQ ID NO: 117472 - protein, 121 aa, Triticum aestivum
  Clone ID: PAT_TA_11890.pep
MECETGLVGSLNGEGLCMSAPRADPLNWVKTAEELTGSHLDEVKKMVAQFREPLVTIEGASLGIAQVAAVAAGAGVARVALDESARGRVKESSDWVMNSMMNGTDSYGVTTGFGATSHRRT

SEQ ID NO: 117473 - protein, 390 aa, Triticum aestivum
  Clone ID: PAT_TA_11891.pep
FGTRVFSYGFPHAGSCVEISMPLIVLLLLCTLYMRKISLFGNHIFLIYAVPLSVGIIWVYAFFLTAGGAYNFKGCSSSIPSSNILLDSCRRHAEIMRRCRTDVSNAWRSAAWVRVPYPLQWGPPTFHFKTAIVMVIVSVVASVDSLSSYHAASLLVNLSPPTRGVVSRGIGLEGICTFIAGLWGTGTGSTTLTENIHTLDTTKMASRRALQLGGALLVIFSVFGKIGALLASIPVALAASVLCFTWALIVALGLSTLRYTEAVSSRNMIIVGFTLFISLSIPAYFQQYEPSSNLILPGYLVPYTAASSGPVRTASDGLNYAVNALLSINVVVALVVAIILDNTVPGSKQERGVYIWTDPKSLELDPASLEPYRLPKKISCWFRWAKCVGF

SEQ ID NO: 117474 - protein, 127 aa, Triticum aestivum
  Clone ID: PAT_TA_11892.pep
MECETGLVGSLNGEGLCMSAPRADPLNWVKTAEELTGSHLEEVKKMVAQFREPLVTIEGASLGIAQVAAVAAGAGVARVALDESARGRVKESSDWVMTSMMNGTDSYGVTTGFGATSHRRTKEGGAL

SEQ ID NO: 117475 - protein, 160 aa, Triticum aestivum
  unsure (1)..(160): unsure at all Xaa locations
  Clone ID: PAT_TA_11893.pep
MECETGLVGSLNGEGLCMSAPRADPLNWVKTAEELTGSHLEEVKKMVAQFREPLVTIEGASLGIAQVAAVAAGAGVARVALEQSARGRVKESSDWVMTSMMNGTDSYGVTTGFGATSHRRTKEGGALQRELIXXLNAGAFGTGTDGHVLPAEATRAXXLV

SEQ ID NO: 117476 - protein, 129 aa, Triticum aestivum
  Clone ID: PAT_TA_11894.pep
MSEFLELEALDGIRMPWNVIPGTKEDAVSCVVPVSAIYTPLKSIPDMPVVPYAPLRCRMCRSILNPFSRVDYNAKIWLCTFCFQRNQFPQHYSSISENNLPPELFPQYTTIEYMSTAETGPVMPPVFIF

SEQ ID NO: 117477 - protein, 332 aa, Triticum aestivum
  Clone ID: PAT_TA_11895.pep
VRIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISARKTAEAIDILKLMSSTFLVALCQAIDLRHLEENVKNAVKDCVTRVVRKTLITNDMGGLHNARFCEKDLIRTIDREAVFAYADDPCSANYPLMKKMRAVLVEHALANGEAERNAETSVFAKVAKFEQELCATLPQEVEAARGAVENGTTAEPNRIVDCRSYPLYRFVRKELGTVYLTGEKTRSPGEEVDKVFVAMNQGKHIDALLECLKEWNGEPLPLC

SEQ ID NO: 117478 - protein, 353 aa, Triticum aestivum
  Clone ID: PAT_TA_11896.pep
MAMASAHAPSGAGSLAPRGALRVRAPAGLGYLGLGPSRPALRPVALARRAAPSGARHPLLKSAAASSPPAAAAARPASAPRFIQHKKEAFWFYRFLSIVYDHVINPGHWTEDMRDDALEPADLHSRKLKVVDVGGGTGFTTLGIVRHVDPANVTLLDQSPHQLEKARQKEALKGVDIMEGDAEDLPFPTDTFDRYVSAGSIEYWPDPQRGIKEAYRVLRLGGKACLIGPVHPTFWLSRFFADMWMLFPTEEEYIEWFTKAGFKDVQLKRIGPKWYRGVRRHGLIMGCSVTGVKRESGDSPLQLGPKAEDVSKPVNPITFFFRFLMGTICAAYYVLVPIYMWIKDQIVPKGMPI

SEQ ID NO: 117479 - protein, 128 aa, Triticum aestivum
  Clone ID: PAT_TA_11897.pep
LMQKMRAVLVEHALANGEAERDVETSVFAKLAMFEQELRAVLPNEVEAARSAVENGTATQQNRIADCRSYPLYRFVRKELGTEYLTGEKTRSPGEEVDKVFVAMNQGKHIDALLECLKEWNGEPLPIC

SEQ ID NO: 117480 - protein, 123 aa, Triticum aestivum
  unsure (1)..(123): unsure at all Xaa locations
  Clone ID: PAT_TA_11898.pep
MECENGHVAANGDGLCVAQPARADPLNWGKAAEELSGSHLDAVKRMVEEYRKPVVTMEGASLTIAMVAAVAAGSDTRVXELDESARGRVKESSDWVMNSMMNGTDSYGVTTGFGATLNGGQGG

SEQ ID NO: 117481 - protein, 482 aa, Triticum aestivum
  unsure (1)..(482): unsure at all Xaa locations
  Clone ID: PAT_TA_11899.pep
AEAFKIAGIQHGFFELQPKEGLAMVNGTAVGSGLASIVLFEANVLGVLAEVLSAVFCEVMNGKPEYTDHLTHKLKHHPGQIEAAAIMEHILEGSSYMMLAKKLGELDPLMKPKQDRYALRTSPQWLGPQIEVIRAATKSIEREINSVNDNPLIDVSRGKAIHGGNFQGTPIGVSMDNTRLAVAAIGKLMFAQFSELVNDFYNNGLPSNLSGGRNPSLDYGFKGAEIAMASYCSELQFLGNPVTNHVQSAEQHNQDVNSLGLISARKTAEAIDILKLMSSTFLVALCQAIDLRHLEENVKNAVKNCVTRVARKTITNDMGGLHNTRFCEKDLLQTIDREAVFAYADEPCSANYPLMKKMRAVLVEHALANGKAERNVETSXVFAKVAKFEQELCATLPQEVEAARGAVENGTAAEPNRIVDCRSYPLYRFVRKELGTVYLTGEKTRSPGEEVDKVFVAMNQGKHIDALLECLKEWNGEPLPLC

SEQ ID NO: 117482 - protein, 119 aa, Triticum aestivum
  Clone ID: PAT_TA_11900.pep
MVQRLTYRKRHSYATKSNQTRVVKTPGGKLVYQYTKKRASGPKCPVTGKKIQGIPHLRPTEYKRSRLSRNRRTVNRPYGGVLSGTAVRERIIRAFLVEEQKIVKKVLKIQKTKDKTTSK

SEQ ID NO: 117483 - protein, 519 aa, Triticum aestivum
  unsure (1)..(519): unsure at all Xaa locations
  Clone ID: PAT_TA_11901.pep
GTITASGDLVPLSYIAGLVTGRPNSMATAPDGTKVNAAEAFKIAGIQHGFFELQPKEGLAMVNGTAVGSGLASMVLFEANILSLLAEVLSAVFCEVMNGKPEYTDHLTHKLKHHPGQIEAAAIMEHILEGSSYMMLAKKLGELDPLMKPKQDRYALRTSPQWLGPXIEVIRAATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFLVALCQAIDLRHLEENVKNAVKSCVKTVARKTLSTDNNGHLHNARFCEKDLLLTIDREAVFAYADDPCSANYPLMQKMRAVLVEHALANGEAERDVETSVFAKLAMFEQELRAVLPKEVEAARSAVENGTAAQQNRIAECRSYPLYRFVRKELGTEYLTGEKTRSPGEEVDKVFVAMNQGKHIDALLECLKEWNGEPLPLC

SEQ ID NO: 117484 - protein, 463 aa, Triticum aestivum
  Clone ID: PAT_TA_11902.pep
EGLAMVNGTAVGSGLASMVLFEANILSLLVEVLSAVFCEVMNGKPEYTDHLTHKLKHHPGQIEAAAIMEHILEGSSYMMLAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFLVALCQAIDLRHLEENVKNAVKSCVKTVARKTLSTDTNGHLHNARFCEKDLLLTIDREAVFAYADDPCSANYPLMQKMRAVLVEHALANGEAERDVETSVFAKLATFEQELRAVLPKEVEAARSAVENGTAAQQNRIDECRSYPLYRFVRKELGTEYLTGEKTRSPGEEVDKVFIAMNQGKHIDALLECLKEWNGEPLPLC

SEQ ID NO: 117485 - protein, 184 aa, Triticum aestivum
  Clone ID: PAT_TA_11903.pep
EALKGVQIMEGDAEDLPFPTDTFDRYVSAGSIEYWPDPQRGIKEAYRVLRLGGKACLIGPVHPTFWLSRFFADMWMLFPTEEEYIEWFTKAGFKDVQLKRIGPKWYRGVRRHGLIMGCSVTGVKRESGDSPLQLGPKAEDVSKPVNPITFFFRFLMGTICAAYYVLVPIYMWIKDQIVPKGMPI

SEQ ID NO: 117486 - protein, 479 aa, Triticum aestivum
  Clone ID: PAT_TA_11904.pep
FKIAGIQHGFFELQPKEGLAMVNGTAVGSGLASMVLFEANILSLLAEVLSAVFCEVMNGKPEYTDHLTHKLKHHPGQIEAAAIMEHILEGSSYMMLAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFLVALCQAIDLRHLEENVKNAAKSCVKTVARKTLSTNNNGHLHNARFCEKDLLLTIDREAVFAYADDPCSANYPLMQKMRAVLVEHVLANGEAERDVETSVFAKLAIFEQELRAVLPKEVEAARGAVENGTATQQNRIAECRSYPLYRFVRKELGTEYLTGEKTRSPGEEVDKVFVAMNQGKHIDALLECLKGWNGEPLPIC

SEQ ID NO: 117487 - protein, 168 aa, Triticum aestivum
  Clone ID: PAT_TA_11905.pep
PFPTDTFDRYVSAGSIEYWPDPQRGIKEAYRVLRLGGKACLIGPVHPTFWLSRFFADMWMLFPTEEEYIEWFKKAGFKDVQLKRIGPKWYRGVRRHGLIMGCSVTGVKRESGDSPLQLGPKAEDVSKPVNPITFFFRFLMGTICAAYYVLVPIYMWIKDQIVPKGMPI

SEQ ID NO: 117488 - protein, 702 aa, Triticum aestivum
  unsure (1)..(702): unsure at all Xaa locations
  Clone ID: PAT_TA_11906.pep
MACAWRSRXRADPLNWGKAAEELSGSHLEAVKRMVEEYRKPVVTMEGASLTIAMVAAVAAGSDTRVELDESARGRVKESSDWVMNSMMNGTDSYGVTTGFGATSHRRTKEGGALQRELIRFLNAGAFGTGTDGHVLPAAATRAAMLVRXNTLLQGYSGIRFEXLETIATLLNANVTPCLPLRGTITASGDLVPLSYIAGLVTGRPNSMATAPDGSKVNAAEAFKIAGIQHGFFELQPKEGLAMVNGTAVGSGLASMVLFEANVLSLLAEVLSGVFCXXMNGEPEFTDHLTHKLKHHPGQIEAAAIMEHILEGSSYMMLAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFLVALCQAIDLRHLEENVKNAVESCVKTVARKTLSTDNNGHLHKARFCEKDLLLTIDREAVFAYADDPCSANYPLMQKMRAVLVEHALANGEAERDVETSVFAKLAMFEQELRAVLPKEVEAARSAVENGTAAQQNRIADCRSYPLYRFVRKELGTEYLTGEKTRSPGEEVDKVFVAMNQGKHIDALLECLXKEWNGEPLPIC

SEQ ID NO: 117489 - protein, 701 aa, Triticum aestivum
  unsure (1)..(701): unsure at all Xaa locations
  Clone ID: PAT_TA_11907.pep
MACASLSRXRADPLNWGKAAEELSGSHLEAVKRMVEEYRRPVVTMEGASLTIAMVAAVAAGSDTRVELDESARGRVKESSDWVMNSMANGTDSYGVTTGFGATSHRRTKEGGALQRELIRFLNAGAFGTGSDGHVLPAATTRAAMLVRVNTLLQGYSGIRFEILETIATLLNANVTPCLPLRGTITASGDLVPLSYIAGLVTGRPNAVAVAPDGTKVNAAEAFKIAGIQHGFFELQPKEGLAMVNGTAVGSGLASIVLFEANIFGVLAEVLSAVFCEVMNGKPEYTDHLTHKLKHHPGQIEAAAIMEHILEGSSYMMLAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFLVALCQAIDLRHLEENVKNAVKNCVTRVARKTLITNDMGGLHNARFCEKDLLQTIDREAVFAYADDPCSANYPLMKKMRAVLVEHALANGEAERNAETSVFAKVATFEQELCAALPQEVEAARGAVENGTAAEPNRIADCRSYPLYRFVRKELGTVYLTGEKTRSPGEEVDKVFIAMNQGKHIDALLECLKEWNGEPLPIC

SEQ ID NO: 117490 - protein, 762 aa, Triticum aestivum
  unsure (1)..(762): unsure at all Xaa locations
  Clone ID: PAT_TA_11908.pep
MSEFLELEALDGIRMPWNVIPGTREDAXSCVVPVSAIYTPLKSIPDMPVVPYAPLRCXMCRSILNPFSRVDYNAKIWLCTFCFQRNQFPQHYSSISENNLPPELFPQYTTIEYISTAETGPVMPPVFIFVVDTCIIEEEIGYLKSALAQATELLPDNSLIGFITFGTYVQVHELGFGLLPKSYVFKGTKEVSKEQILEQMCFFAGKQKPTTGVIAGTRDGLSSESISRFLVPASECEFVLNSVIEELQKDPWHIPADQRASRCTGAALSVAASLLGVCVPGSGARIMAFVGGPSTEGPGSIVSKSLTEPIRSHKDLDKDSAPLFDKAVKFYDQIAKQLVHQGHVLDLFACAVDQVGVAEMKVAIEKTGGIVVLAESFGHSVFKDSLLRIFQSADNGLGLSFNGILEINCSKDVKIQGIIGPCSSLEKKSPLSADTVIGQGNTSAWKMCGLDKKTSLCFVYDISRKVGPDSVAQQTGEQLYLQFVTYYQHHEGQMRLRTTTISRQWASGSASVQELIDGFDQEAAAAVVARLVSFKMETEADFDPIRWLDRALIRLCTKFGDYQKETPSSFSLSPRLSIFPQFMFNLRRSQFVQVFNNSPDETAYFRMMLERENVGNAVAMIQPSLISYSFQSGPMPVLLDATAIAPDKILLLDSYFSVVIFHGITIAQWRNAGYQDQEGHEVFAQLLKAPHEESDSIIKERFPVPRLVVCDQYGSQARFLLAKLNPSVAYNSDNPAPGGDVIFPDDVSFEVFMAHLQRLAVQ

SEQ ID NO: 117491 - protein, 577 aa, Triticum aestivum
  unsure (1)..(577): unsure at all Xaa locations
  Clone ID: PAT_TA_11909.pep
AFGNGSDGHVLPAAATRAAMLVRVNTLLQGYSGIRFEILETIATLLNANVTPCLPLRGTITASGDLVPLSYIAGLVTGRPNSIATAPDGTKVNAVEAFKIAGIQHGFFELQPKEGLAMVNGTAVGSGLASMVLFEANILSLLAEVLSAVFCEVMNGKPEYTDHLTHKLKHHPGQIEAAAIMEHILEGSSYMMLAKKLGELDPLMKPKQDRYALRTSPQWLGPQIEAIRAATKSIEREINSVNDNPLIDVSRDKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFLVALCQAIDLRHLEENVKNAVKSCVKTVARKTLSTNNNGHLHNARFCEKDLLLTIDREAVFAYADDPCSANYPLMQKMRAVLVEHALANGEAERDAETSVFAKLAIFEQELRAVLPKEVEAARSAVENGTATQQNRXSLECRSYPLYRFVRKELGTEYLTGEKTRSPGEEVDKVFVAMNQGKHIDALLECLKGWNGEPLPIC

SEQ ID NO: 117492 - protein, 496 aa, Triticum aestivum
  unsure (1)..(496): unsure at all Xaa locations
  Clone ID: PAT_TA_11910.pep
SVATAPDGGMVYAVFAFITAGIQHGFFELQPKEGLAMVNGTAVGSGLASMVLFEANILSLLAEVLSAVFCEVMNGKPEYTDHLTHKLKHHPGQIEAAAIMEHILEGSSYMALAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDLYNNGLPSNLSGGRNPSLDYGFKGAEIAMASYCSELQFLGNPVTNHVQSAEQHNQDVNSLGLISSRKTAEAIDILKLMSSTFMVALCQAIDLRHLEENVKDAVKSCVKMTARKTLSTTNNGHLHNARFCEKDLLLTIDREAVFAYADDPCSANYPLMQKMRAVLVEHALANGEAERDVETSVFAKLAAFEQELXRAVLPKEVEAARTSVENGTATQQNRITECRSYPLYRFVRKELGTEYLTGEKTRSPGEEVDKVFVAMNQGKHIDALLECLKEWNGEPLPLC

SEQ ID NO: 117493 - protein, 701 aa, Triticum aestivum
  unsure (1)..(701): unsure at all Xaa locations
  Clone ID: PAT_TA_11911.pep
MACAWRSRXRADPLNWGKAAEELSSSHLEAVKRMVEEYRKPVVTMEGASLTIAMVAAVAAGSDTRVELDESARGRVKESSDWVMNSMMNGTDSYGVTTGFGATSHRRTKEGGALQRELIRFLNAGAFGTGTDGHVLPAAATRAAMLVRVNTLLQGYSGIRFEILETIATLLNANVTPCLPLRGTITASGDLVPLSYIAGLVTGRPNSMATAPDGTKVNAAKAFKIAGIQHGFFELQPKEGLAMVNGTAVGSGLASMVLFEANVLSLLAEVLSAVFCEVMNGKPEYTDHLTHKLKHHPGQIEAAAIMEHILEGSSYMMLAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDLYNNGLPSNLSGGRNPSLDYGFKGAEIAMASYCSELQFLGNPVTNHVQSAEQHNQDVNSLGLISSRKTAEAIDILKLMSSTFMVALCQAIDLRHLEENVKDAVKSCVKMTARKTLSTTNNGHLHNARFCEKDLLLTIDREAVFAYADDPCSANYPLMQNMRAVLVEHALSNGEAERDTETSVFAKLAAFEQELRAVLPKEVEAARTSVENGTAAQQNRITECRSYPLYRFVRKELGTEYLTGEKTRSPGEEVDKVFVAMNQGKHIDALLECLKEWNGEPLPIC

SEQ ID NO: 117494 - protein, 284 aa, Triticum aestivum
  Clone ID: PAT_TA_11912.pep
MGGVLGLIQIDQSTVAIKETFGKFDAILQPGCHCLPWCLGQQIAGYLSLRVQQLDVRCETKTKDNVFVNVVASVQYRALADKASDAFYRLSNTREQIQSYVFDVIRASVPKMNLDDVFEQKNEIARAVEDELEKAMSAYGYEIVQTLIVDIEPDEHVKRAMNEINAAARMRLAATEKAEAEKILQIKRAEGEAESKYLAGVGIARQRQAIVDGLRDSVLAFSENVPGTSSKDVMDMVLVTQYFDTMKDIGASSKSSAVFIPHGPGAVKDIASQIRDGQLQGRMV

SEQ ID NO: 117495 - protein, 284 aa, Triticum aestivum
  Clone ID: PAT_TA_11913.pep
MGGVLGLIQIDQSTVAIKETFGKFDAILQPGCHCLPWCLGQQIAGYLSLRVQQLDVRCETKTKDNVFVNVVASVQYRTLADKASDAFYRLSNTREQIQSYVFDVIRASVPKMNLDDVFEQKNEIARAVEDELEKAMSAYGYEIVQTLIVDIEPDEHVKRAMNEINAAARMRLAATEKAEAEKILQIKRAEGEAESKYLAGVGIARQRQAIVDGLRDSVLAFSENVPGTSSKDVMDMVLVTQYFDTMKDIGASSKSSAVFIPHGPGAVKDIASQIRDGQLQGRMV

SEQ ID NO: 117496 - protein, 429 aa, Triticum aestivum
  Clone ID: PAT_TA_11914.pep
NELVHQNRWREALDRLLETNNFPEFTGRVCPAPCEGSCVLGIIENPVSIKSIECSIIDKGFEEGWMVPRPPLQRTGKKIAIVGSGPAGLAAADQLNKMGHFVTVFERSDRIGGLMMYGVPNMKTDKIGVVQRRVNLMAEEGVTFVVNANVGSDPLYSIERLHSENNAVILACGATKPRDLSIPGRELAGVHFAMEFLHANTKSLLDSNLEDGRYISAQGKKVVVIGGGDTGTDCIGTSVRHGCSSIVNLELLTKPPSKRASDNPWPQWPRVFRVDYGHQEASTKFGNDPRTYEVLTKRFIGDENGKLKALEVVRVKWEKVDGRFQFKEIEGSQEIIEADLVLLAMGFLGPEENIADKLGLEKDNRSNFKAQFGHFGTSVDGVFAAGDCRRGQSLVVWAITEGREAAAAVDKYLSRDEQNVARPYIGLWC

SEQ ID NO: 117497 - protein, 738 aa, Triticum aestivum
  unsure (1)..(738): unsure at all Xaa locations
  Clone ID: PAT_TA_11915.pep
MLEDKSTRALFSHKSAPSRLQDPLLIKPMAANGNHGLCVAEPRSAADPLNWGKAAEALSGSHLDAVKRMVEEYRRPVVVMEGASLTIAHVAAVAAADGARVELDESARGRVKESSDWVMTSMANGTDSYGVTTGFGATSHRRTKEGGALQRELIRFLNAGAFGTGSDGHVLPAATTRAAMLVRVNTLLQGYSGIRFEILETIATLLNANVTPCLPLRGTITASGDLVPLSYIAGLVTGRPNAVAVAPDGTKVNAAEAFKIAGIQHGFFELQPKEGLAMVNGTAVGSGLASIVLFEANVLGVLAEVLSAVFCEVMNGKPEYTDHLTHKLKHHPGQIEAAAIMEHILEGSSYMMLAKKLGELDPLMKPKQDRYALRTSPQWLGPQIEVIRAATKSIEREINSVNDNPLIDVSRGKAIHGGNFQGXTPIGVSMDNTRLAIAAIGKLMFAQFSELVNDXFYNNGLPSNLSGGRNPSLDYGFKGAEIAMASYCSELQFLGNPVTNHVQSAEQHNQDVNSLGLISARKTAEAIDILKLMSSTFLVALCQAIDLRHLEENVKNAVKNCVTRVARKTLITNDMGGLHNARFCEKDLLQTIDREAVFAYADDPCSANYPLMKKMRAVLVEHALANGEAEHNVETSVFAKVAKFEQELCATLPQKVEAARGAVENGTAAEPNRIVDCRSYPLYRFVREELGTVYLTGEKTRSPGEEVDKVFVAMNQGKHIDALLECLKEWNGEPLPIC

SEQ ID NO: 117498 - protein, 207 aa, Triticum aestivum
  Clone ID: PAT_TA_11916.pep
EFGTSSELAVGEAAWGLARYAAISQDNGLVPIVEPEILLDGEHGIQRTFEVAQKVWPETFYQMAQNNVMFEGILLKPSMVTPGAECKDRATPEQVADYTLKLLSRRVPPAVPGIMFLSGGQSEVEATLNLNAMNQGPNPWHVSFSYARALQNTCLKTWGGRPENVKAAQEALLLRAKANSLAQLGKYTSDGEAAEAKEGMFVKNYSY

SEQ ID NO: 117499 - protein, 389 aa, Triticum aestivum
  unsure (1)..(389): unsure at all Xaa locations
  Clone ID: PAT_TA_11917.pep
MASATLLKSSFLPKKAEWGVARQVAAPRVSMVXVRAGAYDEXTPSKTAKTIASPGRGILAMDESNATCGKRLDSIGLENTEANRQAFRTLLVSVPGLGNHISGAILFEETLYQSTVDGKKIVDILVEQGVVPGIKVDKGLVPLTGSNDESWCQGLDGLASREAAYYQQGARFAKWRTVVSIPNGPSELAVKEAAWGXLARYAAISQDNGLVPIVXEPEILLDGEHGIERTFEVAQKVWAETFYQMAQNNVMFEGILLKPSMVTPGAECKDRATPEQVADYTLKLLSRRVPPAVPGIMFLSGGQSEVEATLNLNAMNQGPNPWHVSFSYARALQNTCLKTWGGRPENVKAAQEALLLRAKANSLAQLGKYTSDGEAAEAKEGMFVKNYSY

SEQ ID NO: 117500 - protein, 119 aa, Triticum aestivum; identical to SEQ ID NO: 117482
  Clone ID: PAT_TA_11918.pep

SEQ ID NO: 117501 - protein, 165 aa, Triticum aestivum
  Clone ID: PAT_TA_11919.pep
MPPKLDPSQIVEVYVRVTGGEVGAASSLAPKIGPLGLSPKKIGEDIAKETAKDWKGLRVTVKLTVQNRQAKVSVVPSAAALVIKALKEPERDRKKVKNIKHSGNISLDDVIEIAKIMKVRSMAKEMAGTVKEILGTCVSVGCTVDGKDPKDLQTEIDDGEVEIPA

SEQ ID NO: 117502 - protein, 119 aa, Triticum aestivum; identical to SEQ ID NO: 117482
  Clone ID: PAT_TA_11920.pep

SEQ ID NO: 117503 - protein, 165 aa, Triticum aestivum; identical to SEQ ID NO: 117501
  Clone ID: PAT_TA_11921.pep

SEQ ID NO: 117504 - protein, 165 aa, Triticum aestivum
  Clone ID: PAT_TA_11922.pep
MPPKLDPSQIVEVYVRVTGGEVGAASSLAPKIGPLGLSPKKIGEDIAKETAKDWKGLRVTVKLTVQNRQAKVSVVPSAAALVIKALKEPERDRKKVKNIKHNGNISLDDVIEIAKIMKVRSMAKEMAGTVKEILGTCVSVGCTVDGKDPKDLQTEIDDGEVEIPA

SEQ ID NO: 117505 - protein, 407 aa, Triticum aestivum
  Clone ID: PAT_TA_11923.pep
MNTSKLTSSVNITSPPGASCRIRHELKSSFLPKKAEWGATRQAAAPKPMTVSMVVRASAYADELVKTAKTIASPGRGILAMDESNATCGKRLASIGLENTEANRQAYRTLLVTPPGLGNYISGAILFEETLYQSTVDGKKIVDILVEQGIVPGIKVDKGLVPLVGSNDESWCQGLDGLASREAAYYQQGARFAKWRTVVSIPNGPSELAVKEAAWGLARYAAISQDNGLVPIVEPEIMLDGEHGIERTFEVAQKVWAETFYYMAQNNVMFEGILLKPSMVTPGAECKDRATPEEVASYTLKLLQRRIPPSVPGIMFLSGGQSEVEATLNLNAMNQAPNPWHVSFSYARALQNTCLKTWGGRPENVAAAQEALLLRAKANSLAQLGKYTSDGEAAEASENMFVKNYSY

SEQ ID NO: 117506 - protein, 284 aa, Triticum aestivum; identical to SEQ ID NO: 117494
  Clone ID: PAT_TA_11924.pep

SEQ ID NO: 117507 - protein, 389 aa, Triticum aestivum
  unsure (1)..(389): unsure at all Xaa locations
  Clone ID: PAT_TA_11925.pep
MASAALLKSSFLPKKAEWGTTRQAAAPKPVTVSMVVRASAYADELVKTAKTIASPGRGILAMDESNATCGKRLASIGLENTEANRQAYRTLLVTPPGLGNYISGAILFEETLYQSTVDGKKIVDILVEQGIVPGIKVDKGLVPLVGSNDESWCQGLDGLASREAAYYQQGARFAKWRTVVSIPNGPSELAVKEAAXWGLARYAAISQDNGLVPIVEPEIMLDGEHGIERTFEVAQKVWAETFYYMAQNNVMFEGILLKPSMVTPGAECKDRATPEEVASYTLKLLQRRIPPSVPGIMFLSGGQSEVEATLNLNAMNQAPNPWHVSFSYARALQNTCLKTWGGRPENVAAAQEALLLRAKANSLAQLGKYTSDGEAAEASENMFVKNYSY

SEQ ID NO: 117508 - protein, 166 aa, Triticum aestivum
  Clone ID: PAT_TA_11926.pep
MPPKLDPSQVVEVYVRVTGGEVGAASSLAPKIGPLGLSPKKIGEDIAKETAKDWKGLRVTVKLTVQNRQAKVSVVPSAAALVIKSLKEPERDRKKVKNIKHNGNISLDDVIEIAKIMKPRSMAKEMAGTVKEILGTCVSVGCTVDGKDPKDLQTEIDDGEVEIPSA

SEQ ID NO: 117509 - protein, 360 aa, Triticum aestivum
  unsure (1)..(360): unsure at all Xaa locations
  Clone ID: PAT_TA_11927.pep
MASATLLKSSFLPKKAEWGVARQVAAPRVSMVVRAGAYDDELVKTAKTIASPGRGILAMDESNATCGKRLDSIGLEXHRGEPAGVPHAAGLRXGPRQPHLRRHPLRGXLYQSTVDGKKIVDILVEQGIVPGIKVDKGLVPLTGSNDESWCQGLDGLASREAAYYQQGARFAKWRTVVSIPNGPSELAPEILLDGEHGIERTFEVAQKVWAETFYQMAQNNVMFEGILLKPSMVTPGAECKDRATPEQVADYTLKLLSRRVPPAVPGIMFLSGGQSEVEATLNLNAMNQGPNPWHVSFSYARALQNTCLKTWGGRPENVKAAQEALLLRAKANSLAQLGKYTSDGEAAEAKEGMFVKNYSY

SEQ ID NO: 117510 - protein, 389 aa, Triticum aestivum
  unsure (1)..(389): unsure at all Xaa locations
  Clone ID: PAT_TA_11928.pep
MASATLLKSSFLPKKAEWGTTRQAAAPKPMTVSMVVRASAYADELVKTAKTIASPGRGILAMDESNATCGKRLASIGLENTEAXPPGLPDPSCHSTRIGKLHLWCYPLXRETLYQSTVDGKKIVDILVEQGIVPGIKVDKGLVPLVGSNDESWCQGLDGLASREAAYYQQGARFAKWRTVVSIPNGPSELAVKEAAWGLARYAAISQDNGLVPIVXLRSCSTVSTASRGXFEVAQKVWAETFYYMAQNNVMFEGILLKPSMVTPGAECKDRATPEEVASYTLKLLQRRIPPSVPGIMFLSGGQSEVEATLNLNAMNQAPNPWHVSFSYARALQNTCLKTWGGRPENVAAAQEALLLRAKANSLAQLGKYTSDGEAAXAKENMFVKNYSY

SEQ ID NO: 117511 - protein, 135 aa, Triticum aestivum
  Clone ID: PAT_TA_11929.pep
LWRRSTSRMSSELEKHLHLRDQWLMQEYFNRVKIRNFARVCYNESEKTGVIFERPPGQVRQLQEQMLPKSLPQILGEQLLPRNLPQMKQRVKQSLESAMGYLHRQRAPRPRVFNLACAITLLSTTCMANESKTVN

SEQ ID NO: 117512 - protein, 72 aa, Triticum aestivum
  Clone ID: PAT_TA_11930.pep
VRVFLVLVTYKNQVFVGLCFHEGSKLQKMKSEQGCLKLTTWHLLASRRGSCFSLPLSVAGEYPALEVVIFFL

SEQ ID NO: 117513 - protein, 166 aa, Triticum aestivum
  Clone ID: PAT_TA_11931.pep
MGSTRATCDEGKARGLCRLRRRFGEPALGACCAVAPAPLAYTRSLWRTGSAPCTSGGPEGPPGSSGCSASPATPGPPGCRRRSSFLSPAAAQPPRGSCAPAPPPGSSRRLLGNRWNPGGDPAGTVGDLRPPPVPATREPSSPVPMLAARDRAGRPPCEAPPGTPPW

SEQ ID NO: 117514 - protein, 220 aa, Triticum aestivum
  unsure (1)..(220): unsure at all Xaa locations
  Clone ID: PAT_TA_11932.pep
GDPMLKRLEGRAMEIAAQSXQXRGGIASAELVQKIASLVVDAMGGVVEDADAMNRXWSTKSRQLCAGLNSIALPLGSLGIGLSRHRSLLFKVLADRVNLPCKLVKGICYTGTDEGAINFVKIDFDSAEYIVDLMGAPGTLIPSEISVSQFQDSNNSQLSSDAIEESVAELCIALEQVSGVYESKNDMGGSSSDRNSVLELPTPHLEDTCHTENPLKQRII

SEQ ID NO: 117515 - protein, 269 aa, Triticum aestivum
  unsure (1)..(269): unsure at all Xaa locations
  Clone ID: PAT_TA_11933.pep
MSAAGAGPGPGAEAQMGKDRDVVRLERESVIPVMKPKLIMKLAYLIERENDREEFVKLCKRMEYTIRAWYHLQFDDMMELYALFDPVQGAXKLQQQNFSSEEIDTLEQNFLTYLFLMMEKSNFNILSDDEVELAHSGQYLLNLPIKVDEAKLDNKLLSTYFKEHHHDNLPEFCDDVIQQEIKEVIIAYYILMENGKATIEDLDLQCEELIQEEFGLQCNFEVMDALQKLERFGIVTRDSIGRIVCVPLKRSNEIIGATTEELVMKFRQS

SEQ ID NO: 117516 - protein, 136 aa, Triticum aestivum
  unsure (1)..(136): unsure at all Xaa locations
  Clone ID: PAT_TA_11934.pep
PXCLXXTVDAAXGQLFCTXIGEISFCQLEGYKEGTGNWSGRRWRRLLACAAVVRPSDDPPEAVGASWYMDSPFSGGVLFCPMPPVFRIGPGIALFPGGDSIQKARAILGVLFRKAISLLLVGGLKFPSGVLRFNSF

SEQ ID NO: 117517 - protein, 171 aa, Triticum aestivum
  Clone ID: PAT_TA_11935.pep
VQSFGGSVANGLSSSELYNRSIHEIVPLRIISLLRLLAETEIRSREDDYKSLLPKEMDALTYVRKELRPLDVEAEVLPMRALTYALGIPLRVETVGEGSNCGIQVERLDLFPRSESGKGPLHLVQSYWSSITTPEPHEIGSGNLLSSDGTPLLTLLCRPRHCDILYRSEQN

SEQ ID NO: 117518 - protein, 57 aa, Triticum aestivum
  unsure (1)..(57): unsure at all Xaa locations
  Clone ID: PAT_TA_11936.pep
FFFKIGLQIDLNLSQMCLFSHLLTSSRTESKQCXLLETCRHRVWRQGLPAHPNSVAA

SEQ ID NO: 117519 - protein, 244 aa, Triticum aestivum
  Clone ID: PAT_TA_11937.pep
MIQGHPNLHVHPPSPPPVSPKGPSNGSKGPRVSPTLPPIPPETDPRAPSTHPPRARPPPPPNLDCKLLVCPEPLTDPPAGAPCACVLPIKVGIRLSVDLYSFFPLVSDFADEVGSGVNMARRQVRVMGANVAGDQPDKTVVLVHLVPMHVNFDKATALSTFQSLWSKKISLKPSVFGDYEILYVVYPGLPPSPPSAPAGAFGNSRNARAMKPLGVDVGRPKRKVNGSVIAIAVLSTVIALIICT

SEQ ID NO: 117520 - protein, 103 aa, Triticum aestivum
  Clone ID: PAT_TA_11938.pep
DRSYATASPGPQLRPRRRRIRSGQNLGLRGRGDREHELRKPHGRVGGCRRWPLPSPPQAQPLHFFTSPEQCSVAQRIEADRCETPARARPEYQTGGWSRSCRQ

SEQ ID NO: 117521 - protein, 165 aa, Triticum aestivum
  unsure (1)..(165): unsure at all Xaa locations
  Clone ID: PAT_TA_11939.pep
SKGGNIXYIEHTTQAHTPFARLHFSGLPFQHQRLSIYFLTIRGCLCYDPISHRVYTSRHMYFFENVFPFQQVPPSVESSGGASHRAPDVAQVSLAACPYYHRWQVAPSPGPALAASSNIRKIRGIQKLKLRKFQPNLHRTPWWSASFMVETRTVSDRLRAPNFRS

SEQ ID NO: 117522 - protein, 233 aa, Triticum aestivum
  unsure (1)..(233): unsure at all Xaa locations
  Clone ID: PAT_TA_11940.pep
HHCSLIKKHVFPRCFIVGKRFPICLVRWRGSLFEVSSFKTNTTQVKGNENVNCSEETDGHDEVDILRWKDSLRRDFTVNSLFFNPFNHRVYDYVNGVKDLRKNKVCTVIPAHVSFKEDPARILRGLRVAARLGFQFSXETSTAIRDLSPSIINIDKTRLAMEMKYMLSYGAAESSIRLLRKYGLLDILLPFQAAYLSDQLKGKSSDRGLMLMNLLANLDKFFSADRPCHCSLW

SEQ ID NO: 117523 - protein, 122 aa, Triticum aestivum
  unsure (1)..(122): unsure at all Xaa locations
  Clone ID: PAT_TA_11941.pep
YHKELARFFWQAADGRPKYHMVKWADICLPKDRGGLGMTASRHMNVALMLHCVWRILRGEGGLWXAKYLRGAPLLDMLARXGSQFWKSIQKIKHEIRLGATFSVGNGNDTQFWLDHLLGDEP

SEQ ID NO: 117524 - protein, 198 aa, Triticum aestivum
  Clone ID: PAT_TA_11942.pep
NRAYMFWHPATRATTIFSCSTWSQSVLDMLSQSSASNLMLRNPKFTCSMSYDCSGTGYCGSASCQIKSSTLSDGLPTDYDLIPPKRKISGDRKFIMLRITIHQASSVSKSHVKGKGLTSTPLTLFPRRSDDDGDIVCRSCIEGKCPTSSQKLLFPDYSSDDDDDVPSRFGACSQTGVPCLINRPIDDVPSRSDRAHVC

SEQ ID NO: 117525 - protein, 79 aa, Triticum aestivum
  Clone ID: PAT_TA_11943.pep
VDPAFSQRPSTHPCAGAWADAWAPFQVIVCGILLVVMAVGNFVNTVETLALKLRFKAKMKRTRPRQDPGQGGANRLHQN

SEQ ID NO: 117526 - protein, 254 aa, Triticum aestivum
  unsure (1)..(254): unsure at all Xaa locations
  Clone ID: PAT_TA_11944.pep
VRPSRGDNLKVKDEXTTNWDRAADMFLKVYTPLSSYREWWVWDGXCLPALAVQVYQAWLLFLYTSSALRENVLLVNGSDIRPWWIYHHYLAMLMALVSLTWEIKGQPDCSSKQRGVQLFLRWAIMQGIAMHLQNRYQRQRLRTRIALGKAKRMDVVAGETAGVEGQLLLLYPVLFVLQGFEAYVGVLLLQTAWHGLTSEWQVIVCGILLVVMAVGNFVNTVETLALKLRFKAKMKRTRPRQEPGQGGANRLHQN

SEQ ID NO: 117527 - protein, 113 aa, Triticum aestivum
  Clone ID: PAT_TA_11945.pep
NAGVRFYKCVNKDDGICNYMSTKEEYLAELSFHLGTAQQLGHGSSQAGSSLNHRVRVVQQQRTVPAVAQAFRVNQAGSSAAALRVLVFLDAAILFVGVLIFLALLKVVSLLSR

SEQ ID NO: 117528 - protein, 203 aa, Triticum aestivum
  unsure (1)..(203): unsure at all Xaa locations
  Clone ID: PAT_TA_11946.pep
MLPVPPVPVAEAAAGHEVEPLPAPEKARHRQGIHGEELPFKVTLTETPENDGFHWXRKYGEKKILNAVFPRSYYRCGYSDEHRCPAKKVVQQQNNNDPPVFXVTLMNDHTCSSLFPANDQPPSSSNSATANSQVLDFTKASLSSAVGVSRLKKEEDAGMSVTVPSYTYDELASYSSLPLLSPKEWEMEMEIKSLFSHHSGGGT

SEQ ID NO: 117529 - protein, 102 aa, Triticum aestivum
  unsure (1)..(102): unsure at all Xaa locations
  Clone ID: PAT_TA_11947.pep
ETATTSSLTRSCTRSGATSPSSSAAWRISSVRNAVLCSFVIVVVVVVVVDNQGGTILCRFLKLSVSFMALLSVKAGGFGKCCFALEALFXSMFIXKLKQISK

SEQ ID NO: 117530 - protein, 218 aa, Triticum aestivum
  unsure (1)..(218): unsure at all Xaa locations
  Clone ID: PAT_TA_11948.pep
LTPIVRVYFLLGSVSRNGGRHHMVSYNPXXSKSRAVNREVLSELIKLHGKTSLGGKLPAYDGRKSLYTAGSLPFESEEFSVTLVDPEKKDKEKAEREYKITIRIAGRTDLYHLQQFLKGRQRDMPQETIQVLDVVLRESPSWNYVTVSRSFFSTTFGHRGDVGEGLECWRGYYQSLRPTQMGLSLNIDISATSFFKPVTVVQFVLEFLNLRDASRPLT

SEQ ID NO: 117531 - protein, 296 aa, Triticum aestivum
  unsure (1)..(296): unsure at all Xaa locations
  Clone ID: PAT_TA_11949.pep
MSSSSAAASPAPADAAGGERPTAAPFGSWRSPITADVVSGASKRLGDIALAGDGRLLWIEGRPEEKGRMVIVKEDDKPADIIPQEFAARTLAQEYGGXGAFAVQDSVVVFSNYKDQRLYKQPIGTGSLPVPLTPDYGAPDVSYADGVFDPHFSRYITVMEDRRTSSLNPATTIVSINLSNGDVHEPKVLISGNDFYASPRIDPTKKRMAWIEWGHPNMPWDKSELWVGYFSESGDLTERVCVAGSNPMLVESPAEPKWSPKGELFFVTDRGSGFWNIHNGVEHTNEVGPDAHALDA

SEQ ID NO: 117532 - protein, 258 aa, Triticum aestivum
  unsure (1)..(258): unsure at all Xaa locations
  Clone ID: PAT_TA_11950.pep
NCNNGHHQKXKPMRATTTXLINRIWSDYYAHHFPEDLKEGDGNEXKEVDDEQXENEDEDAEEEXXIEGRQXLQXTPPSTRSRKLVSQTXKXMRWKGEPAGKTTSGEALYKCAYARELRIDVGGAVTLEDDSGEIVICFVEYMFQKSDGAKMVHGRILQKGSETVLGNAANERDIFLTNDCLEFELKDIKELVSVNLQSMPWGHKYRKENSEAEKIEWAKVEERKKKGLPMEYLCRSLYWPEKGAFFSLPRDKLGLGNG

SEQ ID NO: 117533 - protein, 150 aa, Triticum aestivum
  unsure (1)..(150): unsure at all Xaa locations
  Clone ID: PAT_TA_11951.pep
MGMAMPIPMLPADVGESITADNGSNELSMSSWDDTNSNIMFFVPGSKKAKVLIDGDNGMVTNFSKIKSQFGLSSTSLDMPGMDGYLQPQQDFVACIVLXKRVCTTHPXSITKRQRRTRISKRLRRLQDLVPNMDKLFSGRSRAMQLLETC

SEQ ID NO: 117534 - protein, 165 aa, Triticum aestivum
  unsure (1)..(165): unsure at all Xaa locations
  Clone ID: PAT_TA_11952.pep
LIHIFVHFILTQMDMDQQRYYYYNMLKRRTLCVIVLLLALWYRSRDGRKFRGKGRKYGPLVQRDIYRTNVLIRLFDTSDATCIKQLRMTXAVFYKLCNRLRQKELLSDTFHVSVEEQVAMFLYMVGQHHTNSSVGFWFWRSSETVSRYFNIVLRAMGELARXLIY

SEQ ID NO: 117535 - protein, 236 aa, Triticum aestivum
  Clone ID: PAT_TA_11953.pep
PRPAGGAPASSPPPHLPRRRRGAGPPPAAVGAPPAAAGAPRPPPLAAPPRAISARLPLHRPAPVLADPDGVPLRCLPTLVNPPTWVLLTCDPALGVPCAGLRVAAFFGTCVPRLGLRNAALFRALVPQLGRRTIPRDLGLLTNFITGALPCDLGNLTNLISLDLYLNNFTGPIPDSLGNLLKLRFLRLNNNSLSGTIPKSLTAITALQVLDLSNNKLSGEVPSTGSFSLFTPISFG

SEQ ID NO: 117536 - protein, 212 aa, Triticum aestivum
  Clone ID: PAT_TA_11954.pep
ATTLLLCLEADAKSGSYVFTLGSGRPPRRIRGPDAKELMNFHGSVLFHGSLHWHTDNLIMVFDTTTESFRQMRTPIVSGHVIAGLFEMGDMLGTFSLNDEETIVDIWVMQDYQGQVWASKGRVEFPIEELMAQSEDLGSCWLVEATYWDGDLLVLAKFDNGSLHQVDIDGKLVDSLGHRLLYPTPLRLKQSLVPHTFFPALEGYVVNASSFI

SEQ ID NO: 117537 - protein, 185 aa, Triticum aestivum
  unsure (1)..(185): unsure at all Xaa locations
  Clone ID: PAT_TA_11955.pep
APPAPLPAPPRCPTPPLRPRTPSCHLPARANAGPLILAPDRPPPPTTGSRLPRSAVMPPVPPCDGSXLDPGPAAPSHLPLGPGRAATGTAVVPPPAPPRPPACPRPPLXPPPARPLPCPPRAAPPAAAXAARPAPPPASPAPVGQPAVVPHPHNNADVRVGPRSATAAPPSWRSFRTVRESSSGN

SEQ ID NO: 117538 - protein, 448 aa, Triticum aestivum
  unsure (1)..(448): unsure at all Xaa locations
  Clone ID: PAT_TA_11956.pep
IRHEALGFYCYKRKQKPSGRVQSPHAMVIHPRHSGSDPDMVKITVAGGNANGGAATSEPYSQASSAPRDIHVGEAGNRLISLEVLRIVPNNFSQENILGRGGFGTVYKGELHDGTKIAGTRVDSRAWGYQAPGVLGSGVSVLTKVRHRNLVSLLGYCLDGNERILVYEYMPQGPVSQHLFEWKEHNLQPLEWKRLPSIAVNVAXGRPKFRRQLRQTLIHKDFXHQIYLLGDDMKAQVADFGLVRPAPADGKCVTREPNAASRVGXFLHLRAVKIRVACKADVFSFGVILMELVTGRRALDDTQPEDSMHLVTWFRRMQLNXDTFXKAIDTSMELDEETLASVSTVAQLAGHCCAREPHQXRPDMGHAVNVLSTLSEVWKPADPDSDDSYGIDLDMTLPQALKKWQAFEDSSHFDGATSSFLASLDNTQTSIPTRPPGFADSFTSADGR

SEQ ID NO: 117539 - protein, 104 aa, Triticum aestivum
  Clone ID: PAT_TA_11957.pep
MSLRLPLPQGLSFFKSVGWFEDSKVDSAAKQQLSPKFKLQTDKEVYRPGDSVTATIEICSPASLKDEVGAASGGDVTSLLIDGLSFELKGIEKLDSQWFSVPKP

SEQ ID NO: 117540 - protein, 200 aa, Triticum aestivum
  Clone ID: PAT_TA_11958.pep
MSAVNITNVAVLDNPTAFLNPFQFEISYECLVPLDDDLEWKLTYVGSAEDETYDQQLESVLVGPVNVGTYRFVFQADPPDPLKIREEDIIGVTVLLLTCSYVGQEFMRVGYYVNNDYDEEQLREEPPAKLLLDRVQRNILADKPRVTKFPINFHPEPGTSSEQPQQDAEQQQQPTSPEPQTAPVEPHMAPLENVPIAADQ

SEQ ID NO: 117541 - protein, 171 aa, Triticum aestivum
  Clone ID: PAT_TA_11959.pep
TQCISLLIRRLCASAAVRRHRRPRSTSVRTCSLHPDIDFSAPHSRHMEEIIPVGREHVSPQTPLTEVISTSETTSGVDELCAGDFYNLRGVDDDTKASKKRQLRMREERIQNRRLKKQRKRREAQETVERALKLREELRQNRLDFEASVKGREDEFYYTPRWRRAVPVDKV

SEQ ID NO: 117542 - protein, 67 aa, Triticum aestivum
  Clone ID: PAT_TA_11960.pep
KMGRLAYWRNSLVVRVLTLLRIAPKGVVKVHEMLYETAQHLTLGGETGIFSPMHMVVLRKPVADAAE

SEQ ID NO: 117543 - protein, 277 aa, Triticum aestivum
  Clone ID: PAT_TA_11961.pep
MEPATMAWTAGLLGAGLVYWFVWVMGAAEVKGKRAVDLKMGSITRDKVQDKYTQYWSFFRRPKETATTQASADKVPAFVDTFYNLVTDIYEWGWGQSFHFSPSLPGRSHRDATRVHEERVADLLGAEPGHRVLDVGCGVGGPMRAIAAHSGARVVGITINEYQVNRARAHNRKAGLDAQCEVVCGNFMAMPFDDASFDGAYSIEATCHAPRLQDVYGEVYRVLKPGRLYVSYEWVTTPLYRADDPAHVEAIHGIERGDALPGLRRQDEIASIAPEVG

SEQ ID NO: 117544 - protein, 231 aa, Triticum aestivum
  Clone ID: PAT_TA_11962.pep
MMRSVGGGFLFSVSIFGGALDRMQAGFRFVSALIRPCIDQPPFPFLSRALSACTRKAGWCAATSWPCRSITGPSNAPRLQDVYGEVYRVLKPGRLYVSYEWVTTPLYPSDYPAHVEASHGVEDARRRHPRHRPDEIASIAQEVGFEVVQELDLALPPSLPWWTRLKMGRLAYWRNSLVVRVLTLLRIAPKGVVEVHEMLYETAQHLTLGGETGIFSPMHMVVLRKPAAAAE

SEQ ID NO: 117545 - protein, 42 aa, Triticum aestivum
  unsure (1)..(42): unsure at all Xaa locations
  Clone ID: PAT_TA_11963.pep
FFLWERMVPNXSHSPAYWYALFCLSNLAEHSDAHTRAYTHHP

SEQ ID NO: 117546 - protein, 108 aa, Triticum aestivum
  Clone ID: PAT_TA_11964.pep
YMSTHFVRAICSGRSSLKLIRRHLLFHGYCCRSRMTRRQLMYQVQVISNRCDDFEVFWSIWLSIVFWTSQLNCNRESYVFSRPFGAQVLWSRNLVLMDVTQLFGPSSV

SEQ ID NO: 117547 - protein, 190 aa, Triticum aestivum
  Clone ID: PAT_TA_11965.pep
VRLTPAAHLAPNEPYACPDSQPPARTAQFAAPAYYVTTTGHLYQASYQAYGPSPATYHYAQAPPLQLVYLQAQHPVRKHVTDPACSSDPNYDANGNDPYRYDAVKSHYQETTSGRAAAPHEVAATNLQLVMHYGYAPGSEGATRETTQSSAEGAASAIYSHAGAPATTQALPHMTWPAETSHVSCTMGTP

SEQ ID NO: 117548 - protein, 65 aa, Triticum aestivum
  Clone ID: PAT_TA_11966.pep
LIIHSIPHPHQRMANTIPPQNVAYEHTNAHTQAKTPCICAASHVMIHQPSYGPKANTHTTAPNGS

SEQ ID NO: 117549 - protein, 175 aa, Triticum aestivum
  Clone ID: PAT_TA_11967.pep
MSMLKCFPHGLAMPAQATWCRGRAAARAGRWACKVTSTANFEDTVTGMAAQEQAEAEVVRSLGLSGWVEEQLLPLLTPVDDAWQPSDLLPCFSPSAAGLSAEQQPSMMMTTEELQAQASGVPDDVLVCLVGNMVTEEALPTYMCMGNRVPGYRDDTGCSDLPWARWLRGWMAEEN

SEQ ID NO: 117550 - protein, 158 aa, Triticum aestivum
  Clone ID: PAT_TA_11968.pep
FFFLMNTFAPPLSIDPSLFRTTPSLIITNFLTIQSNLCPLDTRTAAPATGSEKMTSQISKSPRQIDTHARTHASVLLPSDRERRRHCCPAAFCASTALPISSSYRPGGGRSLRPTSPGSRWPPRGGRWTRPAGRTRWCPTASRPPRSSRCSSSSRPPC

SEQ ID NO: 117551 - protein, 227 aa, Triticum aestivum
  unsure (1)..(227): unsure at all Xaa locations
  Clone ID: PAT_TA_11969.pep
MTHMFPNGGASSSSTSVSSQRSETDDDKMIAGALVGLSALPAPARASRPALVSPTPRVPRFMPCFHMYYSHSSXLMRIFCRLNAYGLFEVRVSGDGNCQFRALSDQLYRSPEYHKHVRKEIVKQLKACNSLYEGHVPMKYKHYCKKMKKSGEWGDHVTLQAAADKFAAKICLLTSFRDTCFVEIVPQYQAPQRELWLSFWSEIHYNSLYDARDLPSKYKPRKKHWLF

SEQ ID NO: 117552 - protein, 218 aa, Triticum aestivum
  unsure (1)..(218): unsure at all Xaa locations
  Clone ID: PAT_TA_11970.pep
CRFGTRPSKVVDWLLNAARHEIDKLPPLQFPPHQVDLMDHMMTSSSMPLMPHVDDKFCHFASTLARDGGVKAGADADGGGAHHNMGRFGYHRFMGLNNNSLGLVNSGMPYNFTGEXSWNNXSVDQXQAGAGSPQVSIACRPPAGSTTPEFPVVYSPXAPXXXNKLGLXXXREADSSSKFDDLGXSQSLSLSXARAFHXXTGKLAANLACLYNAWIRYA

SEQ ID NO: 117553 - protein, 70 aa, Triticum aestivum
  Clone ID: PAT_TA_11971.pep
VKYQRYKHREKRGIEIVGQWIRFLAWNPLIKDFICAQYNHSRSAGERILTSILTKKAISDKKLGKPLQIV

SEQ ID NO: 117554 - protein, 252 aa, Triticum aestivum
  Clone ID: PAT_TA_11972.pep
FLCPPVPKTAAGGGGGGGGETADGEMATAGSSRGSSGEFVLSEELYQAGVSVHESMRWIQVQEDKMAEISAIRNNLLGLKSDALELFEKISRQANSETQKRLCAMQKTHGVKSLETQSKIGDDGEMETRCEESKRRSAASLELEDLLHRAALQTQMWIGEGAESEELLDLAAKETQGRIVGQVHSLSSLPKFVSEVMLKFGQVAGDISMVLEAQQTRKEALAVLSFGFRLQLLSKQIDELWREMCTLLRSFS

SEQ ID NO: 117555 - protein, 600 aa, Triticum aestivum
  Clone ID: PAT_TA_11973.pep
MSKLANQPPPPSSDMDVDSAAAVEEKNPVRFSINVLELMREAQMQHGLRHGDYTRYRRYCTARLRRLYKSLKFLHGRGKYTRRNITESTVTDVRFLHVVFYTAERAWSHAMEKKTAGPNAPQRIYMLGRFRKAVKWAALFSQLCSIKGDSRTSLEAEAYASYMKGTLLFEQEKNIEAAMLNFKNTRTVYEELGKYGGIENQLLCRQRIEEVEPMIGFCSRKLGGSALQEHDLLDMEKEGPAYDLFKAKIEAVLSETRSQQAASMTEFNWLGRRFPITSAKTRVSILKAQQLERDLNGAATEPISADKKLAIFDKLFSAYHEARSCIRNDLASAGSAENIRDELNGLDKAVSAVLGLRTIERNQLLVSIAKSKFAKHRDEKNEKITKPEELVRLYDLLIQNTTDLTDLVSSGRDKNEEENAFVREYELKDLAFRAERCFYLAKSYSSVSKRAEAYALFSYAHSLADSALQELANSPHKTLIQDLEALSFNCRSNSCIEHATGIMEDESAPERLSKGVSTISLGDDKRKDTKYLLDILGSYESALGEQSAKAPCRISQFPPPFQSVPCNPIVLDMAYNTIEFPNLENRMKKEKKGLLRRFWG

SEQ ID NO: 117556 - protein, 35 aa, Triticum aestivum
  Clone ID: PAT_TA_11974.pep
TPRLIIVTCSQVTLAHSSIMIQYQNRSYSMKEATA

SEQ ID NO: 117557 - protein, 288 aa, Triticum aestivum
  Clone ID: PAT_TA_11975.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPEKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLL

SEQ ID NO: 117558 - protein, 140 aa, Triticum aestivum
  Clone ID: PAT_TA_11976.pep
IANSLKRLAHGEEWLALLTFLIPIFSRDVALRGGGLAQARGGGVVRHQSGSNRRLGFGRGRWRRGRLVRDGGEGSRGNWGGNRKAKDCLGDWRGDGETNRGGGLAGDQKGGRIARRKGGEEGNFGGLKRRGGETNCRTRR

SEQ ID NO: 117559 - protein, 273 aa, Triticum aestivum
  Clone ID: PAT_TA_11977.pep
MAARALGLAGRALLRPLSSPGAQRLLSTDKSPLQGLANAGDPMSRLIMQARNQTGGGFSPHFAENGFTAGGGRMGGNVFTAGDGRMGGNGFTAGDGRMGGVGFTVGDSRMGGIGFTAGGARMGGNGFTAGGRSGRFNMEMLRPAGAPRVKRDVLHVTLKGKKTFVTVTDVKGNRKAGASAGCLEDRKGRSRLARYAGEATGEHMGRVASKIGLKSVVVKVKGYSFFRKKKKVIMGFADGFRGERVRTPSPIMYVHDVTQLAHNGCRLPKKVRK

SEQ ID NO: 117560 - protein, 185 aa, Triticum aestivum
  Clone ID: PAT_TA_11978.pep
MEWAPEVRALGLAGRALLRPVASAGTQRLLSTDKDSLQGLTNGDPVSRLMQTRKQNDSIYRRFAENDFTGGGSRSGRLNMEITWTAALRVKIDVLRITPKEKKTFVTVKDVKENRKARASAGCLEDRKGRSRLARYAGEATGEHMGRSASKIGLKSIVVKVKGSSFLGMKKKAHLSCRAAKKVRK

SEQ ID NO: 117561 - protein, 181 aa, Triticum aestivum
  Clone ID: PAT_TA_11979.pep
FAPWTPAFGRCPPSGAPFLVPNRNMTPEAALDHVRSIRPRVLLAPSQWQAVIVFSTLTPGRLPSGSTNLNCYLEGTKASIPDSDIEDCTVEFDYDDSGLPLCQVMVPRPSSPTGCVDAVFITEADLEGYDAYVDTGKDVVSFEVVASRKPIMRRLSCLFGSLKVTSNCEPAPNRFTEVRAC

SEQ ID NO: 117562 - protein, 160 aa, Triticum aestivum
  Clone ID: PAT_TA_11980.pep
PHLSFPQPPHSPSTWSSRYKQHRCLPMLPPRIPHPRRCHRPRIPHPCHRLRIPHPRHRRRSTANLEATSANRLAISPPSTAHNRYCGSRFVHHSRCAGGVSLALPAVQISLPMVCPRHRGLSYRSGAHHLSIILLSSACVCTLLPLLPFCSSVMQTEWFK

SEQ ID NO: 117563 - protein, 88 aa, Triticum aestivum
  Clone ID: PAT_TA_11981.pep
MIPMGRYPSLKREKRVRFAGIEERNLEDPYGIPKCIAALEGLPDLQMEDVLKAADLFTDNKGNREVFLSFSSNALRLGWVRRKIQNAS

SEQ ID NO: 117564 - protein, 113 aa, Triticum aestivum
  Clone ID: PAT_TA_11982.pep
FGTRGEQELRHVRELAEPAVVCQAAGVQQVVRLVVEEPAVLGVVGRRRPAGATGGWLYRGVSADSVAVAGSTGADDGPNAACSLQFRVCFFLEKCIDPKCSTDDQLETNPYFV

SEQ ID NO: 117565 - protein, 246 aa, Triticum aestivum
  Clone ID: PAT_TA_11983.pep
GPGLFHILASRPGGPPRVRLTGLGASMEALEATGKRLSDFAHTLGLPFEFYPVAGKAGNLDPEKLGVDTRRREAVAVHWLHHSLYDVTGNDSNTLNLIQRLAPKVVTMVEQDLSHSGSFLARFVEAIHYYSALFDSLDASYSEDSSERHVVEQQLLAREIRNVLAVGGPARTGDIKFGNWREKLAQSGFRAASLAGSAAAQASLLLGMFPSDGYTLVEENGTLKLGWKDLCLLTASAWRPFQALGR

SEQ ID NO: 117566 - protein, 118 aa, Triticum aestivum
  unsure (1)..(118): unsure at all Xaa locations
  Clone ID: PAT_TA_11984.pep
MDSNMKELQEALVDIETDAEQLLLARXELVQNDKXRNANRXRALTSPSGKXKPRTTQKVVVPSPFDIVMKEMEGTSGKQLVKEICSTCGNHDPKEHTWLMFPGSDIFARVPFHATHTI

SEQ ID NO: 117567 - protein, 88 aa, Triticum aestivum
  Clone ID: PAT_TA_11985.pep
PALAESGSHLAATLTLPYLSSVERSHGLLHLINENILGKCFRSCSSFINPRISPLTMKYECPRLSLLIITPIPKANTIGPESYDVIPC

SEQ ID NO: 117568 - protein, 131 aa, Triticum aestivum
  Clone ID: PAT_TA_11986.pep
VRGRVGGGKGSGGLGWQDNGSGNAAPATGGGVVRAAATPGSAWCVANAMAGEARLQAALDYACGPGDADCKGIQPGAACFEPNTMVAHASYAFNDYYQRKGRSIGTCDFAGAAYVVNQAPKMGKCELPSTV

SEQ ID NO: 117569 - protein, 85 aa, Triticum aestivum
  Clone ID: PAT_TA_11987.pep
AIHFILLMNFTMGKTKSFFASEALDLPETKKLLSNKFVFSYNSNYFLLLSGPVLREIICFIGSIKLLGSGLHTTCKLHGHQYVIF

SEQ ID NO: 117570 - protein, 191 aa, Triticum aestivum
  unsure (1)..(191): unsure at all Xaa locations
  Clone ID: PAT_TA_11988.pep
PGRPWQRGLAARGRPWGSVGWFRAEALPGGAGGPPRREPMAPPYNVLITGSTKGIGIRAGKXFLKAGDNVVICSRSAERVESVANDLKKEFGEQHVWGTVCDVREGKDVKALVDFARDKPEYIDIWINNAGSNAYSYKPLVETSDEALIEVITTNTLGLMLCCREAINMMWNQPRGGHIFNIDGAGSDGRX

SEQ ID NO: 117571 - protein, 236 aa, Triticum aestivum
  Clone ID: PAT_TA_11989.pep
MARRTSIEALIRRLRLHQAPPSPYSGDPSTAATPAAANLFQPRRAAVLVCLFHDAAGELRVLLTKRASSLSTHSGEVALPGGKAEEGDADDAATALREAKEEIGLDPTLVTVVSSLEHFLSKHLLVVVPVVGILSDIQAFKPVLNVDEVDDIFDVPLEMFLKDERRRSEEREWMGQAFTLHHFDYEKGDKTYVIWGLTAGILIHAASVVYQRPPDFAERRVQFNLPKCSKEPSPMP

SEQ ID NO: 117572 - protein, 250 aa, Triticum aestivum
  Clone ID: PAT_TA_11990.pep
MTSTAAAASAAAAINYVSSYALSPHAAPFNPPSRPACAPFQYRQNGDVSRSAGASSVGYAEEKTSRDTHSASPIACALMKSSGAVYPPSTHAMHTGQPSSWSAVCLDAYPSSPYVRITSNYKQQNSLTSGNGSKCSTVRIERPPNKTSETNKNSCGSGSKLVIAENPKSNKDSEKETSSRSLQFNGPADGKDNSQGTMFSSSGQKNMFSSKEANPVFSASPLHIPTTCADPCGVLAEDVMPDPSECSVDS

SEQ ID NO: 117573 - protein, 141 aa, Triticum aestivum
  unsure (1)..(141): unsure at all Xaa locations
  Clone ID: PAT_TA_11991.pep
CRXFGTRSISANRAVARQTEHHFFRKEDTKSSNPAPPVPLLPVKVEVSELDDHRPVLKANLQFVVPSTAQTRLVSCLDTINSLLLQFHHYYYFTTTFMSVCFSILWYKTSIHHTIPSYLSAFEGCYGTYAKIAVSLDVVQS

SEQ ID NO: 117574 - protein, 383 aa, Triticum aestivum
  unsure (1)..(383): unsure at all Xaa locations
  Clone ID: PAT_TA_11992.pep
FGITVRCPTCMVAIAVAQPQHXXQVVSCSKCRYQYELFSXDVTSIESEEVCMDMSAFEKALQFINVMKDDLPAAVHSIVIRTPSGTARTHRFATKTVELPAQGGERVTISLAAPANAYRQMGPLKIAARSKGFSPGEPMCLTNHVSGEISKLLRVPSKNAGPLFLSPYLVVGAVALLASGDAVSAFIDPSLPRLITATVIASAAVGTTLNQVILPETRKLPQKAVDIVAVQQKLLSQYDMLQSRLKDLKRLVEKENYSIXVWMLARMCQLENKILAVGEPSYRARRGRVKRVRKSLETTLLAKIELMESYAKLCSMIEIEVEMDSDVIVAEAATGAERISEQIEQLMEIDSLEEQWRIQAEANDEAERLLGSDSLEALSAERV

SEQ ID NO: 117575 - protein, 395 aa, Triticum aestivum
  Clone ID: PAT_TA_11993.pep
IRHEERSVAEALMSAGQVPPDLPSRTAIQQYLQSKNRLLILGFNSTLTEPVESSGRRGGDQIKEMELKLHPDLKGPLRALCEDESTTVIVLSGSDRSVLDENFGEFNLWLAAEHGMFLRPTDGEWMTTMPEHLNMDWVDSVKHVFEYFTERTPRSHFEHRETSFVWNYKYADVEFGRLQARDMLQHLWTGPISNAAVDVVQGSRSVEVRSVGVTKGAAIDRILGEIVHSKSMVTPIDYVLCIGHFLGKDEDIYVFFDPEYPSEPKVKPDGASVSVDRRQNGRPSNGRSNSRNSQARIQKPQVAPPPPERSSSSSDHSTANNNSHHDWREGSSVLDLNGDNYFSCAVGRKRSNARYLLNSSEDVVSFLKEMAESTTPRAGGLPPGAAADYMFLDRQ

SEQ ID NO: 117576 - protein, 247 aa, Triticum aestivum
  unsure (1)..(247): unsure at all Xaa locations
  Clone ID: PAT_TA_11994.pep
MRSCYSSSSLCGISRAAWRHAVAGTLTLSGIRNQHHHQHSLRYLPLRPPVPPIALGLAERFFSSSSPKRSTKRSAAKKGTPPPMDSAGGDPFYVVRKGDVIGIYKNLADCQAQVSNSVCDPSVTVYKGYSLRKDTEEYLAARGLKNALYSINAADARDELFDDLAPCPFQQPDGTSTLKRPXETETGPSKKHPKVAEQELLPDSHLSCILEFDGACKGNPGKSCAGVVLRXSDGSVXAQLRXVWVNE

SEQ ID NO: 117577 - protein, 65 aa, Triticum aestivum
  Clone ID: PAT_TA_11995.pep
AILDRRMVKKGNTSIIQVRVQWSSLSPDSATWEDYTVLRHRYPTARCWDDAASAQGGAIVTPAPT

SEQ ID NO: 117578 - protein, 117 aa, Triticum aestivum
  unsure (1)..(117): unsure at all Xaa locations
  Clone ID: PAT_TA_11996.pep
TIGCDSVFVDIEYIDSENHTELPDVDTXLSGLLAELDSKNWVKSFEDLNTVRQLAIXHKQRVPELLEPLLPLIVKSVKNPRSALCKTALMTCADIFKAYGEQMVDLIHQLLKKSLCL

SEQ ID NO: 117579 - protein, 255 aa, Triticum aestivum
  unsure (1)..(255): unsure at all Xaa locations
  Clone ID: PAT_TA_11997.pep
QGVVTELVKLSQKMEEVRKLGAVELLHAMALDDADVREEAIGMGVIQSLLQLIYPDLPLSYKAREVALAAIWFFCFSSASSIDDLTSSDVLGWLLHYLNNGRLXVLDCTLKILRHLAEASEEYSRMMARAGYFAALAGLLAAKSFRVREMAAQVLSSLLALHGNRVIFMQDGDNLDRLLQLLNPSEGKLMAKGLILSAVTSLAETGAGRKKIVSSEHFGSLKELADSGDPDAKKVVKKIANSSRLQSMFSKIWSA

SEQ ID NO: 117580 - protein, 169 aa, Triticum aestivum
  Clone ID: PAT_TA_11998.pep
VSTGTKVEDELRMVCNEILSIIAIHCLPLANAGENVVFFHKMKGDYYRYLAEFSTGVEKKSAADQSLMAYQHAMVVASTELSPAHPIRLGLALNFSVFFYDIMNCHQRACQVAKQAFDEATTEINSAGMDGNNDSTLMMQLLNDNLALWKSELTEGETSKDSDIDMEEG

SEQ ID NO: 117581 - protein, 133 aa, Triticum aestivum
  unsure (1)..(133): unsure at all Xaa locations
  Clone ID: PAT_TA_11999.pep
VAVLASAGAALLASVAWQPSSAESPAAGLASPGVHWGGFCSPGLPRRLSPLPPTRSPALSVLLPAPLASSPRPARELGATVVGMRPAARRFLXEHRLSFYFLVIISSYFEPGSPLPLAHLPLVNAVQRNVLCF

SEQ ID NO: 117582 - protein, 230 aa, Triticum aestivum
  Clone ID: PAT_TA_12000.pep
MMSDTSNAESGSDVDDFGSSVIPKGAEYGCLTPVHEESSLETSLETGRRLRRTTETVPKQLADNRQFSTNGSPRDLGSNVGNLDGSIVRWGFENLVKVVTALIKLFSFFKLFISSRALRRLENAGPSTVPVPAAEKPQPRTIGADEMSACLQRIENLESVCNHLASKPPEMPEDKEQQLLNSFERIRSIEADLERTKRALHATVAKQNSLAETLEAVQESSRVKRRLFCS

SEQ ID NO: 117583 - protein, 218 aa, Triticum aestivum
  Clone ID: PAT_TA_12001.pep
PRVRRWHTRRASRGGAPKPRSWTPRRRRSRNSAARTRMRAALHCPGGASARRASISRRPTPTSACLLSRTSPQMIRQRSRRPPELLTRMRGRASGRHQRRSSSTRRRPRWAGSAAVTPPSRRRRRRRPPPRTVQRRMLLRRIRKRRMFLTRRRGAERRRSRSRMEPPQKALLSTRGRRWTKPPQKQLLGLPLPPPLALALAWLSRPPFLSGRCVPRVP

SEQ ID NO: 117584 - protein, 194 aa, Triticum aestivum
  unsure (1)..(194): unsure at all Xaa locations
  Clone ID: PAT_TA_12002.pep
RRRSSQCCPPAAAVSASSPSPSLSATSLRPRPPPPPPPPTLPLPTPLCSTSNPPARSPPPPPPALRTPSASPPXESTAQADXSSTSSAGMASPTPRYPPPSASSPSSWSPTPSRHSSPSSTSSPPSASTRRSSPGSSPSAPLSSTGASRTTSPRSSNLSASSSAPMPASSPRSARCRSLSAAAPTVPSTSCSPH

SEQ ID NO: 117585 - protein, 85 aa, Triticum aestivum
  Clone ID: PAT_TA_12003.pep
KQMNASYIISVARKLGCSIFLLPEDITEVNQKMMLTLTASIMYWHLKRPTSYSLDPDNSSLCETSSISTSDDSASESSIDDSGTR

SEQ ID NO: 117586 - protein, 108 aa, Triticum aestivum
  Clone ID: PAT_TA_12004.pep
RTPPPGRKQLATTAARKSAPATGGVKKPHRFRPGTVALREIRKYQKSTELLIRKLPFQRLVREIAQDFKTDLRFQSSAVSALQEAAEAYLVGMFEDIQLARRIRGERA

SEQ ID NO: 117587 - protein, 90 aa, Triticum aestivum
  Clone ID: PAT_TA_12005.pep
RNSDEPGDSGEHRVREIGSAGDQPQEAAPRYPVLQCADPGPEASPRYVSEGCASGSGFSLALREFFGFSPPHELRGGLSKVDESHTLLTR

SEQ ID NO: 117588 - protein, 240 aa, Triticum aestivum
  Clone ID: PAT_TA_12006.pep
TGPEFPGRPRVRQVLALEDNSFSGEVPAALGGLRRLRHVGLGGNSFAGQIPAALGNLSWLETLSVPKNRLTGGLPNELFLLGNLTVLDLSDNKLAGEIPPAIGSLPALQSLNLSGNAFSGRIPSTIGSLLNLRVLDLSGQKNLSGNLPAELFGLPQLQHVSLADNSFSGDVPEGFSSLWSLRHLNISVNSFSGPIPATYGYMASLQVLSASHNRISGEVPAELANCSNLTVLDLSGNHLT

SEQ ID NO: 117589 - protein, 81 aa, Triticum aestivum
  Clone ID: PAT_TA_12007.pep
PILKTGSLSIQKPRPSIATAIILSLTGSANPIDDNPSMQQGGPYVYVLIVAIDYRCPMTTASTVVFQAQGCESSYMSSRGA

SEQ ID NO: 117590 - protein, 141 aa, Triticum aestivum
  Clone ID: PAT_TA_12008.pep
VWTEPPYIAATKWLKPLNCFLQTLGHSKCGQPVNNANACHTEKRTPWFRKLQQRSKNQHECEKMIYAFVQEIKTSVIMRITICLEASEYAVFVSKCKSQFCKPTRDRQVNKRRITKHGNSLELTLEEVEIYSDSKLGTVLH

SEQ ID NO: 117591 - protein, 253 aa, Triticum aestivum
  unsure (1)..(253): unsure at all Xaa locations
  Clone ID: PAT_TA_12009.pep
MLDARYKLWPCVFVLCDFGRYPHRVANIDKDVIAPYRHVVDNFFNDSTGYHDRPTLLYFQGAIYRKGGGFIRQXLYYLLXDEKDVHFSFGSVAGNGIEESTRGMRASKFCLNIAGDTPSSNRLFDSIVSHCVPVIISDEIELPFEDILDYSKFCIIVRGADAVKKGFLINLIKGISPEEWTSMWNKLREVEGHFEYQYPSQPDDAVQMIWKTIARKVPSIRLKVNRLQRFSRSEANKTNDSPARSSWLENQAR

SEQ ID NO: 117592 - protein, 106 aa, Triticum aestivum
  Clone ID: PAT_TA_12010.pep
GVRSRSRKEGRSRRGETWRGRRPGRRRTASHLSIQITIILDPLIQKPQPILILTRRLSGLHSRLADCPVPVVGAFSPLDSLIRLTAGPSTSSLSWLLLSVVTFSPP

SEQ ID NO: 117593 - protein, 393 aa, Triticum aestivum
  unsure (1)..(393): unsure at all Xaa locations
  Clone ID: PAT_TA_12011.pep
HEAALKDDVWRLEKVGKDGAFHXKLNGSGIYTVEDFLRLLVRDRQRLRSILGSGMSNKMWESLVEHAKTCVLGGKHYIYYVNDSRNVGAIFNNIYEFTGLIADDQFISAENLTDNQKVYADTLVKKAYEDWMHAVEYDGKALIGFKQKKKSVTTRSDTASASTSKPALYGFVNAQKQLLPGKAGQTSTDTPSEAGVRSTYNGNLAARNTVSPQXNAANITMQYERGALSPESQFSGSSLQTQTSXGSNILALEPAQQQQQGFEFSAVGQSMQPADLDPFDQWSQPQENRAVDDYLMEEIRLRSHEILENDEMQQMLRILNMGGASTNMNDDGFTFPPYMQSPSPNFNFEVDRTRPPGKAVVGWLKIKAAMRWGIFVRKKAAERRAQLVELDDD

SEQ ID NO: 117594 - protein, 191 aa, Triticum aestivum
  unsure (1)..(191): unsure at all Xaa locations
  Clone ID: PAT_TA_12012.pep
MAEAARAGATPPHRGLPDEIFIWEILVRLPPKSLLRCRAVCRGWRSATYTRGFLLAHHARQPTLPILXATSSSDDEDEAECLDIIPFXTGAGLPAAEQIQSAARLAQASHLFLEASCDGLLVVXREASAQFAICNPGDSVSMLPLSAGFSDXTVLWAMYPYPPTGGYRLLTYPCRKSTLTSQVDCYVFALG

SEQ ID NO: 117595 - protein, 174 aa, Triticum aestivum
  unsure (1)..(174): unsure at all Xaa locations
  Clone ID: PAT_TA_12013.pep
MEGGGEVGWYVLGPSQEHVGPYALSELRDHFANGYLNESTMLWAEGRSEWTPLSSIPELHSGVTKKDQPEQETEDDFEKFQKEVIEAESEVEALKAKAADGDLSKEHVIDDPDERPASPPDGVEEFTDDDGTIYKWXDRTLRAMVPQNDVSGWKWTTMERMTYHVKRMTMNFET

SEQ ID NO: 117596 - protein, 104 aa, Triticum aestivum
  Clone ID: PAT_TA_12014.pep
HLQKFAWRRSGTLGYIRPTRQRDGGHALKWEAELASPNDDGFDLKWKWEAKSKPCAAGKVETKWGAEEANKDDNNPARKCVQIKEISTGCDVQIEVLDRNLKLL

SEQ ID NO: 117597 - protein, 127 aa, Triticum aestivum
  Clone ID: PAT_TA_12015.pep
MVPFFGSAFRLLLLPPSRCAWSAVTTFGPTTHGHFTDKLLHQAQRDGGHALKWEAELASPNDDGFDLKWKWEAKSKPCAAGKVETKWGAEEANKDDNNPARKCVQIKEISTGCDVQIEVLDRNLKLL

SEQ ID NO: 117598 - protein, 104 aa, Triticum aestivum
  Clone ID: PAT_TA_12016.pep
LQDQRRRPLGGRGGAEASSCRSVAAEFIKKATPRRLTRRIKGCPARAIQAIRVYRSVVDSLGLGRPFLWWSSLRSFSQTAGGDTTGVLRHCYRPCLLAAASVNR

SEQ ID NO: 117599 - protein, 180 aa, Triticum aestivum
  Clone ID: PAT_TA_12017.pep
DLQELVLIGVNPTVQSLRMLGEHCRALERLALCGCETVGDTEIICLAERCAALKKLCIKGCPVTDRGMGALNGGCPSLVKVKLKRCRGVSYECVEHLKMARGGSFSISLDIVLEHDAVAPSENGVQETGQQAQVTELTGQMAAMDLPTNAAGAQSFAQANSRMRSVMSALRRRFGNPPPA

SEQ ID NO: 117600 - protein, 101 aa, Triticum aestivum
  Clone ID: PAT_TA_12018.pep
LCCRHFTDEIFSSCSRLLMWCHLLTSCSLHTRSHRVRNRKCQSVHRVLTRSPRSSCYPVARIPTHNISVHISLTYSCVSFQYPKLKNSSDTYIVWNFAAMP

SEQ ID NO: 117601 - protein, 121 aa, Triticum aestivum
  Clone ID: PAT_TA_12019.pep
EIGRGISPPPARTRRRVVLRLEHLHPVSSFSDLPCLRLELELQSAATRSDPVTPSSLACPSSSPSPSPPPGSVSPEGKAQREHGDGSVGVVVAARERTTATQQASRASLEPRTMVTAPDVL

SEQ ID NO: 117602 - protein, 152 aa, Triticum aestivum
  unsure (1)..(152): unsure at all Xaa locations
  Clone ID: PAT_TA_12020.pep
RLECRGFGTSAVGALLTVYWVNRGXCHFRHKDWARVEEDSRRALLLDDTSIKGHYLLGCALLLEGDCALTVKEFDKVFDHLKSSNXKGQMSEDIXQFLAKAKYQDWEKHSTQRVWKMQSLREACENALPRLHLLLRPSPPSPLIHHTRHALC

SEQ ID NO: 117603 - protein, 135 aa, Triticum aestivum
  Clone ID: PAT_TA_12021.pep
VASDRMKVWGTRSVVDRRRACSGCSSALLLDILGCRCSPVLDLHGCRCAGSRRRRAACWCSSSIRLGVDLGRGCRVSWSSSLANTFTLLLAKRHSFINLLGGIMHHRILDIRPQARCKGNDENCGRTQELVGSRH

SEQ ID NO: 117604 - protein, 282 aa, Triticum aestivum
  unsure (1)..(282): unsure at all Xaa locations
  Clone ID: PAT_TA_12022.pep
ALKKVLRGILKYLGVLWLFAQLRDILKDILGSVLKDNEGALLNLDQEQPALRFFVGGYVFAVSVQRVQLHLQVLNVKRFHHQQQQQQAPQSSAQGELTPSEIHEICDYFSQXVVCEPYDASRIASFIMLLTLPISVIQEFVKLITWNKSLSEAHGDIAAAERARAELCLEKHPRSVSDDYTEPSLLSKSNIQHDRANNSVDFTLTFVLDHNLTPHARTSGGAAWLPFCVSLRLRYTFGDTSHIAYLAMDGSHGGWSCWLQHEDWERCKQSVVKAVKTVNGSP

SEQ ID NO: 117605 - protein, 90 aa, Triticum aestivum
  Clone ID: PAT_TA_12023.pep
SRGRKIWFNSMVAAYTGWKDARNDPVKAVTFGDGSLLPADVIEACGKILEEECVAVPWQQGDILLIDNWAVLHSRRSFEPPRRVLASLCK

SEQ ID NO: 117606 - protein, 329 aa, Triticum aestivum
  unsure (1)..(329): unsure at all Xaa locations
  Clone ID: PAT_TA_12024.pep
MAPVAGSSFFQEARLPEQRAVEGVAFPAVLVPAGGPPGPGEGSLDEFLATVRSERASRVEPLLREAGAVLLRGFPARTAADFDAAVEAFGYEELPYVGGAAPRTNVVGRVFTANESPPDQKIPFHHEMAQVPTFPAKLFFFCEVEPKSGGETPIVLSHYVYKRMKENFPEFVEKLEKHGLIYTRVLGDEXDRGLQSTFLTKDNSVAEKRAVKVGMKLEWTDDGVKTEMGPIPAVKWDESRGRKIWFNSMVAAYTGWKDARNDPSXKAAPFGDGSLLPADVIEACGKILEEECVXAVPWQQGDILLIDNWAVLHSRRSFEPPHGVPFSPL

SEQ ID NO: 117607 - protein, 300 aa, Triticum aestivum
  Clone ID: PAT_TA_12025.pep
MGPAGRLSVAAALLSCLCLHGLLGNSGQAFAQGPPVLHRIDHAEEDDDSGGLMPELSPTGSPQPFVPFLAPAPLAPFYNNSTPKLSGKCSLNFTAINGLMTTTAVDCFASFAPFLANVICCPQLQATLTILIGQSSKQTGSLALDPTLANYCLSDVQQLLMSQGASDDLRSICSVHLSNATEGSCPVSTVDAFESVVDSSKLLEACRKVDPVNECCSQTCQSAISDAARKISSKDAALTSDTASPKVDSCRNVVLRWLSSRLEPSSATKMLRQISNCNVNGVCPLSFPDTIKVAKGVVDS

SEQ ID NO: 117608 - protein, 95 aa, Triticum aestivum
  Clone ID: PAT_TA_12026.pep
MGYFLRNQPSFLFILIILHFGARAARALSSDGEALLAFKKAITNSDGIFLNWHEQDADPCNWKGVKCDGHSKRVIYLILPYHKLVGPIPPEVGRL

SEQ ID NO: 117609 - protein, 217 aa, Triticum aestivum
  Clone ID: PAT_TA_12027.pep
MAGIYRPEPQNPTARRQRLVSILLGAFFAFQLLLFVAFRSSPPSKPAPTASAISSSVPEPPSRGTEDSGCGGGLVYVYDLPAVFNEDLLAMCDTLMPMYSVCPYLANDGLGFPAEGTSLSTAYLQYHWYLPTEDGQEGEWSVFIDRDELRAGNVTVRGVLAAIPEARVRQMKERVVEMIPRLVYSAADKDGLGGGMKDAMDVMIDGMLRRVAEQRRN

SEQ ID NO: 117610 - protein, 59 aa, Triticum aestivum
  Clone ID: PAT_TA_12028.pep
AGTSFYLILTLMHHPDICLILHPPDNISLCKIEALTNVCFSWANMFSCKENSCFLLDMA

SEQ ID NO: 117611 - protein, 164 aa, Triticum aestivum
  Clone ID: PAT_TA_12029.pep
MGREDRFPVWEAALGAGVAAVFAAGLVGVYLSMPDSDYSFLKLPRNLHELQILTGHLENYTSDYTVQVLIGYCAVYIFMQTFMIPATIFMSLLAGALFGQLRGVALVVFAASAGASSCFFLSKLIGKPLVFVLWPDKLTFFQQQVAKRREKLLNYMLFLRVTPT

SEQ ID NO: 117612 - protein, 301 aa, Triticum aestivum
  unsure (1)..(301): unsure at all Xaa locations
  Clone ID: PAT_TA_12030.pep
MKGSRGKLSPPPQISSSFFRSSPRLASPRPDPGRILVKEEEEEEGEGMGREDRFPVWEAALGAGVAAVFAAGLVGVYLYMPDSDYSFLNLPRNLHELQILTGHLENYTSDYTVQVLIGXGAVYIFMQTFMIPGTIFMSLLAGALFGQLRGVALVVFAASAAASSCFFLSKMIGKPKVFVLWPDKLTFIFLQKHVAKRKQMKLNYMLFLRVTPTLPFTFITLASLDVPVPSHSFLTLIGLIPAADATVRVRAALAVRAPLSHLYDTQSVALLFLIGVVSVTPALLSKDEAQDTAPEIAAGAS

SEQ ID NO: 117613 - protein, 163 aa, Triticum aestivum
  Clone ID: PAT_TA_12031.pep
RIRGRVDLRIQRESLTHKRNALKLRREGKTAEADAEFELAKSLESQLEESDSQGSNSGGKSEASDAFVEDLIDPQMMSALKSIGWSAADLSTQSPSPQPLVKAEARPTVAATSKAQTEKSQLEEQIKAEKLKALTLKREGKQAEALEALRSAKRLEKKLVSLS

SEQ ID NO: 117614 - protein, 212 aa, Triticum aestivum
  unsure (1)..(212): unsure at all Xaa locations
  Clone ID: PAT_TA_12032.pep
TVDQETCNRPYLPDGHIHKYNSLSEQPDILRPLYSALQPSSSLEEIRYYDSRLSDQQMALLQYQRENIHYLSEEVLRLQESLSKYHRSVAASTPQVDLTHLLASRDQELRALSAEPTCSPEQDSHTLSLIGQRIPILSPLLGPVRHYVAERSRERTGLRDXGKRASRGERALEAERVSNMELQKTRAKLRRQSTREKIPDIPQSESSSIGVL

SEQ ID NO: 117615 - protein, 215 aa, Triticum aestivum
  Clone ID: PAT_TA_12033.pep
APLPPPSSPNVPTKQHHHFPPFAVAVAVAAVLVLLSPPSAADPNDELCLSSLQESLSLRNWTKSFFTDPCDGFISKLQGVTCNNGRVYKLSLPGLSLAGSIPPELSNCTNLQSLDLSSNALSGAIPTELSKLLNLAVLNLSANALSGAIPRELASCAYLNVIDLHGNQLSGPIPDELGLLVRLSTFDVSYNRLSGPIPVLLANRSIAGGGGAVAA

SEQ ID NO: 117616 - protein, 190 aa, Triticum aestivum
  Clone ID: PAT_TA_12034.pep
MATPRSPSPRGDELLDSAPLLGGGGRRRGALRRPSLRGTARLLRQGGRRAMREPSLLVRETAAEQLEERQADWAYSRPVVALDLLWNLAFILTTAVVLVLSGDESPSVPLRIWVAGYAVQCVLHMVCVAMEYRVRHGQRGGSSTAADEERGTDGSSSSIDDAGESGPHGRTGDFVSVAKHLESANTMFSF

SEQ ID NO: 117617 - protein, 320 aa, Triticum aestivum
  Clone ID: PAT_TA_12035.pep
PRVRRAARTLLASRSSLLSSRALHAAAASPAAAGRWGNAPPPPPTPCPGPSSRAGIAGAVSFSLTFATVAVAEVQAKERLPTDLLPRNVVLYQYQACPFCNKVRAFLDYHDIPYKVVEVNPLSKKEIKWSEYKKVPILTVDGEHLVDSTDIINILQHRISPDDEVTNEEETKWRKWVDEHLVHVLSPNIYRTTSEALESFDYIAKHGNFSFTERFAVKDAGAAAMYFVAKKLKKKYNITDERASLYDAANTWTEALNGRNFLGGSKPNLADLAAFGVLRPIRYLQSGKDMVEHTQIGEWYQRMEDAVGEPSRIPEGQYQE

SEQ ID NO: 117618 - protein, 76 aa, Triticum aestivum
  Clone ID: PAT_TA_12036.pep
NETGGMRMQQCIPTHNLTTTTIPWWLYSMMIRDKSNQSWRPPRRPAAGTLRAVVWCILLLPLHASLASRKHTRAVA

SEQ ID NO: 117619 - protein, 144 aa, Triticum aestivum
  Clone ID: PAT_TA_12037.pep
SPNSWAKRQHLILQSGPSIACKCITQMSRHSSEQSMAMTTSEQRTSRTRCCCCSAVESWAFLPATPSSTRRAPATDALGVNGAAPPRPDPDHLRLVVVRGREHHNGRESLQERRERDGPKKVHSVSHEDGAHGDEQVACVATAL

SEQ ID NO: 117620 - protein, 201 aa, Triticum aestivum
  Clone ID: PAT_TA_12038.pep
MDVDGRGDELAASPRPACGKKRPLSPSTPQNDVADSSKSTTSDEDDNPWALSDDEEEDGYHGKYRPFTVDDFPRVSSDDDEQTVAVYKNPEISTRGPRPLRRFPAFKPESRHSCDMEYQLADESEISFSNVGTVDCSHKGYCRSMDMVQFIDLKIAGYQHARPGCAKIFGFFAARDRVEPLRNYVYRREIENYEAVTVKPK

SEQ ID NO: 117621 - protein, 141 aa, Triticum aestivum
  Clone ID: PAT_TA_12039.pep
ISYSLFDGTCYSDNRSNSRANTCNKPRLLGGAHLLDKRPTSAYVRFKAGSVEPAHHHTFGHDLVVIKGKKKVWNLTKKESYGLVDGDFLFTPAGDVHRVKYLEDTEFFIRWDGHWDIFLDEDLETAHNAIDAQLGVVDSEK

SEQ ID NO: 117622 - protein, 256 aa, Triticum aestivum
  unsure (1)..(256): unsure at all Xaa locations
  Clone ID: PAT_TA_12040.pep
LTVPXRAGAAPSPPTSIEEIKKSEPGAATEENAKPTPPTEVDGAKKMPREEGAAKLTPQAEVDGAKKMSKEEGAVKPPPTPASHQLPSKDGGAGKKETNGAKQPAATRDDGGEKKEAVVGTEPKESTLGKTTRQVAEHVHRMEEAKRRKQIEHMPAPAAKKEEEVKPKAPQPAAAAMTPEKPAPKAEVANGEKAKAAVDRESLAERVSQRGEEERAKAAATADNAVEMARRNKEVVAVGVAAFSIGFLVSQKLFRK

SEQ ID NO: 117623 - protein, 339 aa, Triticum aestivum
  Clone ID: PAT_TA_12041.pep
KAGEFFPGVGVEFCSFEHRVVFQESGANFYAPTPVSLSNELVTVWDPELGRTNPSEHREVKLARSLTRGIIDKDLKPSSNERKSLQRIIKCPPTRTILPDEKQLVWKFRFSLMSEKKALTKFLRSVDWGDSQEAKQAVELMGKWETIDVADALELLSSDFKSEEVRAYAVSVLERADDEELQCYLLQLVQALRFERSDKSRLAHFLVNRALSNIEIASFLRWYVVVELHDHAYAKRYYSTYDMLEDEMMKMVAREDGDEDGFRLWQSLSRQTELTAQLCSIMKDVRNTRGNAEKKIEKLRQLLSGVHSELTHFDEPIRSPLAPTLLLTGVVPQESSIFK

SEQ ID NO: 117624 - protein, 303 aa, Triticum aestivum
  unsure (1)..(303): unsure at all Xaa locations
  Clone ID: PAT_TA_12042.pep
MRAARQFVNVVMRTGTTYSVSRIKPEEKLFYASVEEARAAAAPKKKIPALSRMPAPKLRLEAYXWTTCGSISCPCTGGAAAAXGGDSSSGILSVDSAGHTILCDASSGCVQPAPSLREPKGDSPISFTIARAGGPDPRVAVALYVMDRFPTGRSSCSFESLAYGENSCWEWSRLPPPPYVNDPGLRLHRYPXYTLLNAGSTICISSSXAAPSGPTRWALPFCGRAEHVPELDNLWFGMADSSPNNLCASDLSSLDGGAPRMLREWQVLAPPPGCVLSGGSPPRLGAGRFCINKVFDIGDEGRT

SEQ ID NO: 117625 - protein, 171 aa, Triticum aestivum
  unsure (1)..(171): unsure at all Xaa locations
  Clone ID: PAT_TA_12043.pep
RTRGGPRRXDVYSFGVVLLEVVCGRKPMSFTATDQDQQQKNGGVFRLVEWVWGLYGRGAILESADKLLNGDLDAAEVERVLVVGLWCAHPDPSARPTIREAMAKLHSKVDKLPVLPSKMPVPTYAQPPFGLDMDDGLSTLLTSSTSTSVPPHTTCTTTSSSDGRGSTSTTS

SEQ ID NO: 117626 - protein, 135 aa, Triticum aestivum
  Clone ID: PAT_TA_12044.pep
KINNFRHLAVLQRRPRQTSTVRQPHRTFRSPLSSSRRAPGVMAEHEHRNGRAQRACMRRTGAGAGRESRRAAHHTHAADCTHARATEEGSLPKLHDEGNAKIMQHGIPPNCGNHLPAKINKLNLKRKHQRTTSAL

SEQ ID NO: 117627 - protein, 210 aa, Triticum aestivum
  Clone ID: PAT_TA_12045.pep
MPQSVLVDRATSESLIGPDWSLNLEICDILNHDPSQAKDVVKSIKKRIGHKNSKIQLLALTLLETLIKNCGDFVHMHVAERDILHEMVKIVKKKPDYHVKEKILILIDTWQEAFGGARARYPQYYAAYQELLRAGAVFPQRSESSVPIYTPPQTQPLQNYPPPALRNTDYRQEAPESSSVPEVSTLSVTEIQNASGVMDVLSEMLNAIDP

SEQ ID NO: 117628 - protein, 89 aa, Triticum aestivum
  Clone ID: PAT_TA_12046.pep
GETLSKFSIWSLYITFVLAVARFIRLQCSDLRMRIPYENLPSCDRLLDICEGIYAARAEGELEVEEVLYWTLVNVYRSPHMLLEYTKPD

SEQ ID NO: 117629 - protein, 227 aa, Triticum aestivum
  unsure (1)..(227): unsure at all Xaa locations
  Clone ID: PAT_TA_12047.pep
MDGGGGGGGRPALQPAAAGGGASGPDEPRDARVVRELLRSMGLGEGEYEPRVVHQFLDLAYRYAGDVLGDAQVYADHAGKPQLDADDVRLAIQAKVNFSFSQPPPREVLLEXARSRNKIPLPKSIAPPGSIXPLPPEQDTLLSQNYQLLPALKPPTQTEEAEDEEEGANADAANANPNSSQDQRGNEQQQQQPQSQSQGQRVSFQLNAVAAAAAKRPRMTIDQLNMG

SEQ ID NO: 117630 - protein, 92 aa, Triticum aestivum
  Clone ID: PAT_TA_12048.pep
KIACPKSKPKECVAWLVSGSDNRTTVSHQRKPIPITINSCRPAYSSRHHRRGTGDASPPAPAGPSAVRRAPLPRSPPPSSPRSRRRCCRRTG

SEQ ID NO: 117631 - protein, 102 aa, Triticum aestivum
  Clone ID: PAT_TA_12049.pep
PMGMSFCVGDPAWSPKLRLPRASSLPSVAAHPGKIGCSQGFTGLYSGAANPNVHVGAVVGGPNQNDQFPDQRSDYEHSEPATYINAPLVGALAYLAHSSGQL

SEQ ID NO: 117632 - protein, 100 aa, Triticum aestivum
  unsure (1)..(100): unsure at all Xaa locations
  Clone ID: PAT_TA_12050.pep
WNAYEQMRKSCGLNSGPGRPFNDRRWLLPFLASLLVSVTLFLAAACGLFSPPYLAGDDAFLVDVVSFTDWDDGGSPSQRDSGQSVEPXAKDRLLDXTTNP

SEQ ID NO: 117633 - protein, 57 aa, Triticum aestivum
  Clone ID: PAT_TA_12051.pep
DEQSWCLCLCVGRAIRPTVCIMLSSCLGQCVFSLEKGWWCLYSAILVWMYLPGRPLE

SEQ ID NO: 117634 - protein, 75 aa, Triticum aestivum
  Clone ID: PAT_TA_12052.pep
MKGTKLAAILILQAVLVMGVLSHVNADYFPKCCNNCRSFSGVDVCDDAHPKCPKGCSGVPPWVSDSPEMWRCAGL

SEQ ID NO: 117635 - protein, 140 aa, Triticum aestivum
  Clone ID: PAT_TA_12053.pep
MPPKSKAAAAAAAEPVSVEDLFAALHRHIEAGEFPQAVKVADQVLAASPGDEDAVRCKVVAHIKSDATDKALAAIRAAERLPIDLSYYKAYCYYRQNKLQEALDILNGQEETAAVLQLESQIYYRLRRMNDCMSSYEKLQ

SEQ ID NO: 117636 - protein, 103 aa, Triticum aestivum
  Clone ID: PAT_TA_12054.pep
YNRHLRGEQQQTTLEEEIKTKNNDGDETTTTDNSVYIVGMQGGATGTHKHCDKLAHHLSFILDGTPRLSLKPYNTRNNDIESSVVARGDLWNNRTTSSRSLAI

SEQ ID NO: 117637 - protein, 123 aa, Triticum aestivum
  Clone ID: PAT_TA_12055.pep
VLRSKKFKLLHDDDIIKEPAAHWGREEDIISTGSYPSLAHGIASLSSLLQLMGQGAGWNKHQRPFFAHAIASLGSLLHPLRLCVCVWPTNMYTSMPCLRRCVFSLEKKLVLLVGQISRNILRE

SEQ ID NO: 117638 - protein, 89 aa, Triticum aestivum
  Clone ID: PAT_TA_12056.pep
MKGTKLAAILILQAVLVMGVLSHVNADYFPKCCNNCRSFSGVDVCDDAHPKCPKGCSACRVVSTSPEMWRCADMKSTVDGTCGGPCKKY

SEQ ID NO: 117639 - protein, 58 aa, Triticum aestivum
  Clone ID: PAT_TA_12057.pep
LLISSELYFRRHTSSEPEALNGSVLFAWPAAGAVDGALHVGAPERLVRARHLPGRPLE

SEQ ID NO: 117640 - protein, 107 aa, Triticum aestivum
  unsure (1)..(107): unsure at all Xaa locations
  Clone ID: PAT_TA_12058.pep
MKSTKLAAILILQAVLXVMGILSHVNADYFPKCCNSCRSFSGXSDVCDDAHPQCPKGLLRPAALGDAQPSTRLPGCARHEDTVRRTCGGHAKXLIRFKASSSNKCAA

SEQ ID NO: 117641 - protein, 292 aa, Triticum aestivum
  Clone ID: PAT_TA_12059.pep
SEKKVPKAEEVLSRYAEKHPDNSKGVLLALAQIAANANHFQIAADSLSKISDIQHMPATVATLVALKERLNDSNGAASVLDSAIKWWKNAMTEDNKLDMFMREAATFKLNHGRDEEACQLYEELVKSYGSTEALAGLVATSARTDLAKAEQYEKQLKPLPGLQGIDVKSLEKTSGARHVEQAMKVDAPEEVKKQKAKKRKRKPKYPKGYDPANPGPPPDPERWLPKRERSTYRPKRKDKRAQVRGAQGAVSREKHDGSAANAGATSSKPTTSAKAPEPPKGSNKSRKKKSRS

SEQ ID NO: 117642 - protein, 89 aa, Triticum aestivum
  Clone ID: PAT_TA_12060.pep
MKGTKLAAILILQAVLVMGVLSHVNADFFPKCCNNCRSFSGVDVCDDAHPKCPKGCSACRVVSTSPEMWRCADMKSTVDGTCGGPCKKY

SEQ ID NO: 117643 - protein, 494 aa, Triticum aestivum
  Clone ID: PAT_TA_12061.pep
MKAQKVDLTTRALRDTRSFELAYNSACTLIENKKYSEAKEQLDLAKRIGKEELMVEDYAEDEIEYELAPVSVQLAYVQQLQGQTQEAMETYANMINKKSGDPSSLAVATTNLISIKGTKDVADGLRKLDRLVEKSTAPNQLQLIESLEFKLSSRQKEALYSARVLLLLHANKIDQAQELVSGLLGMFRDSVFPVLLQAAVHVREKKVPKAEEVLSRYAEKHPDNSKGVLLALAQIAANANHFQIAADSLSKISDIQHMPATVATLVALKERLNDSNGAASVLDSAIKWWKNAMTEDNKLDMFMREAATFKLNHGRDEEACQLYEELVKSYGSTEALAGLVATSACTDLAKAEQYEKQLKPLPGLQGIDVKSLEKTSGARHVEQAMKVDAPEEVKKQKAKKRKRKPKYPKGYDPANPGPPPDPERWLPKRERSTYRPKRKDKRAQVRGAQGSVSREKHDASAANASATSSKPTTSAKAPEPPKGSNKSRKKKSRS

SEQ ID NO: 117644 - protein, 91 aa, Triticum aestivum
  unsure (1)..(91): unsure at all Xaa locations
  Clone ID: PAT_TA_12062.pep
MKSTKLAAILILQAVLVMGILSHVNADYFPKCCNSCRSFSGVDVCDDAHPQCPKGCSACRVXVTPSPHKTFRCADMKSTVDGTCGGPCKKH

SEQ ID NO: 117645 - protein, 366 aa, Triticum aestivum
  unsure (1)..(366): unsure at all Xaa locations
  Clone ID: PAT_TA_12063.pep
IRHEGLKVLDLVNIGIQCSLRQLLEYGYFHADPHPGXNILATPEGKLAFLDFGMMSETPEDARVAIIGHVVHMVNRDYEAMARDYYALDFLKPEVDVSPIVPALKIFFDDALDSTVXSELNFKTIVDGLGAVLYQYPFNVPAYYALILRSLTVLEGLALYADPNFKVLAASYPYFAKRLLTDPNPYLRDALIELLFKDEKFRWNRLENLLVQGRQDREFVAKDALQPVLKLLLGPDGENLRVLVVKEAVRVTEAITFGTLIDSYNAAPEFLKPLISNGNPAGPFKISDVEREQMLELRDTVLRIWGLLRSSDTFDPSLLQPIVQVLQEREARMFGSRIAGGVSQRLAARLLQQLLRIPPAPVPGSS

SEQ ID NO: 117646 - protein, 662 aa, Triticum aestivum
  Clone ID: PAT_TA_12064.pep
MPPKSKAAAAAAEPVSVEDLFTALHRHIEAGEFPQAVKVADQVLAVSPGDEDAVRCKVVAHIKSDATDKALAAIRAAERLPIDLSYYKAYCYYRQNKLQEALDILNGQEETAAVLQLESQIYYRLGRMNDCMSSYEKLQKFKVDSIDLKINIIAALVAGGRASEVQAAMKAQKVDLTTRALRDTRSFELAYNSACTLIENKKYSEAKEQLDLAKRIGKEELMVEDYAEDEIEYELAPVSVQLAYVQQLQGQTQEAMETYANMINKKSGDPSSLAVATANLISVKGTKDVADGLRKLDRLVEKSTAPNQLQLIESLEFKLSSRQKEALYSARVLLLLHANKIDQAQELVSGLLATFRDNVFPVLLQAAVHVREKKVPKAEEVLSRYAEKHPDNSTGVLLALAQIAANANHFQIAADSLSKISDIQHMPATVATLVALKERLNDSNGAASVLDSAIKWWKNAMTEDNKLDMFMREAATFKLNHGRDKEACQLYEELVKSYGSTEALSGLVATSARTDLAKAEQYEKQLKPLPGLQGIDVKSLEKTSGARHVEQAMKVDAPEEVKKQKAKKRKRKPKYPKGYDPANPGPPPDPERWLPKRERSTYRPKRKDKRAQVRGAQGSVSREKHDASAANAGATSSKPTTSAKAPEPPKGSNKSRKKKSRS

SEQ ID NO: 117647 - protein, 185 aa, Triticum aestivum
  Clone ID: PAT_TA_12065.pep
LRGQENSHYWQPRTITTGVYSRRIFRIAEQQATPTSSRERKHSDEDTTYWYTYLLVTHTRIGTMTLLISSELLFNFRRNISYAGMNRSVLLAGSTAGAVDGGFHIRAAPHFGARRHHAARRAALGTLGVGVVADVDPREGPAVVAALGEEVGCTHAKTSASDSITHKHRPRSLTAITKRQSIELC

SEQ ID NO: 117648 - protein, 111 aa, Triticum aestivum
  unsure (1)..(111): unsure at all Xaa locations
  Clone ID: PAT_TA_12066.pep
MKSTKLAAILILQAVLVMGILSHVNADYFPKCCNSCRSFSGVDVCDDAHPQCPKGCSAXAXPGXPVVTPSPHKTFRCADMKSTVDGTCGGAMQKALIRSGLQAQTRCARLK

SEQ ID NO: 117649 - protein, 96 aa, Triticum aestivum
  unsure (1)..(96): unsure at all Xaa locations
  Clone ID: PAT_TA_12067.pep
MKGTKLAAILILQAVLXVMGVLSHVNADYFPKCCNNCRSFSGVXDVCDDAHPKCPKGCSXACRVGVRRAPEMWXAAPDMKSTVXDGTCGWALAKKY

SEQ ID NO: 117650 - protein, 90 aa, Triticum aestivum
  Clone ID: PAT_TA_12068.pep
MKSTKLAAILILQAVLVMGILSHVNADYFPKCCNNCRSFSGVDVCDDAHPQCPKGCSACRVVTPSPHKTFRCADMKSTVDGTCGGPCKKH

SEQ ID NO: 117651 - protein, 90 aa, Triticum aestivum
  Clone ID: PAT_TA_12069.pep
MKSTKLAAILILQAVLVMGILSHVNADFFPKCCNNCRSFSGVDVCDDAHPQCPKGCSACRVVTPSPHKTFRCADMKSTVDGTCGGPCKKH

SEQ ID NO: 117652 - protein, 90 aa, Triticum aestivum
  Clone ID: PAT_TA_12070.pep
MKNTKLVAILVLQAIMVMGILAHVNADYFPKCCNNCRSFSGVDVCDDAHPQCPKGCSACRVVTPSPHKTFRCADMKSTVDGTCGGPCKKH

SEQ ID NO: 117653 - protein, 90 aa, Triticum aestivum
  Clone ID: PAT_TA_12071.pep
MKSTKLAAILILQAVLVMGILSHVNADYFPKCCNSCRSFSGVDVCDDAHPQCPKGCSACRVVTPSPHKTFRCADMKSTVDGTCGGPCKKH

SEQ ID NO: 117654 - protein, 143 aa, Triticum aestivum
  Clone ID: PAT_TA_12072.pep
MSRSVLLAGPTAGAVDGGFHIRAAPHFGARRHHAARRAALGALGVGVVADVDPGEGPAVVAALGEIVGVLVMGVLSHVNADFFPKCCNNCRSFSGVDVCDDAHPKCPKGCSACRVVSTSPEMWRCADMKSTVDGTCGGPCKKY

SEQ ID NO: 117655 - protein, 189 aa, Triticum aestivum
  Clone ID: PAT_TA_12073.pep
RPPGFLDPTLKLGQLRKGVSFASAGSGYDDITANTLSALPFRRQLWHFWRYKQLIRALLGLRRAERIVNRATFIISAGTNDMLLNYIASNRSAGPIAMLRYENHLIARLGNYTQVMRMLGARRFVFVGLPPIGCLPIARTLLGRDPDGCDSDLNQLAAFFNSRLGQLVEFRQLPAPYEERLLRFLHNHT

SEQ ID NO: 117656 - protein, 119 aa, Triticum aestivum
  unsure (1)..(119): unsure at all Xaa locations
  Clone ID: PAT_TA_12074.pep
SIKCTVSSNTHTLPGSTTNQKHSSNQHIHFLLQNMAKQLTGLENSIISIHGGKSQLVPKHEGLFKNIIFITTYPTHTHTHTISDKHYLPGECSKARDAKSDGPIGTRIVXPLQDRRRPA

SEQ ID NO: 117657 - protein, 135 aa, Triticum aestivum
  Clone ID: PAT_TA_12075.pep
FEHHTHVLIANLLPDTDNDPLTSARAYHHAAAGPPTKRATPVALIIQPRSSPLTCSDRVTTPASWQGRPRRRCHDTDVSLYVVLPAHLFQQVNCHVPVVVLVQVGKGRQLSSRSTHHRQCFCYSIFPCPLIISHA

SEQ ID NO: 117658 - protein, 173 aa, Triticum aestivum
  Clone ID: PAT_TA_12076.pep
MSHHLASTTAAASSSPSRRPSLTSFPSPLHRPSALFQQTNFVATRTERKPAPSVAAAAASPVSPLHRLEEMSDHEAIPERLAVVTGGNRGIGIEVCRQLALQGVTVILTARDEERGKAAVESLCRESNLSNIIFHQLDILDAGSRASLARHIETRYGKLDILVNNAGVGGVAV

SEQ ID NO: 117659 - protein, 149 aa, Triticum aestivum
  unsure (1)..(149): unsure at all Xaa locations
  Clone ID: PAT_TA_12077.pep
PFLLXNPIXILQFXXCQREXSPXAXEGXXSSXXVXLDSXKXCGLXKFCLISLEPXFFGXSFDNLXPMXGNIKGMRLGRLPTGKPGSGTIAAGIRWRWRCTAGSSMRLFAAKVRCLCRIHVVCCSATQESDWHRSFLWGAFSLANLASPH

SEQ ID NO: 117660 - protein, 440 aa, Triticum aestivum
  Clone ID: PAT_TA_12078.pep
MKEIIVSRKCAESVLRGAQVYVPGVLACSAHVEKGDKVAVSVAIEQPVKDSGWAVGITRGIVLQGLQSDAHYEERKGLYIGQGIAAMSRAGIFRVLHGVAVEMTERVYKLPSFNDVLEGEIFLQNLPSIVAARVLDPRPGEQILDMCAAPGGKTTAIAILMRDKGEIVALDRSHNKVMGILKLADEMGLSCIRAYKLDALKSVRKAYEERNLGVADNCSEAIVTLAENSGPIRSIIGAGVTDAAEDSSTAIVEQTDAKSYVSKADLRKNLRRMRNGTGRSNCSGGRVEDSKGFFPSSFDRVLLDAPCSALGLRPRLFAGEETRVSLGPAPSEPGSGLAPALGLVRPRGRVGDSSRARMPGVVDAWARAPLHALRGRALGSLHPLGGGPAFLGSWLLPAVALARPGGTEDEAQLVQRFDPSSSLDTMGFFIAKFNVGQKED

SEQ ID NO: 117661 - protein, 94 aa, Triticum aestivum
  Clone ID: PAT_TA_12079.pep
DPSRLGIFLAYLKPRFEYPWYFVFLPKLTNKRFRLCFVLCTHLYSLAFEPWCHCCFVFIPSLPVGCSTGLVPICGRPLRSHHGCIYPLVLLLAI

SEQ ID NO: 117662 - protein, 52 aa, Triticum aestivum
  Clone ID: PAT_TA_12080.pep
FGTRADLCSEEEGPDCFSILCFRVLFVNFKDYSVTLVLLAVPVYILYSSNVE

SEQ ID NO: 117663 - protein, 234 aa, Triticum aestivum
  Clone ID: PAT_TA_12081.pep
ALCPVPDSRQAIFMDSTHRSKEKLNLRDNLKEKTLLFRFFKLVQSHIAASSSGGKDGEGQASGKISEEDLDLPFIEFLKKQQLQPKIRAVVLYAIAMADYDQDAADTCEKLLTTRDGIKTLALYSSSIGRFANAQGAFIYPMYGHGELPQAFCRFAAVKGALYVLRMPVTALLVDQEKKRYIGTRLASGQDILCQQLILGPSYKIPSLDMHLMLRLKLDEKVAGEYDIRVIKSS

SEQ ID NO: 117664 - protein, 66 aa, Triticum aestivum
  unsure (1)..(66): unsure at all Xaa locations
  Clone ID: PAT_TA_12082.pep
PSTPTARSAPXIVTGRETGRSRGFGFVNFDDDNSMNNAIQGMDGQELGGRTISVSQANQRPRCWRA

SEQ ID NO: 117665 - protein, 256 aa, Triticum aestivum
  Clone ID: PAT_TA_12083.pep
ARGEYMAKGTLRSHLYGSGLPPLTWKQRIDACIGAARGLHYLHTGADRGIIHRDVKTTNILLDKNFVAKIADFGLSKTGPTLDQTHVSTAIRGSFGYLDPEYFRRQQLTQKSDVYSFGVVLFEVACARPVIDPSVPKDQINLAEWAMRWQRQRSLEAIADPRLDGDYSPESLKKFGDIAEKCLADDGRTRPSMGEVLWHLEYVLQLHEAYKRNVDCESFGSSELGFADMSFSMPHIREGEEEHHPKKSGIREDSAP

SEQ ID NO: 117666 - protein, 203 aa, Triticum aestivum
  Clone ID: PAT_TA_12084.pep
TRPSAQASADAWVQLQLVLEMSARDNPEEMEIEVAKQMSLGFRRPASSLAEVLAARYWNFNALGYDDKITDGFYDLYVIGNGPASINMPSLSELRAQPVSHNSVNWETVLVHRGEDPELMKLEQKASIIAIELRSRNSEFGGNVLIQKLANLVSNHMGGLIFDPENTSRKYQNMIRSLRARIGSVVVPLGQLKTGLARHRALL

SEQ ID NO: 117667 - protein, 64 aa, Triticum aestivum
  Clone ID: PAT_TA_12085.pep
IHCDMRTSVLKELLESVCKLSCLDLMYYPWTFLSNEYLVCTFCERLQSQPPISGIFSLALRRIH

SEQ ID NO: 117668 - protein, 305 aa, Triticum aestivum
  Clone ID: PAT_TA_12086.pep
MPAASSSATATPATSRGGSRVSAFTMRAVARMSRARWFIFLRRVYQYQNGPRSDLGSNPFNSSGWLALELGVIVAQMVITTTVVATSPKERPAWPLRLWVCAYNVGNVLSLPLLYWRHRHSSAAGRGDDPEMHGAGDALRNSSYLMNKARAFLELFFAMWFRPGNVWVFDARLGSFHRAPRLYALCIGLLAWNAVVYSLPFLLFLLLCCFVPVVGYALGYNMNSASVGRGASDEQLDALPRWRFKEPDVPRDREKDDQECCICLAQYREKEEVRQLPCTHMFHLKCVDRWLRIISSCPLCKQELS

SEQ ID NO: 117669 - protein, 47 aa, Triticum aestivum
  Clone ID: PAT_TA_12087.pep
IISFMKCYHIKYSALAYGVNQVSCKQLKKHKYVYINLNCDKSGLILN

SEQ ID NO: 117670 - protein, 45 aa, Triticum aestivum
  Clone ID: PAT_TA_12088.pep
SDTSANQFWRICPLFALCISGEVMKTPSFVLVCLLLDAKIILHLY

SEQ ID NO: 117671 - protein, 324 aa, Triticum aestivum
  Clone ID: PAT_TA_12089.pep
MAGGCGGEGTLARWRRAAAKRIGLSCASFFSSHAASPSPPPPKTISCSAVNAPADSSDGEQEKLEEPTSTRMADKNFCAICLETLSTSSSGIDNCDRPAIFTAQCSHSFHFLCIASNIRHGNVTCPICRAQWSQLPRDLKVPPLLHNQSDPILRILDDNIATSRVNRRSSIRATRYNDDDPVEPYTLTEHVDPCLRFALIPSPVAAHHHVLGHYPCGRMMPPQQHCQYSYSGSSMVSPPQIASPSVQKRAFPLRRMSSHGKRMALQVIEHLCSAGGIDPVGALQKGLKILEDRAHQNPSNCILHLSDHPIRSYAGVDMNRASIP

SEQ ID NO: 117672 - protein, 208 aa, Triticum aestivum
  Clone ID: PAT_TA_12090.pep
IGAEFYQYHHAQSQSVLDHNQQWEQGPNSYSLRNDDMSGSIDPAAFRDGIPLPAKKSKKWIKGWNIWGLKHKKSSTKESEAASLANRSFSEKWPELRARGYNGQMLRCNSSVSARSSFGNSGAAMGGVSGRRSNVEMHVNGLGRMRKDEVLLERNFSARYTPCTVDNGAIPYPIGGAQFNRRNQNGMPGKGRPARSSNSLPRSSLGMY

SEQ ID NO: 117673 - protein, 117 aa, Triticum aestivum
  unsure (1)..(117): unsure at all Xaa locations
  Clone ID: PAT_TA_12091.pep
ESALIEFIRENRDIFAWKPSDRSGVPRELXEHTLNIDPKFKPVKQYLRRFNEERRKAIGEEVAPALGGRVQSSKSFIXEWLANPVLVXKKNGTWRMCVDYTNLNKACPADPFALPRI

SEQ ID NO: 117674 - protein, 266 aa, Triticum aestivum
  Clone ID: PAT_TA_12092.pep
MAAARVSIPAAVPRPIPGSTHAAGDLTDEEVYAALRECDMDPNETAQKLLHQDTFHEVKRKRDKKKESNKESVDPRWRPGTQGRGGKGGRGNYSSRQLSNSSDGTGRNAPAGKENDLNPSMDKCTSPSPVNPSTETKLSTSILSSSGGLSNGPSQPLAPGAKYSQPTCHLSPSDSKGLAVVKGTPEEVVLDLGSHVNNSSIQALGVGTSVSDPLLTPPLQPHSHGGEIVANKHAVRSQRSAGEYKVVSDDASALPKDTPQSSSSSS

SEQ ID NO: 117675 - protein, 143 aa, Triticum aestivum
  Clone ID: PAT_TA_12093.pep
CVPERERWPLWSCWSLPCRGKSPASGSDSGNCKDLACRYEQRRPHLLIPQLRAAAGATGRPRCRWSCCTSELLSCSGSRSAAKLQHEPPTKMEPKVPSSASSWCFLTSLQYIKGGKGNGTKICLMEPRVPDTWLVFCVLVGSP

SEQ ID NO: 117676 - protein, 106 aa, Triticum aestivum
  Clone ID: PAT_TA_12094.pep
LFPLHSPSSSIPSPTPARPTMSASSCTGCHRQGSTAARATVTHGPVTADSSPRVKAAASDFSNHRRPRHRPARLLLLPAPTPTAWLHLCPCTLGVCWNASKEENKV

SEQ ID NO: 117677 - protein, 138 aa, Triticum aestivum
  unsure (1)..(138): unsure at all Xaa locations
  Clone ID: PAT_TA_12095.pep
HPHPWDSDATPWFPXDHCFLPNRLDGVXPATAYRMGQGRPELLRPHPPSLPLPPKFYAIGRAGFVARRQHAVRFVFPAEARLPHPKKGNDRVHWLHPQPCARRRRRPEDKDAGSMACSSSRLRLQVGMPLVGEFFAAR

SEQ ID NO: 117678 - protein, 51 aa, Triticum aestivum
  unsure (1)..(51): unsure at all Xaa locations
  Clone ID: PAT_TA_12096.pep
KKGSTKNIRSNKXLHQIRRPPSNDYNHWTKLKACRHHLPSLIGPSKTCCST

SEQ ID NO: 117679 - protein, 168 aa, Triticum aestivum
  Clone ID: PAT_TA_12097.pep
DRLRQHIGDFLASAKTAWEFAKVYGFSHTPGETDINRYRSCLLVNFLEFLRHLDEHLLDHTRNNNGEQKVKNIIHVDLMIGDVYEVQVATLIRQMMLDLTDAPFASSWRHYEMSECELDNTDPESGKEDEVEAKDISDSGSNIVIGSVNEKNAQLGGMDTSASGSGSK

SEQ ID NO: 117680 - protein, 152 aa, Triticum aestivum
  unsure (1)..(152): unsure at all Xaa locations
  Clone ID: PAT_TA_12098.pep
LHGTTVAEXMPLIATCSENRQQGMCRQLVDYIEEMLKSLEVEMLLLFAIPNIVDTWTSAFGFRLIEESDKKKLSKVRLVSIPGTVLLKKDLYERSPETEAGELRTEQQQPLEDTGPVCTTETNLADELGGSDTNLPLADPPSAVALGKCHVD

SEQ ID NO: 117681 - protein, 197 aa, Triticum aestivum
  Clone ID: PAT_TA_12099.pep
RLDAVCLQLDEACFRRHGRVGAPVAAGADPPPAEAQPPGLLAPLGARPARLRRLAAPRRGGGPLRATGLAKILKKYDKRTGRLLRLPFIEEVLKQPFYTTELMSRLVRECEETMEAVFASDNSADPCTRKRCTGTEMTPMSTEQGPLGVPLAARAAAPAPRRRGAAHAPLPLPPAHAEAPPPVRGDHGGRVRLRQQW

SEQ ID NO: 117682 - protein, 211 aa, Triticum aestivum
  unsure (1)..(211): unsure at all Xaa locations
  Clone ID: PAT_TA_12100.pep
APLLSRATLXSRRPVAFVHVVGAPPRCCAGRTLFLSHLPVRLFPFPSPVLCRSRCFFCRCRWVSGQSGGLLRPRMRRKTRRELPRVPDPPVGLAPFGPPPSAPPRPAVALSGLLPPSGSRRGADCAQVGCARVRREPVLPSGPGWLGSPSSPSLARRRGCRPLSVPPSTAAVLHRRLLATWPRPRRVAAPILPSCDFPHAPCAFPASFHAV

SEQ ID NO: 117683 - protein, 206 aa, Triticum aestivum
  Clone ID: PAT_TA_12101.pep
MLECHHKQFITISLAYHVKTSTSVQQGEHHRQAAMHLCNEMDCFSSTFRIWVTAQKSYVHALNEWLQKCILQPPQERRRRKRKTSFPPRQAVSPPIFILCRDWLDMMESLPTDELCKSIKDVMQLLRDSFEHQADQTKLRREPHSRSESQECVMLENNEQESSGGVALVEGLQSKLTVVLDCLTKFSEASLKRHEQLKLNYEEAHD

SEQ ID NO: 117684 - protein, 301 aa, Triticum aestivum
  Clone ID: PAT_TA_12102.pep
MVAARLLARATRQCAAAVVASAARRPLGGVAAVAARPLGSSFGPARVPYMLNQPLRYSSNIFQRFGFSSSTPQQNDKEVHEPKDQESTAHESNGEASKEDSGSSGSTEDLDLSKEDLVKLVFEKDELLTSKDEEIKDMKDKVLRSYAEMENVIARTKRESENSKKYAVQNFSKSLLDVADNLARASSVVKESFSKLDTSEDSSGAVPLLKTLLEGVDMTDKQLGEVFKKFGVERFDPLNEKFDPDKHFALFQIPDPSKPSGTVASVVKVGYMLHDRVLRPAEVGVTEGGPSEEPEEKSGGD

SEQ ID NO: 117685 - protein, 130 aa, Triticum aestivum
  Clone ID: PAT_TA_12103.pep
SARERTSGNGTSVDPWVCIGDRQRAGAATASRRKDGSNCRIECYRNWVFVARDAYVEVWTQVEITSEAGEKKVMRKNWVGNGPSMVTADGEEKAKIVSWAFGGSRMALARVDQRSIEVWDSASGAISGNR

SEQ ID NO: 117686 - protein, 309 aa, Triticum aestivum
  Clone ID: PAT_TA_12104.pep
RNSARGRNRFAFVDLTAGPFSWGPAVGGDGVRTELTLPNVAKTVGAVAEVTEEEAEENLQDTIRERFSSVGEDYHAVDILLAEIDVYELFAFKHCMKRRVQLALCKELDHRMHELKNELKGYNSGDSEEINKKKALDALKRMENWNLFKDNSEEHHSYTVARDSFLAHLGSTLWGSMRHVVAPSVSHRAYHYYEKLSFQLYFVTQEKVRTIKQLPINVKSIRDGLSSLLLPSQKSMFTQHMLSLSEEPALMMAFSMARRAAAVPLLSVNGTYSSTVRTYLDSAILPHPLQKLSEATALKGEHTNHRSTL

SEQ ID NO: 117687 - protein, 235 aa, Triticum aestivum
  Clone ID: PAT_TA_12105.pep
GCSIRSRGLRLNGYTYKCILQAHLRSKGVSNGFEVYEEMRRKGYRLDIFAYNMLLDALAKSGMVDQAYQVFEDMKQKYCEPDAYTYTILIRMSGRAGKTSKFLSFFDEMVSKGCALNLIAYNTLIEALGKNKMVDKVIFVLSKMIEGDCQPNQFTYSITLDILATEGQLRRLNEVLDICDRYMNKSIYSYLVKSLSKSGHVSEAHNVFCQMWNSYETGDMDAFVSMLEVLCNSGK

SEQ ID NO: 117688 - protein, 150 aa, Triticum aestivum
  Clone ID: PAT_TA_12106.pep
RATTGWCGCYNPCWASCNLQGVVTTSTGRRDGGAHEMLQPLRQELQPPPDFAGTSDSGELQGDHGGECCNHDQVCWNRLGDLLEPAPKSASTGIRFFLYQRFFATTTVLFWLGTNIPKMLPSEFVLLVPAPTGFIRYLASLVPSSAWVPN

SEQ ID NO: 117689 - protein, 125 aa, Triticum aestivum
  unsure (1)..(125): unsure at all Xaa locations
  Clone ID: PAT_TA_12107.pep
MEIVDKIAEPEDPLVVTARKVQSLEPPLPIPIKASWKGKTSQQQDEKDLPDDGEESFQSVDSSDEGGRSXFSGASHPLEPIDMDLMKTVYVAIDEEKPEPPVCMVRGLSAXGPFMDDLSLRVTGL

SEQ ID NO: 117690 - protein, 133 aa, Triticum aestivum
  Clone ID: PAT_TA_12108.pep
IIRFLKSRLVLRDQFFLLIIRAGLMPSFLLVVNFFMWNNNFFHRWFFHFLILGCGARNRTRGPGASHGAPTGPRAWRRAVPTSDATTSSRRGAGSPPTRRGFRRAHPVRLGRRGGGGKSRRSRGGNRRRRRRG

SEQ ID NO: 117691 - protein, 118 aa, Triticum aestivum
  unsure (1)..(118): unsure at all Xaa locations
  Clone ID: PAT_TA_12109.pep
FFFHEQPVSLMLFRPYKXTTXRSFRXRHPSLQHRMCCVPPIQQISHRMDSHHDHITLKERKKKKKRECYACTPLATAILWCQANQAYIWCMRACMAGLVSIGIRVMAYWGWEERMFLG

SEQ ID NO: 117692 - protein, 174 aa, Triticum aestivum
  Clone ID: PAT_TA_12110.pep
IFSLSNSHELRSGALRPASPRPAPTPNAVSNPARPPSRTRAASESIARSYISLRVTPFRSVVMVPPVYQEPSIMPINTRTEKELEEKEVLCTHKKPKATGCVAQPQQEIELAIESDNKGHGDPSPKESACVVLSSGEANGCGEGHVLGGANAEPEASLRLFPTLQCNWLEESNI

SEQ ID NO: 117693 - protein, 107 aa, Triticum aestivum
  unsure (1)..(107): unsure at all Xaa locations
  Clone ID: PAT_TA_12111.pep
LQEAISKLEDTLQAVNIVLLKFRALXFAAVPKATEIVAVALLVAAAVVVLMPPKHLLLMAVLEVYTREMPLRKQHTEKFRRRIKEWWARIPAAPVQMIRPKEDKKKI

SEQ ID NO: 117694 - protein, 169 aa, Triticum aestivum
  Clone ID: PAT_TA_12112.pep
DESLQAGLELQSSEKEKEGVPGATASHTMSNTLTDLTKNSVSGTSSLTNAGAHVAPVSQTMSGTLTVPANISGAPVAAVSQTVNLTSHAENSGISSVINAGTSKVVSSKISNLRKHQRTEEATFEHPKMQRTSGAFDEACLASVTKAGAGSRAGTVLELEGPKQEVEPR

SEQ ID NO: 117695 - protein, 182 aa, Triticum aestivum
  Clone ID: PAT_TA_12113.pep
RSMTLLFKETSVGYNMSTRQNEANSVPFTCKNQNIKQNHQTSHRAPSSIDPSSCPASPSGRIARWVSVHHLQQRSFLLAVLTILDLLGRQRLGRRVSHRHLLIQIIYLLLQPRTMVRATSKLVIEDCKQRRIHSSLKIGIFPDRPGRSSPQSVLAPHGGAPGATPRPGARALGDKHNHACIS

SEQ ID NO: 117696 - protein, 132 aa, Triticum aestivum
  unsure (1)..(132): unsure at all Xaa locations
  Clone ID: PAT_TA_12114.pep
RTLXISRAFVSAAARRTGLEELWLVHLIPKEHTYRSQLTSTQGSRRQHTPSAPSRANRTYHGSSIHTTGEHRQMCRGVGNKPGRHAPCRRTTLSSRAQNTNDRSEHRFGPLAAPVSRRAGLFDIFDTQVRTL

SEQ ID NO: 117697 - protein, 194 aa, Triticum aestivum
  Clone ID: PAT_TA_12115.pep
RPPTRPPTRPDMFYDFNAVGASDVAVVYVPEWAKMADDPVHIMFAYSGSDGASLMMSNPRVLVIAEKGAEVAIVEEHFGVGEEDGGCYWANPVVDIIVEEGARVVHSYVQRQSPAAAHTKWTTVQQNTSSKYEFVEVSTGARLNRHNLHIQQLGPETETELSTFHLTSHNKQIHDLHSRLILGPPRGGFHRHPH

SEQ ID NO: 117698 - protein, 397 aa, Triticum aestivum
  unsure (1)..(397): unsure at all Xaa locations
  Clone ID: PAT_TA_12116.pep
VLIPSSKLTLTKGNKSWSSTAVAAALELVEPPGSPRAPAPLFASCHASHASLLLLSPNPAAAARLRVGGLRVRRPRRLRLPVRTAAGGSPLDAEIPDPTVDDDEWGREPPASAPGCSRPGVTDEWGEPGVAEPEQPSGADTPTNDDEWGGEPTPTPPKAKEAPVTKEDEGREELKRCLVDTVYGSGLGLKASSEVRGEVVELVAQLEAANPTSAPVQAPELDGNWILLYTAYSELLPILLAGATPFTRVDKISQEIDSRIMTIINASTISTPFASFSFSATASFEVQTPSRIEVQFKEGSFQPPEISSSVNLPEQIAIFGQKFSLGTVKELLEPLQRAFASIAGSISGQPPLKVPIPGXNKAKSWLLTTYLDKDLRISKGDGGGVFILAKEGSPLLD

SEQ ID NO: 117699 - protein, 137 aa, Triticum aestivum
  Clone ID: PAT_TA_12117.pep
GPQWRTTPTVPSLTYVTSTQACMGKILGREEAKHASSFRRADCSDRLIKCRNQVVAAKNSRPPGLRWCKPPNRVPPLFQPKQSSILRLTHLPAVSRRSSQSVHSCLNSQLASGNSRTIKFVSPLPPAFHPLRTISYY

SEQ ID NO: 117700 - protein, 133 aa, Triticum aestivum
  Clone ID: PAT_TA_12118.pep
EELAAEEKGNAGGGSEVKVCVRVLVKKGHKQQTRQMLIPGDCSLVQSTKQQEAALLEEKQNIKQKILEYNEREEEEFNASSFQTGFWGQGGSSAGGSIGSAGRGSWDGSNRGGRGRQRYYIAGGIYHGYGRGR

SEQ ID NO: 117701 - protein, 93 aa, Triticum aestivum
  Clone ID: PAT_TA_12119.pep
PVTNATNHLVFHRFIVYVTFVMLMIPRVRACDATTPSEIQAVVVCWRGKVFPPSTFSLHLSWLGPLFMGLRCLLLPQVLVVACSFITVVQYEC

SEQ ID NO: 117702 - protein, 338 aa, Triticum aestivum
  Clone ID: PAT_TA_12120.pep
KPLHSAPTGMWECPDLYPVTVDGRQNGLDTSVTSSPKVKHVLKNSLDLRRYDYYTVGTYNRKTERYVPDNPTGDEHHLRYDYGNFYASKTFYDPVKRRRILWGWANESDTAVDDVAKGWAGIQAIPRKVWLDPSGRQLMQWPVEELEALRAKKPVSLKDRVVKRGEHVEVTGLRSSQADVEVSFEVPSLEGAEALDPALANDAQKLCSVRGADVEGGVGPFGLWVLASSKLEEKTAVFFRVFKAARNINSTKPVVLMCSDPTTSSLNPNLYKPTFAGFVDTDIAKGKISLRSLIDRSVVESFGAGGRTCILSRVYPTLALGKNAHLHVFNNGKVDIKV

SEQ ID NO: 117703 - protein, 564 aa, Triticum aestivum
  unsure (1)..(564): unsure at all Xaa locations
  Clone ID: PAT_TA_12121.pep
MSSTRPTSWRRRRRRPTCRLRFLTPXLSTGYHFRPIKNWINDPNAPMFYKGWYHFFYQYNPKGAVWGNIVWAHSVSRDLINWVALETAIQPSIKSDKYGCWSGSATILRDGTPAIMYTGIDRGDINYEVQNIAFPKNKSDPLLREWVKPKSNPVSVPEGGINATQXTCPGGGVLSGXRRRLLSGALARPSRAGAYDSRPRQEMRRSRVQQPQHSAPTVTVRGLGDVEARAHERSLEFKLDLHAXLPIYVPELSSYSVKLXLVKRDXFYVGTYVARFARSISALRRDHFARRNNKSSMHTLPCTLVESIYIAGRVLVSKVALYLSIHYIAHVPEFGSRSVKLVSGETXLVCEGTYVARFARSISALRRDHFARRNNKSSMHILSCALVESIYIVGRVLASKKKKKKKKKKKNAQKLCSVKGADVEGGVGPFGLWVLASAKLEEKTAVFFRVFKAARNINSTKPVVLMCSDPTTSSLNPNLYKPTFAGFVDTDIAKGKISLRSLIDRSVVESFGAGGRTCILSRVYPTLALGKNAHLHVFNNGKVDIKVSQLTAWEMKKPALMNGA

SEQ ID NO: 117704 - protein, 146 aa, Triticum aestivum
  Clone ID: PAT_TA_12122.pep
SPFPTNPRPLAATASPPPSAIEKLPGARVSRTDRWPSPSPTRCCRRRRSRPRPRRRGSSSWCWRSCTWPSPRCSRWGAPSASRREPSPTRASGSRGSSPRPRLDRSWRAAPGARAPPNSCSCRPSCTGASRSSSTASLCWSRFSPC

SEQ ID NO: 117705 - protein, 80 aa, Triticum aestivum
  Clone ID: PAT_TA_12123.pep
HASDDEQQPNGIHVTRFTLQSVYWCFLIHRETRSTNIVVNGYTSQHEIAQQVDIFIRKMNSIPAFTANLTMESFNKRSIC

SEQ ID NO: 117706 - protein, 144 aa, Triticum aestivum
  Clone ID: PAT_TA_12124.pep
SRGSCDCGGWDEGCTLSVLTDNTQGNQGCKSIQVNQTQDGSHRFDLLSQGRSREDRHAFSMVSFKEGLYAVEFRSSIALLQAFAMCIVMLHGRSPVRTQADLPTSQDDAVFADHKLKAMAAAGQGRAPASYVPRQPPLSPVGRA

SEQ ID NO: 117707 - protein, 80 aa, Triticum aestivum
  Clone ID: PAT_TA_12125.pep
NQGIPTQFPLPLHPNVTGIKNRIISQKISQDVSAPPYIQVEFSVVGQPQQVYFLELISLACESIKRIALQTKGKRSPSIR

SEQ ID NO: 117708 - protein, 409 aa, Triticum aestivum
  unsure (1)..(409): unsure at all Xaa locations
  Clone ID: PAT_TA_12126.pep
VLPLTQGRAMASLFGHVEPAPKDPILGVTEVFVADPSPDKIDVGDGAYRDDSGQREKLECLREAERWEDGNLKIXYLLMRWSVNXINGSLKKSIGXDPDFIRENKLAALQALSGTGPCRFFAGFYQGFLPDLQSYIPTPTCSIYHNIWRDAQVPQRTFSYYHPESRGLDFARLMDDIKNAPNGSFFLLHACAHNPTGVDPTEEQWREISYQFKLKNHFPFFDMAYQGFASGDPERDAKAIRIFLEDGHQIGCAQSYAKNMGLYGQRAGCLSILCEDEMQAVAVKSQLQQIARPMYSNPPVHGALVVSIILSDPELKNVWLGEVKGMADRIIGMRKALRENLEKLGSPLSWEHVTNQIGMFCYSGMTPEQVDRLTSEYHIYMTRNGRISMAGVTTGNVAYLANAIHDVTK

SEQ ID NO: 117709 - protein, 255 aa, Triticum aestivum
  Clone ID: PAT_TA_12127.pep
MWGDSKPMLKSRGGGGGGGGADEEGDYFPNTPRKDWSTGLLKLVTAMVIFMAGVVIGLSVSANVSRYYYNSSAELFFPTATYSSCDRRGATGDCGPGFRAFVHPPTLAHSMTDDELFWRATLVPTAEEFPFQRVPKVAFLFMTRGPLPFAPLWERFFRGHQGLFSVYLHTIPDYKLNVSKTSPFYGRQIPSEEVSWGSITLVDAEKRLLANALLDFSNERFVLLSESCIPVFNFPTVYEYLINSEHSFGESYNID

SEQ ID NO: 117710 - protein, 237 aa, Triticum aestivum
  Clone ID: PAT_TA_12128.pep
PLVDAEKRLLANALLDFSNERFVLLSESCIPVFNFPTVYEYLINSEQSFIESYNIDTPQSAGRYNRRMAPHILPEQWRKGSEWFELNRELAVRVVADYKYYSIFRKHCRPSCYPDAAGTPHHGTPKENERERGKAHGRRNAKPNPEQHYIPTYLHLFHGSLNANRTITWVDWSRGGPHPARYGAGNINVDFIKAIRNNGTQCLYNSKHTSVCYLFARKFAPSALGPLMNLTSTVLDF

SEQ ID NO: 117711 - protein, 83 aa, Triticum aestivum
  Clone ID: PAT_TA_12129.pep
EGFSRARDAARIVYGNPGRLGNKRRGRAGANEQADEKGGNFPWNGMGLATEKPARKRHYPPKAQGGMVLKQRSHRGSALRGES

SEQ ID NO: 117712 - protein, 103 aa, Triticum aestivum
  Clone ID: PAT_TA_12130.pep
MWRALILYVAAGALPEARAPGRGNQRQDTAALFLLACHEIYSQITTESKPADEVPGSATERSQKLLFPSKNVSDENLTAVSEVFGQYQGREHALCMDMEPIVN

SEQ ID NO: 117713 - protein, 563 aa, Triticum aestivum
  Clone ID: PAT_TA_12131.pep
MMDPEMMRLAQEQMRRMSPDDLARMQQQLMSNPDLIKLASESMKNMRTEDFKRAAQQLNQTRPEEMLDMTEKIANAKPEEFAAMKAQADAQISYALSGAKMLKQQGNELHSHGKYTDAAAKYKLAKENMKSVPSAAGRTLQLQCTLNLMSCYLKSGMFDECVNEGSEVLTYDSSNVKAYYRRGQAYKELGNLQAAVADLRKAHEISPEDETIAEVLRDTDAKLATEGGGTNLPKGVVIEEIVEEDSSELLSTQRSSSTEYTVSQPHEGAGNSRQSDSSESLMNDPATIRSFQNYVSNSDADGLSKLGMQGMSPELVKTASEMIGTMKPEELQKMFQAASSLTGTNPVGSNLGSNMPEMSPDMVSMASEMIGKMSPSELQNMMDFASKMGGPGSAPVRPGTGSNIRPSSRAETSSNNFQPSSSQTVAENPDEIVNNQSMDHSSSSSPVSTADMQETMRNSMKDPAMRQMFASMMKNMSPDVMANMSEQFGMKLSKEDAAKAQQAMSSLSPEDLDRMMKWMDRAQQGVEVAKKTKNWLLGRKGLILAIVMLILAFILQRLGFIGR

SEQ ID NO: 117714 - protein, 115 aa, Triticum aestivum
  Clone ID: PAT_TA_12132.pep
AHGKRVSGSLFCLSHAYSGCYLFCLSHANSSFFCSNWIYSKGVRIPNGLITVLLKLYWPGLYCPDPVRQPARRVLATSWDHWEAARHADHETHAKAVITTFWVSSLQKHKSILVS

SEQ ID NO: 117715 - protein, 117 aa, Triticum aestivum
  Clone ID: PAT_TA_12133.pep
SDIKFSLPYRPDSFNLVVVSDALDYLTPRYLNKTLPDLARVSTDGLVIFTGNPGQQKAKVSELPKFGRPAKLRSNSWWTRYFIQTGLTENEGPLKKFEQAASKGNYEPDCQIFHLSS

SEQ ID NO: 117716 - protein, 238 aa, Triticum aestivum
  Clone ID: PAT_TA_12134.pep
MSPLSTDAENGNGKALEEELAKLSVNGDSSGRNCGKEEEVREARVQLPWEFLQPVMRVLGHCLLAPLNPMEVRDAAAEAVRVVYARACHDLVPQAILAARSLIELDKSARKAAKAAAVAGGGPGGDCGSGGGPAAGSGAGAGATTGSKPRKPAEAEEGKGGALEGELGKRRAQGGRRGQECGAGGGVREAGGQPAGEVRQAGKRAGGDCWHGGIGWELGLELDAVLPAVPEVPRPRPR

SEQ ID NO: 117717 - protein, 107 aa, Triticum aestivum
  unsure (1)..(107): unsure at all Xaa locations
  Clone ID: PAT_TA_12135.pep
VVPPPAPKNKDGGDKKKQQQQQQQQGQGGGGGKKKNKNKNRQEEGGEEAGGAAGVXEQARAMAMMYGGVGGGGGGVVAGGWTTSYRVEMLHAPQLFSDENPNACAVM

SEQ ID NO: 117718 - protein, 285 aa, Triticum aestivum
  Clone ID: PAT_TA_12136.pep
VTHPHPGEDSSPSIAAVVASQDWPEVTKYAGHASAQTHRQELIEDLYNVTHDPQRGTIHGGMVRELLTSFKRTTGEKPERIIFYRDGVSEGQFYQVLLHELDAIRKACASLEANYQPLVTFVVVQKRHHTRLFAHNHNDQSTVDKSGNILPGTVIDSKICHPTEFDFFLCSHAGIKGTSRPAHYHVLWAARPPTGAGLQTLTNNLCYTYARCTRSVSIVPPAYYAHLAAFRARFYMEPDSSDSGSISSARKSGSSTSRSTRAAGAGVVRPLPALKDSVKKVMFYC

SEQ ID NO: 117719 - protein, 216 aa, Triticum aestivum
  unsure (1)..(216): unsure at all Xaa locations
  Clone ID: PAT_TA_12137.pep
MAGAGEDEAGRPPPAPAARQQPGAEAAAAAKRGGPGHQPGEADGPPARMAEYAQLQKLPTRQQGMFLHLRHMTCQLIVNSNDPNGDNEVLQLANCLDVAPGLETLHLHMVCGEPSGVSSGEVGGMGGHDHLKTVFMSGFRCYRAQTELACCILGNACVLEQLTIEPRIRDTTXGRXCSAWNTGLEGVIPGICEWARVISEGFGKVITVLGAPLHSE

SEQ ID NO: 117720 - protein, 114 aa, Triticum aestivum
  unsure (1)..(114): unsure at all Xaa locations
  Clone ID: PAT_TA_12138.pep
AFSKTPTAQHLSLDRFSKLLDEKKHEVIEFEGXILAFRVFQPLAIGKDRKKFALRSFDLSSVCFIDWQPGKSRVTFILDGMXMRNAGYALREAILQKTIDSWNGHRDGKILDRP

SEQ ID NO: 117721 - protein, 152 aa, Triticum aestivum
  Clone ID: PAT_TA_12139.pep
MLALFSPRSFTGIFSPRILTDIDSPKTEDRVLDCALLFNKLRGCGQNMVILSNSVNLKIKAMSEGLLCEGAKEFRETLMNPCSDRFMWAASVPRGAAWSRLDEAALAENYYNSHRESRRNVPRPVEAARGLKLILLHNSSSLCARSGDQLRR

SEQ ID NO: 117722 - protein, 136 aa, Triticum aestivum
  Clone ID: PAT_TA_12140.pep
MAPKAAEKKPVEKTPAGKKPKAEKKVPASKEGGGEKKGKKKAKKSVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 117723 - protein, 209 aa, Triticum aestivum
  Clone ID: PAT_TA_12141.pep
MAIAISQEAFDDMVRENMEDLGMDPDEALADAVDALTLQGANLSGIIRRVPGDAAAEEVNPVMRVLDELKASASGRSGEDLDRLLSLLDELLELCSGEGAENAAVAARNGGVEALVALCASAGVTQQRLLASGLKALSSLIRDVGSTEKFRQSQGSKIVMDILKGALENSDILDGGFSVVAAASAGHEVVNDAFMDLKVDELILEVMRN

SEQ ID NO: 117724 - protein, 76 aa, Triticum aestivum
  unsure (1)..(76): unsure at all Xaa locations
  Clone ID: PAT_TA_12142.pep
FEPGQVRDISDDXXRDAARKIDGFSGREIAKLMASVQAAVYGSPDCILNPQLFSEVVEYKIAEHQQRMKLASEAAA

SEQ ID NO: 117725 - protein, 127 aa, Triticum aestivum
  unsure (1)..(127): unsure at all Xaa locations
  Clone ID: PAT_TA_12143.pep
RGQSAXRDRTFXAQLAGSXESPSYDGTGDCGTMYCGGYKEGIXKLDCNHVXGDGSRNISIFHIDEASPPSELVSGCSSISITDSQDVLNGELDLIEVEYKDWFDELARMREEAMEGGQEKWLQYNDV

SEQ ID NO: 117726 - protein, 136 aa, Triticum aestivum
  Clone ID: PAT_TA_12144.pep
LIPLKRALNPFCVSYEFVESVTAAATSFSLSFSFAGSVAAGATSSSLSFSFAGSVPPAATSSSLSFPFAGAGAPASSCSLPPSGPFPCPRPPPPRGRSRRQRLPSIRRPAARPSSCLTAQRALSVPTSTATTWVIV

SEQ ID NO: 117727 - protein, 85 aa, Triticum aestivum
  Clone ID: PAT_TA_12145.pep
MASHSAAGRRPTALVHIALFVAIAAVIINSSVCLGAAVHDAATSGTGALDPNVPAVPTPGGAGQPYTGRGCRTVYGCKPPAGSQP

SEQ ID NO: 117728 - protein, 88 aa, Triticum aestivum
  Clone ID: PAT_TA_12146.pep
MASLGSSAGGRRPTVLLQIALFVVVAAIIINSSVCLGATAVHDAAASGTGALDPNVPAVPTPGGAGQPYTGRGCRTVYGCRPPAGGQP

SEQ ID NO: 117729 - protein, 68 aa, Triticum aestivum
  Clone ID: PAT_TA_12147.pep
VGSTFIADVLPPVIPLARTGRRYIDQITGNNTFLSELELEDLCSACGLVNFTFVRNGFYIMFSATKAS

SEQ ID NO: 117730 - protein, 265 aa, Triticum aestivum
  Clone ID: PAT_TA_12148.pep
RPPTRPAKSVQNVLQQPANHPSWTPPSTEYMQARLDCQICKVAVMDANSLLVCDACERGAHLKCLQHYGNKGVPIADWHCPTCVAQSKGKPLAPKYGKVTRTVVTSQSGPPVGGAQFSVQRVGQNTVAKGNHQGLAANGNIIKPNSTKTGNTVKNSPVLALNAATDLSQSQAVSISGPAKGNANNAETSSNDMEWNEQSCSSTGCEFTAGSELSLHSVDSPNDTVHGQQSTVTSRANCPDNSSAIAADTKIKSEAQSEAPGGAMK

SEQ ID NO: 117731 - protein, 223 aa, Triticum aestivum
  Clone ID: PAT_TA_12149.pep
PRVRETQGEFVKSLIKEVTDAAYKDIEDVVAFVKWLDDELGFLVDERAVLKHFDWPERKADTLREAAFGYQDLKKLESEVSNYKDDPRLPCDIALKKMITVSEKTERGVYNVLRTRDAMMRQCKEFNIPVDWMLDNNLISKIKFASVKLANMYMKRVAMELQYMGPLNKDLALEYMLLQAVRFAFRIHQFAGGFDTETMDAFEELRNLVHVRNSTQGRQLDVV

SEQ ID NO: 117732 - protein, 161 aa, Triticum aestivum
  Clone ID: PAT_TA_12150.pep
ARGSFAIVVVGESPYAETVGDNTDLTILDPGPDTIRTVCSAVKCAVVVVSGRPVVIEPYLPLMEALVAAWLPGTEGQGVADVLFGDYGFTGKLSRTWFKSVDQLPMNFGDPHYDPLFPFGFGLAVNSSQPGFSGARSRGDKKEITVWAALSLLLSMMLAWA

SEQ ID NO: 117733 - protein, 141 aa, Triticum aestivum
  Clone ID: PAT_TA_12151.pep
AGPPLRLPADARARTLPTLLTPPHRIGRRSARGSARARHGRWAWDEGRCGGAGFISIRSVAVEIMRRNLRARCLPLHLVRRQLPPPCACDCAAPCPAQIRQQCRSGWSPTPLQVQAGSIRRSIPHFSFHICLFHIPITHFC

SEQ ID NO: 117734 - protein, 216 aa, Triticum aestivum
  unsure (1)..(216): unsure at all Xaa locations
  Clone ID: PAT_TA_12152.pep
MKCPVKRXALIWKTLLGACRTYDNIEIGKIAANHVIDLEPRDPAPYVLLSNLYAHGGLWDEVARIRSLMRHKNLSKETGLSWMHVGNTIHEFRAGDTGHPQAQEIYAKLSALIRESEDAGEVPDTSIVLHDMSDELKEECLLQHSEKIAVAFGLITTSPTKPIRIFKNLRVCADCHSAIKYICKSTGREVILRDSNRFHRMKDGKCSCGEYRPGRP

SEQ ID NO: 117735 - protein, 266 aa, Triticum aestivum
  Clone ID: PAT_TA_12153.pep
MLFMQQAIKGLVDEFRIPERENIKALQYIPSWRFANGMFAIVLSFGLLLTALRSRKARSWRYGAGWLRGFIADYGVPLIFAGCWGRVPYNIETVPFKTIAMFTLFQTTYLLVCFGITWIPIAGVLFPLMIMLLVPVRQYILPKLFKGAHLNDLDAAEYEESPAIPFNLAAQDIDVALGRTQSAEILDDMVTRSRGEIKRLNSPKITSSGGTPVTELKGIRSPCISEKAYSPRVTELRHERSPLGGRDSPRTGEARTSKLGEGSTPK

SEQ ID NO: 117736 - protein, 751 aa, Triticum aestivum
  unsure (1)..(751): unsure at all Xaa locations
  Clone ID: PAT_TA_12154.pep
MLAGLARPYRFSRAADVIWGSLHTVGPLPVPPRFRRVSPGQVSPVSPSGDLGEGCELLPPPKIDVRGPLACHNHDWTGGFRAPMRVLAPTPQTFAASALPPIPSEGSVTMRTDGLLTAVQTLAPTALRRIVHSIVRWQHLLILCVAEPTVLMYQCMSSFAKDPANVPTSLLTSCSGRFDASVDETIFLLVLLADDLLPMEVKEQRLSNFLQAVMVGGCVAAMPLLKKILAAVLRADMEAIQVLQFLPSWSCANGMFAFVVPFGLLLTALRSRKARSWRYGAGWLXRLHPRPGLPPAGLLWDHMDPNSWGSLPPHDHAPGSXSGSTSSQSSSKVHISMTWPQRGMRSHGAFMPATMIAVLFYFDHSVASQLAQQAELNLTAVRSCAXIVLLLRFLTLMWCLIGIPPSNGVIPQRPMHTKSLATLKHQILRNRLVATARQSMRQNASLSQLYNNMQDAYHQIQTPLIHQQQTVSGLNELKDSTVHGVSSMDNFEKYDYRLMCIYLKPPDLREHRMCNXAEWAAVPFRINFPTAVLWGYFAFMAIESLPGNQFWERILLLFTAPSRRYKVLEEYHTTFVETVPFKTIAMFTLFQTTYLLVCFGITWIPIAGVLFPLMIMLLVPVRQYILPKLFKGAHLNDLDAAEYEESPAIPFNLAAQDIDVALGRTQSAEILDDMVTRSRGEIKRLNSPKITSSGGTPVTELKGIRSPCISEKAYSPRVAELRHERSPLGGRDSPRTGEARPSKLGEGSTPK

SEQ ID NO: 117737 - protein, 62 aa, Triticum aestivum
  Clone ID: PAT_TA_12155.pep
LACRQCTSPLANMLYHFNWMLPEGACLTSFDMSEKFGLTIRRRYDLQLRAIPRVGVKDILSK

SEQ ID NO: 117738 - protein, 236 aa, Triticum aestivum
  Clone ID: PAT_TA_12156.pep
MSTQSISPASVSAQFPYPATAAAAAPSYFPVPFHLQTSQYPTWPTVAPAQPAPAYNAVYPMPQVQQAQQLFQRDSQIISPEALATVKAAIADNDKDKKVEANKKAVPRKAAGQCWEDPTLADWPENDFRLFCGDLGNEVNDDVLTKTFSKYPSFNMAKVIRDKSTGKTKGYGFVSFANASDLAAALKDMNGKYVGNRPIKLRKSTWKSRIDYEALLKPKTRPQKKLKVQPRSVLHK

SEQ ID NO: 117739 - protein, 390 aa, Triticum aestivum
  unsure (1)..(390): unsure at all Xaa locations
  Clone ID: PAT_TA_12157.pep
MGEDGQIRRDRVIIDTDPGIDDSMTNLMACGGRGRASIGLSSLLPCGSIPYPTGSERMVRERAPQTVGPDGQIGRDEAIMDADPGVDDSMTSLIGFGELSLETIRPTTIYENVTAVYGTQNALLAXERAVPPLGPLTNGSPEPLKGGEFRVADFENGSDGLGNLSLPAPTTKKVEESAAEFEANKVSQFPGEISVLALGPLTNVALAIKRDSSFASKVKKIVVLGGAFFAAGNVNPAAEANIYGDPDAADVVFTSGADIDVTCINITTQCCFTDEDLLELKNSKGVHTQFLCDMCKFYRDWHEKSDGFQGIFLHDPVSFTALVHPEYFTFKKGVVRVETQGICTGHTLMDHGLKKWNSENPWSGYAPISVAWTVDVPKVLAYVKKLLMAP

SEQ ID NO: 117740 - protein, 716 aa, Triticum aestivum
  unsure (1)..(716): unsure at all Xaa locations
  Clone ID: PAT_TA_12158.pep
MAGAMVDRATSDMLIGPDWAKNMEICDICNRDPGQSKDVVKALRKRIAHKNPKVQLLALTLLETAIKNCGDIFHMHVAERDLLHEMVKLVKKKSDQRVKDKILVLIDTCQDTLGGPRSSPWRFPXGHHDLRTSSSAXPQHRQDEAQQSFVIRPSESXEVQYIFVSVFSYKFSTWLDHIHLCSSLLLRWMCKLQFLTLLPHIDSIIKFVTTCVRXRQRGNPTSVNGDLMLVSSASDVEPWSQGLALNDDLQRVLAKHDAIAAGIAVRVEKRPKSLQALVDTEDSANQDSKKEQALVDIDDPTSQDSKTEQNQSTSEPSPFEQLALPAPPVSNGSANAAPKPDSGIDLLSWDDTPSTAENSLALVPVTDPLADSTSNQNALAIVDIYSQNNTANSNAKSLDPFGFDSSPTPLGSQPYNTATQHPVQSQQPPQQVALYSNGSAVNPGTSYDPASQYNHTNSGWNGQVANHAAPPPQQVNYDDQSGALPPPPWEAPAAPSNEMPNGQLGAMQPLPTPASQFGGVQPLQPQNNHMAGLQPQPMYNNQPGAMVPHAMQSNQTVGGQMQPGYGNQYGHLAPQPMPMPGMQFAGMQPSPMPGAQPGMMYAQPMPGAQFGGMPQQQMYGGGGRMATQYGYVQQQAAQYYNQGRPAMYGYPGTNGLSQSMYGLSMQDSSYMGGMNSTYQAAPSSSSMAQPMRPSKPEDKLFGDLLSIAKTKQNRAS

SEQ ID NO: 117741 - protein, 150 aa, Triticum aestivum
  Clone ID: PAT_TA_12159.pep
LSRDIRDAKLWRLANSNGDLKTKQEKELASAAGKLAECQKTIASLGRQLKSLTEIDNVVLEPGLGLLLEPRDIALDLRASDAGLLQKRSTGSNFAVFADELYDLDLPDGDVGCFSPLPSMIRPSSPPPSEMSVFAGGLSSLSSYRGKRRK

SEQ ID NO: 117742 - protein, 111 aa, Triticum aestivum
  unsure (1)..(111): unsure at all Xaa locations
  Clone ID: PAT_TA_12160.pep
MNIKVGSVASTPSHYLVWKEKPRLAMFERRLPFFGCGIGIFXLLLGHLCPLIWYIAPLLYCCKYYNRDPRERPGLAASALLAIMLTAATIITLSVLLVMCTHKRFLNSCGS

SEQ ID NO: 117743 - protein, 178 aa, Triticum aestivum
  unsure (1)..(178): unsure at all Xaa locations
  Clone ID: PAT_TA_12161.pep
MDSSSRAALFCFLAVASSLLPPARSDGGVHELGALSGQFGSSPALSCFPADATALLHPARSDGNDNXLIKGTNTQQRLAQGPGGRPEKQCRLPAPSTSTRRSPTTDWTNTPGSPALPRTLGRSSPNXPXLSDRHRLNASVAAGVEVMPACVPGIVAHIVLTNYDTIPCTTGFLKATQL

SEQ ID NO: 117744 - protein, 362 aa, Triticum aestivum
  unsure (1)..(362): unsure at all Xaa locations
  Clone ID: PAT_TA_12162.pep
PSPPLTAPAAPAARLRPPPSPSPPFPPPAPSPPPPPAPGCPSPPPPNPLKAPAACRPPPPSRPNRAEPPAAGEGEGESDRPATPASSERAATAADTATALPPDCAATDPTPPASQGLGTLPAPSPASNPPPPTASGGRVLPNSTPGPGTSPASATAASDRPPAAPSGDTGDDDEDLVGLITVLNLGRYGENRCIKXLKEYLLAVCGDKDTKKKLKSLLEDKASTVGLLVCRRFVNFPYEMVPKMYDSLFDEVAWATEDEPTQELQDSFRFKQYLLLVRILERKTPPKQKAKNSKDEDEPVIYPKLEDEIFRELSSWSFTFPIRAEQSAQQELKNYKEMGLVMCVKAEAIPKFRKKLEALVSE

SEQ ID NO: 117745 - protein, 162 aa, Triticum aestivum
  Clone ID: PAT_TA_12163.pep
MRLEKCWFCSSTVYPGHGIQFVRNDAKIFRFCRSKCHKNFKMKRNPRKVKWTKAYRRLRGKDMTQDATFEFERKRNRPERYDRNVTEQTLKAIPLITKIRHERQKKHITERQKGGKSMVRKSDAKELDQFIDMVPKQETENYVAKQKVLVSQLKTEENLMEE

SEQ ID NO: 117746 - protein, 133 aa, Triticum aestivum
  Clone ID: PAT_TA_12164.pep
HVLTRRLERSGRRANRKALEVVARGEKPKEDPERGGQTKRRGREQQGSQGLPRRRGRIREETMQYKKSTSHGEVGRESRHPHGCRVIQRGRGHSPEGSTRLDGRGEMKRPARGGRAYRRCRPPPNGIGMTMYS

SEQ ID NO: 117747 - protein, 308 aa, Triticum aestivum
  unsure (1)..(308): unsure at all Xaa locations
  Clone ID: PAT_TA_12165.pep
MVMQGLIAGVDADGASRVQSIGAPGFWRGDLADLERDIFFQRGGYRCGCKWAAEDQVSVEGQTXVGDPADVILDDTPSPTEAPXCGLLEIWIGFSRPPDMISRFVVGQRVRIRGCIRQPRFGWSNHNHSSIGTISSIDADGKLRIHTPAGARAWLIDPAEVEKVMDEHEVCIGYFVVAKDSVLIPTYQXGLSDPQQHXGLAHRAGDGELWVSFCFCERLWLCTGLEVEKVRPFRPGDRVRIRPGLVAPRWGWGMETYASKGEVIGVDANGKLRIKFRWRDRLWVGDPADVILDDTPSPTEASNGGFCS

SEQ ID NO: 117748 - protein, 193 aa, Triticum aestivum
  Clone ID: PAT_TA_12166.pep
ARGSKRAPGGFVASRSRYLKDAEFCPIPENLGSVADEDLWMQLNKGCITDLDMLEMTSDFKCPPSPEDTTAVVPLEDGIDVRCLRLETACSSDRQQLEDSKARCTTLEKELELLKEENSSLRQELSKSKHDTDHEKEGLLKELETEKYKMEELKQDIRLFRQAFSQRQGHLTSLYTKSKAIVENCKASRVALP

SEQ ID NO: 117749 - protein, 92 aa, Triticum aestivum
  Clone ID: PAT_TA_12167.pep
SADAWADAWADAWAATVGTLHNLECYLHGVAGEQGSAGGFKLEVDRDISLVNKGADALTDEHPVPACWWVPRHKFMVKGEDGRWTLQDFKHI

SEQ ID NO: 117750 - protein, 200 aa, Triticum aestivum
  Clone ID: PAT_TA_12168.pep
VQVPKEVTRLVELYKDEEVSITVCGHSLGASLATLNAVDLVSSGANKPESSTKSFPVTAIVFASPHVGDRFFRSAFNSFPDLKALHVQNAGDIVPMYPPLGYVDVAVELTIRTIRSPYMRMPATVLTLHNLECYLHGVAGEQGSAGGFKLEVERDVALVNKGADALTNEHPVPAEWWVPKHKFMVKGKDGRWALQDFKHI

SEQ ID NO: 117751 - protein, 136 aa, Triticum aestivum
  Clone ID: PAT_TA_12169.pep
LHLILRRSVISRREGVAPPATPACGHRRREDREVMARGKQLPRGQRDLPSDRPAHTRTTRPIEIREVTADGIVMASEVPFYEVMPKACTKRQLKWRRLIQKLGHLWQRNNGLSPDKKLSRSFLMRWGALAVQQFED

SEQ ID NO: 117752 - protein, 335 aa, Triticum aestivum
  Clone ID: PAT_TA_12170.pep
TAVNGHLDHKNILHCPQTKSDIIQTATSLARQLRSRGVAPELAVTGDLCRHLRKTLEAMESASVQELSLNESLQNFLEGCLVEVVRGVKDVRPLYDMMAITLENLPSIPAVARATIGSSLILCHIISLTSVSSDAPMQVFPEALLQQILRSMVHPDADTRVGAHHIFSAVIVRGPSHQRGDSEYLFATKKCQSRSPSVFASATALLEKLRREKEPTRPRTPGHMMHDDGKERNTHEEDNKHVWARKSPAYFSKLVFSFVDRWATLASSAEETKIVLLTEDQTNQLLSAFWIQANQTDNTPFNYEAIGHSYSLTVLSSRLKNSSNSNNIQFFQLPL

SEQ ID NO: 117753 - protein, 375 aa, Triticum aestivum
  unsure (1)..(375): unsure at all Xaa locations
  Clone ID: PAT_TA_12171.pep
LEDQTNQLLSAFWIQAHQXPLTLPFNYEAIGHSYSLTVLSSRLKNSSNSNNIQFFQLPLSLRSIALTPSGGLPPSCQRSIFSLATNMLAFAGKVCHIVELAELLRCFTSSNIDSYLRIGEDLQLYVRLQSDLGSYGSESDQDVARSVLSDCRKKVGINDQRVLDVIACALSNLTEMDKDALAKELTEMFTPEEVPLFGSNSALDWANFHAQAFSDESLSFDEECSRTSSVDGGLHDSPITNTASSTSKITLPHSAPRVLGVGQLLESALHVAGQVAGASVSTSPLPYGTMTSQCEALGSGTRKKLSSWLVNGHNSTPDNPVPSLPAADHFILPKVNSCGFEMNRTSSEPCSMVKLPPASPFDNFLKAAYRTPQEM

SEQ ID NO: 117754 - protein, 260 aa, Triticum aestivum
  Clone ID: PAT_TA_12172.pep
MEPAPLSSLQEEGEPDESSSSSAFSAAAVPPRPATHHSLQKYAPLDWSAYFDEERPVAIPDTEDVFNVYMAGSEGPVVFCLHGGGYSGLSFALAANQIKGKARVVAMDLRGHGKSSTSDDLDLSIETLTNDVIAVIRTLYGDPPPAIILVGHSMGGSVAVHVAARRAIHNLHGLVVVDVVEGTAMASLIHMQKILLNPSTALPRAFEKAIEWECPKVGPLRNIDSARTLSIYLEYDEQRKPYIPYPPWKNREKMVQFQTF

SEQ ID NO: 117755 - protein, 352 aa, Triticum aestivum
  Clone ID: PAT_TA_12173.pep
MLPSLLMQGYGPQSVEEKQRLYMLLRNLNFNGESLPASVSEPYTPTAQKFGSGTSAEGLYSPELRGELGAGLLDLHAMDDTGLLSEDVDSEPFEPSPFMPKEIDDDEDDMITGSQLGPADNYNAVTSEKEISTRENNVAKIKVVVRKRPLNRKELSRKEDDAVAVHDSSSLTVYEPKLKVDLTAYVEQHEFCFDAVLDEDVSNDEVYRETVEPIIPIIFQRTKATCFAYGQTGSGKTYTMQPLPLRAAQDMIRLLHQPVYRNQNFKLWLSYFEIYGGKLYDLLSDRRHLLMREDGKKQVCIVGLQEFEVSDVQVVREYIERGNAARSTGSTGANEESSRSHAILQLAVKNIL

SEQ ID NO: 117756 - protein, 200 aa, Triticum aestivum
  Clone ID: PAT_TA_12174.pep
PGRRPRDSFSPLHGPGHILGVFSHPCCRVCSSPSPSLVPGSCRRGPPLLSGARGSRAASGLGQTIGSLPALIFCAPCASPAAPAGGRAVFVVPSLFSPLCVGAALPPVISPRLGLDAALAALSSAGPFASPGLTLLGRMLLKTVLDSPSRLVAVYVICFLCFSPQVSFSLSFPSGHLPVCITRLFSPFSAGMMFFSATVG

SEQ ID NO: 117757 - protein, 156 aa, Triticum aestivum
  unsure (1)..(156): unsure at all Xaa locations
  Clone ID: PAT_TA_12175.pep
NFKXGSSQLRFQPRHGGFLAAASENVVSILDVETQACVRIFEGHTEHGDSVCRSRTGDYVVCSGGATVGVRSVNAGDGPCVRELNSTGSKFHACAFHPKYPSLLIIGCYQSLELWDMVENRSMTVAAHDGLISALASSSSGLVASVSHDKHVKLWK

SEQ ID NO: 117758 - protein, 219 aa, Triticum aestivum
  Clone ID: PAT_TA_12176.pep
RHEDGVPLHLIRELYETFRNFRIRISDYIRYRKVTSNMNERFPDATPDELDAGDVTCIICRDGKAAAKRALGGHLFHVHCLRSWLQRQHTCPTCRAPIIPPDNGRAASAQQHGAQPGVQPGTGTPSSGGAPTENVNMRQAKLEAAASAASLYGRSFAYPPVNTLNRNSGPLHATPSTSQPGEASTSTSHPLEPQPSYSRGPERAAGRQEGPWKRPTERL

SEQ ID NO: 117759 - protein, 152 aa, Triticum aestivum
  Clone ID: PAT_TA_12177.pep
MAPKAEKKPAAKKPAEEEPAAEKAEKAPAAKKPKAEKRLPAGKTASKEGGEKKGKKKSKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 117760 - protein, 133 aa, Triticum aestivum
  Clone ID: PAT_TA_12178.pep
MESGLMDSTQTEQDVSAVGEDSLGEGYAGPTTLEACLSTTPGDVSERSETEKEQQSTDDVSESGAEKLPVADTRDVAPISDSIVLEAGSILVEFMRKEAACMAAHSLHGRSFGDRTVSAGYAPHDLYLQRYPR

SEQ ID NO: 117761 - protein, 142 aa, Triticum aestivum
  Clone ID: PAT_TA_12179.pep
RDVMSSDPYVILNLGHQSMKTKVIKSSLNPVWNGRLLLSIPDPVPLLKVQVYDKDTFTTDDRMGEAEINIQPLVAAARAYETKSITDNAELNKWMAKDGIWIPRDSAITIIDNKVKQEVTVRLQNVERGHLEMELECVPLTQ

SEQ ID NO: 117762 - protein, 137 aa, Triticum aestivum
  Clone ID: PAT_TA_12180.pep
SRLYCTLIGHVKPVLGVSFSPNGHLVATASEDNFCRIWDLRTRQMLYSIPAHKSLISHVKFEPQEGYYLATSSYDTKAALWSTQDYKAIKCLAGHESKVTSLDISGDGQQIVTVSHDRTIKIWSCRGTARDNEMELD

SEQ ID NO: 117763 - protein, 67 aa, Triticum aestivum
  unsure (1)..(67): unsure at all Xaa locations
  Clone ID: PAT_TA_12181.pep
INGVWLPXQVQMQSSSGQSDATNDSRSQHLISAHDFSVAMQLNPQQLGEDWPVLLEKERLRPREEKD

SEQ ID NO: 117764 - protein, 104 aa, Triticum aestivum
  Clone ID: PAT_TA_12182.pep
SIYIPEVSIFIFQGSSCQAEQEGLRQKCKNHVHNNLINRPPRHFHLHHPMVGPAKLKQKLQPQRPAVLPQQHGVASHGNHERCSARGPALLFTNPSRPSGPLLF

SEQ ID NO: 117765 - protein, 177 aa, Triticum aestivum
  Clone ID: PAT_TA_12183.pep
STHASNDPMQSSFNATLEDKNLEIPNFRLLLKQVVTMEVIQWTKLWEFFKDEYENEKNLLGGALGTKAAEDLKLRIIEHNILVVSKYYSRITLKRLADLLCLSLQEAEKHISDMVNSKALIAKIDRPMGIVSFRTAQDSNGVLNSWASNLEKLLDLVEKSCHQIHKETMIHKAVLKA

SEQ ID NO: 117766 - protein, 441 aa, Triticum aestivum
  unsure (1)..(441): unsure at all Xaa locations
  Clone ID: PAT_TA_12184.pep
MEGGSSSLDAAIESLLNTEKQCRLAGDVAGTRKAAVDIVELCFKDAAWKTLNDQIVVLSKRRGQLKQAITAVVQKAMEYIDVTPDVETRIELIKTLSSVAAGKIYVEIERARLIKRLAKIKEEQGKIDEAAEIMQEVAVETFGSMAKTEKLAFILEQVRLCLDRQDYVRAQILSRKISPRVFDADTSKDKKKPKEGDNMVQEAPADVPSLLELKRIYYELMIRYYSHNNDYLEICRCYKSIYEIPSIKEDPAKWTPILRKICWFLVLAPHDPMQSSLLNATLEDKNLSEIPNFRLLLKQVVXTMEVIQWNXLWEFFKDEYENEKNXLGGALGTKAAEDLKLRIIEHNILXLFRMYYSRITLEEXWSDVLCLSLQEAXEKHISDMVNTRALIAKIDRPMGIVSFRTAQDSNGVLNSWASNLEKLLDLVEKSCHQIHKETVTH

SEQ ID NO: 117767 - protein, 132 aa, Triticum aestivum
  Clone ID: PAT_TA_12185.pep
MRGGFHLTRAQLMRDLVHLYRHVLKEPSQALTTGAFGAIPVAVRMILDIKHFVKDYHEGMNATNSGVVGHVYISLCCTLIVRNGSPELVPPYETVTVPAHATVGELKWEVQRLFRDMYLSLRTFTAECVVGI

SEQ ID NO: 117768 - protein, 196 aa, Triticum aestivum
  unsure (1)..(196): unsure at all Xaa locations
  Clone ID: PAT_TA_12186.pep
MALHQHHAGSASGSASASSSSSGLHASAHASVGDTTHTKLFVGGLAWETTSERLRRFYERFGDILEAVVITDRHSGRSKGYGFVTFRDAEAATKACEEPSPVIDGRRANCNLASLGRAQPSTPLGRPRSAGSYFGVPVPRGIYVGGYGQQRPLPIGYYQYQGFPVPQYSYSTYGTKYLXQGTLNPYVGQQYVPVYG

SEQ ID NO: 117769 - protein, 196 aa, Triticum aestivum
  unsure (1)..(196): unsure at all Xaa locations
  Clone ID: PAT_TA_12187.pep
LPFRDPTVRVRPVTPCLLQVIFGNLSSTXGEPREAHKLHRLGQSCGMYRATTFSYFLCTQKRVASDYPTTSVSFSLLLGIFASVNHTDAAPTCMVSVDGDKAWLVAGRRRIGVGILFFLLLLVVLVLGVREEHVSSLVSLQHQVIWSPRRRCRVAFALTSAVLGNRVPAVRSTRSKNRANEYSPSPPTMRGRVCRR

SEQ ID NO: 117770 - protein, 194 aa, Triticum aestivum
  Clone ID: PAT_TA_12188.pep
MGSTEDGRVRKGRGFTQKYSFARRYRTPSPECSHVRSSYYGGRNDRWNNFNRYGRNGLYGARSPVRRYQGSPRASSPPRYTRRDRSRSRSRSPVRRRDGGGRHRRPSPRRSRSSAEQHKRDAAYRPRSGRGGDGGPSAANRGRSRSRSKNRDASRSRSPNAAPAKRVSSKYNRRRSSSSRSSSPSGSKGGLVSY

SEQ ID NO: 117771 - protein, 146 aa, Triticum aestivum
  Clone ID: PAT_TA_12189.pep
VRVDPPHAIDRLHNRISMLQVVSELDVPLSDAASASADGEGHRHTFGIPSQVVVYDAAALADSGLLAALRFPLIAKPLVADGSAKSHKMSLVYHREGLRKLRPPLVLQEFVNHGGVIFKVYVVGGHVTCVKRRSLPDVSKEILEDA

SEQ ID NO: 117772 - protein, 157 aa, Triticum aestivum
  Clone ID: PAT_TA_12190.pep
LNASGVCFAGSASRGHAAAWSSNTAATCIWFIISYFQKLHTARGRTASVPITKTDQFPGLPVFILPRISCFLSLCFFPPQRAPQKEGAAQATGHRTARKAGAECGLGIRTACMACEVGCRPLAVVNGEYEFGGWILVSGVNFLFDTSGVESVQVYSG

SEQ ID NO: 117773 - protein, 342 aa, Triticum aestivum
  unsure (1)..(342): unsure at all Xaa locations
  Clone ID: PAT_TA_12191.pep
MEPQAVQNRDDLFVWPWMGVLVNVPTEWKNGCHVGESGNRLKEKLSCFCPQKVIPLWNYRGHTGNAIVEFGKDWTAFNNALAFENHFESEGYGKLDWKAYKHRRPGMFGWVARADDQKYPGPIGDYLHKNGDLKTIADVENEEARKTNKLVANLASQIEVKRRHVEELECKYNETTTSLDMIMEQKDQLLRAYNEEIHKMQQLARRHSQRIIDENQKLRSELESKMQNLDSRSKQLDELVARSESDRRNLEHEKEKNGVKTKHLKMATLVQQKADENVLKLVEKHKLEKQVALDKIIKLEHQLDAKQKLELEIKQLQGKXXVMKHMPGEEDXXSXXXIDELS

SEQ ID NO: 117774 - protein, 165 aa, Triticum aestivum
  Clone ID: PAT_TA_12192.pep
MGTSSGANFHQQLPQGMPPPRHNRGTPNLQTSLSLASSDQVGTPDIQERASNSDPGHDSATESASSRETWPVEPNKSSGGGAATTIRIVDKDKEVATKGVAERQVIRSTGRVTLREVARERVDLVAEKMKVMLDEVLDEIKSELRSILEGTEGSHHVEEVFDLQK

SEQ ID NO: 117775 - protein, 212 aa, Triticum aestivum
  Clone ID: PAT_TA_12193.pep
MDTAAAGSPREGHRTVCSEPPKRPAGRTKFRETRHPLYRGVRRRGRLGQWVCEVRVRGAQGYRLWLGTFTTAEMAARAHDSAVLALLDRAACLNFADSAWRMLPVLAAGSSRFSSAREIKDAVAIAVLEFQRQRPVVSTSEMHDGEKDAQGSPTPSELSTSSDLLDEHWFGGMDAGSYYASLAQGMLMEPPSARTWSEDGGEYSAVYTPLWN

SEQ ID NO: 117776 - protein, 542 aa, Triticum aestivum
  unsure (1)..(542): unsure at all Xaa locations
  Clone ID: PAT_TA_12194.pep
NNLLASIGEISSLEYVNLSSTGLHERIPGALSSRLVGLHVLDLSRNNISGVVPDLSTLPLRVLDLSVNNLTGEIPVSLVKKLVSMDRFNFSYNNLTVCASELSPEAFTAAFARSRNDCPIAVNPDSIKKNGGHRKGMRLALAIVLTLFFSVLALLCLALVCRKPRKKRGDTFPVDKQPSSFKDEPGTSGPFAFQTDSSAWVADVKVATSVPVVIFEKPLLSFTFADLLAATSNFDRGTLLAEGRFGPVYTGFLPGGIQVAVKVLVHGSAMADEDAARELERLGRIKHSNLVPLTGYCLAGSQRIAIYEYMENGNLHNLLHDXLPLGLQTTEDWSTDTWEDNNGGVATENITPRGXLRAWRFRHKIALGAARALAFLHHGCIPQIASGDVKASSIYFDYAMEPRLSDFGLSMIAGTSTDGDHSPGYVPPEFSDPENATATSKSDVYSFGIVLFELITGKKPLGDEYPDQKEASLVSWARAMVKANQGSSIIDPKIRDTGLDRQMDEALRVAYLCTAELPSKRPTMQQIVGLLKDIEPRVADEN

SEQ ID NO: 117777 - protein, 617 aa, Triticum aestivum
  Clone ID: PAT_TA_12195.pep
MSGAALCAALTELGFDGEDPLDADALEWPFQYEEARPLLAWICSCLRPSNVLSPSHLSQYEQLVEEGRLLEGEDLDSAFDSISAFSSKKDNQEAVFEAEETILDIREAKLAYRAEVFELQRQLARQQAQFDMLAGQASSLIQGRRARVSAMSAVSVQLISLDEILSSRNLEMNAVLGRITATTQELAHYHSGDEDSIYLAYSDFHPYVIGDLACTKELNRWFSKQFEKGPFRLVAEEGKSKCSWVSLDDITNGLTRGDSEKSHHHQRVTELQRLRSIFATSERQWIEAQVENAKQQAILQILKSQVSSDEAHIHRDIHSLRRKSSELAGEFSTLTQKVQPFISETIPCLCSELAQLQGTYILQGDYDLKVMRQEYYINRQKTFINHLVNQLARHQFLKIACQLERKHIASAHALLRVIESELHSYLSAVNARLGHCNSLIQAASEVREQGAIDDRDTFLHAVRDLLCIHSNSQAAVPTYMSAHALVQQISALQSDLLSLQSELETTLPADRKRCINELCTLIQTVEQLLFASSTTAEPVLTPWPLMRALDDMENANAQVEVAVEEVTKARTQKIKIFENRAHEVGRERQVFVDFFSNHERLKNQVRELTSRVKALQE

SEQ ID NO: 117778 - protein, 175 aa, Triticum aestivum
  Clone ID: PAT_TA_12196.pep
MLKFRRMSRSSNGRQKIRKRVVKKEVSSIVSDRRKAVVENITQELATKLSPSIVSLASFDGDKMHFRSTGIVLANSSSGGACVLTSSALVSTSDKERMLTPALKIKLRLPNNEVVGGWIKRYRLPCSMVVIETRFSPDLRAACLNKTVQVEPHSQLLAVKHCFHSGKLMDTRGEL

SEQ ID NO: 117779 - protein, 149 aa, Triticum aestivum
  unsure (1)..(149): unsure at all Xaa locations
  Clone ID: PAT_TA_12197.pep
MGAITSAELNFLVFRYLQESGFVHAAFTLGYEAGIHKGGIDGNIVPPGALITIVQKGLQYIELEANTDENDQEVEKDFALLEPLEIITKDVEELQQIVKKRKRGRLQIDCDKDKGKAKECIEEHEHRLGGERSXERHDKQKTHRWKEIE

SEQ ID NO: 117780 - protein, 326 aa, Triticum aestivum
  unsure (1)..(326): unsure at all Xaa locations
  Clone ID: PAT_TA_12198.pep
PRVRQELATDLDFTRQGRENAMLVRRLELLGEVAKLARSLHLPEDVSYTCENAAYFWLLHVYARWEQFLAACVPNKENPSFVKDRFPFSEFFLDTPQPVFTGESFEKDMHAAKGCFKHLSTIFQELEECRAFEARGSTAERANYLMTKQAKIVAMTCTHAALKRRDFLQLGFKYDNLLMEESAQILEIETFIPTLLQRQEDGYARLKRCILIGDHHQLPPVVKNMAFQKYSHMDQSLFTRFVRLGVPYIELNAQGXRARPSIAXLYNWRYRELGDLPYVHEEAIFHKANSGFSYEYQLADVPDYXGRGESAPSPWFYQNEGEAEYI

SEQ ID NO: 117781 - protein, 64 aa, Triticum aestivum
  Clone ID: PAT_TA_12199.pep
LGNRESTFETLVDAFVVLDNNKDGSLSMDEISLAITISIPGERSAGRTTIKRLERDGLGHEWDG

SEQ ID NO: 117782 - protein, 143 aa, Triticum aestivum
  unsure (1)..(143): unsure at all Xaa locations
  Clone ID: PAT_TA_12200.pep
VXGXTDGXXKQPMADLRAIEVDIXXXGTILTPXGRHLRVREYVTPXEKFDFLKGVWRSLGFVYVASGXLVRXSYRAGEIFVPKFCPDRKRPSLYLLHPSLILAQSIIPCQSFVREELVLRPPELRAMLILQSFALVSFMIAYT

SEQ ID NO: 117783 - protein, 135 aa, Triticum aestivum
  Clone ID: PAT_TA_12201.pep
ENRINEGLLPVLSFLAHPRNPLPVCIPSNATKRSAGSPCSHKTFTSASVPLKFGSCIVAGSLMMPSQEEIFRTESSLVSSLHDTMAPGSNRTAVGSLFLPTRWSSSGRLAVRRRELAAVTPHPQNQAPPVIIVLK

SEQ ID NO: 117784 - protein, 161 aa, Triticum aestivum
  unsure (1)..(161): unsure at all Xaa locations
  Clone ID: PAT_TA_12202.pep
MQFLRGVGGGGGGGAGGAGSMAWEVLRRHFSRKRAVDIRRINPKVPKXEDEVIFGRLLQILADHGPLTVGNTWNHAKDAAIDGLNSKTHMKILLKWLWGRRIIKLSCTQAGNTKKFLYSPFTADDAEAAEEPSPAEEQPKKKGWKGKHPKYQTKKQPAAAA

SEQ ID NO: 117785 - protein, 188 aa, Triticum aestivum
  Clone ID: PAT_TA_12203.pep
MQFLRGVGGGGGGGATLGSTAWEAFRRHFSRKRAVDIRRINPKVPKEEAVAISGRLLQILADHGPLTVGSTWNHAKDAAIDGLNSKTHMKILLKWMWGRRIIKLSCTQAGNTKKFLYSPFTAEDTEAAEEPGRGAAEEERVERETPKVPDQETAGNSRLDPGLPAVSIPFGHFRAAAVIFFCFLLSTE

SEQ ID NO: 117786 - protein, 162 aa, Triticum aestivum
  Clone ID: PAT_TA_12204.pep
KTEIEDKQKRLQAVKQSLLSIEAKDEEINRRVERASKVYDLLEKRIESFKMLPAANKKPLSQAELEFKSQLDRFADVELDALRTSIAALSTRMKRFTQPSLGGGATGTGMAPWQAPKAGRGHVSESQMSLMKSSLERLSLLNEENNQKLRAIETELKNKEQQ

SEQ ID NO: 117787 - protein, 392 aa, Triticum aestivum
  Clone ID: PAT_TA_12205.pep
RPLNLARRVDSASGSHTPMAGNEGFATKRVLGRCTAEEISSDPAQQKSAIDGFGTPERCATLPTAVTREYALLKRKSKEADQDHDEEQEQEKEINEILATAKLPRRADVVSVAAAEPMVVDPFLEQDIAKATVSEPQADAEIEEPVSEPQAEAEIKEHVSEPQADAEDEEPYAEPDAEADPQDRADYDGYYDEDEDDYESEYDDDYDHEDQDDHDYDWESEFAKHRPVVRETLLNFPEAANLEPQELDAAVERVLEQSKPEYRDVAAPGKVRLLKNDIRLILADKWEPPNIHILPSTISPADMIKRSEELDKELPPGNDKEADDRFGELQAKVRKDLIEKGYAEVDEDYYDNSGKFWEELREEWNKIDFSRFRFASSEDGILRYSEELGDFI

SEQ ID NO: 117788 - protein, 271 aa, Triticum aestivum
  unsure (1)..(271): unsure at all Xaa locations
  Clone ID: PAT_TA_12206.pep
IRHEANPCRRPTPPPPPRPTTTPSSIEVRFEDFLWANSIFWTRALNIPLPHSYVFPGSLDGQQIRTGEVLGDSDLTTQQETDTTTKNSSCDENSESHNMESIWVEGLVPGIDFCNHNVKALASGEVDSEGNLTGIPASMYLILAQAGKSSVETGTEIYINYGNKGNEELLYLYGFVVDNNPDDYLMVTLTLIHYPVEALRQLQSADIKMKLIEMQKAELRCLLPTSLLDRGFFGTSTSSGEDDDNKKKHFSSYXSWSGQRKVPSYLQKNVF

SEQ ID NO: 117789 - protein, 142 aa, Triticum aestivum
  Clone ID: PAT_TA_12207.pep
MDKTVYTVKVGEATPAAGGRPAAGPVYRSIYAKDGLMRLPQEIHSPWDFFSGAVKKYPKNKNAPGRRQGFPGRRWRRCTAFGRTSVKQCQKGSQNGPIKKGFRGFKRALQQPKGNLFPPVIANPPGKKSLPFREKGPFTFPN

SEQ ID NO: 117790 - protein, 142 aa, Triticum aestivum
  Clone ID: PAT_TA_12208.pep
MDKSKGSTARKTATCSCNKPQLLHKPCSHVIAVCCHIGVSAAEYMSPYYSLTCLGRTWSKKFNEFSRNYRKNLPRYYRDVRPFERETPTWIPDKRSECGFPVYLLSDCVQTAVVDEGQQCTTEDESVAGNESTNARSEESRT

SEQ ID NO: 117791 - protein, 430 aa, Triticum aestivum
  unsure (1)..(430): unsure at all Xaa locations
  Clone ID: PAT_TA_12209.pep
PRSPPLPLSLLCSWKKLDLLMAAAADFTQSKQAMSYALCKHLNLDPNSISSTLIKENDIASLFSHIVTSPQDEVKKWVEFSSNFVLSDGEQHALLGNLNQHLSQMSVLLAGFKPSAADIIVFATVHVFMCHLSDSELQKYPNILRWMDYIQNVVDFGMTLQKINLTKSIFNPPAPAPSHPKKADKGDGDPNSKKAVSGQKVADKSDVAADSKKAAGENKVPGXRANPTPTKNNKPSGEKXKVKEKTAGKAEAAAEEAPQRSAEKGSESVISMQIQVGGVSKAXWQHPSAGLLVEEVVLGGGNNVRQVVSGLAXFFSPDELVNRHVVLITNVKPGKLRDVMSAGLVLCASNKDHTVVEPLIPPEGAKLGERISFAGFDGKPEDVLNPKKKQLDKITPHLRTDENGIATFRGVPFTTSAGPCRSSVPNADVK

SEQ ID NO: 117792 - protein, 250 aa, Triticum aestivum
  unsure (1)..(250): unsure at all Xaa locations
  Clone ID: PAT_TA_12210.pep
DADRFAASFSALWIPRVRDVVNLGCSCKNELALAHYACALKWFISHGSTVCEICGNVATNVRPEDFNMVLASLKDYEALRERTSTGDLSYLHYRADAFVDPVALAAVRRQRLCEISSWFNPHNTHFVFSQRHNEEVPVSPSNNSVDYSVTAARAAHARRKFGSSGXFVAIALGFVLLAWFVAPHVGKRAAAIILHMLLGGLCSLTIIISLRFVFPRIQFGSIRCWAILFVSWFLVFGVWASRTRTTRRAS

SEQ ID NO: 117793 - protein, 232 aa, Triticum aestivum
  unsure (1)..(232): unsure at all Xaa locations
  Clone ID: PAT_TA_12211.pep
MMERQGEAWCSCSPRQCRICHEEEGDDGCATAMESPCGCSGSLKYAHRGCVQRWCDEKGSTVCEICLQNYEPGYTAAPKKTQVAHVAVTIRGSLEVPRQDYEAPEDAPLIGLDAAAGDPAYAECASAAGRSAAWCRSVTVTFTVVLLLRHLIALVTVVAANQYAFSLLTIYLLRASGILLPFYVLMRLISAVQHGQMQYRLQMLQXDQRRNASRMQHGVPGQRQQQHVILVV

SEQ ID NO: 117794 - protein, 607 aa, Triticum aestivum
  Clone ID: PAT_TA_12212.pep
ARASPPPAGPLPPIRAAPGSARVARARALAAARRPRVAPGAGAGRLAGGAGALASAPSARRRTAAPGGGSCGVPIGALGGAPPPPWPLHGVCPRPGPARAPPVLVRAHALGFLAFVRGKNFLITGGTGFLAKVLIEKILRTNPDVGKIYVLIKAKDSETALQRLQNEVVDTELFKRLQEIHGKDYQDFIATKLVPVVGDVREANIGIAPELADEIAERVDIIVNSAANTTFDERYDVAMDINTVGPFRIMSFAHRFRRLKLFLQVSTAYVNGQRQGVLVEKPFRLGDTIGKGSAGSSDSSEQHKNAVLDIEAEIKLAFWSRRRADDDSASFSQEMKDLGIERAKLHGWQDTYVFTKAMGEMVINSMRGEIPVVTIRPSVIESTWRDPFPGWMEGNRMMDPVVLYYGKGQLSGFLADPAGVLDVVPADMVVNATLATMAKHGRAAEGGMHVYHVASSTVNPLVFGDLSRFLFQHFTRSPYSDAAGQPIAVPPMRLFDTMEQFASYVETDALLRSARAGIPADERLSQRLQELCAKSVEQTIHLGSIYQPYTFYTGRFDNGNTEGLMAEMSAEEKAAFHFNVRSIDWTDYITNVHIPGLKKHVMKGRGI

SEQ ID NO: 117795 - protein, 185 aa, Triticum aestivum
  unsure (1)..(185): unsure at all Xaa locations
  Clone ID: PAT_TA_12213.pep
AECGGAMVGRMANVLWLKGSFVETIKGWQSGWFYITEPRDPKWAAAPEFLSGFPTRLTSWKETGLMWGDLEELTRLQACVQKLVNKNIKLVNVVQVMLIRRIVPCQQRAFKLWEFDLAHHQTLSKFFDTTYEDAWKVLFKGRRXSRVRYRRLRIISPXQADEVSXFTLYRTLSXFDPSGXXTPCX

SEQ ID NO: 117796 - protein, 261 aa, Triticum aestivum
  Clone ID: PAT_TA_12214.pep
RLLAIYLENEKNNSGPEKENLTVPTSTQASPATSPAMLPNTKEASKCEQDNHKRGPYSDRDDDDASAPLKHKKVSRKQADRKLKSDSGTRTSLPPISSNNGKGDCFNSCSGQGISHNVKQTADGIATCSTAPKLNGNHVSVAPVNDTISFVASHPGPNGVASKPPSHMKAGTNGIDKGSGLSNENLANVKSPFKLFLMDEDGIDLFVDLNSTPGDWVGSFKGGVNLPPSTHNSETDMFTHSISSLRNRMIRPQWCHQIILL

SEQ ID NO: 117797 - protein, 198 aa, Triticum aestivum
  Clone ID: PAT_TA_12215.pep
GESYVKTSTNNTSDHSEVMIMGKRVTLGQKEHRSPNQYNFLGPSMESSLPVRSTQSYAHTPPDFSVFGYPSQPAAMSLPPPLYAPGGAPYMVDARGAAVVPPLPGLGVGISHPSFTSRTIQPVPSEFGYMNASMDFNYALSSEGARREAGGYWPVPFQGHTVFLDERMRSTSQGGSSGTGLVSKRKEPDSGWDIYPRH

SEQ ID NO: 117798 - protein, 85 aa, Triticum aestivum
  Clone ID: PAT_TA_12216.pep
EQTHHHQYSSVELEASKIMYTQIQIQGNIKYIYSAIFSPAQDCLVSKSLAYIFCSEISLLNFNPHCLINSQNIKLVSSLQILSYE

SEQ ID NO: 117799 - protein, 136 aa, Triticum aestivum
  Clone ID: PAT_TA_12217.pep
DGWPALSIHGDKSQAERDWVLSGFKSGKSPIMTATDVAARGLDVKDVKYVINYDFPGSLEDYVHRIGRTGRAGATGTAYSFFTAANARFAKDLISILVEAGQKVSPELANMGRGAPPPSLGHRDRYRGHGGGRSWS

SEQ ID NO: 117800 - protein, 145 aa, Triticum aestivum
  unsure (1)..(145): unsure at all Xaa locations
  Clone ID: PAT_TA_12218.pep
QAITVAXQRVAVPPMVFAGGRVMDSRTVITRLQPTAYRALRDAFRAQMGAYRVAPPKGQLDTCYDFTGIRTLRLPKISLVFDSRSNGGAAVELDSSGVLFNSCLAFASTGGGDGSTGIIGYVQQRTIEVLFNVGGSAVGFRRGAC

SEQ ID NO: 117801 - protein, 335 aa, Triticum aestivum
  Clone ID: PAT_TA_12219.pep
YQVYKQVDEGSPECGIIVNRHRRWLRNLLWATSKHDVYVTQNYSVMHWSSLLRRGKEVPNVAGPNQDMRGGRPLSRVQISTMTVKDNLLAAGGFHGELICKYVDQPGVAFCTNLAGNKKSITNAVEIYESPNGSTRVVAANNDCVVRTFDTEKYSLLTQFPFAWSVNNMSVSPDGKLLAVVGDSSDCLIADSGSGKEIASLRGHADYSFASAWHPDGRVLATGNQDRTCRLWDVRNPSEAFAVLEGRIGAVRGLRFSPDGRFLAAAEPADFVRVYDVAAGYARAQEIDLFGEIAGVSFSPDDGAEALFVGVADRTYGSLLEFRRRHRHAYLDCYL

SEQ ID NO: 117802 - protein, 198 aa, Triticum aestivum
  Clone ID: PAT_TA_12220.pep
MRADVPVDVTGASADAWGVEEASDISTNVQNDDPLSRFLPPPVTTKCSTALQQRINKFLGYKRSGKSFNAEVRNRKDYRNPDFLQHAVRYQEIDQIGTCFSKDVFNPYGYDKSDYYDEIEADMKRELERKEQEKKRNPRIDFTSSGVQPPINPSIAKISAAISAAAVAGVSVPASADTVQKEARPNKKSKWDKVDGDT

SEQ ID NO: 117803 - protein, 126 aa, Triticum aestivum
  Clone ID: PAT_TA_12221.pep
KDLHVLSPTFSFAHANTSSSRRGGAALDQTSVAPLRLSLRNSAPATRSVCAYVQLHPWFLFLLSSKGVPTSGDFLDPYILFRSLWWKKSSRFTARRVPLPPLTAVCEHLPRSAELHRVPSLILLNG

SEQ ID NO: 117804 - protein, 133 aa, Triticum aestivum
  Clone ID: PAT_TA_12222.pep
LASLVKSSVDTLTCLNTLKQSVVRYPGASQFSGLVFVSVREKGRVLGIFNGLDSDLTSYDERRGMHGIDYKLLEDGVTAEVRFVLGKVIMDTMSAESPCASTDDAAALPRPAADVTDANHCLLSTLFHSGESD

SEQ ID NO: 117805 - protein, 242 aa, Triticum aestivum
  Clone ID: PAT_TA_12223.pep
MTRSHGEGREEDRPVACETGPRKKGRKRKRGSAKAQPPPPAPSQEHRATTSDDDRSAQVRAMVGEQVRHMLAVRDARKKETAELLKRLSGESDLSVEDTFGDCNDGSLESLQARKVALLVSKSVLCRSSCAGGMWFRVCSRCVLHGTDNTGANMILTSATLVRSLNGDSNVISDVTVKVLLPDGHITDGHIFLVDFHYNVAVVKIAAYLALLEEGTTNNGAVLALGRAYEGGLLMCSRGQVV

SEQ ID NO: 117806 - protein, 94 aa, Triticum aestivum
  Clone ID: PAT_TA_12224.pep
CHSKAGGVGLNLTAASNVFLMDPWWNPAVEEQAIMRIHRIGQKRAVQVRRFIVRDTVEERMQQVQARKQRMIAGALTDEEVRSSRIEELKMLFK

SEQ ID NO: 117807 - protein, 137 aa, Triticum aestivum
  Clone ID: PAT_TA_12225.pep
KRAAALDNLLKIYFRLNGTQQKAFRSTLASIDCPNWPAAKSYCIFEPLVTYQVNKRGFDTYLEEHFDCLLILRNHNEHGKVLEWELLDYASVACFGDFVQDSSWGRMLKGYEVHKALGGRHLAGRRWSLRSRRRLRV

SEQ ID NO: 117808 - protein, 327 aa, Triticum aestivum
  Clone ID: PAT_TA_12226.pep
ELYSEVEVKVADPVVTFCETVVDTSSMKCFVRPRVNTRESTMLAEPLEKGLAEDIENGLVSLDSRQKEVTDFFRQRYQWDVLAARSIWAFGPDKQGPNILLDDSLSVEVDKNLLNAVKDSIVQGFQWGAREGPLCDEPIRNVKFKILNANIAPEPLHRGGGQIIPTARRVVYSAFLMANPRLMEPVYYIEIQTPIDCVSAIYTVLSRRRGHVTADVPKPGTPVYVVKAFLPVIESFGFETDLRYHTQGQAFCVSVFDHWAIVPGDPLDKGIVLRPLEPAPIQHLAREFMVKTRRRKGMSEDVSINKFFDEAMMNELAQQTADIHLMM

SEQ ID NO: 117809 - protein, 258 aa, Triticum aestivum
  Clone ID: PAT_TA_12227.pep
MGASSCSSVRLLLPLLCLLGFCFAASHQKSDSCDGDLQVARLVPFDTDAFHCITLWKDEDFILRYKNTGTSQWSFVLSAPEKRSYVAVGFSGKGGMVGSSAMVGWSSGGKGAAKQYYLQGRSPEAVTPDDGRLTLVRNRTVAVSKSGRLYLAFELSTDRPQPYLIYSVGYEGSLPSSSDYTIQMHRDMGSRSFKFASASPSSAGGESGEEGFPAKRWHGLLSMMGWGVLLPMGMMVARYFPREDPYWFYGHIGVQGLG

SEQ ID NO: 117810 - protein, 154 aa, Triticum aestivum
  unsure (1)..(154): unsure at all Xaa locations
  Clone ID: PAT_TA_12228.pep
LNRSHGLLSVMGWGVLLPMGMMVARYFRRQDPYWFYGHIAVQGLGFLIGIAAVVLGFRLNGDGLKNIVVHNVIGLSILSMACLQVTAVLARPDKTSKVRRXGRVAILLAMANVFLGLTIAREVSAYIVSYGVFVAVWIMAVAAFEFXRYYEDDD

SEQ ID NO: 117811 - protein, 106 aa, Triticum aestivum
  Clone ID: PAT_TA_12229.pep
HAGVADMRAAAECSFSHCCCSSCVGFIGISNIFYEKIISAAEHASSRGASSNAASSVLLAAPRGRLLLRHGGDGFPNFFEANLVIIIRLNSLTLLFHVLVSHGFPS

SEQ ID NO: 117812 - protein, 141 aa, Triticum aestivum
  Clone ID: PAT_TA_12230.pep
MALTLLRGIRTPTLLRANFSLFCTTQRHPLAHFTTRVESVQTTEPKAVPKSIQQATKEAAEQKIQGFESVIGIETHVQLSTITKAFCSCTNNYGSQPNSTVCPTCMGHPGTLPVLNAKVVECAVKMSLALNCKISMTSKFD

SEQ ID NO: 117813 - protein, 289 aa, Triticum aestivum
  Clone ID: PAT_TA_12231.pep
MPRTLPTPTLTPTLLSANFTLFCTTPGQFRTTRPTPLASVPTTVPKALPNATKQAPKETPQATKQAVEPETHVEAPVHRTAIPVPLSSFTNAYGSRPYDYGSQPNSTVCPTCMGLPGTLPVLNAKIVECAVKLGLALNCEISMTSLFDGKQYFYPDLPKGYQISQFDIPIAEKGYLDLDIPMEFGGGHRRFGVTRVHMEEDAGKLLHSESGSFSQVDLNRAGVPLLEIVSGPDMRTGIEAAEYGAEIQRVVRYLGVGNGNMQEGSLRCDVNVSVRPIGQSEFGTCAGGR

SEQ ID NO: 117814 - protein, 113 aa, Triticum aestivum
  Clone ID: PAT_TA_12232.pep
DGPFLLSSYALDDGEGSGWKLEHQVSLSKVLADGGYPWQENSAQSSPQIAVLSMPVSFTSRRASPSPPWGPRARGRGSGRLRPRPRPGQMDDAGSPGGLDRAGSPRQRRVPGT

SEQ ID NO: 117815 - protein, 112 aa, Triticum aestivum
  Clone ID: PAT_TA_12233.pep
MDHRQGRDDHEGVQVVGFEVPSSPDSSYSNPIPGNEDEAREPPLVPPHLQHTLLSFPPSHDDGSSLPLPQPVVLNHLYIEKENSRSVVALGITHRFKAKYVTVVLYKPVQRR

SEQ ID NO: 117816 - protein, 126 aa, Triticum aestivum
  Clone ID: PAT_TA_12234.pep
MVPKASLLVALSLVLVFTVANACGDSCPTPTPATPTPTPSHSKCPKNALKLAACADVLGLVSAEVGQPPAEPCCSILGGLADLEAAVCLCTAIKANVLGISLDIPLKLSLLVNYCGKNLPSGFICA

SEQ ID NO: 117817 - protein, 140 aa, Triticum aestivum
  Clone ID: PAT_TA_12235.pep
TLEVESSATIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 117818 - protein, 333 aa, Triticum aestivum
  Clone ID: PAT_TA_12236.pep
MVSARGVDTTTAANKQQQATCLAPNPGKATILALGHAFPQQLVMQDYVVEGFMRNTNCNDPELKEKLARLCKTTTVKTRYVVMSDEILKSYPELAQEGLPTMKQRLDISNKAVTQMATEASLACIKAWGGDLSAITHLVYVSSSEARFPGGDLHLARALGLSPDVRRVMLAFTGCSGGVAGLRVAKGLAESCPGARVLLATSETTSAGFRPPSPDRPYDLVGVALFGDGAGAAVVGTDPTDQERPLFELYSALQRFLPDTEKTIDGRLTEEGIKFQLGRELPHIIEAHVESFCQKLIKEHPAAAAAEGDHGEQLTYDKMFGAVHPVGPAILTK

SEQ ID NO: 117819 - protein, 230 aa, Triticum aestivum
  unsure (1)..(230): unsure at all Xaa locations
  Clone ID: PAT_TA_12237.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLXEDGRTLADYNIQKESTLHLVLRLRGGQ

SEQ ID NO: 117820 - protein, 154 aa, Triticum aestivum
  Clone ID: PAT_TA_12238.pep
MPRDRDEPAAVRVYTVCDESKYLVVRNVPALGCGDELGSLFSAYGPLEECKPMDAEDCEEYTDVYFIKFAQVGNARFAKRKLDESVFLGNRLQVSYAPQFESLLDTKEKLEVRRNEVLRRIRSPAGSRPEGISQYSPGQGASSGIPHHQLHTNQ

SEQ ID NO: 117821 - protein, 244 aa, Triticum aestivum
  Clone ID: PAT_TA_12239.pep
TKSVPPPKARVRVSEAAAAAALFPMPIAMDTGGAPEPDEESVVFPRWAMLDRRGRTRCHNGLNAARVAANKNKTAAPVDMDGGPSCYVSFTLAAPQKRISCLNLHLPEEPPLTPATPPAYAFVRATDKNLVLFDITNPSRSCYWDPPSDLFVYTAGGPSPSVQPLPMYTKERERPFLMDNLTTGILRLAEDRYIVADLNVYPKRKGNGMRAELCVFNSETGKWEIIRKLDPGNGGQVPRTLVNR

SEQ ID NO: 117822 - protein, 193 aa, Triticum aestivum
  Clone ID: PAT_TA_12240.pep
RPRTRRLAAALLGSRCSAAAPWLALGEDEEEKRKLTMNPDPMEVQEPPPHRNEKTIFEICREARNFRNNARRCGTLLQPYEFSCPQTAELGFKNGYIYYSSKAIKFAADIEQGFVSEELQKRAATFWVLNEVPFGQLNPLGLNPSVDVGIVKTYGVAYNTLIGKTIIAFARSQHNHCLCSLSPKCALLDSKSR

SEQ ID NO: 117823 - protein, 231 aa, Triticum aestivum
  unsure (1)..(231): unsure at all Xaa locations
  Clone ID: PAT_TA_12241.pep
YISLHRHEDGSFYPGTGAANEVGVMDGQGFSVNIPWSRGGVGDNDYIFAFKHVVLPIAAEFAPDITIISAGFDAARGDPLGCCDVTPAGYSRMVSMLTAXSEGKLLVILEGGYNLRSISSSATEXVVKVLLGDGPGYGTDAAAPSEEGMQTVLQVLGIQQQYWAGLVPTFASGQGQQGPTSSKYVNAENKLKRRMLTGGPGPVWWKWGSKRLLYEVLFEGRRPRKSRAKGE

SEQ ID NO: 117824 - protein, 121 aa, Triticum aestivum
  Clone ID: PAT_TA_12242.pep
KLPTRKLLHSSSPHHPQNWSFLSSHSAMTGRRSLGWTYNQAAKTKAAEALERSRREAAAAAEMSRCAAEPSNELSRAREGSHKRTRGVGHRDELAFLKSLAGDDDILAGVIKLQELVDPGI

SEQ ID NO: 117825 - protein, 988 aa, Triticum aestivum
  unsure (1)..(988): unsure at all Xaa locations
  Clone ID: PAT_TA_12243.pep
GALLQRNTRLENRSLCIWNPDRKKKQIGCQEALQSSKILIVSKGAKXVCGATLCYEVAHEKRGQHINESSIHAESTRGHMPRIGSTDAIDVWANQHKDKKLYIVLVSIHGLIRGENMELGRDSDTGGQVKYVVELARALGETPGVYRVDLLTRQISAPDVDWSYGEPTEMLSPRNSENLGDDMGESSGAYIVRIPFGPREKYIPKEQLWPHIQEFVDGALVHIMQMSKVLGEQVGNGQPVWPVVIHGHYADAGDSAALLSGALNVPMVFTGHSLGRDKLEQLLKQGRQTRDEVDATYKIMRRIEAEELCLDASEIVITSTRQEIDKQWGLYNGFDVIMERKLRARIKRGVSCYGREMPRMVPIPPGMEFSHIVPHDVDLDSEEANEVGSDSPDPPVWADIMRFFSNPRKPMILALARPDPKKNITTLVKAFGEHHELRNLANLTLIMGNXRDVIDEMSSTNGAVLTSVLKLIDKYDLYGQVAYPKHHKQSEVPDIYRLAARTKGVFINCAYIEPFGLTLIEAAAYGLPMVATQNGGPVDIHRVLDNGILVDPHNQNDIAEALYRLVSDKQLWAKCRQNGLDNIHRFSWPEHCKNYLSRVGTLKSRHPRWQKSDDATEVSETDSPGDSLRDIHDISLNLKISLDSEKSGSMSKYGRSSTSDRRNLEDAVQKFSEAVSAGTKDESGEKAGATTGSNKWPSLRRRKHIVVIAVDSVQDADLVQIIKNIFQASNKEKSSGALGFVLSTSRAASEIHPLLTSGGIEITDFDAFICSSGSDLCYPSSNSEDMLSPAELPFMIDLDYHSQIQYRWGGEGLRKTLIRWAAEKNSESGKEAVVEDDECSSTYCISFKVKNTEAVPPVKDLRKTMRIQALRCHVLYSHDGSKLNFIPVLASRSQALRYLYIRWGVELSNMTVVVGESGDTDYEGLLGGVQKTIILKGSFNSAPNQLHAARNYSLEDVVSFDKPGIASVDGYAPDILKSALQQFGALQG

SEQ ID NO: 117826 - protein, 127 aa, Triticum aestivum
  unsure (1)..(127): unsure at all Xaa locations
  Clone ID: PAT_TA_12244.pep
STHASANSYSGSSRRHTSFEFRLPCTIGXDEDKYPSLSEIEEGFLRRLEWQDVSKGGDEDEGSIFSTSTKEAEQLSSSESISESCKVSDQTSSTEDAVGTDSIERTMQMETRTKTTREKATNAKEVS

SEQ ID NO: 117827 - protein, 208 aa, Triticum aestivum
  Clone ID: PAT_TA_12245.pep
MSQQDPAAAGEELPGGLSRSSSASRLNAQAPEFVPRVAAAPPPPAPVQPVIHVFAAPPPPPPASFFAAGPPPPPPRPPFEFYAAVGAGGPGFVAVPEHEMGPEQAVPPPPPPAQAHQQGRELTTDDVLHKITKQVEYYFSDINLATTEHLMRFISKDPEGYVPMSVVASFKKIKALVQNSSMLASALRTSSKLVVTEDGNRVKRVQPF

SEQ ID NO: 117828 - protein, 277 aa, Triticum aestivum
  Clone ID: PAT_TA_12246.pep
MAAAVVSNTAVSDGIMATAAVSDTAVSARVLNSTAVPDVMTDIHEAAGGNTVKKRSRLEVAVVTEHCRGPSGDKEGCAPMELPSENPKRKKSSVVMTTGQQCLQISAVQQMGVEQCGIEVCSNNLMGPSQRPYILPKKTTLPSELEKKVKEKVKTIQSKLPIFVRELKTYPVVGTGQGGCALVFCKEFASACGLPHTKKTTIHLQLEDKTKGPWPVTLIRSEHNSNQRWLTTGWNKFVTDNGLKKGDACLFQPDKSSNTQGLTMTVYLIRKSSEKEL

SEQ ID NO: 117829 - protein, 195 aa, Triticum aestivum
  Clone ID: PAT_TA_12247.pep
GQWHAVAFDGWSARVAQVSQGEDVRSSTVFGERYYAHGCFCWAIPGIGKLLMLDIATMEFSSVNLPPSPWSNSQMAFVEAREGRIGLFAVSHNRLMYTILGSIGDDDPRLWYMGAVVPLSRDYAYDIIGVAGGYLLLHGYPDNPESSFELPEPDCISLDLQTMNLEWFCETGWIMPLKSQLLYAGFPPSLSPPTI

SEQ ID NO: 117830 - protein, 445 aa, Triticum aestivum
  Clone ID: PAT_TA_12248.pep
MHPSPPPAYANRPPQAPPPPPPPMINSSGGSVSNYSGGEILPPPSPGTALGFPNSKSTFTYDELVRATDGFSDANLLGQGGFGYVHKGVLPNGKEIAVKQLKLGSGQGEREFQAEVEIISRVHHKHLVSLVGYCISGGKRLLVYEFVTNNTLEFHLHGKGRPTLEWPIRLRIALGAAKGLAYIHEDCHPKIIHRDIKSSNILLDFKFEAKVADFGLAKFTSDNNTHVSTRVMGTFGYLAPEYASSGKLTEKSDVFSFGVMLLELITGRRPVDSTQTYMDDSLVDWARPLLMRALEDGNYDELVDARLGKDFNPNEIARMIACAAACVRHSARRRPRMSQVVRALEGDVSLEDLNEGVRPGHSRFFGSYSSSDYDSGQYNEDMKKFKKMAFTTNDYTSSQYSAPTSEYGQIPSASSSEGQQTQEIETGTMKKGGHSGYSSGYSGPS

SEQ ID NO: 117831 - protein, 163 aa, Triticum aestivum
  unsure (1)..(163): unsure at all Xaa locations
  Clone ID: PAT_TA_12249.pep
GATYSKCRAVAVRALKVDEPACTHMKCTFGGVWNGGGGAGQKQVDAAGLLDDGAGQAGFVNPKAAVAKVKPXDFEEAARRVCKCEEGQEARAPKPEWLRRKPYPFPIXRMLCFTSTHVLCGIGSWWLDPYQXPITLVKKVRNGNSFVEAAWPLGSAIEVASSS

SEQ ID NO: 117832 - protein, 149 aa, Triticum aestivum
  Clone ID: PAT_TA_12250.pep
MDTVGARLSRSSTRYGPVGSSNASFSGPVRKWRKAWVPLAGGGAGSASAGMGPIGCPRGNKVVLLKWAPVSGAGDGNGKEVASAVTRRRYVPVSGVPQNPTRKGGSTELNLNLGLEDPDDDSDADLSPDEQRDMGSTPRSENRLKRKVF

SEQ ID NO: 117833 - protein, 137 aa, Triticum aestivum
  Clone ID: PAT_TA_12251.pep
YQPVLYGSSDNARSKSGNPFPLHANSGFNSFPSNYQTLPPKQSVPLPMMDHHVVPMGIRAPADNSPYGDHVIGGGSSTSVPGDMQHLVDFPFYGEQDKFVGSSFEGLPLDYISMSSPIPDIDDLLLHDDDLMEYLGT

SEQ ID NO: 117834 - protein, 147 aa, Triticum aestivum
  unsure (1)..(147): unsure at all Xaa locations
  Clone ID: PAT_TA_12252.pep
MAGVGRNMVAPLLVLNLIMYLIVIGFASWNLNHFINGLTNRPGVGGNGATFYFLVFAILAGVVGAASKLAGVHHVRTWRGDSLATSASSSLVAWAITALAFGLACKEIHIGGYRGWRLRVLEAFVIVXMFTQLLDVLALHSGXFGNQ

SEQ ID NO: 117835 - protein, 176 aa, Triticum aestivum
  Clone ID: PAT_TA_12253.pep
MAGVGRNMVAPLLVLNLIMYLIVIGFASWNLNHFINGLNNRPGVGGNGATFYFLVFAILAGVVGAASKLAGVHHVRTWHGDSLATSASSSLVAWAITALAFGLACKEIHIGGYRGWRLRVLEAFVIILVFTQLLYVLALHSGLFGNHAGGYGAEHGGYGAGDPHNKGMGTGGVARV

SEQ ID NO: 117836 - protein, 182 aa, Triticum aestivum
  Clone ID: PAT_TA_12254.pep
MAGVGRNMVAPLLVLNLIMYIIVIGFASWNLNHFINGLTNRPGVGGNGATFYFLVFAILAGVVGAASKLAGVHHVRTWRGDSLATSASSALVAWAITALAFGLACKEIHIGGYRGWRLRVLEAFVIILMFTQLLYVLALHSGLFGNQFGNHAGAGGYGAEHGAYGAGDPHNKGMGTGGVARV

SEQ ID NO: 117837 - protein, 193 aa, Triticum aestivum
  unsure (1)..(193): unsure at all Xaa locations
  Clone ID: PAT_TA_12255.pep
ILIIIVFISCPHHHLNRGLNRPPGVGRSGATFYLLLLALXAGPAGAASIPAVVHHRPPRRGHSRAPPPSSSLVAGGGHRGLRSGVRXMEIDIGGWRSRERRRGLRAFVNVQAFSQRLCATVLPLGVRVCQQRWWSCVGGRARQGARGGAAPHDQGHRLGGVAGIGTGYGSRRGWAVGSLAGGCSVRCYYGWCT

SEQ ID NO: 117838 - protein, 207 aa, Triticum aestivum
  Clone ID: PAT_TA_12256.pep
RPRTRGADSHPEWKETLEDLLILARSCSVMTPGELWLQCEGIVQDLDDQRQELPMGVLKKLYTRMLFILTRCTRLLQFHKESGFAEDEIVMDQRDKIIQSADNKILTQSGPHATTSRSSKSDARKSYSQEQHNLKWRRSQEIKPVKLLPLDTDIKKEVESPTRERISSWKPFPSPVPKPPKEPTPIKEESPTKKIDTLATIPSGVEL

SEQ ID NO: 117839 - protein, 114 aa, Triticum aestivum
  Clone ID: PAT_TA_12257.pep
RQPVRGSFYPQKPRCLVEWLQNFWSNCEGKKARSSPLKDALEMQIMLAACNRAGLTITEGLKADAAGVVTGVVHTTPPRKLPPMKASPCLQPPAPLPQMGPTGYRRWSPSSAGP

SEQ ID NO: 117840 - protein, 98 aa, Triticum aestivum
  Clone ID: PAT_TA_12258.pep
EGTSGKQLVKEICSTCGNHDPKEHTWLMFPGSDIFARVPFHATHTILEEDQERLDFDTKKLQSFVKEKSFLISEKGALADKISPGIVKSLVSLTDKPK

SEQ ID NO: 117841 - protein, 130 aa, Triticum aestivum
  Clone ID: PAT_TA_12259.pep
STDPSNLYGVASAPGSGETSGARNGQYLPYAGDCTRSAGDAALSCSSSTKGYTALPKNLQHGHVLSGLEETATQRHAPLPYGACQGLNGGTLDGVAAHSYITGQDGILRSNSKYGSSDWEHVLTEEIGWS

SEQ ID NO: 117842 - protein, 182 aa, Triticum aestivum
  unsure (1)..(182): unsure at all Xaa locations
  Clone ID: PAT_TA_12260.pep
MATAAVPNGHPSADGDDSPPSPPPSSSSSSLVFLGTGCSSAVPNARCLIQPSDPPCAVCSQSLSVPPELNPNYRCNTSLLIDYCQDEGAHKYIIIDVGKTFREQLLRRFVCHKIPCVDSIILTHEHANAILGLDDIRVVQXFXPTXNDIDPTPIYLSQYAMDSISQKFPYLVKKKLKEGXXX

SEQ ID NO: 117843 - protein, 126 aa, Triticum aestivum
  Clone ID: PAT_TA_12261.pep
KTENSKRFLHACMRCLGFLFSLETCDASSFLPHVWQLARPLFLYSLENNNGMLPRHDRRGLVACDRCKSFPTNKARSASGRTSSPIYKNVPLFLQNQPAIPIKWIWETIRFKKKLASRRWPWPAWR

SEQ ID NO: 117844 - protein, 178 aa, Triticum aestivum
  unsure (1)..(178): unsure at all Xaa locations
  Clone ID: PAT_TA_12262.pep
MRNALHYASWKLDDRVDSIFLLYEQASAESEAFFCXVEVLSGFRDNFCKQLDNSVVGIRSTISKLSQLLKRHDEELWRHLEVVTKVNPQFYAFRWITLLLTQEFKFRDCIHLWDALLGDPEGPQATLLRICCAMLILVRRRLLAGDFTANLKLLQNYPPTNIDHLLAICNPTRPRTPC

SEQ ID NO: 117845 - protein, 275 aa, Triticum aestivum
  unsure (1)..(275): unsure at all Xaa locations
  Clone ID: PAT_TA_12263.pep
VRNLVTDGPPATPLXALGFNPPDKDIHEETTKEERDSLITPWILFCYLVIGLDIVSTPLRSLDISPTPPSILGPRLAAGAHAGVASQRIFVIWYTHGSFMGIDLTGDGHTLVSYSQLSNWGQSSTWDNFTASPFTAGARTFTFDDNPCDHFQAGKVKATTLSLSVLXVAIEMFNSXLNALSEDTSLLRMPPXWVXPWLLLAMSVSFGLHFLILXVPFLAQVFGIXVPLSLNEWLLXVLLVALPVVLIDEVLTFVVRCMTASGPKRRLKGHLCSVK

SEQ ID NO: 117846 - protein, 168 aa, Triticum aestivum
  unsure (1)..(168): unsure at all Xaa locations
  Clone ID: PAT_TA_12264.pep
MALGRGSARNGAAGLGAAVLMLGLLVMSAEAAKYTVGDYGGWKFNVAGWAKGRTFRAGDVLEFKYNGAVHDVAAVDAAAYQSCVVPKGKRALRNGHDKVRLVKGMHYXICTVRGHCKANMKIPSGSSTEPQVATTGFLLSANLAIRQFFALLRRFSLNCCSVNNIIRN

SEQ ID NO: 117847 - protein, 225 aa, Triticum aestivum
  Clone ID: PAT_TA_12265.pep
MPEHRELKRTALTDLSGGGFFIRRVASPGALAGRRAGKPLPRRFASPSSNKENVPPAWAVKATPPRRRSPLPGWYPRTPLRDITVIVKAIERSRLRIAAARQQSETPEQSPQPANLTTPVPAEQGTPHSTEAQGSQAIASGSGLTEMVANPAPSQAEHGFKVYSSPSKSSQKTPTKPIDPALADLMEKKLTSSIEQIEKMVKKNQKKAAQPSKRANQRRTLMSMR

SEQ ID NO: 117848 - protein, 254 aa, Triticum aestivum
  unsure (1)..(254): unsure at all Xaa locations
  Clone ID: PAT_TA_12266.pep
MAAATAPVEVPAAAPVRTVKVTNVSLSATEQDIKEFFSFSGDIEHVDMKSGDEWSQVAYVTFKDAQGAETALLLSGATIVDLSVIIAPAPEYQPPPTXSAPLMSGTRVPVGGDNVVHNAEDVVSTMLARGFTMGKWPHGNSKSFDERHGFTSTATAKVASIDKKIGLSEKFTMGTTVVNEKVKEMDQKFQVSDKTKSALAAAEQTVSNAGSAIMKNRYVFTSASWVTSAFGKVAKAATDVSTMTTGSISATPIR

SEQ ID NO: 117849 - protein, 239 aa, Triticum aestivum
  Clone ID: PAT_TA_12267.pep
QHILMYEYMSNGNLATLLYGDNTSSLSWQERLQIAHDVSHGIEYLHEGAVPPVIHRDLKSANILLDESMRAKVADFGLSKEEVFDGSKSGLKGTYGYMDPDYMSTNKFTKKSDVYSFGIILFELITAINPQQGLMEYIDLAAIGGEGKVDWDEILDKNLLGGSIPEEARVLADVAYRCINRSPRKRPWISEVTQAISRLRQRQMTLPRSETRTVLRRIEYQHVELSDLAGMKELTPVGA

SEQ ID NO: 117850 - protein, 190 aa, Triticum aestivum
  Clone ID: PAT_TA_12268.pep
GCIFTVRQRVGGRVGSGKDDIVDDVVDMRSGSSTGQGAIGEPFNATGFGENSNASENKLSSMQEDAGPPSGSEQEEPAAAVCSEGHVVGAAQNLILRANVDCQIGNDALDPAVLQKIAGIPVPVTSVGEKRFSEFEATDTLEKETSTGDGYPDQYDEISTKRRKVAASWHENAGAPDTKIEGNAKTDDQT

SEQ ID NO: 117851 - protein, 152 aa, Triticum aestivum
  unsure (1)..(152): unsure at all Xaa locations
  Clone ID: PAT_TA_12269.pep
FPPKSLQEQQATAVRALQXLSSNVAVCPPGMFMIYLSTPCTDAFTGKQYINKAMEVLFSTQASDDSEGHLETTSKNIEDTKPVLIWSCVYVQEITQGTSGTVLSCPMPDENLDYRDILESTKQLFTDTYPDEEFLPRNAAPKYADDDSDLAE

SEQ ID NO: 117852 - protein, 202 aa, Triticum aestivum
  Clone ID: PAT_TA_12270.pep
SRVTFALDRTYQSHIEYRWGGEGLRKYLVKWASSIVERRGRTEKQVIFEDAEHSSTSCLAFRVVNPNYLPPLKELQKLMRIQSLRCHALYNHSATRLSVIPIHASRSQALRYLSVRWGIELRNVVILVGESGDSDYEELFGGLHKTIVLKGEFNTPANRIHTVRRYPLQDVIALDCSNIIGVEGCSADDLTPTLKALGIPTK

SEQ ID NO: 117853 - protein, 138 aa, Triticum aestivum
  Clone ID: PAT_TA_12271.pep
VRPRVRECVGAGREKVAAIFKHQGYDVAEIPDDKPRQLISSNGCLKVWLVDRGCVTLLCTEELEQLYNGDCYIIQYSYAEDGKDYHLFLAWFGQDSVQEDRVATVSLMPSMADSVKGRAVVGQVLEGREPELFFLVFK

SEQ ID NO: 117854 - protein, 181 aa, Triticum aestivum
  Clone ID: PAT_TA_12272.pep
LRPSILIGNVLYWLLVGGEVLVHDFERQSLGMIEKPADTHNGHAEFSYHLLRTEDNGLGLAIVSNFTIKLWERKSNRDGVVGWEFLKKVAPLDGLFPEPMLSGHMWILLVGYDEDTNVIVLSTMTSTFMLQLDSMQIRDISVRTNLRHPVIYPYRNFYTAGEEKGTQPRTTTTTHMVNCGI

SEQ ID NO: 117855 - protein, 76 aa, Triticum aestivum
  Clone ID: PAT_TA_12273.pep
VPMISVLCTEPTEADIDSWLQELGVSKAPTVEGAHPPTESIAAFHMPLINPSALVASDTPSFNCSLIALLMSLSYM

SEQ ID NO: 117856 - protein, 84 aa, Triticum aestivum
  unsure (1)..(84): unsure at all Xaa locations
  Clone ID: PAT_TA_12274.pep
RIAXCLVGDETGSIIFTARNDQVDLLKAGATAILRNAKIDMFKASMRLAVDKWGRVEATEPASFTVNEENNLSQVEYELVNVAE

SEQ ID NO: 117857 - protein, 130 aa, Triticum aestivum
  unsure (1)..(130): unsure at all Xaa locations
  Clone ID: PAT_TA_12275.pep
MSTAAAQRGEKTPLRKPVFVKVDRPKPGTNGHTPPRHGPSAPTPSLAAGALRAPASSSARAPRLAECLXGDETGSIIFTARNDQVDLLKXLDATAILSYAKVDMFKASMRLAGDKWGRVEATEPLSFTGE

SEQ ID NO: 117858 - protein, 143 aa, Triticum aestivum
  Clone ID: PAT_TA_12276.pep
SLHTKAKHTGQGQKGKPLHTYWTTWMDSEPTTKAKKRITNTSLKCLQECKERTNKNHILVKLVTRLCVQPIIKLLHLFNHSLSGSVHVEMFRPSPRHERVKVIPALGAAAAPPLAADARPHVSAPAVPAVALLLEPDSDLARP

SEQ ID NO: 117859 - protein, 407 aa, Triticum aestivum
  Clone ID: PAT_TA_12277.pep
SEQVAASTNKEVDSQIPNYPNLPPQLICQLHNVTMHADAETDEVYAQMTLQPLSPEEQKEPFLPIELGAASKQPTNYFCKTLTASDTSTHGGFSVPRRSAEKVFPPLDFSLQPPCQELIAKDLHDNEWKFRHIFRGQPKRHLLTTGWSVFVSAKRLVAGDSVIFIWNDNNQLLLGIRHANRPQTIMPSSVLSSDSMHIGLLAAAAHAAATRPRFTIFYNPRASPSEFIIPLAKYVKSVYHTRVSVGMRFRMLFETEESSVRRYMGTITTISDLDSVRWPNSHCRSVKVGWDESTAGEKQPRVSLWEIEPLTTFPMYPTAFPLRLKRPWASGLPSMHDMFNGVKNDDFSRYSSLMWLGDGDRGAQSLNLQGVGASPWLQPKMDSPLLGLKPDTYQQMAAAALEEIRTG

SEQ ID NO: 117860 - protein, 147 aa, Triticum aestivum
  unsure (1)..(147): unsure at all Xaa locations
  Clone ID: PAT_TA_12278.pep
HDRYYARGDAVMLPEVPSEECRGGSPESVPTGGPAITAGGAQGQGRTLRVRCRGERNXSCYPEEHYFPTLLDMQDPAGCTQYSLTRVNWTDQVEGHPHTYHPGEVSANLIRELRKSNAKYSYMFARKFAPECLEPLMEIADSVILRD

SEQ ID NO: 117861 - protein, 71 aa, Triticum aestivum
  Clone ID: PAT_TA_12279.pep
FFFFFFFFTNPHVHILPRDKTRYESSRAPTSKSGTCTKNYNPGTDSINETLHGFLIEREKKTPHGVSAERK

SEQ ID NO: 117862 - protein, 120 aa, Triticum aestivum
  Clone ID: PAT_TA_12280.pep
GKCELIWYVQVQYYYMLGLSQKFNPRLVISRKFRYRAPKTGAFTTRALLSRNYNARENSLQLPNPDTRNPPSNPEPKGPLVQIGGGYFCNTPYILDKRVPKSCFTPSHRPLFAIRNPRPP

SEQ ID NO: 117863 - protein, 257 aa, Triticum aestivum
  unsure (1)..(257): unsure at all Xaa locations
  Clone ID: PAT_TA_12281.pep
DASCLAGIRRHWNTPVPSEITQLAGSCFNHYGNKNESENESDNNEVPSDSTDKKSWIAEKPVVAVGAGGTAIXGFSSLSKTIQASAILKLXPYKTPVILKYGLMQLQRHAGVVLSKLLSHGVXSAGSKSSVLQFTASAEKIRAVTHTVISSVERTSLVAMRTSFYEIMQKRQKHNRPFRIAPWATFSFSLVACAGLLKHGDGIECAAEAAPSVPMIASLGRGLESLRVTSEETRQTRSQNVKEALLTLLRSLKKSEK

SEQ ID NO: 117864 - protein, 126 aa, Triticum aestivum
  Clone ID: PAT_TA_12282.pep
RPVETTSMKKTRSTNQTELDQSKKSSRKMLTEKNSGSDKNDILTKRQHHSRAAELSRSVNPSNKDACKLSHNGSDVDGTDINITHKRNCRGCRERGVPPVLIKQEYSSESVEVIEVRKDQRKRKHP

SEQ ID NO: 117865 - protein, 335 aa, Triticum aestivum
  unsure (1)..(335): unsure at all Xaa locations
  Clone ID: PAT_TA_12283.pep
VRLLPNTFTYNTIMTAYGNAGKVDEALALFDRMKKNGFVPYTNTYNLVLGMLGKKSRFPAMLEMLGEMSRSGCTPNRVTWNTLLAVCGKRGMESYVTRVLEGMKSCRVELCRDTYNTLICAYGRCGSRANAFKMYDEMTRXAGFAPCLTTYNALLNVLSRQGDWTAACSIVSKMKSEGFKPNDMSYSLLLQCHAKGGNAAGIEAIEREVYQGTIFPSWVILRTLVIANFKCRRLDGIERAFQEVKARGHKPDLVILNSMLSIYAKNGMYSKAMEMFESIEQSGLSPDLITYNSLMDMYAKSNEPWEAEKILKRLRTSQSQQQQQLKPDVVSYNTV

SEQ ID NO: 117866 - protein, 75 aa, Triticum aestivum
  Clone ID: PAT_TA_12284.pep
QCRSFAGEQDLYGYPLPPMRGHGLSVLAIVGIGLGSGLLSLVLSFSAVCIWLRSTDRTAATPGEEGKISHLMPAY

SEQ ID NO: 117867 - protein, 219 aa, Triticum aestivum
  unsure (1)..(219): unsure at all Xaa locations
  Clone ID: PAT_TA_12285.pep
MYVPQSSRGGGGSSGEQPRVYQVWRGSNEFLLQGRFIFGPDVRSLFLTIFLILAPVLVFCIFVARHLMNDFPDHWGISVMVVAVVFTVYDLTLLLLTSGRDPGIVPRNTHPPEPESLDGNNDTGNGQTPQQLRLPRTKDVYVNGVVVKVKYCDTCMLYRPPRCSHCSICNNCVERFDHHCPXWVRQCIGLRNYRFFYMFVFSTTLLCLYVFGFCGGYFI

SEQ ID NO: 117868 - protein, 212 aa, Triticum aestivum
  Clone ID: PAT_TA_12286.pep
EGALDLCAPVLYVSDGGVGCGAADLERGPRGGSGAHDRRLEPLSSPQPSTAGLSPVSSPLRSPWRTAASSLPPSSTAPRPDSSTQGHGEPAGGVADQTPPPLVPLLFFLSTSHLNGLCGRVQALSSHLIFLRGEGMRPGHGEKSSCSCRFKRRGGPWREKPAAAMPTSSSSWRRPRRWLRIKLLHLGQRRRRVGDGSAGVLDQKLPGSPSPG

SEQ ID NO: 117869 - protein, 288 aa, Triticum aestivum
  unsure (1)..(288): unsure at all Xaa locations
  Clone ID: PAT_TA_12287.pep
MGTPEFPDLGRHCSVGDCHQIDFLPFTCDRCDFVFCLQHRSYTSHKCPKANNKDVTVVICPLCAKGVRLNPNEDANITWESHVNIDCDPSNYQXATKKNGCREQLTLANITFSNTIMCKDCSKEHCLKHRXFGPDHKCPGPIPFENTFPFANMLRRSQKVEPRANSSGSGSSWWSSSLLNAASSFRSSAEAGMQKLSIATSEAVQKAKDGVTPSSSGGGLVEQCVQCPARFSTVGALIEHAEKSHGNNSQPSRGKVTIDACPKCSKGFQDPVLLVEHVEREHGGTSKA

SEQ ID NO: 117870 - protein, 217 aa, Triticum aestivum
  unsure (1)..(217): unsure at all Xaa locations
  Clone ID: PAT_TA_12288.pep
MAALSVPLRTAAALSSSGAGSRAAADPSKVSCVRSTGSAHFDCSFPSIAASSSSARNIEPLRAIATQAPPAVPQYLSGEKTKVGINGFGRIGRLVLRIATSRDDIEVVAVNDPFIDAKYMAYMFKYDSTHGPFKGSINVVDDSTLEINGKKITITSKRDPAEIPWGNFGADYVVESSGVFTTIDKASVPRPRPPXKVVISAPSADAPMFVVGVNEMS

SEQ ID NO: 117871 - protein, 119 aa, Triticum aestivum
  Clone ID: PAT_TA_12289.pep
KIAELGFAGGKSKSLYGKEGHLGLTLIKFANNPSGLKEAERLAEFFERQDHGRVGWSRAQATHNLDPDTNPMLVETDSRGEKKRILYGCLAISSDLDELDSDSRKRATVKSIKEFDPSD

SEQ ID NO: 117872 - protein, 199 aa, Triticum aestivum
  Clone ID: PAT_TA_12290.pep
SGRPDLRDVAQPRVAGLREGKAAAAAASRRFSTTSSYTVVDHTYDAVVVGAGGAGLRAAIGLSEHGFNTACITKLFPTRSHTVAAQGAYNADSWGNMSEDDWRWHMYDTVKGSDWLGDQDAIQYMCREAPKAVIELENYGLPFSRTEDGKIYQRAFGGQSLDFGKGGQAYRCACAADRTGHAMLHTLYGQAMKHNTQFF

SEQ ID NO: 117873 - protein, 402 aa, Triticum aestivum
  unsure (1)..(402): unsure at all Xaa locations
  Clone ID: PAT_TA_12291.pep
SINLSGSTNTGFQPSDDVSACFFERLAHTDKDDAYGEVVSGSMTMEIREGRGVGPMKDHLYLHLNHLPPEVLKERLPGISETAAIFAGVDVTKEPIPVLPTVHYNMGGIPTNYHGQVVDIKGDNPDTIIPGLMAAGEAACASVHGANRLGANSLLDIVVFGRACANRVAEISKPGETQKPLEKDPGEKTIAWLAKLRNANGSLPNFDXIRFNMQPIMQNNAAGFRTQGTLTEGCEQIKRSTXKIPQCQAQVPDVSYGNRNLIDDHRIRKPAKRCVLNNAFLQSFVHRKLEHKLVRXLSEAHKSFHDVKLSDRSLIWNSDLIETIELENLLINACITMHSAEARQESRGAHAREDFKTRDDDKWMKHSLGYWEDEKVRLEYRPVHMNTLDDEVETFPPKARVY

SEQ ID NO: 117874 - protein, 158 aa, Triticum aestivum
  Clone ID: PAT_TA_12292.pep
MFTHINPVGVGATRLFITPNRCAHRRFTSSRRAPCTSASLASPAPLLDGPLAPAGVSAPVRTEEPQMVSRWRAWRRSTALRLLLSLTSVCPPLPLLATCFRPRLTGRGWHAQTPHSLVYFPPLFYQVRLPMVSPSSAGPCSNIMHECTPSKSSDEWQV

SEQ ID NO: 117875 - protein, 180 aa, Triticum aestivum
  Clone ID: PAT_TA_12293.pep
FFFFNLKNMHSELLNVYSAALNSQLLFTFRFKANKKGVEGSRFVQKYDWLEQNNLSLSLRIHTHMHKQVNQTSKLNEPHLQSYFCCDQARRRRDTVALAADTAEVDKLAYILFSGFTNLVSAFPCSPLAPTARVRLSRRGVGGEGGGTWKPSTGLNQTRPHPFLKCPCLYCCLFPASTLV

SEQ ID NO: 117876 - protein, 163 aa, Triticum aestivum
  Clone ID: PAT_TA_12294.pep
CGTRPKQSQRKELERQKRLEGERKELEKQKQRAKEEETLKEKEHERRKGEHGVERGSKRKVGEDRHDPNSNRLSDDENRDRKTREDYGRQKTTDSDRYDPNSNRYSDDENRDRKRHEEYGRHRARYSDSHDLKRSRYDDSYNHSRRDYEERYSRDEHRDRRHR

SEQ ID NO: 117877 - protein, 226 aa, Triticum aestivum
  Clone ID: PAT_TA_12295.pep
QIMARKRAIFRNFPKWWLFKLRKRKARRLAPLPPPSPPPLPPPPSPPPPQSPTPPPPAIPEPYFSPVTHNQERRDQIANALVMLAIGDPEAEDESYDTFIPVINLRAHQGSYCLLFESALMKQREDESPFGHHVLNFPLPDDTDVLPVPTDAMQTKTFENTEGEISLTVLSCKTEFHHCDSIEFGGEVVVGQKLFLYDLRYGTPSLVDGHVTCVGSDSFVLDANYM

SEQ ID NO: 117878 - protein, 119 aa, Triticum aestivum
  Clone ID: PAT_TA_12296.pep
DLQGIQHDDCKSVIWLSYVMQLRQVRRVMTSKRENLVIFEVVGLKDACHGKVLVDIDDTLQNRQELPGGLVTTSETRRRKRNNRRGQEGGDGEAGEEEEEEERPRQWDRAVEPTAVPST

SEQ ID NO: 117879 - protein, 167 aa, Triticum aestivum
  Clone ID: PAT_TA_12297.pep
RGEAVAGASELIDHVLNAQTSETLALLQGLKLLSEIGCTKVTVESNCLELIEARSGKIEILGPNVAILADCFHIAHEIPGICFKHCPSEANGLAHFLASKFHLVSQRIGPLHLLMLLCFDLRSDTSRFSVKVDKCHRHSLCCFYSNVIYLRPGDKRLSLLWGPTPND

SEQ ID NO: 117880 - protein, 384 aa, Triticum aestivum
  Clone ID: PAT_TA_12298.pep
DSTVRSGIYQPSAPEIPPEPAAAYLAASVAEPVLAGAPHSIPDSTFAFRRTGDTEVLVMAAANGLVHASAKKPLFTFGVIADVQYADIPDGRSFLGVPRYYRHSISVLQRAVSTWNKQGNIKFSINFGDTIDGFCPKDKSLWAVQKVIDEFEKFDGPTYHMFGNHCLYNLPRSKLVALLKMPTDSDRAYYDFSPCPEYRFVVLDAYDFSALGWPHDHPVTAAALKLLDEKNPNTDKNSPDGLFGVDRRFVKFNGAVGKEQLSWLNDVLQDASDRRQNVILCSHLPMDPGAVYPAALMWNYDEVMAIVRRYNCVKACFAGHDHKGGYSVDSHGVHHRTLEAALECPPGTSAFGHIEVYPDKLLLVGSDGMADTEMCFRSSDRAAL

SEQ ID NO: 117881 - protein, 136 aa, Triticum aestivum; identical to SEQ ID NO: 106789
  Clone ID: PAT_TA_12299.pep

SEQ ID NO: 117882 - protein, 136 aa, Triticum aestivum
  Clone ID: PAT_TA_12300.pep
MARTKQTARKSTGGKAPRKQLATKAARKSAPATGGVKKPHRFRPGTVALREIRKYQKSTELLIRKLPFQRLVREVAQDFKTDLRFQSSAVSALQEAAEAYLVGLFEDTNLCAIHAKRVTIMPKDIQLARRIRGERA

SEQ ID NO: 117883 - protein, 531 aa, Triticum aestivum
  Clone ID: PAT_TA_12301.pep
MRRRGWGARGGGRTGCACRARRVGPAGWRTRQAQGGLPGRRRRPRPGRGGRTGGRGRCPGAGAGRGACGGGARSASRTGGSRGGRRPPAGSGAASPRRRRRGRSCAPPASAAACSAPCRRWTCAPSASCGPSKLVGEGRDAAAAATVWRLRLLPMHSGTSFVVNDSHNVEETQKAELLPPKEEPTALLENKGSLSLWNFARNRESGVHEPFFQGRNTRDKSETADSNTGYYVGLNVIDIDKDNGNPQMCASYAAEIYRNLMAAELIRRPKSNYMETLQRDITKGMRGILIDWLVEVSEEYKLVPDTLYLTVYLIDQFLSRKYIERQKLQLLGITSMLIASKYEEICAPRVEEFCFITDNTYTKNQVLKMECEVLNDLGFHLSVPTIKTFLRRFLRAAHASQKAPCATLGYLGNYLAELTLTDYSFLKFHPSVVAASAVFLAKWTLDQSDLPWNSTLEHYTSYKSSDIQGCVRDLWELQQGNTSGSPPLNAIREKYRQEKFECVANMLSPAMPGSLFHRQANGTSPLLINNS

SEQ ID NO: 117884 - protein, 98 aa, Triticum aestivum
  Clone ID: PAT_TA_12302.pep
GLVGLVVFLSCVGLRRSLVSIMNVVVEYDQFNRRCWRRSVGRIYDGNSGFGCWLMVWSGMVWYDVVIGSSNEQLVASLFLGCRQTDLTVLLYLGRDHA

SEQ ID NO: 117885 - protein, 129 aa, Triticum aestivum
  Clone ID: PAT_TA_12303.pep
FSSRSFQIDGRQCPVLHSRGEVAAWKLFCRGEGRRFPRPRASPLQPPRPLMVRPRWKVGWPCPWPLRCRHARERCRHRRPCRRRPSIWAPPLAEGVAAEGRMRAVALAAAAGEGLSTLESLSRERADTE

SEQ ID NO: 117886 - protein, 172 aa, Triticum aestivum
  Clone ID: PAT_TA_12304.pep
DRSAPPRSPHPPRRTTILDLNLHLTPTRCLPMITRFCFAARFPPPGVLPHVVPRRPTRPHAPPPLDPSPCCCGRGSRARKPGGSDGHWPPHIEVEGHDRFVTVVMRSALGVAASLADVAPGSTRAGASCAARSHMSNALISRRSVRNRPRAWRRRCGRRLQVVGICKRPRPQ

SEQ ID NO: 117887 - protein, 109 aa, Triticum aestivum
  Clone ID: PAT_TA_12305.pep
KISPVIQLQICNQQPLPKPYRLMLTAQQQLTATNIGVESYNPPVSPPPDEPIPITVATSLPSNVTGATADRCYISLHRGLSKGKNPDGESSPDGDCGNHSPGEGGNTYP

SEQ ID NO: 117888 - protein, 79 aa, Triticum aestivum
  Clone ID: PAT_TA_12306.pep
QVQSHLQHDQSGGPRITGTFQGLKIIKQTQGWRQLFAGLSLNYIKVVPSVAIGFTAYDTMKHLLKIPPRESIKPEQGSG

SEQ ID NO: 117889 - protein, 133 aa, Triticum aestivum
  Clone ID: PAT_TA_12307.pep
AEPPKLGSISSTDQAHSRNNVDAKRGAASQQVVIRTEDLRAEVTVPCWDDVAVPSSETREYKSSGKKSIGYVLDEWDEEYDRGKAKKVRKAREDDDDDGMNPFQAEANYVSARKTKQNSYKSKPWDKPARPSR

SEQ ID NO: 117890 - protein, 622 aa, Triticum aestivum
  unsure (1)..(622): unsure at all Xaa locations
  Clone ID: PAT_TA_12308.pep
GRVATFMSDSKGTDYKYSLYGVLVHAGWSTQSGHYYCFVRTSSGMWHNLDDNQVRQVREADVLKQKAYMLFYVRDRIGNTMGRKDNRTPNLPVNKMIPGKISSINGVIGSGVMXAKSSGLTSPYANKKLQSTSNAHSGVSSMTLVDHCSTNDGKAEIAAAPQNSVLPAAQKALGSQNDGATLSTKSKQVASSSHKETSSSGQPASSNQTMAKMSLQGPKAGGAFAKLGNNTSIASSMVSGPAGLSETDKLTSCSQTCSKPSSNLVGTITGFTVQTFQTKDAVVSMGSPRRQAGGTPMRKMKDLTGSLKQDDHIVKALXIGRAAGFCPLCALQKKEKTILPGLEQVDVGKQISSQVSTKVVPGDSSHXRNSRQNDALTKRVTXESIMKSWLTXQKKKHKKTKKRVKDTASVDCSGDNSSEQQTSTSATVPPKTAESTSRKRKYSHASVSSENNTQALKDRQQAVGASSAGAGDDNMNTKEQXSGTSASAVASKVGXSPPTVSRHIQRNNVNAKRGAALPTNRHSHRGLEGVLVXCWLEDSIWSLLLLCSDFQWDVAQSXTIIRYAWVEGHTRGNAKPVWYAMDVADDDGMNPFQAEANYVSARKTKQNSYKSKPWDKPARPSR

SEQ ID NO: 117891 - protein, 236 aa, Triticum aestivum
  Clone ID: PAT_TA_12309.pep
HCPWVGQCIGKRNYRFFLMFVSSATVLCIYVFTFCWVNIGKIMDTHECTFGRAILKSPISAILMLYTFVAVWFVGGLTSFHLYLISTNQTTYENFRYRYDRRSNPYNRGLVQNFIEILCSRIPSSRNNFRAKANEDSAAFASTLSMGRVLSPPKMSVDLEMGTKRQAVGAEDMEDLHSQIGSSMGLERCGTEPPHFVSRKGCSEIASDIETFAEEFGMDNKFTERKKTVRHTNDNP

SEQ ID NO: 117892 - protein, 279 aa, Triticum aestivum
  unsure (1)..(279): unsure at all Xaa locations
  Clone ID: PAT_TA_12310.pep
ARKLCRPSPPPSLPCRASRHHGSCIRATPPRPSALLARAAGRAPGQHPLPLPLPASLAPARGTDRVYDPCTDTKIQRGDAFTFGXAFAATGAFYSGSTPSLPLRPAASPIPSTALPSSDPKVDEISLLTDNTTTGISPASAGGYMVAFAGRKYAARSQPVFVSNSSVTVXSFTLVLEFNKGKLQNLHWQEGTGCGACTGKPNFICLGKQTCAIRTNICKSNNQGSMDCSIGIQLAFSGTDKHESVLNSWYKVSNLQQYSLYGLYSNVKGSLSGQFNKFF

SEQ ID NO: 117893 - protein, 332 aa, Triticum aestivum
  Clone ID: PAT_TA_12311.pep
AHPPLVRPGPAAAVRGADVFLTRVPDDEDEGSDDEDDGESDSLGWSGYYGGEGDRAGWSMTGCRDGYVVLVNRGTKRAAVYDPLTRSLHLLPAPPVEICEDPEEAEVEFHVITSEEDRRSLRVVFVCKERGKVRVAVFSLDTREWQISPKGARLQLQDDDSGTLVNGCVYWASVSEDAIHLLNTATLQFSRMVLPRRMRRMGLKVGQTSDGKLCLACASELTLDVCFRRADDNGVDKWILNRTFELVDDIDKLRLQFVDRFPRLEVVAIIGGIVYLSTFQVEHPSSSGCFLSFCIETEELKEVCPITNSDSSYPYIMAWPPVLVGNKVSSLG

SEQ ID NO: 117894 - protein, 93 aa, Triticum aestivum
  Clone ID: PAT_TA_12312.pep
RPVLRHQSADRRRAPPPSRPRPSSPFVSDRLPPPQPPARRRPPLPSPADPNFLGLYGFTALIAQPDMKAFVQNLLGQMQTRFESMSLEEHLEK

SEQ ID NO: 117895 - protein, 290 aa, Triticum aestivum
  Clone ID: PAT_TA_12313.pep
RRPAQTLVICLQRKYFPCEATNIILQLPTKNKEWKCRFNPGRRNLYLGYFVRENCVQEGDICLFQPIAKAKEGRFTVIVHLLHKESVHHSPGGTAGMTHTATDGRTGAKTSLTARVKEEPTTDGEDMSSLGPKEDGDNSEGAPETPFVLPDRASITPAQEQKVWEKVEAIESTVPVYVAILNKCNVARKSGMMINMGKQYASRYLEKQYFTGHHGKKNVISLVLQREGKSRTWDTELRRGTDRMMICKGWVAFARGNHLRVGDLCLLKLMESEEPLKMMVYIIRREKCLH

SEQ ID NO: 117896 - protein, 319 aa, Triticum aestivum
  unsure (1)..(319): unsure at all Xaa locations
  Clone ID: PAT_TA_12314.pep
ARPRRACNECRRPRANPSINRWNGRPYSARYLEILEKRRTLPVWQQKDEFLRVLXTNQTLILVGETGSGXETTQIPQLVLEAEGLSNRSMVACTQPRRVAAMSVSPRLAEEMDVTIGEEVGYSIRFEDCSSHKTVLKYLTDGMLLPEAMADPLLERYKVIVLDEAHERTLATDVLFGLLKEVLKNRPDLKLVVMSATLEAEKFQGYFSGAPLMKVPGRLHPVEIFYTQEPERDYLEAAIRTVVQIHMCEPAGDILVFLTGEEEIEDACRKINKEVNNMGDQVGPVKVVPLYSTLPPAMQQKIFDPAPPPLKEEGPAGRK

SEQ ID NO: 117897 - protein, 103 aa, Triticum aestivum
  Clone ID: PAT_TA_12315.pep
KSSCIPLHNLGWLRYLLCAESEHLASESVGFNCPGGGIVESWLRRVGWLQFCRCGVESRVAGYLRFPWWACAADGCGRLCIFMDEFSPLSLWSPCMFIFPIKG

SEQ ID NO: 117898 - protein, 270 aa, Triticum aestivum
  Clone ID: PAT_TA_12316.pep
MAHNLVPDAWGWITSLPPFSQWRTNTMSLCICATPSASASSQPTSMTLSVAKTPPTQPSYLTFSISANYREPIFLWTSKPVHLKTKAQQSLDEQDMVQLFVDIVNQVLWYGPDNSSKPSFRFPGAQQLHGGSFSDAFNIVFLSLAFLVCIYEGPRDLRRGCLDSLRTQLTSPKCRGAAKTLVKMLGANLEDQWMQTMNLAVTNWMAEMRSSHHAPRAASPLFSYALQASGLWKVQLYCPVIAMGMEDPAAAAAQDERLLFSLTYQQLEGV

SEQ ID NO: 117899 - protein, 174 aa, Triticum aestivum
  Clone ID: PAT_TA_12317.pep
MIAFLLFLLLALAASNTEHGGAVAAADDPPAALTILTLHGSHENTSLAVQTHDLSLAGFTDESLHWHAFPGHEHLIPTSKPLPFGSSYSELIGGLANLPGLPLGRDAMMHAVRVLSAYDPAGDAKPVKWALAAVKVMICESGRLKPIRETVRSGWDKRVRVAPEHLAYIEHWDT

SEQ ID NO: 117900 - protein, 261 aa, Triticum aestivum
  Clone ID: PAT_TA_12318.pep
SADAWADAWAVLAAFLLFLLLALAASNSEHGGAVAAADDPPAALTILTLRGSPENTSLAVQTHDLSLAGFTDESLHWHAFPGHEHLIPTSKPLPFGSSYSELIGGLANLPGLPLGRDAMMHAVRVLSAYDPAADAEPVKRALAAVKVMICESGRLKPVREAVRSGWDTESRVAPEHLSYIEHWDTMGRAIGPGNPPRCWRPKPTSAARRRRSPSSGCCSMPTSSRCSRLTAPRSTSSEHACMQLLLDFRFVLHLVSSPMFL

SEQ ID NO: 117901 - protein, 88 aa, Triticum aestivum
  unsure (1)..(88): unsure at all Xaa locations
  Clone ID: PAT_TA_12319.pep
MARATTLVLVAALAVLLLLASGPAGATARXRPRPRDVATASPDEKVAVAAAEDHECEMMAGEKQRDECMARRTLAAHTDYIYTQEKHN

SEQ ID NO: 117902 - protein, 357 aa, Triticum aestivum
  unsure (1)..(357): unsure at all Xaa locations
  Clone ID: PAT_TA_12320.pep
RPRGIQSFGFVNFESPDEAALAVQDLNGKKFSDKEWYVGRXAQKKSEREMELKEKFEKNLQEAADKYQNTNLYLKNLDDTVDDEKLRELFAEFGTITSCKVMRDSNGASRGSGFVAFKSADDASRALAEMNNKMVGNKPLYVALAQRKEDRKARLQAQFSQMRPVPMAPTVGPRMQMLPPGVPVGQQMFYGQPPAFINPQPGFGFQQPFMPGMRPGGAPMPNFMMPMVQQGQQPQRPAGRRAGAGGMQQSMQMGQQQMMGRGGGRGYRYPTGRGMPDPAMHGVGGVMTSPYEMGGMPMRDAGASQPVPIGALASALANSPPETQRMMLGENLYPLVDQLEHDQAAKVTGMLLEMDQT

SEQ ID NO: 117903 - protein, 172 aa, Triticum aestivum
  Clone ID: PAT_TA_12321.pep
RPAGRRAGAGGMQQSMQMGQQQMMGRGGGRGYRYPTGRGMPDPAMHGVGGVMTSPYEMGGMPMRDAGASQPVPIGALASALANSPPETQRMMLGENLYPLVDQLEHDQAAKVTGMLLEMDQTEVLHLLESPDALKAKVAEAMEVLRSAQQHTNQSPEQQLASLSLNDGLISS

SEQ ID NO: 117904 - protein, 715 aa, Triticum aestivum
  unsure (1)..(715): unsure at all Xaa locations
  Clone ID: PAT_TA_12322.pep
RPGRRCEPGPQLLSFSKPKHNKKSKKSTKSKKKYSSFGAGRAGGAVGVAARRRGRAGGCGGGAAGPWSLPAPWLYGGDRDWTCRSPKSSDVFAPSSAGASAGASTGVSPPKSLASTKTHRHTPHDASRXALDLPNYTPIYERXITIMYPNLDPSLHNYYTSKKFYKXMKIKVSTDTCFMYVMFFXMFLSYIAATGPDGLSGGXGFVGXERVMVLSAKIKGMIMNVKDGERGNVGSFVREQESDTRQCQVKINNVYIKNLAETPTEDDLKEIFGKFGAITSVVVMRDGDGRSKCFGFVNFESPDEAALAVQDLNGKKFSDKEWYVGRAQKKSEREMELKEKFEKNLQEAADKYQNTNLYLKNLDDTVDDEKLRELFAEFGXTITSCKVMRDSNGASRGSGFVAFKSADDASRALAEMNNAKMSNKPLYVALAQRKLAQRKXRLQAQFSQMRPVPMAQTVGLRLHMLPSANVVXPGVAVGQQTFYGQPPAFIWLQPAFGFQQPFMPGMRPDGDPMHDFVMPIVQQXQEPQGRAGGRAGAGQMHQYMQMGQDGMMGRGGCRPYRDPTGPXMPDLAVHGVAGDMTXPGCERGGTGMSEPVPIGPLASGLVNSPXPTQPQRRDECWXPIACQLXTTARPRVTGKRQELDHGEGLRLLDLPDSLRPKLAEAXEAMRSAQQHXTNQSTEQQPASLIWSSLGLIYAYISSSTIFPPVSNFINV

SEQ ID NO: 117905 - protein, 228 aa, Triticum aestivum
  unsure (1)..(228): unsure at all Xaa locations
  Clone ID: PAT_TA_12323.pep
MERRGTAALACTFRSSSSPSPVSHCSPLLRPRRRPPAAAGAPHFLPPAGRRFSYCSQNRFLDTSKGLKRHPLTTFSPFGRPSVSLNDADLVKDKMLIDCGEEQDCVLDGIVALXGKFDALHIGHRELAMHASKSGNPFLLSFVGMAEVLGWEYRPPIVAHCDRKRVLLSWAPYCRNVVPLEYQVEFAKVRYLTPRQFVERLSTDLRIKGVVAGENYRFGYKASGDAAE

SEQ ID NO: 117906 - protein, 589 aa, Triticum aestivum
  unsure (1)..(589): unsure at all Xaa locations
  Clone ID: PAT_TA_12324.pep
MIGRHPLNTQTSPLPPLPPPPLGKMAAAALANGDVRAGGGGAVPRPTNPMVTPLLTDLYQFSMAYAYWKAGKHLDRAVFDLYFRKSPFAGEFTVFGGLEECIRFIANFKFKEEEINFLRTALPTCEDGFFEYLSSIDCSDVEVYAIPEGSAVLPKAPLMIIEGPMAVVHLVXNDRERAVYVPPFGSTNAAXRHRLCXAGKPKNLXLEFGLRRAQGPDWXGSSASRYSYMGGFDATSNVAAGRLFGIPIRGTHSHAFVSSFLGLDEIIDKALSSSDGSNKCENFVSLVQNWLVKIQDASSLRGSFGETNQSELAAFTSYALAFPNSFLALVDTYDVMRSGVPNFCAVALALNDMGYKAVGIRLDSGDLAYLSIETRKFFCAIEKEFGVVGFGKTNITASNDLNEETIDALNKQGHEVDSFGIGTYLVTCYAQAALGCVFKLVEINKQPRIKLSEDVTKVSIPCKKRCYRLYGKEGYPLVDIMTGQDEPSPKVGERILCRHPFIESKRAHVVPQHVEELLKCYWPGHSSVQREELPSLNENRSRCMRQLERMRPDHLRKLNPTPYKVSVSAQLYDFIHFLWLNEAPVGELQ

SEQ ID NO: 117907 - protein, 256 aa, Triticum aestivum
  Clone ID: PAT_TA_12325.pep
GYYRALVRSDLQRRERKHQLLFVSEAGGIFSPGNDFGWLYYTWVDVGTPNTSFMVALDTGGALLWLPSVCLGCAPLAGAPVTLDRDLGIYKPAESTTSRHLPCSHELCSSGSGCSSPKQPCPYSTDYLQENTTSSGLLIEDVLHLNSRESHAPVKASVIIGCGRKQSGSYLDGIAPDGLLGLGMADISVPSFLARAGLVRNSFSMCFKEYSGRIFFGDQGVSTQQSTPFVPLYGKFQTYAVNVDKSCVGHKCFEGT

SEQ ID NO: 117908 - protein, 411 aa, Triticum aestivum
  Clone ID: PAT_TA_12326.pep
RPDPSRAAAVGQDMINSLANEEDKEKYGRYLRRSYIEDNRKTKWCPAPGCEYAVEFVVGSGSYDVNCNCSYGFCWNCTEEAHRPVDCATVSKWILKNSAESENMNWILANSKPCPKCKRPIEKNQGCMHITCTPPCKFEFCWLCLGSWSEHGERTGGFYACNRYEAARQEGAYDESERRREMAKNSLERYTHYYERWAANQSSRQKALGDLQSLQNDKLEKLSDIQSQPESQLKFIIEAWLQIVECRRVLKWTYAYGYYLPEHEHAKRQFFEYLQGEAESGLERLHQCAEKELQIYLEAESPSKDFNDFRTKLAGLTSVTRNYFENLVRALETGLNDVGPSTSQSTGIKNTTSKSLGGKSKTGKNRASAAGSKSGSSSRGVDDSNIWTCDQCTYVNPRSAKACQACDHQHR

SEQ ID NO: 117909 - protein, 125 aa, Triticum aestivum
  unsure (1)..(125): unsure at all Xaa locations
  Clone ID: PAT_TA_12327.pep
MERAPRERGFPTDPKEYKLYEEVGEGVSATVYRALCVPLNTFVAIKVLDLEKCSSDLDGIRREVQTMSLIDHPNLLRACCSFANDHQLWVVMPFMAAGSALHIIKTNFPXGFEEASLQTFVGSSK

SEQ ID NO: 117910 - protein, 216 aa, Triticum aestivum
  Clone ID: PAT_TA_12328.pep
SSLLSSARGWASAAFVYHNFLSKEECEYLIGLAKPRMVKSTVVDSETGKSKDSRVRTSSGMFLQRGRDKVIRATARGIADYTFIPAEHGEGLQVLHYEVGQKYEPHFDYFLDEFNTKNGGQRMATILMYLSDVEEGGETIFPDANVNSSSLPWYNELSECARKGLAVKPKMGDALLFWSMKPDATLDPLSLHGGCPVIKGNKWSSTKWLHVHEYKA

SEQ ID NO: 117911 - protein, 106 aa, Triticum aestivum
  Clone ID: PAT_TA_12329.pep
MAGFLLCFASGGGGFGTDFTNKKRIKSRKRAKDVVQDPSKVASADSKNQGQWAPELGIGRENKSGKTVMDKKFLEKVEAVRRSALDKKKVEENKTYQAIDYDAPIE

SEQ ID NO: 117912 - protein, 212 aa, Triticum aestivum
  Clone ID: PAT_TA_12330.pep
FTGSSSSRWGLYEGLTWSVEEKILVWHIATNIYIYSMMSSSSEEKEEHEVSDLAEAVQALSNYMLYLLASRPYMLGPTANHNSYIEVCFGLIARGPRDAAATPYSSPEEVARFLKTYGDTGRGSRFPLLRVDHTTQGHLVSMLDKGCELGAKIVQDDAVDTLELLAQVWVETLCYAGQRCSALCHAKQLSDGGELITVAAILVEYFKRGKFR

SEQ ID NO: 117913 - protein, 204 aa, Triticum aestivum
  unsure (1)..(204): unsure at all Xaa locations
  Clone ID: PAT_TA_12331.pep
VKHWCKNMGIKLDYASVYHPQTNGQVERANGLIMSGIKPRLVRSLTESNTRGIEELDSVLWGLRTTPNHTTGFTPFFMVYGAEAVLPSDIIHDSPRVRMYEEREAELDRQDSLDALEEERDVAKARSAFYQXQARRYQSTEVRAKTYKFGELVLCLPDKKKDKLKPKWEGPFIIDQVXTVGAYRLLASDNXLEPNPWNTAXLRR

SEQ ID NO: 117914 - protein, 163 aa, Triticum aestivum
  unsure (1)..(163): unsure at all Xaa locations
  Clone ID: PAT_TA_12332.pep
FGTRVTMLTFILSVIIAVVILLFRDKISYIYTGGEDVSAAVSKLTPLLALTLVLNGIQPVLSGVAVGCGWQAFVAYSASTLTSALRXLRLPCMAYSYSIDAIFCYMREVIDTKSQGLWSGMIGGTLIQSMILMWVIFRTDWNKEVHMGSPAMSFTETEGYIVV

SEQ ID NO: 117915 - protein, 383 aa, Triticum aestivum
  unsure (1)..(383): unsure at all Xaa locations
  Clone ID: PAT_TA_12333.pep
PARPRQRRGRRSPPPSPRRVRPARCAGFVGPAVESASPGARAPSLPSSRGRTTSSLVMGGVLTGMFLDTGGWGPFAGAAPVTPSLQKYNRVIDAWGGADLFRPALHLFGMFSNKLRRPRPTERLKDIWXITKSVAPPMLGARRRLVEHINRSSKSLYVAALDMLQFHWWDYANPGYLVILKHITYLKEEGKLWTVALTNFDTDTLQIILENGIPIVSNQVQHSIVDMRPQKKMAELCDLTGVKLITYGTVMGGLLSEKFLDTNINIPFAGPPLNTPSLQKYKRMIDAWGGWSLFQALLQTLKKVSLKHGVPISTVAVRYILNQTSVAGSMVGVRLGLSEHIRDTNAILSLLLDEEDMGNITEASQRGRNLMEVIGDCGDEYRA

SEQ ID NO: 117916 - protein, 53 aa, Triticum aestivum
  Clone ID: PAT_TA_12334.pep
AGPSGPRSGDRRTQSNLSLDASSIFNTTISWYSHHDAGLRKRACIRVRSTLLS

SEQ ID NO: 117917 - protein, 143 aa, Triticum aestivum
  Clone ID: PAT_TA_12335.pep
SAAQLPPMTCALPATPPSHRSILGFPHRTPSRRPLLHQRRHPAPQMHLHQRMAASINIDSFTVGCSAAGGFAACLVVSVSDAIAGGLHSPTVAAQLGLRRHRSIQPLLPLSDPPASTPHRIRPSPCQRHLPPHATSCSHLVDY

SEQ ID NO: 117918 - protein, 446 aa, Triticum aestivum
  unsure (1)..(446): unsure at all Xaa locations
  Clone ID: PAT_TA_12336.pep
RLNELFSPAICAHYSRCARPAMSSPAACWPRVVAPSVFCPLLVNGRPVLPGLLALDIIAKEVXLGWVQLMPVYAAELVENVRTFLXERPHERCRASYMEAVLEKQSYILLSRSDVESLMCLDPANASLQNSFGQLDNDIPDAGIEVEIELSDLLLDMCPIKQENLIHDDQKLILLASLSDSLEYLADSVERLGESFISPSTISENKSDIHQSHHTRTTSAIPKSLASLANEYRRLATDCVRVLRLEMQLETIYHMQEMTKREYVEDQDAEDPDDFIISLTTQIARRDEEMAPYIAESKRNYVFGGISSVAANASIKALALMKSINLLGVQQICRNSIALEQALAAIPSIDSEAVQQRLDRVRTFYELLNLPFESLLGFVAEQEIFFFSKKLIGLKDNSTCRAEPNECGPPALPHLGSLIELGQASLAQTWRRAPPSLFLARLSAWL

SEQ ID NO: 117919 - protein, 176 aa, Triticum aestivum
  Clone ID: PAT_TA_12337.pep
MSSRLCVKNLPKGADEKRLREVFSRKGEVTDAKVIRTKDGKSRHLAFIGFRTNEEAAEALNYFNNTYIDTSKITCEIARKIGDPDAPRPWSRHSLKKPEYNAKDKSNSGDVNAPLKSSKSQGKSADVGASKGTIANDPKFQEFLQVMQPRSKAKMWANDTTGTLDDAAKDSTVATG

SEQ ID NO: 117920 - protein, 289 aa, Triticum aestivum
  Clone ID: PAT_TA_12338.pep
ENPAQIPHLPFLLPFPPQSPPRNPRPPRLAAMGSAASPPRALDAATQEDLKRVSAHRAVDMVESGMTLGLGTGSTAAHALDRLGDLLRTGALRAVAGVPTSLKTEAHAARVGIPMLALADAAEIHLSIDGADEVDPDLNLVKGRGGSLLREKMIEGAGARFVVIVDESKLVPRLGCTGSVPVEVVPFGSAYTLGLIRKVFDKLPGFHARLRTVKSKAGDGQEELFLTDNGNHIVEMFFEDGIHGNLRDISDSLLRITGVVEHGMFLGMATKVIVAKKDGTVAVLSKKVA

SEQ ID NO: 117921 - protein, 93 aa, Triticum aestivum
  Clone ID: PAT_TA_12339.pep
MFVQNIGLDSLVYPIEQICDDSGEDPTCSRSVSGNSVQDHIHYLGISMHSESRGSCRIVTDDNMLRYKVGTVDGAIVFSKQPGLSVDQLLSAQ

SEQ ID NO: 117922 - protein, 290 aa, Triticum aestivum
  Clone ID: PAT_TA_12340.pep
MAPNETAQKLLLQGAQNAWDMLSEEQSQKHITTGSGDLNGILGGGIHCKEVTEIGGVPGIGKTQLGIQLAINVQIPVDYGGLGGKAIYIDTEGSFMVERVYQIAEGCISDIMEYFPCHHDKSSSGQENLQPESFLAGIYYFRICSYTEQIAVINYLEKFLGEHKDVRIVIIDSVTFHFRQDFDDLALRTRVLSGLSLKLMKLSKSYNLAVVLLNRLATDAAAGSWRWTRALGGCGSLSCTTRLVLYWKGNERCAYLDKSPSLPVASTPYAVTSKGVRDAGSSSCKRVRVM

SEQ ID NO: 117923 - protein, 159 aa, Triticum aestivum
  unsure (1)..(159): unsure at all Xaa locations
  Clone ID: PAT_TA_12341.pep
FQADVPCEAPVDFDTRELYFLIAHFLSHGPXKRTAGELCSELQEHHLLPRRYHAWYSRGGFHSGEENDDGVSLPLDYLKLVERYPHIGKDHLVKLLKQLMVGSCHPESLIGAVSPNAADVPTLLGSNSFSLLASNRGRQEKENHRLPTYLRWPHIQADQ

SEQ ID NO: 117924 - protein, 93 aa, Triticum aestivum
  Clone ID: PAT_TA_12342.pep
ISTCLLIDEVETVSSLAHCLNIFGHIIVLLLASSSVHLCESNCLKWKKEANPTNPKLRKDQRQRQQLQIGQTRKSEGRLGRRGGGRTRVRLRL

SEQ ID NO: 117925 - protein, 339 aa, Triticum aestivum
  unsure (1)..(339): unsure at all Xaa locations
  Clone ID: PAT_TA_12343.pep
MGQGVVEIQARVLHMTLKLYKKRSCFVQIVDKTVEXATCKFKTTTPKRYSVPPDIGCYHYFGXCEFTCLHAKHSVQRLQDMYLQNKFMVMTTVSTLGVIHDYGLIPAFCSKETYASMEGSELRVVRVDASRPSXKQLINKVPSTDAAVEVPVLKDTPNVQNEVPAMEKKVPAPQEKISAVVPNIPSPPIKDPSPPPVQLESPSYITVTSESPPEQLSPLKEETVTSNXSPLEETLPKETVTVSDRGFFSVQNHQLSHVTEDVQNLKSKLNNLESKLEGAEKMIIKLREESRTTTQERDRLQQEMVFLKKGTPKSQLGFPLLFVVYVALLGTSLGYLLRL

SEQ ID NO: 117926 - protein, 141 aa, Triticum aestivum
  unsure (1)..(141): unsure at all Xaa locations
  Clone ID: PAT_TA_12344.pep
GTPQLAAATPTIXNGRDPPALRPARCPRPRVQHAGLQCRTPPKLLDRGRLPLFRQLPLQRHRGRPPPRVTPGTMTGSASPLDQGFEATSLSYFFLDTDCHCCRPEFAVIGPCAIGHRQQQGEKLPLPSCAFFSLSASFLSF

SEQ ID NO: 117927 - protein, 118 aa, Triticum aestivum
  Clone ID: PAT_TA_12345.pep
GNAMITSEQFKPEGTLCTLRKTFEPNSSSIWPSSFFLRKSSTTEREREEAPCSCCSGRRTNSAFHSSWRTNSSSLLLQLRQRPRLHPPLHELLLRLPAGVRFATTRAAVVMRKRKRAA

SEQ ID NO: 117928 - protein, 84 aa, Triticum aestivum
  Clone ID: PAT_TA_12346.pep
RKNSFPTGHRNTKSSKCFKRLQDTITHTTKCTPISPRMTQLKSHSEIIITQQRSRMFQTSTRYNNTYNKMHTNFPQDDATQVTQ

SEQ ID NO: 117929 - protein, 448 aa, Triticum aestivum
  unsure (1)..(448): unsure at all Xaa locations
  Clone ID: PAT_TA_12347.pep
HASGLMAFSMGETRVVVTADPDVARELLASPAFAXPAXVRXSAYGLMFHRAIGFAPYGAYWRTLRRVSSSHLFSPRQVAASAAQRALIARPLVDAWGPVGGAGVKHVEARRFLKRASLHNVMWSVFGRRYELDEAGSGEAAELKSLVDEGYDLLGQLNWSDHLPWLARFDLQKIRSRCSALVPRVNRFVGRIIDEHRAALNDDDDAVVDFTDVLLSLQGSDKLSDADMIAVLWEMIFRGTDTVAVVIEWVLARLMLHQDVQARVHEELDRVVGPNRAVTESDAASLVFLQAVVKEVLRLHPPGPLLSWARLATSDVHVDGLHVPAGTTAMVNMWAITHDPTVWVKPAEFKPERFLGGSSSDHAAAGAEFSVTGSDLRLAPFGSGRRSCPGKSLAIATVGFWVATLLHEFEWTPPSSDGPGGVDLSEVLRLSCEMAAPLEARLRPRRAV

SEQ ID NO: 117930 - protein, 200 aa, Triticum aestivum
  unsure (1)..(200): unsure at all Xaa locations
  Clone ID: PAT_TA_12348.pep
MSAKASERTYRCSDDSQMAYYNNSVPLAENGRFYMMQNHLDVHYTSSGDGSQKISSSPQVFEAQYCTLESSSANGVYPTQSSTSSHSISPISGSPLSQNDSHSYHTYDSPPTASCVTEIPDFQSKLKELENAILGPELDIASDSPESLLQANHPLKQDNWRQLLGXNTGDLKQVIIACGKGCAGNDMDATELLVSELGQL

SEQ ID NO: 117931 - protein, 118 aa, Triticum aestivum
  unsure (1)..(118): unsure at all Xaa locations
  Clone ID: PAT_TA_12349.pep
AAFVSHCGWNSTLXSVGCGVPMLAWPLYAEQRMNAVLLEEKLGMALRVPPAREDGRCLVTRHEIAKAVKELVEGGQKVRRRVEDLQKAAARAWLPEGPSRRALEQVAVKWKAALGTAK

SEQ ID NO: 117932 - protein, 221 aa, Triticum aestivum
  Clone ID: PAT_TA_12350.pep
LPLPVHTFLHAREDLLRSPPLPWPSRSPASTEPNPAPEPLLPQPHEAPMCPHTPTGNEAPRMSGRVPLLQTGGEATPRSASPSPASSYTPRRRSLARLMQTVAGTFASCLTQSLLIQQQQQKEEAAAPAAPCRFQPTTAPSAHAPLGDPLQFNSLAAQYREDSLEALPQILRPQPCLQGSCGRRREARSSGCGAIPHCRFPSRSSSTGASLNSKRMSKQYF

SEQ ID NO: 117933 - protein, 86 aa, Triticum aestivum
  unsure (1)..(86): unsure at all Xaa locations
  Clone ID: PAT_TA_12351.pep
AAAPKLGKRVCVTAPVRVYHVPKAPXLDLRGMEGVVKQYVGVWKGKRITANRPFRVEFELKLDGQDKPVRFFAHLREDEFEFVRDE

SEQ ID NO: 117934 - protein, 172 aa, Triticum aestivum
  Clone ID: PAT_TA_12352.pep
MPQHLKEEIVPEELVLLERTLPDGSTEQILFSSAGDIDVYDLQALCDKVGWPRRPLTKIAASLRNSYLVATLHSITRSSETEGEERKQLIGMARATSDHAFNATIWDVLVDPSYQGQGLGKTLMEKVIRTLLQRDISNITLFADSKVVDFYKNMGFEADPQGIKGMFWYPRV

SEQ ID NO: 117935 - protein, 237 aa, Triticum aestivum
  Clone ID: PAT_TA_12353.pep
MPADQSCLDGKRLSCSSVAVPTTIFQEDAVEPKTGIKFPAFLEDDSCPATTVLVGVGFKGMKIMRVKNLNLYAFGLYMQPNTICEKLGPKYASVPTTNLKDDPDFYNYLLRENLHIRLRLVVNYKGLSIGAVRDVFEKSLGLRLRKINPNTDYHCLKTFASYFTKDIPIPAGTKIDFCQTSDGQLITEIDGRQISAVQSKDLCRAFFDMYIGDSPVSLEAKREVARNVAGLMGRCGG

SEQ ID NO: 117936 - protein, 134 aa, Triticum aestivum
  unsure (1)..(134): unsure at all Xaa locations
  Clone ID: PAT_TA_12354.pep
APNQASNGRGWGPPSSTQASMASSEAPGGRGGEGARPALITRRSRASTGGDACSIKERGREEKSGMKPYWSGSVYIVLIFFCVTLDSTTRWYKFQFSGRGAISNWPAKPAYSLNFYLLYYSRCVFKKKKKTXXK

SEQ ID NO: 117937 - protein, 84 aa, Triticum aestivum
  Clone ID: PAT_TA_12355.pep
MKGRWAGWRGPGMKGGAKVVVMPHKHDIVFIAKAKEDALCTKNMVAGESVYSEKSYLAWRWYYYPILFYYLYALHCPWKYLHAK

SEQ ID NO: 117938 - protein, 96 aa, Triticum aestivum
  Clone ID: PAT_TA_12356.pep
MGTGSSILGADADWGETSLGDMPESCVAAVLLNLDPPEICQVACLNRAFRGAASADCVWAGKLPANYRYLAALAAAADDEGDGDGDGNVKPCSPIS

SEQ ID NO: 117939 - protein, 129 aa, Triticum aestivum
  Clone ID: PAT_TA_12357.pep
QVAQMKSQGILEQRPVTLRRTLSLLKPWAFTCRHESPLLIGRCRPSKRVSRWEACEQTAALAVREACEQTATQAHQEASPLTRLRRPRSSQLLPLLMLPVPQFKINPALPGVATIFSLPLQFLRRLIVA

SEQ ID NO: 117940 - protein, 274 aa, Triticum aestivum
  Clone ID: PAT_TA_12358.pep
GPVEAAKNAAARYREAVGLQVEAFWRRNYLLLVGAGGVIVCIALWRVMFGIASTFVGLSEGMAKYGFLALATAMVAFAGMYARARFTINPDKVYRIAMTKLNTSAAILEVMGAPLAGTDVRAYVMSGGGSKLKDFKFRVGGKRCFLIFPIKGSERKGLVSVEVKKKKGQYDMKLLAVDIPMATGPDQRLFLVGDEQEYKVGGGLISELRDPIVKAMAAEKEFDYLDEREDAEDERREREEAEEEAAEALRREEDRLREEAKERQRREAENLEKG

SEQ ID NO: 117941 - protein, 68 aa, Triticum aestivum
  unsure (1)..(68): unsure at all Xaa locations
  Clone ID: PAT_TA_12359.pep
LSSSSHKXGSFNSDLSSPIRENSSTDGVLDDLQSRIKRLERWNTINMVLWTILLSALVGYSLYQKRRH

SEQ ID NO: 117942 - protein, 159 aa, Triticum aestivum
  unsure (1)..(159): unsure at all Xaa locations
  Clone ID: PAT_TA_12360.pep
LQDNFYCWERREPPRRLRRCREHPGSRCGRARPRLRRSNKKRSGATSTMESRNELANREPVLTSHRAAGESTASTMDCMGRPLTFSSSSADYLIQTVATVGDCTRRSDAPVETGDDPSSGQHTGAWGHAIRAWTTHAAVCSAAMTQSXGKGRGEGRICS

SEQ ID NO: 117943 - protein, 129 aa, Triticum aestivum
  Clone ID: PAT_TA_12361.pep
MRWSLWMRRGGGDEVVNEEDGEREPERIVSGGRRTGRQMARRSGLLAKQVISVSSARSLGFVSQLWVDASSWVVALVEVRPSLLSGDPDKFLFQVFYLVGGGVLVLGESVVLIGFCLVGLLGFGGHSVG

SEQ ID NO: 117944 - protein, 163 aa, Triticum aestivum
  unsure (1)..(163): unsure at all Xaa locations
  Clone ID: PAT_TA_12362.pep
LTXGLALXFAVVAILAALVASSPTKGWSGRSLSLLDPMDIILYIPIIASVSEHQPPTWPSYFMAINVLAFLVPAGIISCFLPLSDASSFLVLYLVTSVYFSGVMVRLMLVLAPAVCILSGIALSEAFNVLTRSMKFQRPISDDTLPTAGDSTPGSSSTAITTS

SEQ ID NO: 117945 - protein, 384 aa, Triticum aestivum
  unsure (1)..(384): unsure at all Xaa locations
  Clone ID: PAT_TA_12363.pep
CSHTSPFGAAENPAERGKERDVGDGAAKRAASAAAVLLALTGLFLLVLSPADAATAAVEGGELRMKQSDGGYSYNSTLAHILVEYASAVYTSDLTSLLKWTCPRCEGHTKGFQMIEIIVDVEKCLQAFVGVAPDPRSIIIAFRGTQEHSASNWIEDLFWKQLDVTYPGMPDAMVHHGFYSAYYNTTLRHEILKSVQWAWKTYGRLPINVVGHSMXGALASFCALDLSVKWGSHKVQLITFGQPRVGNPAFAEYFNEQVPRTIRVTHENDIVPHLPPYFYYLGEWTYHHFAREVWLRETIVGNVVTRNETVCDCSGEDPTCSRSVYGRSVADHLEYYGVNLHADSRGTCQFVIGTSNSAYGDILQVDGAIILSRYPQERYPVESI

SEQ ID NO: 117946 - protein, 64 aa, Triticum aestivum
  unsure (1)..(64): unsure at all Xaa locations
  Clone ID: PAT_TA_12364.pep
VSCSXRFRSQLQFWINVLDWLNLDAYGDYMFCLFMFIISLYLELAKLRINWKRVRCFNACSKKK

SEQ ID NO: 117947 - protein, 136 aa, Triticum aestivum
  Clone ID: PAT_TA_12365.pep
GPSVKSAAPHPLPEAAVLAGGPTCSSSDFRLGGYGIARIQARGKALLGLPMLAAATPAGAVFLLGGAAMAFIYAPLQAQGKPLVRFFGSDGDGVTTSFSFLKAPSLIARGVPMVGSGDVGCCGGFGLPLYFGACWV

SEQ ID NO: 117948 - protein, 257 aa, Triticum aestivum
  unsure (1)..(257): unsure at all Xaa locations
  Clone ID: PAT_TA_12366.pep
PVRNFRVDPRVRHPGIEKLMDILKSILTYGDISPNMISSASDKAHLRLAAAKAVLRLSRQWDHKVPVDVFYLTLRISQDDFPQMRKLFLSKVHQYIKXRALDAKYACAFLIGIDDYHTPQYEEFQHNLIEVSQICQQVKMRQLSVQADVNLLTAYPEYIIPYLVHVLARDPSCPNIDEYEDVKAFAPIYWPLHLLLSTLLGEEGLQYSVPGMKKESFMTTLSIFRSIKCSKDAVDANKTKTLHAICDLGILIAKRLC

SEQ ID NO: 117949 - protein, 173 aa, Triticum aestivum
  Clone ID: PAT_TA_12367.pep
VGADEKEIIIQDEHGRDANCQQNMQNRTQSCNNWICSLLDSGYMLSSEFELMESTTAPQWESQHAPLASSSPVARTIMHPFNKASYTNQKLLYAPLIFISPFPMIVYTVYMPKTSFLQYRNIKLKKTINRTSYHLFGKQPVLELQLDNTKVELETTVTHAANCYLLTYHIKEK

SEQ ID NO: 117950 - protein, 269 aa, Triticum aestivum
  unsure (1)..(269): unsure at all Xaa locations
  Clone ID: PAT_TA_12368.pep
DPRGRTETELAAAAHSRAVGPPASAAPMDSSSQPQPQSPPAGGDPSEDGAAAELPRLTVTLVEQMKVEARVADIYRVLFDAAPNAKSVMLELWRDQHVEYLTKGLRHLAPSFHVLDANRPWLCYWMVHGLAVLDETLDDDLENDIVDFLSRCQDKXGGYGGGPGQLPHLATSYAAVNTLVTIGSERALSSIKRDNLYKFMLLMKDKSGAFRMHXXGGEIDVRACYTAISVASLVNILDDELAKGVGNYIASCQTYEGGIAGEPSAEAHG

SEQ ID NO: 117951 - protein, 123 aa, Triticum aestivum
  Clone ID: PAT_TA_12369.pep
ASHPEFSSMRQQDALDFFLHLVDKVDQANPGSHELNPFTGFKFIIEERVQCPSGKVSYNKRCDNFLSLSIPLHEATNKEQLEVFHEKKAAMDLDGKEVSNEEIVRPRVPLEACLARPRTRGRE

SEQ ID NO: 117952 - protein, 313 aa, Triticum aestivum
  unsure (1)..(313): unsure at all Xaa locations
  Clone ID: PAT_TA_12370.pep
RSPAPPSPAAARGHGSPPPVPAHLAHPGRKFAMGQGWVPTNPDVSLDVPDMIDIAHIPSNGVQPGEXELLPEGASCGNKAEPARPVAXRDSVARLATXGFNFFACHKAAVFTSNARLEEAMNWLLSHTQDPDINEPISXQDPMPAEDTIDEASLQTLVSFGFPEDVSRMALKASGGNIERATEWVFRXTPEASSSVSADSSTNNVKDDDSHISDGSGRYKLMAFVSHMGTSTHCGHYVPNILKDGRLAILLVIKIAASVGLTLDMRHVGCFKRMISKCRRWRCSLCLPIIPELGGCAKSYWTNLPCFDHFVTS

SEQ ID NO: 117953 - protein, 136 aa, Triticum aestivum
  Clone ID: PAT_TA_12371.pep
MSCRRFVNMVVDTVIGDRHAYALHCINMSGLFYPTKPTTTQLGGADAKDGNTVESSELPRPAMSFYPCRNNGAPVGSVEFMPVSRDKNDILTIDQDGRTLMYSVASRAFHILPPLQTPIWEPTSVIAGGKLYVMKS

SEQ ID NO: 117954 - protein, 199 aa, Triticum aestivum
  Clone ID: PAT_TA_12372.pep
WITEIATDGVHLVGHTKGYIQVLVIAPDSMLGTSADAKITSVGRWSLFGEVIEGTVAIKEAALEQNSAEVQVKNSPNRVEEAACSTNTCDSCACSGAESVAQQCTPQRCEGPSDAPTNCGDATRQETPQSTLVRRNVEGAGKTSGSDTEKSRGDDQQVNVITRGAVNIDRILWGGLAVSFATTVAILVLLTCKIFYTSS

SEQ ID NO: 117955 - protein, 315 aa, Triticum aestivum
  unsure (1)..(315): unsure at all Xaa locations
  Clone ID: PAT_TA_12373.pep
NPTTSLVTRDHPLSHTQSPPWPNPSNFQITPRAAFVEMXELNFRSLYLFHTSLGANQTQSTVIDPNASTGLGQTAVNNWAICDSPSPGATVVARAHGLHIYAGNWQNTFSITXEVERFKGSXLRVLGRSVEDGEWAIVGDAGLATMTGVVKKKNFHEKRSDANIVPXLRTLVGPWGGNGGADKDIVEAPGRLESITVSSGTIIDSIKFSYVDQAGQKRTVGPGLGAGSGGKQIVPGPAASVLVVAGSGTFGLYGRDNHNIITSLKFVTNVKTYGPFGQAKGTTFTIPVQKNSSIVGFFRRSGIYLDALGVYVHPL

SEQ ID NO: 117956 - protein, 194 aa, Triticum aestivum
  Clone ID: PAT_TA_12374.pep
MAEIAGDETPPLPSSSGAEESSLLSSPPSPTAISGDEPPPRTRKPGTKRLVLTASVLLSFLVGLPLLLKSTEIHRSPLPSDAIADLSRRLQSHPPSFPCGLHAVFLRSGPGSPVASLADQLERAISTQHHLLPASSTAGSISVSVTVQSGGGCTSSTAAASPWRCGSVTAADSVRGDEVFDELLHSALGGGDGD

SEQ ID NO: 117957 - protein, 66 aa, Triticum aestivum
  Clone ID: PAT_TA_12375.pep
PIIFSKNQTKYQNTVACQADSRHPLRDEAAAKEHARHLFIQRISEIIKHLGLVAWQHHTFSSAALC

SEQ ID NO: 117958 - protein, 91 aa, Triticum aestivum
  unsure (1)..(91): unsure at all Xaa locations
  Clone ID: PAT_TA_12376.pep
WVXKHLGTNIKTWICLINSPEQLHLQSHVPMFVPRILPSRFYINSDPSTFGSRHFMFFMSTTKLSIMVAHAVLWCITRVLRLVLETIISLG

SEQ ID NO: 117959 - protein, 65 aa, Triticum aestivum
  Clone ID: PAT_TA_12377.pep
SARGEDENLHLPVLKDGYELRKQISGQLLTFKENECENNMPAGILEFISCIREIQNKAAQLCSPI

SEQ ID NO: 117960 - protein, 165 aa, Triticum aestivum
  Clone ID: PAT_TA_12378.pep
CRAPPFPPLVLTRPLLVTGAAVVRGVRRARRGRGRVGGARTDARHAVLVVEDYMPPLARFAYASLLFLQRCRCCGGLGLSLFMAGWGGHEASSPDREGCYQVGTTLRSRRGAAAGKTNLVRRPSSPLRPVRAASMAKRTYFFPLPPWPSLPSGSRGTGDLHGARC

SEQ ID NO: 117961 - protein, 206 aa, Triticum aestivum
  Clone ID: PAT_TA_12379.pep
NSSIQGVGNTPNFMPAGPVNAQAPVNYAPSLPPDYGSNNIFLPQQASNGNYQFQPGVSFHQGAFSAFPSAQTPPVHPHNHHTHMNPMGQQSVPPPCNSYGVQPFPNSQSQYTSEEQWRMTSGNFSPDDQHNTWLPGGRSLSCSDGSFMQDGYPRSNIDRSSMNQMSHQHAVLNHLPSGAPHPGHVVPHMLPAKPDIHALNCWRPSG

SEQ ID NO: 117962 - protein, 158 aa, Triticum aestivum
  unsure (1)..(158): unsure at all Xaa locations
  Clone ID: PAT_TA_12380.pep
AGYCWRXSTPLSSLRSGPSSPPQDFPLPASTRSPKIQSRARVLYSGTPFIVGASPAASGSSYSSSTAPAVVGPPRAGRRGGSPPAGSMDTAHPAVAGPGRGRARRALSCSTMMPANAGAPPGRPLRRSASTASARPAAEPPFSTHPVAYRMSASPTPP

SEQ ID NO: 117963 - protein, 125 aa, Triticum aestivum
  Clone ID: PAT_TA_12381.pep
RNSARGGIDKLAHRQVRRILWSGLGLIMSQIGLFFRLTFWELSWDVMEPIAFFTTASGLLVSYTYFLVTSRDPTYQDFMERLFLSRRRKLCAKHRFDMERYLELHRLCKCPLEGHYPHGPKLHNL

SEQ ID NO: 117964 - protein, 280 aa, Triticum aestivum
  Clone ID: PAT_TA_12382.pep
FRANITHSGELKLGDWIFTGEKKKLGDKVLPPSHPAFVRVSGIATEIIRAAARSLAIHDDNKLLEDKLLDGEIWVGDAAPSPKKKARWGAPRQPTTKHLDGFKWEVIVVNNKQVNAMCAPGGKIIVYTGLLDKFSTDAEIAAVLGHEVAHAIARHTAEGLTKNMWILMLTVFLGIFIDEPKMIDKLAKYLLSLPFSRKMEIEADHIGILLLAAAGFDPRIAPKVHEKLGELGGNSSSLKEYMSTHPCSKKRTRLLLDSKVMDKAMALYTEARARKEEIDR

SEQ ID NO: 117965 - protein, 384 aa, Triticum aestivum
  Clone ID: PAT_TA_12383.pep
TRPAGGGGGPTGRAPPTPPPAAPTSTHGRSGKEGHGMEADCPVPWYTRTLVALGIKSHGDPSGPLRHAFTLSQHSSGALKQGTVDPLLGVVVTSEGYLSRSEFERINNYLECVLNEVKSALGSSAEDVEDEYGCQDTVPPVTQESSSGPGLKTISAIVLGAASRNACESPQISQGTSVRGEIMPNNAEHVQVIQQSTREITPFIHDAARRNLIAPHCARDLVFKIDELGKCTSRAVSRNGTRIFTLNGLKKRLKLPDFSSLPDKIIAFGGSFHSVITITGAAYRVSKSDGPGYFHDVGKEALELIRDPFYLQNHVWNSGRKSSLICGSEFTTSQKLVKKLMLSFKNDGSFMCFKASVIDPLEDVPVNDPEHDVAVNDIPDMEDP

SEQ ID NO: 117966 - protein, 176 aa, Triticum aestivum
  Clone ID: PAT_TA_12384.pep
GLLVHTSIIERLKETETTDEVSSVLSSIVPTKLFVHPHLLCFPCVPNKLIPSSLNLRNFTDEHFAFRLVESYAEETQRRFAKLPLYGVVSPRSTHTLTSPPLVRVVASFPWVPECRTLMVALMPLYCSEVSGDKCFVVTRVNGNMVLLALGVALATSPLRDGSSDLLPYETFSCFA

SEQ ID NO: 117967 - protein, 169 aa, Triticum aestivum
  unsure (1)..(169): unsure at all Xaa locations
  Clone ID: PAT_TA_12385.pep
EARLQXVRXGLDKAXIYSIALSPNVQWLAVSSDKGTVHIFSLKVRVAGEDSSNDQRTLEAPRMDHQNSSTSMDPLIQTNTGSNASSSLSFMKGILPKYFSSEWSFAQFHLPEVTRYIVAFGAQNTVMMVGLDGSFYRCIFDQVSGGQMTQKEYSRFLKTDYPPLRTLTA

SEQ ID NO: 117968 - protein, 92 aa, Triticum aestivum
  Clone ID: PAT_TA_12386.pep
SSQNRLAGIHVIFRSITQGLIFFLSPLILCLLFDVLLADWSCCQNSGICVLFRLSIRLCGLFCSIFPELIVHFPVMCRSAGSMQDHLVRQFS

SEQ ID NO: 117969 - protein, 95 aa, Triticum aestivum
  Clone ID: PAT_TA_12387.pep
MMAFGPASTAVLPPPDDHVNTVSVTFVLEKKCAFGQRFLVLADDPELGRWEPHHAHALDLHTVAGRNPSAWKLLIRLAVVSTSQKNQKGHESLQH

SEQ ID NO: 117970 - protein, 155 aa, Triticum aestivum
  Clone ID: PAT_TA_12388.pep
EEFGTRRIGSPRKPPATATVGPGGRARRAPALLDALGTLVHGVIFAAAPAFLPRRCAPERGRPLQHVDARVTTFVALLQRPPRWEQRCSPATTDTSFPRSPRLPASDGRRQPPQWARPTSTTTRSATTVTTMAVFHGHPLPASLSDQSSRDSTRA

SEQ ID NO: 117971 - protein, 66 aa, Triticum aestivum
  Clone ID: PAT_TA_12389.pep
EEFGTRDKLELPTKKEAYLRRVSACLATDGIVINMVVGGEVALLRSLEETSGFVIAEMPIHVSEIL
